United States Patent 7,868,149 (PLANT GENOME SEQUENCE AND USES THEREOF) - sequence listing, part 86

SEQ ID NO: 45334 - DNA, 6368 bp, Oryza sativa
gttatcaaaaactaggaggctcttcaagcacttgtgcttttctatagcaggtatttcttctacatcattgctgatacataagtggcgtagatttggtaaggctttgctatattccatgttcatgaatatggagtgatcctttgtcaaaaattgaccaagtgacctcaatagatcatgcattgttgactcgcctttgtctacaaactctggtcgtggctgcagaagattccttctgattagctcatggtagtactcttcagcaacctcatgtattgagtacccatgcacttccgtcacgaaaccttcagcaacccaccagtaagcgacagcatcacgacgtatcacaaaatttgacggcaacaaagcacaccagagaaagcattgtttaagttcagggggtaagttgctgtagcttaagtacagagggcctcctagttctctgggaagtccatgaatggaccacttgctatctcggatactctcccattctgcccttgttcttttagtagatagaacacctgcaacaactttgatggcaagaggaaggccatcacactttttgacaatttgatatccaacaccactgaattctctgctttgctcgtatggccctaatgacatcttcatcagcagttctaggccatcgcaatcattcattttgtttaccttgtgggtataagttgcatgcatttcaaccaaaacatccaggtttcttgaggtcacaaggatatgagaattcaaacctctcaagaaaggcaaacgaagaagatcaatccatacatcagatttccaaacatcatccagcacaagaaaaacactcttccctctaatagtgtccactagaagcggtagaagctcagtcttagtctccagctgatcacaaattcctccagccattctgattgcctgttttaacaaactggtctctgtgtaattctgagaaatgcacaaccatatatgaacttggaatttctcccttatcctctgttcattgtatatcttttgagctaatgttgtcttaccgatgcctcccatcccctggatcccaaaaacagttgacctgctttcattgtagttactactaacaatcattttgacgatgtcatcaatagcccttctgatatcttctccaaccacctcaagttcatctacaggagatgtctgacttctgtcaacaattgttatctggatttgttgcccgttggttctctccaagccaaacatctctttgttcattttaatttcttcaaacttttcatttatattatcaattcttttggcaatcatgtgatcaaatgaaaactttgcaaagctagagaacaagggctgattgcaacataccggccttggtggcagcaagagcttctgtgaatgaaccatgaaaagatctacgatgtcatcgacatcaaacataacatctctcatgttcttccaccatgaatctatccctggatcctccatggccagagcctcagcatcctcatgaacagcgttgaagaattccagatttttcttcaggctctcaataccccttttcacacttaatgtcatgataacctcatcctcaataagttgacccagcttttccaagaatttccaagcgagagcatccaaaactgtgcccatagtgctagaacctacggattcccactggatctctcctatgggagatgcttgaaactgcagatcccagaagagatatctcacagagctgctgagtgccgatcacttaaatacggaagatggaaagagatattgaagcagtgtggctaaaacctgatgagaacagagagggcaatgcagattgcagaagagagctgttatagattctcctccctttcttgccaccaactgcctttgtcacaatggacattgacattctctattgcaaaacgtctgaaaaacctgaaaaaaaattaaaacagtatgaaagcactttttgaggcaaaatctacccacaaagatttttgtattcaaatctaaatgtttcaacgatgatgcaatgtgaaaaagggcaagtagtgttacaaaattgcaaggggattcaagttgaaagctcttccaggctgtgtattcttttcctttcatccccttgacaataataatttgattttattgcagcaaaggagccacttggtgctttactttcttttcctgtttaccacctaagaagcctggaagcactggagcagagttctctttttttcaggaatatgcaacaaaaaaaatatatttatattggcattaaggttgggtaaaacaaggttcagagaaaatgatacattagatcaccagagtgcagacagcagaccgaaggaaaaaatagagtcaaacaggtgctggccggtgctgggcatgcaaccgcacgcaggaatctactgggcatttcgtcaaacagctcatctgcgccccaaccatttgttgcaaagtccaagtttcagagcttagagaaaacatcgaaaggaactcatcccattcgcatcagtcgcgttgcacataatcaagtcagaaaagaaaaaaaatatgatggttgattacctacgcaagaaagagagatgcttctcctagcgaaaccaaagacggcgacaacgacccacaagcaaagataagcagggcctaggtcgaactgagcctggatcaggatcacatcgcataactccagtataaacaaagagcaaattctctgattcatctcgcacgtaacgtaacgtaacgaatggggcgctcggggagagcgatgcgcgaatggcgttcgatgaaatgcccctccaagttcaacaggcgcgtccaggccaatcgattttgttttactttctgaattgggccctgtcgcgaagactgcgacctgaattgggccgtaagcccgtaacctaagctctacgccgaaggaaagcccaaactctaaaaactcctccacccccgcgcggcgggaaaccgctcctccccactccgttcccgcgcacattttttcggcatcccacccgtcgatttttccggcatccaacgtcgtacatccctccacgtcatcgatccgcgccgcgtgccttccaccaatcagggcgcacgtcccctcctctacaaaaccatcttcccccgtctcctttccccacgccgcaatctcgcgaatcccaccgcttccctttcctctcctctcctctccccgggaagaagacagcagcggcatccatggcgcccaaggcagagaagaagccggccgcgaagaagcccgcggaggaggagcccgcggcggagaaggccgagaaggcccccgcggggaagaagcccaaggcggagaagcgtctccccgccggcaaggccgagaagggcagcggcgaggggaagaaggcggggaggaagaaggcgaagaagagcgtcgagacctacaagatctacatcttcaaggtgctcaagcaggttcaccccgacatcggcatctcctccaaggccatgtccatcatgaactccttcatcaatgacatcttcgagaagctcgccggagagtccgccaagctcgcccgctacaacaagaagcccaccatcacctcccgggagatccagacctccgtccgcctcgtcctccccggcgagctcgccaagcacgccgtctctgagggcaccaaggccgtcactaaattcacctccgcttaggcttcacccctgcatctatctattgctattgctaatagttgtagtttgatctgtttgtgttagttttagtgctatcgatgattggaaaatggatgttagatcgttagcttggtagtcagatgtcagtgatctggaacagtagctctgattttaaaccatgtgaatgtgattcctgggtatgtgatgtttgaccgccctgtgcctgctggtcaacgaatgataactagatctaatttttgtggaactatttacatggttgctacttgcattctgttcaactgttgtaaattcctctgtcactcgttggagttttattctctgaagcatgtgtggaattgcctgggcatgcttttgggaaactatagtctgtagtcttatgttatgtttggttgccctgagcttgttggaattaatctatctaattttgcgcaattacatcctgtgagtatgctgttgccatttgcattgtcttgcaaactcctttgtatgccacaggaatttgatttctggagcatggatgtttggagtgtgatactgtgcttattggcccatgtaatttataagtacgagtaggtttcatctaagggcactttctggatggagtccaatatttttttagcctgatggcaattttggtttttgatctttgcgtttgaaacaaaagaagagttgtgtgaattagttagtactatatagtatgacagcttggccatcaccgttctattttagctgataactttgacatctgaagtaagttttgctttaccttagtactgtactgtttcaactttcaaagaagtttaattgaaatagtaactgaaacaccgtaagtattttgcttgctatttcaggatgctgctacactagcctgtttcctataaatttcctttgaatcaaagggggccttatgttccgaaggtctaaggaaggctctctctttgttcttgattagcttgtaagctaactggcaagctgaggtatgcactacactgctgcatcttttatcaaagcttgctgttggagttgttgctctgcaggatatgccatgtgtgaagatgatgaccaaactcttgtggactctagaatcttataatgttatcctttggttctttgtccagtgaggttgtttgaggtgtataatttttttcgaaggttctactgcaagagcatcctgaatttctgttgggcttgtttgcattaaacattccatgctgaattgaagttaactacattctgtttacatctttacagtggcatgcatctaagcttaatgaatattaactacgcaaccttgtgttcctccaattattcctggtacaatcatcaacactgtctacatatgtatcttgcccaacgtttagctcacagtgctatgttcttcatggccgaccatccaagacctgagatattcatctctggttgcatgcatctctgatacagcttctgccaacatcattcgctctctgggttgttgctttgagcatgatatgccgagcctaagaacagacaccaagcactgttgaataattcttgtttttatgctttcatttttaacatctgcaacattttcttcttcatgaagccagattgttggatcagctatgtctaggggttggtgaagaaaagaagctgcaacaaacttgtgcagatccattgaatccctgaaaatgtcatcagtagggctccttccagtaaacatctcaagcaacaatatgcctaagctgtaagtatcgcctgctctggttattgtagacccttccccatactctgcaatgtttgcaatcaaagttagttgtcaaccgtaccctccacatgtaaaacaaatacaaagtgccccagtactccaatccacacccatgagggaggagggggagggattatgggaattaatgtaagaagttcagtttttttttaaaaaaaaaaatctacctggtgcaatataaccaatggaacctctgattccaattgagcttttcgaactttgaagagttttagtactacttttcgggaggattcttgatatgccaaaatctccaaccttagcactcttgtcttctgatagaagaatattactaggtttcagatcacagtgtatgattggtggctggcagtgattgtgaagataatccagtgcatcaaagatatcaacagcaatgttgagtctctgtgaaaggctgagtgtattgctaggagtgagattgcttgacttgggatgaatccaaccatccaagctaccattgggcatgaactcaaaaaccaatgccttgaactcttgaccctgtggaccaatacttgagcaacaagtgatgatctttatgagacaacggtggcgtactcttctcagagcctcacattcagcctcaaagctttttgaagatcctgattgttgaaggtcgaacacttttacagcaacaagtgcactctcatcgtctaaagtacatctaaaaacagaaccatatcttcctttgccaagcaggttggcttctgaaaattcattacttcctcttgataatgcataatatgaaaccctttgatactgttcctcaataaccagggatgttgcttgtctattttgtctttgtttgaacttcctttggtgtaacagaataactacaatagcagaaactaacaccaatattgcacccgttgttggcagagctattgcaagagacttcagatgctggtttctgttcttgcttacattgagaatgggacatgga

SEQ ID NO: 45335 - DNA, 1281 bp, Oryza sativa
  unsure (1)..(1281): unsure at all n locations
tgccacagcgttgtcaaattttgtagagttgctgggattggtcctgaaaaattgttgtgtgctagaaacagctgttgcagattgggaatcctagcaatggtgttggggatcctgccagataacttattcatggttaggttcagtatggtgagcccttttaggttgctcagagattgtggtattcctccttcaaatgagttctcttctagatagagggcttccatcacttcacaatttcctatactgtcaggtatttgtccagatagctggtttccggatagatccattccatttaggttaaccaagctaccaacttctgatggaaggggtcctgacagagaattatatgacaagtccaagaaccacgagagtgactgcagctcaaaaatttctttggggatcgaaccatttagatggttgtatgacaaatctagaacaaacagtttttttagatccccaaggcttggtgggattgggccttccaaattgcagtagaatgcgtatatcctattcaaatttgtaagatttccaacagatgccggtatgaggcctgacaggctggtattgtacagggaaatttcaaccaagtttgttagcttcccgatgctttcaggaatcactccagataatatggaattgaaccccagatcgagaaagctcaagcctaccagattgccaatgtcctcaggtatgctccccgagatattgttgttatctaaattgagcatttgtagcgtcgttgacaggttcccaattggccttggcagctgcccactgaaagagttgttagcgaggacaaattcttgcagctggctgcagtttgacagtgaagtggaaattcccagcccttggtgttatctgcctcaagttgatttcctaccaaatacaaatactgaagatattgcaacctccccaagttgggaggcacaaatccggtgaatttgttgtctgagaggtacagatccgtgagtgttgaaagattggagagagaatgagggatgactcctgtaaaccggttaacatccaatccaaacacttgtataccgggaagcatgcgaccaatgtcagaagggatgctgccatgcagcatgttattgccaacctggagcatcatcagcgacgacaaattgtacagagatagcggaagttcgccggaaaggttgtttgcattgagaaaaagataacgcagacctgcgatatcgccaggctggagggatgagaccnnnnnnnnnnnnnnnnnnnnnnnnnnnnnnnnnnnnnnnnnnnnnnnnnnnnnnnnnn

SEQ ID NO: 45336 - DNA, 14764 bp, Oryza sativa
  unsure (1)..(14764): unsure at all n locations
gcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgcccaagatgaccgagacgacgatgccaaagctaggtgggtgcggcgaggagggcatgagtgctggtggctggtgggtagaacgggtagaggtcgccagagctattgcacctggcgatcacgttcctggtttccaaatccttcacagaaagaccaaacggatcaaactcaatagaggctcaagtgaaagtgtgggaatgattgattgtattccacaagtgtcaagggattacatataggggcagctggggtggcactcaggcccaccgcacgggcccaattacatccacaatcaaggcctaattacattagtctaacatgttcagctgagcagagatttgcttgcactactgttcgccttggtcttcgtcataatgttgtataattatgctgtgtagtggccattctgagtataattcgatgtatacgtgggcattatgctttgagtatggtcactagtcgtttacccatactatgtacagtacaggctatatatcattattgatactgtgaacatactttacgaaaagcagtgactttttgtttcttatatatctgtaaattcgtagcttttgtaagcatacctgattaatagcagattagactacttgattagaaactatttgaagctatttaatctcaagcatggaaccaaagaaatcctgattctctcgtttagttacctggtatccactatccagcactcgtgcaagcaaaccaccactttataagcccagctacgctcctgggcccaatcagcccagtagatatttggatcgtaggcctacttgggctccaccctctgatccgagtgcacggctcagtaaatctgaggcccaatctgtggaaggtcctggttaagtagcccactgcagctcccttctctttaatcactgcggccatcaccacggcatgaaaccagtcacagtttcatgcttccgaactctccacgaaatgtaattaattgaactgaaaattaatgctaccaaggccattcccaacccaagacactagacatagtttccataatctccacatcattaagaaactagcactagacactactcttccaatgcaaacactactattccatacttaaatttaatgatacttgtctaacataatgtcttggatgttgtgtagaaaccatgtctcatgcaagacatggttttcttctcttttttcatttattcacttgccacatcatttttcattctaggtggcagcttatttaatgctatggacaccatcctatttattgcgttgggaatggcctaagcacaatgtactagtataaaacactcgtcgattaaaccggccaataatcgaacaacatgacagccataaaaacagtaaacgtacgtatttgatagtgatacacacacaattaatgtactactataagaattaaggagtactagtacatactccaagacacgacaacgacgcagcaagcgaacaacagaatcgaacatgcgatcgatccaaatggaagaaaagggtacatatatcttcattgatgagaacacaaacagcagcaagctagggacgccggcaatatatattattatcgttggctccgatcatatataggttttgatgcgaccggccattattgggcacaacgaagcttgtgatgagacttaccagagcagcgccgccaccgatagaccgacgacggtggcgagtggcgactagcggcgggatggcggcgtagaggagcttcttcccggcggcacggcggcgggcagccggtttgtcggacacccacactaaagcgccgatcagggtcaccccggcaaggaaggtcactgccagggcgaggttgtagtaggtgttggcggcgaatccacccgtcaccgccggctcgaacgctgcagccaaagcggtggccgtggagacggcggccaggccgagtgttcccaacgccgccgcgatcttcgactcggcggcgccgtcgccggcctccgcttcccggggagcagcggcacccaccagtagtagattatttgcggccattaatgtatctcccttttggtgatctctatatctctcacttcgatgatcgtcctctctttcaaagagagatcagagccgataaaaaaaaaaggaaggattattagagagatcgtcgaggagtgggggactggccggtgacccggtgtacagtgcgagtcttcacttccgtcggagcacaactgcgtaagtatatataaggggctttatgacgtcatatgaattaattcgaatgagatgttggagtaaaaattaaataaatcaaggagggagtggtcgtcgtcatatgagctagctgaggaagccatacgctgggtgcaccgttcacactgtacactgcagggtgcagaaattgtggaaccatatatgtcaggtagaaacgtagggtcaggcgtcagcacgggtacgtaaccctaatttaactgggccccgcatgtcattggcgtgctggaaattcaggggatgacgtctttggtcaggaaatttcattcactaaaaggacactaaaaaggaagctaagctagtgccgcgtgtgcagcttacgtcatccattctgttatgtctcgggtagccaaagaagtggagtacttgtcatctgcgtggagtacttgtcactgtcaacgtggagtactttatcacgcgttacttaacttgtccccactgcagtaatttcctgtttatgatatccaattactcctaatgttgtcgttcatggagtatttacctgtatttttgcacttctcccgcaccctaaattcgccaaaataatttggtttggattgacttttgggttacaaatacacactcacacttaggggtgaaaacggtacggaaacggacggaaacaacctttatcgtttttgttttcatatttttttcggaatcggaatcgaaatcggaaaccccggaaatgaaaacgaaaacgaatattatcgaaaccgaaaacggagcgaaaacgaaccggtgcggatacggtaacgaaaaattatcggaacacagaaacccctcaaactgagcttcacagcaaaatatagtcttctataacttcatataatttgcataacaaatatttaaaaaacttacagcaagacactggtacaaggtatagacttattcagtgctttcactccatcatcagtacatactacatagttcatcaattatcacagaacaacaacacatatcaatccatcaatatttcagtacttagttcaatctcataacacatcactccatcagtattcatcagtcatcacaaaacaaagttcaaatcacaaatctgtatgataaaagaaatcaaatcaacggtttaggctcaagaacaccgtctgtctttagctggacatactagcagtctgtctttattggagtgcttggtgaatggcaatagaacatattaataatacagttctcttctacaaaattaacagaacataatataagcagaagcaggaacacctgctgccactgggctactggctgctgctgcctgcaaggcgaggcgtcgtcggcatcggcggtgtggccagtggccggcgtcatccgcgtcggcggcggcgtcgtcggtcctgtggctgtggccggcatcggcagtgtggtgttgtggccggcgtcggcggtgtggccagtggccggcgtcgtcggcgtcatccgcgtcgacggcgtcatcgtcggtggtggcggcggcgaaaatgagcgagagaggaagggcgacgagacggcgggggcgaggtcgcgactcgcgaggagtcgactagccaaggacggcggccagcggtggcgtgctcgactcaaccccctggttgcgctgcctctctcctagggttagcctctctcctcggttagtagggacttgggttgggctgggaacttgggaaggaattatggactatttggatgggcctttttaacttcggaaattccgacaaactttccggaatttttccgaccgattccgagttccgacggaaactgctattatcatattcgattccgtttccgaaaaaatatttccgttttcgattccgtttccgagaaattccgaaaaaattccgaccggctgattccgtttccgaaaacaggtccggaatccggaaaaattccgaaccgttttcacccctactcacactagctagggcaccacatgcatgcacttctttaatttattttcgaaacgagacctatgttatgtgcatataataataaaaaatgacaagagaacaaatttaaagcataatagctaacccaaaaggaaatatatcttatttcggtagaaattttattattaaagtggatgcaagccatgaacccagggcatgtttagattactaccaaaatcaatcttaccaaaatttgtcaatgccaaacttttaacttttagcaagttggcagaattgccaaattttaattttcctaaccatatatttgtcaatttcaccaaataatggtacgatttaaaatgacacgaatctaaacacgcgcccccacttataaactaattagtaagtaaaccgtatatcaatccacgatttagttactaattttatcaataagtgagtttccgagtcaacccacttacatccccacgtgccgtgctattgttgcgcttgtgtattgcgggcccaacagcaacttcgcccactggcccatcaatggtgctcgcggtccataccagcccattaattgcttggctcacttaaacaggcccatttgtggatatcgtaattcttttcggcctattgagctgtgagagcagcagatccgtcctgccctctcgcccgctttaccggaaagttgaaaataacaatgtctatcaaagtgaaaaataaccagaacgctagtgctctctccgttccaaaaaaaaaaaacaatggtttccgtatccaacgtttgaccgtccgtcttatttgaaaaaaatataaaaaaaattaaaaagataagtcacgcataaaatattaatcatgttttatcatctaacaagaatgaaaatacgaattataaaaaaaattcatataagatggacagttaaagttggacacggaaaccagggtttgtttttttttttgacggagggagtagactttatcgtcttcgaccttgcatgtacacctctgaccctgagcctgaggaagcttcctgtaatcgtaggaggagcacgcatggagggagagtcacatcgatccatctgagtcacatcgataatccatctgctcatggatcgattccggccgtccatttgctaacacgcctcgtcattacctaatctgcataaccgaaatgcacgcgcgcgtcactctcgatagccacgatcctgaatcctcctaatgttagcatcctagcgcaatccagcgtttagctcattgtcgcgtccaactgttgatgattatatatgaatttatgatgcatgcttgctaaaaatgggaaaaagaaaataacacagtttatgtctttatcgtatggatatttgtccctgacgtgtgttagtgtaagggtggaaaattcccttgttgctcgtgcacgctttccgcactgataaatggtgcattttttttaaaaaaatatagaaatgttacttttaaaagtatataatctatttttcaatttaaaataattaatattcaattaaaaatacgctaacgactcatctcgtttttatgtatattgtcgataatttattttcccacactgggtcgatccgcgaactcacttatcccttatttatataaagctaatgtccactgaatatctaaagctcaacatgtaaacatagtatttattagcactgtgagcgaatttttcaagatttatcggcgttgtgctttcagtggtaggcgacgtacccgtcgatagcgagacgcctgtggtgacttcgttaatctctccaggatttgccggctcagttttcaaagatgctcatagaggtagggtttgcgtgtgtgttcattggggtgtgtgcgcgtgcattgtgagtgtctgcgttctactgcgtattctcaaaaaaaaaacctacatacaagcatgtcacatcaattcattaagcacacaaagctcaacatgcaagcatatagtaattatatctataatttatttaattctaaaactaaatatacatatgctaaatgttcattctcaaatcattttcataatatttcttgtctaaatcatttcatcatttctccaatatcaaacatatatcccgcagtaaagcgtggggcatcatctctagtttatactataagtaggttcaagacccacttacacctttacatgcatgagatcagtgtttcatttccaccatcacgtaccaggtatgttttttttaataaaaagaatggctcagagagtccggctttttactgaatgcgtaaagagtttttggttcgatacaaaatgctggggtgtaactctccagcttttccaagaccgctcacagcccacaccgagactcaggccgcaggccaacagacaggaaaacacactacaaagaaggcaaaacacacacacacacacacagataggttatcctgcttgcaaccaatcgttcgtcttgtgtgagccccgcagcaagaccccactcttcatccaatcccgtcctctgattgaagtagacgaattcttgcatcgagcaagcctctgcagttttccatttgctccaccatcttccccggcaccaacgtcttccactgtagcaaaaacagcaacatcttgtgaggtgatattgatcgaatcacattacttaaaagttcagttcctagtttaccaaatagctagcccaggcatccaccacaaaaactgtgaggttgattaggttagatttatcgcccaccactcctaacacttccattaggtcgttacaagaaccctttcatcactagccatccaaaaatctttatctttaaagacgcagggaccttccacatctccatctgtctcagcctctcaggtcaatgacacctctaaatgttagttattggtacatggatctcggagtatactgaccgctcttttcaagtttccaagtcattatgtacatctctcccctcagttagttgcacttctcccaacctctccatgagctcatcccactccacttcctctatggagagggtccttcttaagggtatctctcccattctccattcctaaagctcctccttactgtcaccggcccagggttgagagtgatatgctaaagatgtaaggataaatcactcaccagatatgattcagtttctatggagtcattagtgagatctatctacgtacccaatgtagcacttttgtagtgttggaagtactcaattacttctcacttcactcaagcattgatttcaccctctgagtcttgacttatggccccttatattcttttctctcagtgacaccaactattagggcacccacaatggttatctataggctctctacaagagatccatgtcagcatattttcctacatggaagatattaaatgaagagaaagaacaaagctatctactaacttagagatagtctatagagaaaaacaaggcaatgcatgagagagctatagatacctatgtagacatactattgaggcggtttactattaatctagtctattgctgagatgtacatgttttatatatagcaccttactttaccattgcgggtgctcttagtggatgggataggggttcggaacaataaagtggtgccactgggaccgacgagaagcctggaagaaattcttgtacaaacaaaatgatgactgatagtttgatcaggaattgggaccagagagcatgattttgtgaaatcatgtgatgatttaatcgatgtgatgaataattgtcaaaggtaaatgtttgttgagaaaataatgaatagtgttttcggtcggtgaacagtgcagttggcactgggtgactagtcagaccaaaggtatccgggcaatttgaccaggtatccacggcggcgccggatctgccgcctccggggtcgccgccgccaccttccacgggagagagagggagagggagagagcggccagatctgccgcctccagccaccggacgatgacgacgactgccgtctccgccccgtgcgcgctcgccgtcggttgcctctgccccggatctaccgctccggccaccagacgacgacgacgacgacaactgccgcctccgccccgtgcactcgattcgggggcggtggcggcggcgggagagagagggagagggggggcgagcagaggcggaaggcaacggcgagagagagagggaagcaagcggcggcgggagcggcggggagagagagggaagcaggcggcaagtggaacaacgggcggagggagagaggaacgccagtgcggtcgtgcggagggagaaagagagagagagagagggggaagagaggggtaggataggaaagaaaggaagagaagagaaatgagcttttttgggttggaacattcattaggctattcaaacatggtctgcattgtagaggtgagtacccctagagtccctcagttattgagggcatcctaggaatggctcacattgctatgccctaatggaagaagaaagtagctgcgtatcgtgtttctcttttatgtaccctgttcattttttcccctacgaaagaggtgtgatgttagctgtagtccttttctaggaggagatgctttgtatacctagcaggctagcactctggatcgaacctttttagtaaatcctgttttttagaaaaaagggacttcatataacctaaacaaaagcatgggagcttccaaatcgaggctactgttttattacagttacgcagatgcatactatatactttataatacatccctttacttatatatatagtacatatatatactaccaggctgctagctcttgctcgctcaaaataaaactgcaacttcagtgtgagctagggcccatttaattaggtacaagtagatcagtagatggcgataccaccggcactggctcggcgagaatcggagcacgacggtgctgcgtcgtccaacatcccggcggtgctgttggtgctcggcgtcgccaccgtctccgtggctattaataacaccgccgcggctgccaccaactaccactgctccctcgccttcgccatctctctcgctgggggcattcctctccggcatggccatgatcggcgcttccgtctgggtgtccggcgacccacggggccgcactgccgctggtaagaagatcatctacgcgtccatggcaccgctcgtgctggccgccgccggcctagcggtggtgatggcgcactcttctgcaggtaactagctctaatatgtactccctccgtcattaaaaaaaagacaatcaattttcttatagtgcaatgaatctggatatatggttgtctagattcgttgtatttttgagggatcatatcctttttagattgttctttttttagaatggagggagtatggtcttgacgctgacgacgcactagctaggtttacgtatgtcgcctctgccgtcgggccggccaaccgcgagcgccgatgaaataaatgaataaacagatcatgtagtacgcacctagatctagctgcgcgcgtgtgtgtatatatatatatatatatatatatatataacattgtaaattaatggatatttgtactttttattggagatctccatttacaagtctattgcttgtaattaatctttcatggcgcaatttggaaaaggaaaagaaaagatacgaaaagggaagcttgacgggatggggagaagtgcgtgtaggcgtggcgctgctgccgacctgcggcgagcgtactgaccatcgtgagctgcggcactgcggctgcgccccccaccggctgtccggtgaccgaaatgatgatactggtttgattggggctaactcatgcatgcaccgtatgctcgatcgggacaactacagagttagtgaattttctaaagttaagagagatttcattaatgactaaacattagattacattcttggttcagaagttcaaggatttctgcacgagcacataatctccactccgtatcaattcgtgaacccattaccatttgagacaaagcatgagctatctcatttgaatctctccttatcttatgtagtgtcaaacactacatggccgctttaatttctgaaattatgccaccccattctgctcttgaggccgagttatattagtgatatttgatatgcgttcattagtactctcttaccgtgttctcaaattttaactgtgcacttgtttactgtgtactccgtataatatactccaatgcgtatcggtcgccagctaggcaaatcgagtagcacctagctagcgcgtggggctagaaagactctgtgctttttataacgtcagtgctcccgtctaccgctggtccgctgcgtagcctgcggttatcagctaaagcgatgacgtggagagccgagagcgacgtcgccgccggtgcgctacgtacgccgatgccgaccgaaccgcgctcctgatgactcagcttacatcctcttcttttcgtttatgttatactccctctatctctaaatttcttattaaaaaatttttataaaatatgtaaaaccatatatatatatatacacacacaccaattgcttaaattttttagaataagacaaacggacaaacatgtttaaaaaaatcaacggcgtcaaatatttagggacgcagggagtacttattagtcaaaacttaaattttcaacctaaaatttaaagttaattttgattttatttataaaagtttatttttcatcatttgcttttagatcgttaagaacacgtatataaaagttttattcgtaaattatttttggtttgcaaataaaacgtaagcaatgggaccattaattagctcaaccaaacgaacaatgagcctcgcaagacgtttagagccatcgatcgttcgattgcctaacgagccgatcaaaattttaattttagaacttaattttgaaatttattttaagatactatttttaacgcgcgctactcctcgcccgcgacccatatatgcagcattccgagtctccgacgatcttaaggacgacctcgtggacggcggcgctggcatttggatcgtaggcccaggaagcgatcgtaggcctgcttgggctccgccctctctcccaaggaaaaagtccacttagactccttaaatgttcaccgaatctaattcgcaacccttaactagaaaaccgggtaggacgactccccgaattattgaaactagtgcaatttgactcctctagcggttttggagggcggttttgctgacgtggcgctgacgtggcggtgctaacctggtcttcatcccacgtggcgcttatgtggcattagaattaaaaaaaatatttgtggacccatctgtcattcgcacactctttctccatcccttctccttcctctctctctctcccttctctctcttttctctcctccttcggacgcacgcgaggaggagccggatcggcgacggcggcgtgcaggcgagggctggagcgacgtcatgctccttgagatgctcagggggcagactacagagggtgtgcgactgggtggcgacggcggcggccgacggggcctgggatctccagcggctggccgcgtggctcaaggagaagatgaagcgcaacgatgacaacgacgaggtgtcaacgtggctggaggagtcgtggatgcaccgctacgcagtgatttcaaccatgtgcaagcggccgcgatgctggagctgtccgtttcttgcgtggacggtgaaccaaacaggaggccaagcatgaacgctgttgcgcagaagctcgagggtcagccttctcgaggggcttggagcagggcttgccgcacgagtgcggcgtgaggaaagatcgttgggtggctcgcggcggtgcccgcagaagcaggtgtaggcgagctcgcgcgcggggacggcgtgcacggactggcacccggggcagcgccaggaggagtccaggtcaggcgcgtcggcgacggacgccggggagcacgcccacgcccaacgtaacgactaccaacacgacgacgaccactaccacgacgaccaccacggtggccgccgagatcggggcccaccagcaccacccaccacggcccggtgttcgtcggacgccactcgatccgcgtccgaccatggccacacccggacccgacgagctgctcaagtcgcaccacatcctcgccaaacgcagggagatacggaagcgggagatggagggtgtcgtggtgttcgccgacgagaacagcatcctccggacggagctgttcgacgaggtgcagaaggtgaagtcagtgggcgccatgcctgtcggcgtccttggcgaggacgaaggcaccaacgagatgttcctccaggcgccgccgggctgcttgcccttgacagcgggctgctacgcgtcatcgccggtgatcgcctccggcgaacccgagttcgctccggcccccttctgccgctgcccctccgacccccgcccgccaccgccaccgtcgccgtcaatccggtctctgctcccccgcgcaggtctgaaggggaacagaaagggggagaaaagcgagagaagggagagagagagagagggaggaggaagaagggaaaggagatatgacacgtgggacccatatgtcagtgggtcccataattcgatgtaagggacatgtcgacgccacgtggaacgaagaccgagtcaacaccgccacgtcagccaaaaccgcttacaaaaccactcagggagtcaaattgtaccggttttaatagttccgggagccatcttatccaattttcttattaaggggtacgaattatctgcgacccaatctgtatgactagttaagcccactgtggatctcggttgtgtttattcaccgcggacatgcgcgagaattggccacagttatgctttccgatttctgatcggtccaaacagagaaaaccgatcggggacaaagatcatttcattattggataatttcaattttaccttgattctccaggtccaatggcttgattggcggggaattaaggaaggaaggagggtagattatttgctagaacacagctaagtaaattggagcaagcaggctttgactattgactcagctcagttcttttttttttttgggcactatcagctcaattcttgagatggcgacggctaccaggaaggcaacacctggctatcctcctccctctgtcgaattgaatcgttggagagtttgtcgacaccactgaaaaatgagaatgacgattccatcttctccctgccgacaaatatagctgtttgggcatatgacgaaggcctgctttggtgatcacgcctcttgatttgttcaggcccctcttttaatttggtcgtgcgattaaaaaaaaaagagcgggtagcagaacataatttggtcgtgcgattaaaaaagaagaacgggttgcggaacagagtgaatgtaaggcggttctgagctctgatccttgtggagtttgtgggtgctgtgtgactctgactgactgtgtgatctgtcttgcttccaaattaagtgttgttattattccctaggggatgcgtctggcaatcaacaactttataaaagttgatttttcaaatataactaataaaattaaccgaaaatccatcttattcataaattttatccccccaagttagcattggctctaaggataaattaattcataacaacataaatgataattacataattttttaataagacgaatggccagacacattttaaaaagttaacgtcatcatatatttttagaaaaaaaagtagtatactaatttattaatataatagataattgttcttccacatgatcacatgttttcatccaattctaaccccagcagcaaagataagcatggcatgaaaaatcaaagccagggatagagaaaaatatgctagggggcaaacaaaagaataactatcaatcgggtcaattttggctgctactcccttcgtttcatattatatgtttattttttaaaaaagttatttatgtttgatcaaatttatagaaaaaacttagcaacatctacatcactatatcagtttcattaaattaatgaacattaattatattttgataatatgttttttatactgtaaatgttaatatattttactataaactttattaaaaataaaaagtttgataagaaaatagtcaatcgatttatattatggaatggagggagttttttttaagagtaaatttcacaaaactacatgtaacatctggtccaaattgcagaaaaccacacgcactttgacacttggcacttgagtaaatatattttgttgtttaagtttcacaaaactacactatcgatgtatagattcacccgcgagatgatgtggctgtttcccctaggacgaggacaaggcatcctgttaacagccatcgcacgaaattaata

SEQ ID NO: 45337 - DNA, 10693 bp, Oryza sativa
aacatactctccatctacactctctattatgagtcagtgacaggtgggactcatatgtcagcctctactgcctcttcttcttcctcctcctctttctcccctttttcctagccatgtttactctttattcttcctcctctacaactaccccaagctcatttcagcgccctctccctttaggtgtgaggcgtcgatgttactcttcctcatctacaactacccccaagctcctttcagcgccctctccctttactgtggtgtgtcgatgttactcttcctcctctacaactaccccaagctcctttcagcgccctctccctttactgtggtgtgaggcgtcgatgttactctccctttactgtggtgtgaggcgacgacgaaaacatcgatggtgacgggcgcacagggcaatgacgcacggcggatccgtgctcgcatgaggcgggctcgtgcacaggaggcgacaacagacgatgatgaagggcgtgtgagatgacccgagacaagggcatgtaaggtggcggcaacgtcgtggatctgctccttgatggcatgcgagagatgagagaggaggaggcaatgagcggcgtcaactccgtccctctttagccaacagcgagggcctggagctacctcggcttgcagcagagcaggcagacgaagggagtgtaacagccgtccctccagaaccgcatagccagcctattcgacgggtgggcccacttacacataccaccccgcttacactttcgttctcgcttcgtgtaaaaaggaatatgccttacttataagttggttccactcatgctaaactagcaaggtgggaatatgccttataagttgaatccactcatgctaaactagcaaggtggtactaaacaagcgcacacaactcacatggcccacacacacagctcacatgggccacataggcctaatccaaattgggccaggatgtcacatacaccctgagcagggtggtactaaacatgcgcacacagctcacatgagccacacaggcctaatccaaattgggccaggatgtcacatacacccttccactcatgctaaactaaacatgcgcacacaactaggggtgggcattcggtctaaccgaaaatttcggtctcggtcttcggtctttcggtctttgaaaattgaagaccgaatttcaatgcaaaaaatgtcaggacagacaaattcggtctcggtcctgaccgaaattcaacaacattttcatatatgcaaagaaaatggaaattttcaacacaaaagttacaaaaaaattcgtaagcacttatgagtaaatactcttattaggttgcatgcctataataagtaaggatgtgaaaattagagcttagtcctaattgaacgtagtggattgtaggttgcatttagacttttttgataattcggttttttcggttaaacgagaagagaattgaccgaacaaagagaagagaagtgaccgaacaaaggagtgatatggttggagggaatatgcattataagttggttccactcatgctaaactagcaaggtgttagtaaacatgcaaggagtgagggaatatgccttataagttggttccactcatgctaaactagcaaggtggtagtaaacatgcaaggagtgatatggttggatgctaaactagcaaggtggtagtaaacatgcaaggagtgatatggttggagggaatatgccttataagttggttccactcatgctaaactagcaaggtggtagtaaacatgcgcacacggcatagcaaggtggtagtaaacatgcgcacacaggttccactcatgctaaactagcaaggtggtagtaaactattgacgaaaaaatcgaacacaccggcctgggagatctgcttaactcctgtgcaggtccaaagattgatgagatgcgggcgtgccagtcagtttgatcctgtaactgacaagatatacaaataatagatcaaacagccgatctgctgacaaaccgatggagtagttccagccgatagccgataaatagtcgatgtcgataccagccgatagcgatagggtttaaacaatcggctatatgtctaatgtagataatgatataaatgcaatcggctgatcgataatataatatagcaatataatccaatagaaaccaatcggctaacaatatgatgtcacgtcctcatactagagaaacaaccacgtcatatcacgggtaaatccattcatcgatagtgtggttttgtgaaactaaactaccaaaatatatgtacttaagtgccaagtgttaaaatgtgtgtggttttttgcaacttgaaagttttgtgaaatttactctttttttaatgtaacaaggcatgatgatctaaacaaagggaggatggcagttggttacgcactgaggtgtttgcctccacttacaaggcaactctgggccaccccaaaacaccctgacctataaatcggcaaaccggccccaagttagattctgacagagcttgaatttttttataggagtgaatttagtaagcatacaagaacacgagatgtctcaggccggaatcgacaatcttaatcttgagctaggcatggtgggagcgcaagtcgccggcggcgaggctcccgccgccggcacatcgccggagacgactgtgaaggcgctgcggggagtggggttcctcaccctcgtcatttcagtgggcacgctcgtttacaagccacctcatggccttctcttccagcttcacgtgcttgcctactacctcacgctcgtggggatcttcttcgccggagtggtggaggtgtggacggcgttctgggtgtccgaagccggtgtcggcggtggccgtcgcgcgttcgggagagccgtgctctgggcctccgtcgtgccgctcgccgccgccctcggaatcggcggctacaccgtcctggccaacgtgcccagttgagagggctatgatcactcgctaccgttcagcttgttcgcctcttcgctgtaatttgtgaatgtactaatgcagctatgctcaattagttcaaaaggtattagtattaggatattcttttacctcttccgaaggtactgataagattttcttcagattgcaatgcagtacttggggaaagcgattttatctctcgaggaaatatccactcgttccgtgcatgtcaactaaatagtcataaaaaaaattgaaatatatatcactccacaaacatgtaagttaaaatttaacttctataagttgtaacaaaaataacaaatatagatgcgaatgtacgataattattttcagtctaatttgttatttttgttgtaatttgtaaaagttaaatttggtcttgtatgtttatgtaataatatattttatattaatctacgttgttattttttaaaaaaaaatttgataactactcctttagatggcatataaataacgggggatattctctcgagggatgaaaatctatatcccagtacttcaatcaattaaaataatgaaacaagcaaaaaaaattatgtgtttcagattaaaaatgaaatgtagcaaaaaactttttgcccgttagacatgcattcaatcaccgttgcggttgacggtggtgtgtttcagaggagaggaaaagaggagattgagaacatatgtaaaatgaactcatatatgattaattaagtattaattactttaaatttgacaattgaatcaatatgatttttctaaaacaacttttctattgataattttcacaacaaatacgtcgtatcatctagcagtttaggaagtatgtgtggagaacaagagagtttatctcccaatcagcagttgccaaacgcacaaacttgaatcaagattttgttgcatacatgcatcaacattcatcatagatattcacccattgaattttgaatcttaaaacttttaaagttttctaacttttttcacgaaagtttattttacagtatttgcttttgaatcatcaagaacatgtataattatatatatatatatataagttttacctatagattattttttatatgttggtaataggctgttctatatgcataagtaagaagatggggacacgtacaaacaatatagcaaacattgaaaaattcctaaaatcttgagcaagaaattttttttggcagagcaccaaaatggtgaagtttcgtgaatcgtgatcatgacggccgccaccgcctgcaccgtaacgggaggccgtgcggctcgccgccgttgtcggtatcggccactacaccatgtgggtcctggtcaacgtgcttaatggagagggtttcgctgtcgatcggtctctcgttccactatcttccctcctcttttctgcaagggtttgagtgcgcttcttgccatcatctccattgacactctccttcccagcctcgatacctttctctcctaacctacggtttccgcgcctgaccctttttccgcgcttgcagttgcagctacatccccaaggacggcgagcaggcgagcagcagtacgatgatcttgactcgagaaccgacctccgcctccgcaacgaagatgcagcctcccccaccaattcttacacaaatcttggcgcacatatcgtgcggctaaaaaaacgtaaatacctgggaaatccagtacataatctctcgtatatcttaaactaggggtaaaaatgtcatttcaaatttctcttgctgacatgacaatctaattaggaaaaatatctcacttatgtggtatttatgtaaaaaaagaaggaagagtggcatctcagtagtgccactccgtaagagttgcaagtagtagagaacccctctagcaaacaacagagcagatctggcaaagtaaggagctgtttggcacagctccaactccagctccacccctcctggagctggagctcagccaaacagtttcagctccaccaaaattaggagtgaagctgagtggagctctctcataaaatgaactagagttgtggagttgggtttagacagttccacaactccactccagacccaactcctggagttaaatttaggagttggagctgtaccaaacaagccctaagtatttcactattataggatctaaacgcttcttcgtagaaactacctccattatccagcgttggtgacttttggcaggtagttggattgatgaagatagtttaagtgttgagctcaatttgttattttcttattgcatgtcaactcaccaaaattgccagcaaggtatgcaatttgctataaaatgtgcgacttgaggtgcttaacaagacatagtttgccaattgccagcattcaaacagccacggggaatgcgatgttccgattcctaattgcactgctattggtccggcgcagctgcagcagagcagtcccgcgccacatgtctttatcacaccagcgcatccagcaccatcgtcgctagcgccagggtgtccgcctctgccaccgccagtcgaacaagataatggggtactttcacactaaagaatttgggtataaattttgccggctatttcataggcaccatctctgcttgtcttgcgatctgggcctattacatcgtgattctttagagctgtcgggcggtgaccgacgctattcggatggcacttcaagtggagcgacggttgagggtgccgccgtccatcccgcccacgagttcaggcagctcgacgacggagcgcgaaatcgagatgactgcgcaacgcgacaatggtagggggcttgagccccctcccacagttggatctgtccttgaaagtatccaactttttcacaaaagcaaaaagaagtacactatatagagcaaccagagcgacttggtgtagctagcatcgtagtatcccaacaacatgatcgcgtttattaacagctgcagtccaacatctccgatagagaagctatagctaacattgccaccatagacgtcaccgcagttgcagtgtctttcggttgcatgggagtcaaattcaacgaggaggatcatggcggcgccagagccggcggcggcatctccgttcgaggacagcattgcaatggagctctgaccgtgttgtcgatctccataggaatgcgatgttccgcttcctaattgcactactattgctacgtccggtgcagccgcagcagagtaaccccgcgccacatgtccttatcaggcctgcacataaagcaccgttgtcgctagcgccagcgtgttcgcctctgccgccgccagccgaacaagataatgggggtacttgtcacacttaagaatttgggtaccaattttgctagttattttgcaggtaccatctctgcttatcttgcgatctgggcctattacgtcgcgattcgtcagaaccgttgggcggtgaccggcgttgttcgaatgacacttcaagtggagcgacggttgagggcgccgccatccatcccgcccacgagttcagtcagctcgacaatggagcacggaattgagatgactgcacaatgcgataatagtagggggcttgagccccctccccggttggatatgtccttgaaagtatccaactttttcacaaaagcaaaagaagtacactatatagagcagcgagagcgacttggtgtagctagcctcgtagtatcccaacaaaatgattgtgtttattaactgctgcagtccaacatctccgacagggaagctatagctatcatgggcaccatagacctcaccgcagctgcagtgtctttcggttgcatgggagtcaaattcaacgaggaggatcatggcgatgtcggagccggcggcatttccgttcgaggacagcattgcaatggagctctgatcgtgttgtcgatctccatgggaatgtgatgttcccttcctaattccactgctattgctaggttcgacgcatcagtagcagagtaaccccgcaccacatgtccttatcacgcttgtgcataaagcaccgtcgccgctagcgccagcgtgtccacctctgccgccaccagtcgaacaagataatgtgttacttgtcacacttaaaaatttgggtatcaactttgccaattatttcgcaggcgccatctctacttgtcttgcgatatgggcctattacgtcgcgattcgtcagaaccgttgggtggtgaccggcactgttcggatggcacttcaagtggagcgacggtcgagggcgtcgctgtccatactacccacgagttcaggcagctcgacaacggagcgcgaaatcgagatgactgcgcagcacgacaatggtaaggggcttgagccccctccgccggttggatctgtccttggaagtgcccaactttttcacaaaagtaaaaaagtacactatatagagcagcgagagcgccttggtgtagctagcctcgtagtatcccaacaacacatgatcacgtttattaacagctgcaatccaacatatccgacagagaagctatagctaactattgccaccatagacctcatcgcagctgcagtgtcttttggttgcatgggattcaaattcaatgatgaggatcatggaggcgccggagccgacggtggcatctccgttcgaggactgcattgcaatggagctctgaccgtgttgtcgatctccataggtgcagtgcttggcctactggcacatcgagcgcttcatcaaaggaagctctacctaaggctttgttcatttaatcctgtccaaagggttgagaggaatttagaggtgattaattccacacctctcaatacctaagactctgttcatttaatccccacgcaaggggtgagaggaatttggaggtgattaattccagacctctcaatcccctccaacccctttctcatggggacaagctctaaagtgaagcatcaacttctctttctcgaagacgtcatcaccgagctagcactgacttgcgtcgtcgactgcgatgcccacgatttgttaaagcaacaagaagctggttattctcggcgcacacatcggagtttgatcagcacgggacgactatacgtcgatgggagctcaaccagtacctgataaagttaattgcctacatacacatatgcacgctatcgattttatgttactaatatgtactactgtttgggagcgagatcacttataggttaagcatgtgcgtataggatcgagttaaataatttgagtgtgatatgatcgagcttgctagttgcgctttctccatcgagaaaattacatatctaccatcgcataacaacatagcatttgattagttgaaatgcaattgtttaaatgggaatcactagaataccactctcaagtctcaacagagtaccatctgacacaataccattttcatccttttttccactttaagcttagtttattgtctttgtagttgttttttaatggaaataccctggtcaaaaggttgaacctgataaagttttcttttccccaatgctaaaactttgtcatgtgaagcatataaaatgtgatgtttttttcatataaattaaataatttagcaagtcattagtaatttaaattgtcagaagtaaatctattacatggaagataatccaaaatgttagaaatgcatcaattacaactcagatctaaaacatgcaaataaatcaataacaattggagagataaataacccagaatagcatcatcacattctaggtccaagggcatttccgacaaacaaattttaaaagagagtaaaatcttttctaagtgacaaaaaagatgaaaatggcattgtgttaaatggtactcggttgagaatgatattacagcaaaacctatttaagtgatgatattctagcgaattcagtcttatgctatggtagatatgcatgtattcctatgtagacatgtattgtactccttttgttttaggttacgagactttttgacatggtcaaagtcaaaccactctaagtttgactaactctatagaaaaaagtagtgatatttacaataccaacatagtttcattaaatctatagttgaataaatttttataatatattagtgttgggttaaaaatattactaaatttttctacaaaattagtcaaacttgtagtagtttgatttttaccaaagtcaaaacgttttataacctgaaacggatagagtatcaactacgtcatgcacattggactatacaaacatacgcatgcgacagaccatcaccgacacacgtgtggtggggtagcggacccatgccttaattcgttacaacttatcaagtccatataattccataatgtactgtaggttgattttatgatttgcgttacatacatccttattatgttgttcatgtttataaaaccatataggtatatactagttgatacctcgcgctttattgttggatatgtggatggatgcattatagaaatgatatatgtatatgtttaaataacgtgaaaatgatgtggagataatgatttgacattgcttacatattgagttataaaaatagaacaaaattgtaaatgatatatatcatgtttatatgatatttaaaatactctagataataattattaatgtgtaatgatatgatgttaagctttaggagttagtcgatatcaattttatagtaagatatgattaagctatgatcctttcctttattagctcagcaagagcagctctagcgtggcacaagacgcacaactacatgctccagtccaatcagcccaccataatttgggccggaataaggaggcagcaagagggctcagggcccggcccatcacctgatcacctctgtctccgtgtcccttcccatccccatctccgaatcgaatcgatctcctcgtttcgacgactcgtctccttcctcgtcatctccaagttcaccagctccccctcctcgcctgctcgcctagggtttcgattcggatctcgccgccgtcgccatggatgacccgtaagtacctaccccctccttccccaccgccctctctctccccaccctagggtttccccgtctgacctcgattccgccttcgatccgtccgcgccttgcagctacatcgacgaggacggcgagccgctcatggacccctacgacacgcgcgacccctcccccgagccccagcagcagccctacgacgacctcgaggacgacctcggcgacgactggaaccgcggccgctccccgacccccgtgcacggcgacgacggggccggctcctcctccaagcctcggaagcgcctcctgaagaagggcggcgggggaggtggaggcggcggcggccatgggatgcccagcgacgggctggatgactggggcgaggaggcggcggggttggcggatgacgatgtggaccccgaggcggatgccgcgaagaagaggaaggggtcgtcggcgctcagggacctcgcgaggggcggcgggaaggagaagaaggagaagaagaggaggaaggaggatgggagggagagggagggcggcaggggaatggggatggcaagggagaagagaggcggctctggtgggaagggctttggcggcggtggtggcggcgggcatggggaccaggatgaaggggagagggagatccaggagctatgggataccatcgccgggggtgactccgaggtaataattgatcatgttcttctaaatcttattatgcttgctttgttccaatgtatttcagatgtttgttacggagtactcactattagctg

SEQ ID NO: 45338 - DNA, 4441 bp, Oryza sativa
gcttaatattgagtcactaggctccttgtgacttaacatctagatgcccttggattaatttttcaaggcagattttgcctcttgagaaccatgataacttttagattttcctgccagaatttcaaattgttgatgttatgcaatatttaatctatcgttgcgattccttatttccgagtgtaatacttaggaataattgaataattattatcttggaaacatcattaggatgatactttgctaatcttcatgatatttgagtttgcctgcctacctctctgtttcagagatttatctttggatgatgtgtgggaatatcaattcaagtttgacaatatattctactagccttggacaaaaaaaacactctcctaacattttgttttcatgtaacaggatgaccaagaaggtgtcagaaccttagatgatgataacttcattgatgatactggggttgatccagctgaccgttatggcagcgataatgatggccactcacctcggcattaccctcaggtatccatcctaacatccttaacttctcagatgcttttcaggttattattgcatttcaagtttacatgaaaattatatggagaaggaaaagaaaggaaatgggctctatgacaaaaatatttgacactaagttatatgctgtggctgcttatatttatgtcacataccaatgattgattatagtgactaatgcccatatcatagtaggtaaggttatggactttctcaactagtatttagttacacacatgctgatatttgcatcttccagaagttttacatagcataattaccctgcaggaatcatagggtataatatccttgttgatgaagctctaatgccttgctgtctcatagatttccaattcaaaatagtcggtttacactagaattgcataatattttgtctgtcctgctttattttttgtcttgtggctaccattctacattgcaaactaattctctttatcataggcagaggaaggggaagaggatgatgaaattgagcggctctttaagggtgggaagaagaagaaaaagaacgatcgacctcgtgctgatattggtcttatagtggaacaattcattgctgagtttgaagtggcagctgaagaagatgccaacttaaataggcaatcaaaaccagctattaataaacttatgaagcttccactactcatagatgtactctcaaagtaagaagttttgaatgcagatagtagcattagattgttgcctctggttccagtccaagttgctatttcgtagctagtcataagtcataactattttcttctatatcactattttgcaggaagaatctccagcaggaattccttgatcatggagttctcactcttctaaaaaattggcttgaacctttgcctgatggtagcttgccaaatatgaatattcgaacagctgttctgaaattattaactgatgtaggctatcttgctcttgtttcgttcttattgcaccataaaagcccactagctttagcatatgcacacacttttagttcatatggctttattttcattcctcaggactactttctcatggaaggtttttgatctatttacacagtttccaattgatttggagcaatacgatagaagggagcagcttaaaaaaagtggtcttgggaaggtataagcatcttttgatggtccccacatattatgttctgcgtactgaatactgagttactgaccatcaattcttttcccatgtcacatgtataggtcattatgtttttgtcaaaatctgatgaggagactacttctaatagaaagctggccaaggaacttgttgataaatgggtaatttcatgttctttctagtaatttctaattgtatggttgattgatgctgaagattcctggtctctgtgagactgactctgagaaaaacaaacatgtagagtcgaccaatattcaacaagagcacacgattcgaggatatgaggagatatgatgatgaaagagctccttacaggcgaccacaaatgaagaagtgagtcctctgtttctcgtttattcatcaaccatcataagaattactatataaacaatatctaatcttaagtttctctatatttgttctattttccactttgatgtaggccttcatcaagtagttctggaatggaatccagggacgatgatcttgatgctgacttctctcagtaagtccgataatgtgtccttcagtgcaggttgaatcttcactccatcatgtacttattttttttgttttgtgctatgaattccaggcgcaagtctgggcaaggtggtgcaaggcagcatgcttctaggccagaagcatcacccttggactttgttattcgcccgcagtccaaaattgatcccgaacaaattagggctcgtgctaagcaggttgtccaagaccagcgccggctaaaggttctgtccctgcctacaagacttgctgtttttgctagcatgttacattgctggacggttttgccatgccatgtgagttacgcaattaatcattcttgtctgtcatgcagatgaacaagaaattgcagcagctgaaagcaccaaagaagaaaaaccttcaggcgtcaaaactcagtgttgaagggcgtggaatgatcaagtacttgtaaaatatccacttcgaagcacttcgaagttcttgcatggttgcatccacagcgccactgcaaagcagtgtgtgcattgggccacggagcagtatcaagtaccctacctctatcggggagcgaatggtttagccttgaataatttcttggataatcttggactgttgatccaagctctttccattctggtagggtgctatatgtgagcttgagagacatggtgattcgggcactatttataacaaaggtttatactattgttggtcatgatggatatattgtgtttaaagaagaatgatggtgcctctactgtatacatgtttatcatgctttacagcaaaatctgatcgggctgtaacttttatttgattgaagttcctgacctttgtactaagactaaagacatgaaagtcttgctgtggaataaacatattgcgacaacagaattgtgcttacggcacccaagagagttgaatacgtgttgttctactataagactttgttgacttgttggctgattcactataactttttgttgtcttgttggctgatactaggattcactataagcagtttgaggccttgaatagcctctgctacagctctacaaaggttgtcaaatgtcatcctagagttgcatcttgtatggtttgttgatcacgcagacaccccgttatattttcaacgctatacgccggcacacggatatctttggcattatttttttttctagaaaaaataaaataaggcgtcagtatacctttgtgtacgaattttgaagaatttcacgacttcacctaagtgatcatatgctgatcttttctggtggaagataaattacgatgccggtaggcaaaaggcgaaatctgaaacataggtagagcgaaacatggcgtaaatctgaaacgtagataacggactaacggctgctgctgcctggaacgtaaaattgttgctaagcaaagcacttcaccgaccatggcgtaaattgcgcgagacggcttggctgtttcgccagcgacgttattgcgaattcacttcgtcaaaaaggatcaatggctgatgcttgtatttttcattcctgtgtatagattacagtaccaaaaaaaattacagattaaagtcaggccaaataaaaaaaaatgaagcctgcaaccagcaggaacgaaataagctgctgctgctgccaaatggaacaaagaaacagccaaagagcacaggacaaggcgactgattacctgaaagggacacaacaaaagaaaacctgaacaacaaaatccattctcctctctccgttcaatatatatatatataaaatctagattcgtagtattaaatgatttatttttcatgagatgatgaaagaggtgtgtaaaggcacttcttcactctggcaatgatctccgtagcctgttcatagtgtatttaaaaccttgctcttttctaatatagtgacgtgtaatttcctttaaaaaaagacacttgcatcaagaacacacaaaagaaaactagcactccagcttgtaaggaaactaaaagaaaataaaagacagagaaaaaagaaactaaaaatagaggtcggcgttcgtctccctcctgtcccccgtttccacctctccatttccaaagtccaaacttttctccctctctctctctcttctgaggaggccaaggcagcacgcgtggccgaccaacctcccgagcccgcgtgatccggcagcatcgatcgcgcgacgcgctcgcattcctcctcccgcggggaggagccggcaggatccggcagccggcgcc

SEQ ID NO: 45339 - DNA, 5054 bp, Oryza sativa
  unsure (1)..(5054): unsure at all n locations
cagccacggtccagggcactacggcaatcaccaccaccaccggagccggcccccgccgccgccgccgccgccgtcggagttccggccgttccggcgctggttcccgttcctcgtgccgttcttcgtcgtcgtcaacgtcgcgctcttcgtcgtcacaatgtacatcaacgactgccccgcgcatatgcaggccaccggcgacgcgatcggcggtgacgtcggggagggcgccgcgtcgcaggggtgctggctggagccggagctcgggaggttcgcgttccagtcgtacaaggagaatcccctcatcgggccctcctccgcaacgtaagccatccacgcaccaccccataaaatttgagatccttcaggtctctcattctcatggttgaggaacaatgcagcggttagggtgaaatttcgctcatttctgattggtgagatgggtgattcggtaggccattggggtttcgtttcttatcaaaactttggaactggcactattagcttaggtttagatcaaatggaatgccttttcatccatgatggttcaatcttggggattttttgggggagtcaattttgtagattacataaagatagtgactgttgcaatgttgtctgttgacgctatttgtttgtgcatctaattttgttgtggatgtaaatcttgtgccttcttaaaataaacaatttaatgaggaaagattgctgggtataatactttatttagctgtatttgccttagcaagggtggaataaataatgttgatacataagacaaaattttcagtgaatactcaagctttatttctgtttattgaagatggtgctaatttgagagttcaactgacatatctaccaattcgtcaggctgttgaaaatgggggcactagaaaccagtaaagttaccaatgaccatgaaggctggcgcctcattacatgcatttggttgcacgctggtgttgtccacatacttgctaatatgttgagtctcctattgattggaatcagacttgagaaggaatttggtttcagtaagtattgaaataatttaacattgaacttcttgtgattcttcacaaatattacatgttttacttctgcagtctgtataatttcttcaacagctacttggcatataactaagaccatagattttaattattgtctattgcagtgaggattggcacgctatatgtcatctctggggttggtggtagcttgctgtctgctctgtttatggtgtcaaatatctctgttggtgcctcaggtgcactgtttggattgctggggtccatgctgtcagagctgataacaaattggacaatatatgagaataaggtttgatctcagatctatgcatttattttacacaaatcctactgcatttcttgttgctaattgcattcttgtttaataatccagtttgcagcattattaactctagtcataatcattctcatcaacttggctgttgggattcttccacatgttgacaactttgctcatcttggaggatttacatcggggttctttcttggttttgttcttctagttcgcccacagtttggatacattaaccaaaagaactctcctcttggacttcccatgggtacaactaaaagcaagtacaagacataccaaatcatactttgggttattgctacattaatattgatttctgggtaaatttcttctccatcagcaaaagagcaatgataaatatatttagccgcgcatttgaacctcatgcctgcatttgctaaacttcactcttggcaggttcaccaatggattcatattggtactgaaagggttcaatgccagcgagcactgttcttggtgccattacctgagctgtgtacctacttcaaagtggagttgcaacacgccaaacaactattgcatggtaagttctttctatgggtatgcttcttactaaaggtgatcttcagtcttcaccaacaaaatctgatatttttgcaatcactaatggtatttatttccttttttgttatcaggctttatgggtgtattttatttaccagaacaanaatgatccatataaaatggatacaagaatcttgcaattagatgaaagccgtttgaactttattataaaaggttgccttgattggttttgacctatcatttcgttaacaattttgcagttctgtttcctttctacttagggttatgtcctgaagctattttactgtataatggcccagtactttttgctacttttgctaacattttgtgacctttctcaacccgtaatgataaccatagagctcccttccagaggttatttatctttcagtatggtcatctttgtagtgcctacattaatatttcacttttgctatatgttcttattgtaaacttactaatggggagcttctcctgcagtcttcgcagcttggaaatcaattaaatctgacatgcgaaagcaatggaaagactgaggcatatactctcaacaacccaaatagcacggaagcaattaaacacctgtgtgttcacctttgcagttaacgatgaatgtttgtactttgatgacaagtacttctcacgcaatgcacatttctggaagagagagagaagccaatgtggttacaatgagatgctctggtaatgcaatacgtttggcttctatggtttcattctgttgtatgtactatgtgatgtaaatgtcagtgggcggttgtggaagatggctaacttgcggcactagttctgatttcagaaatgccaatgcacaacttgcattctaaccttttcttgtgaagatacaaagattgtcttgggtataagctgttgtatcaagagaaggaagcttggtgaatctctccagtagatggtgtgttgcataccatgtataattattatccagaatattagatactgagttgttggatggagggcaaccatggctaacaagtttaggaagtagaactatatcctggttgtcaaataaagttagatcaatccaacacacaaggtcaaggatggctatgcggccccatgtaaatgtcaaaccatgtaatcgcatatattctccactgttgagcttctccaatgtataactatgatctaggtcagttcatttatgcttctctaccactggtcagacatgaatcatgcaaacatgtatgctcagtgagttgacatgagaagatgagcaaacaagacaactgtgaatttgtgacagaccaacatttctattgttgtgtatgttgtgtgtgaagtgttcatgtcaattgtcagactgagaactgttcgtcttcagctggtctgagatgtacttcaccacctccttcgtcgtcgccttcctgccctccctgaagttccagagctcattcatggtgtgccgtccacgaggattgtactcgttgagctcagccatggcggctttcactgcattgcagacactatcaccgtaatctttgcataactgcctcagtttttgatcatcttcatctacaactccctgcaatcgtcaagaaatgcagcagattggagggcaataattcttagatttacaagttcagaaaatgcaacctcagaattcagaaatggatgcggagaaattgaccagtcaccttatcttctccatcaacctgaataatcttaaacggatgccatgatggattcttcagttcttcctgccagtatgagatcagcattgcagctttgccctaggatcatcctccctgtgcttcctcttgcatgcaaggtgaaatggcctctcatcaagttctcccatcctttttatcccaataatcgtgctcgtggtgatcgtcatgttctcgacaccctgagaattgtggccattttcatggatgaaaaatgtactattttgctacaatctaagtcccagttcgagcagtgagaacttcttgtcaatggatgggtgtttaccttaatcaactcctgtcgatattctttaagttcatcgctgttcgtccgcaatcttttcatgatttcagcacatgagtcaaccagcatttctttttcttcatctacaatcgttctcaaacatatcatgatgctgtaaatgtgttcatgatcttcctttctgaggctcccccctgcttgtaaattcatgttcatctgccgtattatggactctagtgactgcctctgctccagctgcttctcaagctgatttaattttgcataaatggcttccatgtcttgctacaataataaacatatacaaataagtttaggcaagaagtgtctaatgatgatcgcaattggtacagatgaaccttgctaataattgttctagtgttgaagataagagaagaaaccttatgaattttatgcagcatttgagcatggacatcacgattcatctccgggatgataatttcagcgatttttcttagctctgcttattatcaacaccaaacaatctctgaacaaatcaatttctgacgaagatattgacgaattcgacatgaatttcgtgcaaaccgttcacaaattcggacagagatatcaacgatttcgccatgaaatttctcacaaacctttgagctcgtcgtgcagcgaggtgttgcccgcctccgcattctgcaccgccccggccatctcctcgcacttgcgctacaagaacacggcccgcctctcgtgctcgccggcgatggccgcgagcttcgccgccaccctcccttcgtccctctcgacgtcctccgcgctcctcgccgcgccgccggcatccccaggaacctcccgaccaagccgtcgccgtcgtgcaggtcgtcctccccggcgggccagccgtacaccgcgccggaggtggcatcctcccctgcgagccacccgtacacggcgccggcggtggcgccctcacctcgccgtcgacgccgccactccctcctcccggcgccggggaagcggccggggagcgacatggcgtcccggagcccggcccagctcttgccgaagtggagcaccaagaagtggtggtggtggccgtcgcccgccgtcgcttcttggagcgcggtggttgggacgccggcgaagtgctgatgagcgtggaa

SEQ ID NO: 45340 - DNA, 1848 bp, Oryza sativa
aagattaggcccagtgatgcgctggatgatcaatcccctatgctattaacccatctaaaaagcatccatgaactccaaaaactctaaaaatggagaggcgattacacttgcgatttcgagaggagatgatcatggctgaagtaaaacgaaatgtaataaatggagatgatcttcctcttaccaccacgggaacgacgaggcctctccttctcgacgcacgagtccttctccgtctcgccgccgccggggcccttcccctcctcgccaccctcctcctcaccatcatcatcaacatcgtcgtcgtcgtcgccgccgtcatcgacggcagcattcttgaagcgcacggaccacgcattggcttcgtcagacaccgcggcggagaggtccccgcgtccgccgccgccggcggcggcggcggcggtcatgtcggcgtgtccccgtaatcggcgggaggaagtgggttttgcgttgtggcgatctttgttttttctctcctcgatttcctcctctcaagtctcaactttatgtgatgctctctagaaaatcttctgtgtaatttttttttttcatttgccgctctgctggtgtctctcccgcgccacttacaaattgtaaaatctagtagaagaatagataatgctcctaaacggatgtctaatgtgattggaaaaaatcttactcccttcccttcccgggtccacaagttgaatgaatcaaaagtgacgctgacatgtgagcccgggtgacaaataaaaatgaaaatttaggagtggtattttgggcatgtgcattttgggaggatgctagcctcatttttcatccattgagctggtggacacgtgtgaacctgaaggagacttatatgtgggtctgggtgctaatgagaatgaaaatttgggagagtgacatttgagcatatgcacattgggagggtggtaaatagtaaattctcccacggctcgtaggcccattctaactggagtacttcacaacgggattgtagacttcacaactacccaatgtgtcatcgttcaatgtctacagtagtagtatcgatttgttggttagtagattgtctgatagcagaagaaaagagaagattgataagatacgtaatattaggtgagctattggcgtgtgattagttgagtattaattatttcaaacttgaaaaatagattaatataactttttaaagtaactttcctatatatatattttttttataaaaaatacattgtttagcagtttgaaaaacgtgtacgtgaaaacaatgcactttctctctcacatatgaattaacttggcatgtctcatgtgacaaaactgaaaagaattttgccttttgtatgttggattcatgaccaaaattcaaaacatgaaggacaagaaaaggaacaaaggtacataaaaatgaataacttgatcaacgatcgattgatcacagacaatgagacaagtattcctagttcttgttcatgtcccaaaagaacttgttttaggggacatcccatttccctcactgagtacgcagaaactaacacttccactactgctaggactactagataacacataagttcacatcatatgaagattaattaaagtgcagaaatcctcatgttctgaagcagatttatgattattaattaactaacatagactggcacctaaaagcgtcactagcaagaagcaaaatgaggcattgctataaccatctttctgaatcctagctccagggcgtaaaggcgtaaatttgaagatttctgaatcctaatgttagttggagtcgtctccttcctgttcttaataagaccttctttgagggcaattacggtagtcgtgggt

SEQ ID NO: 45341 - DNA, 709 bp, Oryza sativa
aagctagctcgagctggctcgagccaggaaacgagccaagccaagcctagcttgttgcgagtcactacaagctaagacgagccaagctcggctcatttccacccctactcttttggtgttggctgttgggactctggactctgccgaccattcttgctgtgcacatctagaaggagatttgactgaacagggagccacttcgccgtcacaccggagggggggggggggaatttaactatttaccacttttagatttgacaattatccaaatacccttattaggtgtgcagttatttttttttccttcttaagagatggtctcttaattatttgccacttttacctacgtggtatgccaacatggcaacctagattgaaaaacggtgtgggacccacttgtcagtctctccttcccccttcatctctccccacgcgtccacagcccccatggaagccaacactgttgccgccgaggcgccgcctcatctgcccggtccaagctgcataggcgcagacctccactccccgctgtgccgccatcgacgccaacattgctccgctgccccaccacgccaagtcgccctgcaaccgaccactgatggcaccgctcgcagccgacgctgtgaggccccttgctgcctcccaccattggaaccctaccagacgctgcttgggccttcgacgatggggatgacgagaaggaggacga

SEQ ID NO: 45342 - DNA, 927 bp, Oryza sativa
aatttttctgtgatctggatgttgtggttagtcatgctgtggctagagccgatagaggtgaccaagtgacaggctgcgtgttgatagcatccttgtttgcatttcttgattatcctattttatttttttaggagtttacagttcatgctggagtcatgcattcatcagagagtcttgtatagtccctctattcgtaaataaatatttttaattctaatgccacctaagcgtcacatcagtaaaaccgctctccaaaaccgctgagggagtcaaattgcactgatttgaatagttcggggagtcgtgctatccgattttgtggttgagggtcacatattaaattcgagtcatcttattccaaagcgttttgatggttatgggccgttttatgtctcctcagttatagccatcgagcggctcatataagataagagaaaattggaaccatgccattataattttgtaaaatttgagatatgccatcttgacccacatgtcattgggttctatatgccattgagataccgatggcatatctcaaactttacaaaattataatggcatagttccaatttacccataagataatgcccgctcgtttcgaaatcgcaaatgcgagtgggcattctcgtgtctatgggccgggtttggtggttgcttcatgatgtgatttaaactctagttaagatttagattttgtcttggttttcgttcgcatgtttttcaaacttacacacggtgcgttcggtaaaaaaaactttttatataaaaattgcttttaaatataaaatatatttctagacttctccggtattatataacattaacttcccagttttggcacatctttacatatttttctaccaaacaaatgcctcgtgatgattcattttcatccagtcacgaaataatccacgattttttaga

SEQ ID NO: 45343 - DNA, 1840 bp, Oryza sativa
aggggaagggctcatgcggcgagaaggagaggcagagtagcccgcgttcgtgtggtagctctccctctcctggtggtaagacctctcagctcagcctttacgtttcgttattgatcatcccctctcgaaatcgcaagtgcaattgcctctccattctagtctttggagttcatcgatcgatgcttttagagttttaggtgggtgaatagcagtggggatcgattatccggcacagcgtagagccctgatctttggtaagaacagttagggttttgtcaaccgctatatttcgctgtttcaggcgttaattccagtctaatcaatgatcgattgacagattaggatgctaatttacgtgctccacacatttattgcgtcattcttttactcttgcagtaatttgatggaacgtaaggattaggggaaattctcttttttcccccgaaagcctcagaaaatcccagccccaaaaatgtggggaagaatataattttttaatccagtgcagccattgttgtcatagcaagagtatatcttttttttttctgtcattttgtttcccctggacgttggctgtgtggagaatgtgtgcttcttttaacatcaagattaactgcaaatatgttcaaatgcagaggaagtttctgaagatgaatatgttcaggttggtggagtgctggaaagaaggaagaggaaagcaaccgtgacacctggcaagctgcagatttctaaaattgagacacctcataagctgcagatttctgaagttcagacgcctcataagctgcagatttctgaagttgagacacctcatcagctgcagatttctgaagttgaaatcaagagcaaagaagttcaaggtacaagctgaactgcgtcatctattcttatttgcacagcaaattgaggtgcataccctgaaattgtgatttctctgcattcagctcttgtgctggctcaggattctcaaaggatctctcaagagaatgagaatctgaggttgcagctcgctctcaagacaaaggagctcgagcatgaagagaatcagaagctcaggttacagttggagctgaagaacaaggacattgaatccctgaaaaagccagaaatggattggggaactgaaagctgagatcgagtactacaagaagactgtaagttttatatgatgttcttcccatttctttcatagtatcatgtacctagacttttaacactgcgaaaaaactggcaatacatgattttcatggtgtgaggatatcacgtcgcatgctacatatttcttacacaatagacgtggtttacatatccaatctctactgttaggcacacacaactgacaaatttgttgctaaaataataataacaaaagaaaaaagagagaagcctagggtgatgggacaaaccccaactccccttgttctgatgatctataagctgaggaggaaatcattttagattctttcgagtatcatgctagatatctcttgtattctcaactaaatgctagtactactaaaaggcgttctttgtgttatggttatttcttctatttcgcgtcatccataacaatttcataggaagattgataaggtgaggatattaaaccatagtccataggtgatgaaatatgtcaggatgattaacatgaaaactaacactgcttttgatcatacttgaccaatatggtgaaggcagaattcaatttgctgtactcacaactgttttcttttttccctactggtcaaccgggtgacaaaattttacagtgttggagtggactgctccattatatcttattgatgattgattgttttcttattatttgaggaacctatca

SEQ ID NO: 45344 - DNA, 2083 bp, Oryza sativa
tttattaaatttaaaattaaatatattttgataatatgtttgttttgtattgaaaatattaatatatttttctatagacttgatcggatttaaataattttgcttaagaaaaaaagttaaaataacttataatataaaatggagggagtacattgtctatgtacatctatctatctatctatcttctatctattatatactaaaagtccattaaacttcctacaaacgctctcatgctgccacattgtgctctaaaaacgctctcaagctgctacatgacgctataataaaatagaaaaaacttaaaaattctgagaagaaagaaaaaaatctagccctcgattttcatttaagttggtggacccattagtttacaccattggattagatctattataaatagtaatctatccctcctaatttaccgagtaacactttccataaaaaattgaccagaaaaggttgagaaggcatacgtacttactctacaaattaacaaccatcactgagaaaagaagaaactatatacggcaaaaaaatactgtatacgtacgtactactggaaatttaaaaaaatatatcgctttttttaaacttagattttcacttccgctgtatttttttatgacggccaacgttaaatatttagtgaaactaccgaaagaaacaacgctctttaatctggattttctgttatgcctcctttgtatttttattttttttatatattgatgaccaacgtcatatatttggtgaaggtggtagtataagaaaaatatattatttcacaaacatacacagccaaaagtagatctataatataatataaaataacaaataaatgtatcatttcacactattattgttgagtatagatagaatttattttcatcaataagcctgtattgatagttcaagatgaaataatgagtaattaaaatattactcaggacattgttgaaaacacaaataaaaaatgtattttctaaaaatatgtcgcatgtttttctcgctaaacacggtcagaattttagtcgttaatggctcaatctacgcttttaagtacataagtaacaaatttaaggttgagttgtaatgtgcttatcagattggctcccttatttatcttgagcatgctctctcaactactaaacttgcatgttgtgcaaatacattctatacatttttttaataaaaaaactattttcatgtttgtaatatttaatacttaattaatcatgtgttaatgacctatatcgttttgtgtgccctacataagctcaaccaatgagatcgaatgtagcctaagtagagataaattagattatttactataaaatttaaaattaaagaaccaagttaactatattattaaaaaacttcattacttcggattatatatattctacggactacggactagctattgttcactaatccatacatttttaagaaaaaatcaaattgattttagcgtcccttccctctctcttagctataaaactaaaacagaaacaaccaataatattggaaatctttcagaaactgcacgcaccctacccctttagtacctctaaaagaatgagccggcacattttgagattgaagaagttaccacgacgtcttgctgtcgatgggtacgtcacctactgaaagaataattagtcgtaaatactgatacccatgtcaaatctaggacatgaatccaggtgggcaagttccaccacaagaaacctaaccagttgaggtgcgctcacttcgcaataacgttggatgttaaaacaaccataatttttaaactacatttctgcaatactcctatgccttttaaaccagtaaactattagttataatcgttaaatctatcttacataataaaaaaataagaatatattcatggtacatgatatttttaaaatattaatgcgcaattatatttcgtcgttatcgtattcatattaggctgcatggagcctctcacccaccctacatgaaatgttcatatatgatcgcctctcaaactacatcaatcatattaaactatataaacccaaacatttagtggagcttcatgttccaccta

SEQ ID NO: 45345 - DNA, 4677 bp, Oryza sativa
ctcaaacttagcatacgacacatgcccgcgtgaatgcgtgggctatcttcctagttaaggataatagaggcaagctatttctttgaattaatagagagatctatagagattgttaatgtttgcttaaaaaacttaaaaatacacacttattttgattaatgcttgtcatactgttagagaatgttaccatcggcaggagcggatctaggtggcttgaggcttttggactaaaacccacatagatacattatatattttatttcatctcagtaatttttcaatgtagtctaatgtagacaatctcttcatatctagacgcacaccataagtccctaaccatctatgttatatgagtgaattgtaaatttaattacccaattcaaagtagaaatgatttgttcaaggatagtctaacgtgaaactttagcaataaaaaataacccaaactgtaattcagtcaaaatatattataaatatatatcgatcagcaatagcaaccacgcaaaatatatactctttgggtggtttagggcgtttggtttaagtactgagatggtcaactgatgacttgattctaattaaatgtgtagtttggtctatatatatacatgtaatgggaattggtttgcccatcgatcgacttcactcatcaaaagcatatagtaccaagtaaaaaaaatatgacaaatgtaacgttcaactaaatttgagatatgatctcataataggtgacccatatcctagatggttatttgattcctcaaaccaaacagaccgttactgtacatacgctgatcctattgtgtcgttgactttgagtcaacactgtcctcaaaacaaagttgctctcaaaatctttgggagttaaattcttatctcatcttccaaatggtagctttaatccattagacgaagaagctaggccggcacgcgccgagaaaattccatccaggccagccggccaatagacatgattgatagatccaccatggatggctgcaggcacatctgctggttgcatcgatcgagctagctttttagactttcctgtgccaggattttcggctttattcccatccatttcatgttttcaacacatgaacagtagtattattcagagatagtggcagagctagaaaatctacacgcgtagggtttaactaatggaagtttaaatattctcaaaaattgcacggtatcgttcaagattacaattaatggagatcatggagtcaggcatgaggctcaagccctagttgtccatgcttgtttgatttaatttgttcgcagccctgcgtcaaatagtaatcccctcgttttaaaatataagtatttataaaagttttagaagaaattaagatcgagatgataaatagttatgattggatctgagatgggacatgagaaattaaagtatgtgagaaataaaatgagacataatagtgatcggttgagacaagaacataggtgaagaaatgcttatgttaaaatattaaattctaatattgtaatatttaatgcatgctaaaaataaatacaatttagaatggaccgagagtaacaaacagaattgaagttgacattcacacaagctagctcatgccttcattctaacatatctactaaagtgtccatgcatgtgacatgtgtcaatgtagtgcgacagctttaagctagataggaggaagcttcattccaaacattgatggagatgcaagataaaaattaaagaaagctgtatgagctagcattgatctggttccaaactcatccacaagaccacaatgtatggtaactgtgaactgtgaagaaaggcacacacatgcactctttgtcaaggcagcataccctacttagatagccaaattggtcccttcgatgtggagacatggagtagtgaccctccacttgcagatcaaggtgattgtgattccatgtatcctgacctccataacaagattccaatcgaacttttcgtacttgaagaacactttatataaatgcatatatatactcacaatttcatacaattgttttgttctagccattaacgaataaattagtgtcgtcagtatacatcatgctgagctacccaaataactattgtatagaacaaccgacaaaccaataatcaccaggagctcttcattgactaggctttacggttgttgctggctccatcactataactacgtaagtgtggtttgaacaaaaattaattaattagaggtcaatttaattaatttgaaggctatgcttgagctttactcgtgtcaataggagcttgatacatgcatgcttggtagtggggagcatcatgattaatcatttcggaaaaaacagtgacgatatgttggttcgttaggtgaagaaaggcaggacattccatggcaaccgtccagacccatgggaatgaatttttgaacgtggaagaacctaagctagaacctccttttctccctttttttctcttaaatataaatatatatatatatatatatgcatggtggctatcaaatggtcatattttactttattttcgctcttgaacacgtgaggccgacaggtgggtcccactggcccactgccccggccactatacattagctgctcgatttaatttcctgcagctgatgatgcgatcagtgatgagtgcatgctgccacttggtgtaactgagagactgatcgagagccattctgagccactcaatctcatcccgcggtgagatctgaatcttgccttcctggccgtccacgtgtacattacttggtggggtataatgcatctcagcacgatctttacttgcaactttttttgtttcggccaggggttgagaatccggcactgcctgcaaagttgccaccgctatggtgtcgtaagtgggatgctatatgtatacgtgaatctatttttctttcaatcttaatgttagtaattatagtaagattctaacaaaagatatagtaagatcaaaaatataccactggtctaagcggactagctaggactcaagctctaggtctaggatcttaactccatacaaattctttacaaatttagggaaaaaaatgcttggaattatatagaactagggcaaggtgaaaaactcggtcttttttttaagataatggaataacattccgacctttgctcaacgagttacattcaattattacaaagtccacacatgaacaatctcagcacacactaacataacataaagtaaacacaaactagtaaacaccaacacaagataaaagaacccacaattactaaattctatctgagaatctctatctgaagttggtgtaaaggtgcgtaatcgtcgactcaagtttacgacatgcatactttattagcttgatatcatcatcgtgcctttgtagttgagcctaaccctggagtcaatatgttgccctaaaaagtacctgcaaataagaggttttgatagtgttttaataaaaaaatcatattatttctactaaccaaatagcccaacatacagtggaacccacgagccaatttccaaagaacaagaaatgtgcggtgtttgctacgtgtactgtatacgtatgcggatattctgtaaatcgaaataaagcttgtcacatcctgtacctgtgtaataatgtaagctaggaacagcaatgttctagtagttgcatgcagcagcataatatataatcaggccgaaatgattcattcctcgcctttaatctgcatttccccttgtctttaaatttaggccatcaatcatgcctgagcggcttgattaatgttctttatttagtgatcgttccgtgcggattataatttgattgattgatattgattccttctccattgttttgcacagcttgaaaaattcgtgcaggggccccaagagtcaaaaaggagttttggctcactctcactagtcactgaatttatgtactctccagtctccactagaatattgaggacttgagattagaagatgaaatattagtgattgtcttgttatgctcgagaaactctcatttggtatacacattttttagtatgattttatatgttcgactgcgtacatcttagttatgtatagactagaaatgttcttagaaaaatcatatcaccttgatgtaatactatatggagagcatatatgtgtgtaattaattgtgaatactaggacttgtatcttgataagtactcttttatttttctttgtttgatgtaggcaaaatatttccgaaaggagatagtagaatatgtatattttttatagataatagtagaatatatatgtatatatgcacccagccacccactgctctatcaccacgtatctgtcttgagtggttttgttagcgctttcataacctctcaaaaattgtttgaaatgtttcaaattagtaatttgtgaacatttgacctttgctagatacgtacgacgacgtacatcacggagtcgtaaagcacaagatacaaagacacgagtcgctttttacgtgtggcagcatgctggtgtctatatatgtgcagccccgtgaaagactgaaagattcttgacattttcacaaacaaacgatcgattcttgacattctgcaatacactatagccaaactattatccaacactcaagtctctttctatgtgcgatcgccgatcgatctataattgctacttccttt

SEQ ID NO: 45346 - DNA, 11263 bp, Oryza sativa
atgctagaaagttttacattgtaaaacggagggagtagctactaatattattattactggttaccactggttaattgcgttgtatatatataattaagttaattcgttggaggatatctctatacacaaatattaattgcttgcacgctatctacaatttatatatgcatatattcatcgatggtaacatcgatcgaataaagttggagcacgatagctaagttgttgatcgatgtgtaaacacatttgtttttgtcgtcaactgtttgtcgtaccaaatgctagcctcttggggcaatcttgtggctgtcgtgagccagaatgaatagcagagattacgctagcttagctagccctttttgcaaaagctgatatatgcgaattgaaaacgaagggagaattgtgcaagaacagtgtacactggatcatctgatcatgtagctagctagctagcacatggttgcatgtaagtgtgtgaccccagctgaagagaagactcgagtgttgacgaggagacaacacctagttcgtacatgcggatgtcgatcgttgttataaactttaaactcttcagcagttaggcccagttatattcttcaattccaaacttcttttttctcgttttccgttagcacatttttcaaacggttaaattgtattttttaaaaagtcaatatataaaatttgttttaaaaaacaaataaatctatttttaaaatttataatagttaataattaattaatcatgtactaatgagctttctcgttctgcgtgcaacaaaaatctccctcccaagcaggagatcgaacgaggccttagagaagcacatagccaatgcacatctcattagttccataattccacacaaccactagtctgaaaacacccacaaatttcagtcacttttaattagataacaaactcattaaccttagtaccctttcctccccatatgcgtctttcctgcaacacatacacctgcgctcatctcctctgataccatcatctccaattccaaccactccccgtagcctcgtcaataccagaagacgccaacaacggtattagggcccgctagaccagactagcttcttcatcgtgcccaaaggggattgctaggttgaaaggtgaccgaaattccttgcaatttcaattagcaatccccctatgttaatagttaacacttgaattgcttgaaaatcatgcatccattacatatatatgcacatagagaaatcctgttaacatgtactagtattatcggacaaggttattagcttaggtgacctggagcatagctagctaggtagcagctgcaggaggcaagtgctagcaacaaaagaagaggaggaagaagaaacatgtcgatgtactagggatgatttgcagtgcgtcgtcaaagcaaacccaataattgtttggttcagatgcttgatagaccataaagaatggacggcagataacaggtatttttcaagaaaagagagaagctccaatcttgtcaattaatgcctcctcaaaattaactttattctaattttctcccccctgtcatttcattgttggtatagtccgtagtatatattgttagcccattccattcttattccagctatataggtaacactatattctagttagctagtgtgatagtgagatggggttcccctcgtttcttacgtacatccacatttataattattattatttatttataatttatagaagtaaaacttaaatttgtatgtttatgaagtggtatataatacattaatgaataaatttcataaaactatatatactttcatcaaattatcacaaaactacatatttaaggtgatgtaccacaaaattacagatttaaggtagagtatcacaaaactataaatttagtaacaaagttaccacaacactacagattttggagtttaaatgcttagcactagtgttatatttgagttataaacatgtaagttttgtgattaaattttcactaaacatgtagttttgtgataattttattactaaatctatagtttggtgatactccaccttaaacatgtagttctatgagaaatttaatgttaattaaactagaaaaaatacccgtgcgttgcaacgggtgaagtctattttaatcttattattgttatatggtttaggtaagatgacattattcgctgtgggagtttgcttcgatatatatgtatatatatatatatatatatatatatatatatatatatatatatagagagagagagagagagagagagaaaatcatgagctgtagttaggagtccgatcgtctcaagttagcatgtgagtttttttaaacatatttcttatatgattccttctgtattaccaaaagtgaacgatcttaaaacccgactcaaatatgaatatgtatttccaaaaacaaacgaacttaaaaactaactcatacacggatgatgtaccaaaataccggcaaaaacatcttcaatttttatattagtagagaagagatagagatagagaagatatatagattaaacaaaaacataaaattaaaaccgactcaaatacggatgacgaaccgcggaaacatcttcaatttttataaccgactcaaacacgaatgacggactacgaaaacaactccaatttttataatagtagagatttagttatctttcccggtatagatgcacaagacaagagacaagaagagagaagaaaaaaaaagaagcaaagaaaagacacaagaaacgccgcacagatcgcctttttgagcgtagaaaatccaccgctcgtcgtcgtcctcctcgcgaaacccaacccgcacacgctctctcctctcccctccgcttacaaaagggcctcctcctcctcttcctcctcccccatcgccattaacccattaccacctccacctcgcgcactcagtctgtactacctgtacgtacgtggccgccgctagctaagctaggaattgaaatggggatggagaggccgcaagagaaggtggccaccaccaccaccgccgccttcaacctcgccgagtccggctacgccgaccgccccgacctcgacgacgacggccgcgagaagcgcacaggtgggtgtatgtccggtgtccatggatgaggtagctagagctaagctaattaagcaagctaatgggttggtaataacaatggcggcggccggacgaacacttggatgcatatatgcagggacgctggtgacggcgagcgcgcacataataacggcggtgatcggctccggcgtgctgtcgctggcgtgggcgatagcgcagctggggtgggtgatcgggccggccgtgctggtggcgttctcggtcataacctggttctgctccagcctcctcgccgactgctaccgatctcccgaccccgtccatggcaagcgcaactacacctacggccaagccgtcagggccaacctaggtaaatttaattaatcactacaattactgctaattaatactgtaataattactgtacttagcttgttactaatatggagatggagatattttgtgggtgcaggtgtggccaagtacaggctctgctcggtggcacagtacgtcaatctcgtcggcgtcaccattggctacaccatcactacggccatcagcatggggtacctactgtctactatgactaattactctagtaaatttgggcagtaagcttttagctatgaatcagtataacttatgtactcttgattgtggtttagactgtgtacaccttctgaggtgtagaggccgggttaatataatccattatctaaaaagtataagtagcagagtctgtttaaatttatatgcgttattgttattgtattttaggatggagagagctagcacgtacatagtagagtgtggagtaagcttaatccttgattaggacacttcactaacccattcttcacgttactgctactgagagctgtagactgtagagtgagtagcagtagatgagaaaattcagtcaatttaattagccgtgcaagcatgcatgatgatgcatgtgtacaagtacatgtcctccatcatatatctctgcatgcagcctgcccctctgttaatttgtttgtttgtaactatatatctaggtggtaggataatgttttgcatgtcccaaattccgtttagctttcgtcagcttcttaatttagtttctggagcgcaaatatatatctcatttccataattccacgtgcctttacttacaggcggcacgcccgcggcccgaccacctcaaaaagaaaaaaaaaatactccctccgtattttaatgtataacgtcgttgacttttcgaccaacgtttgatcattcattttattcaaaagttttgtgtaaatatgaaaatatttatgtcatgcttaaagaacatttgatgattcatcaagtcacaataaaataaataataattacataaattttttgaataagatgaatggtcaaacgttggacaaaaagtcaacggcgtcatacattaggaggtagtatatgttttggccatttgcaaaaattgttgtcatagtgaatgcgtcgccatgtttaattaggtttgacagtatgattaggacaacataggtaagaggctactcataattctcaaaagcaaagcaaattgtaattaaagcattcattcattctctgaaatgtcgcatggctgctatgacagtcaaattaattaggttgagtacgttaggtggtcttcttgaggatccaacaaaggcaaaaaaaagcagagtatatagtgggagagaaaaagttggggaagataacattactggacagttcaaaagtagttggaaaatattcagattctagtgagtatccaaaactttttccactgaaaaagaaacagcgagctaaaaaggagtggttcttgctctgctctgcatattggcatggctatggagaagaatcttattcgtgataagcatctactagactactaccactaatgattgataaacaaaaaaatcagacacttttaccttgattcctacctttcatttcattttcagtacactcctttttctttctgatatgattttcgtcagtgttactctgaatttctctgaatactaacatatggttaatttacaaatctgttgatgatatgcagtgcgatcaaacggtccaactggttccatcgcaacggccacgacgcagcctgcttggcatctgacacgaccaacatgatcatatttgctggcatccaaatcctcctctcgcagctgccgaattttcacaaaatttggtggctctccattgtcgctgctgtcatgtcactggcctactcaaccattggccttggcctctccattgcaaaaattgcaggtaaatatataccatctgatatatatggatgacaaaaacaaatttgtgtggctatcttattcttaggattgcaagaaatatttttttctggttctcgccgcacatagaactgaaactggttcctgtgaaaatccgacaaaattcttgtaaaaccgctactttccaaaggagagacccaagtcctcctcggtccaaaaatggagaccaagtctttaatttacttcatctattctgttcccgtgtacacatcatgcaattaattcacaagggaaatggacaaaacaaagaagatatgatgctgatattataaatatacatttttggtagggcagaaacaaaattgaggcgtgcaaaaatgtatatacatagcctgggacacttgacatgttggtttttgtttgtatcatccatgttgggggggggggggggccatgatgcagtgcatttgtatgattgaattcatgtggttctctgcaggtggggcccaccccgaggcaaccctcacaggggtgactgttggagtggatgtgtctgcaagtgagaaaatctggagaacttttcagtcacttggtgacattgcctttgcatactcctactccaatgtcctcatagaaattcaggtaaattaattttaattaacctttgcttatatttctcttgatacaaacatgagcgataagctatctttttcagtgaaacaaatttagacaagtataaaatgagaaaagtaaattgatgtagtactctctccgtctaaaagaaaaaaattaaactctaaggatgaatctatgtgtccaaatttatccctaatatttaattctttttaggagggaggaaatagtacattaggaaaagtgagagaaaaaaataggaggaaaattttggggatgttccgtatgcccgtgatcttttgagctctgtcaaagaggacagatttctgaaagatagcagtatgggtgaaccctacaagaggacagattttgcagtttcctgcacatgaaaaatactctgaaaaatacagatatattccttttcagaatcttggtcatactggtcaacatagagtctctgttcttcattgaaaccactggttttgccatgaaatttgcaagtagatagcgatatatcccttattatacttaacctgtcggccatcaaatttcagatcatgaatcggcagtcagaaattcagagttcacatgcaagaacatttctgaaaatgactacctaatctaattactaataccatttctgaaaatgactgcctaacctaattactaagagcaagtttaatggtatagcatagtactagctccaaattttctatagccaatggaatagccaattcatacaataattacttgctatactagtaatacctggtcccacctgtcacacacattacgtcttggagtccgtgctgcagctggctacagatctgtagcccgctgcttttctctctcttcttttatctctttaaaatatgtttatagctagcttatagcctgttattgtacctgctctaatactatatgagcttcaaatcttgaaatgtctttgtcctcaatcaaaatactgtcctttcctttggcgttttgatggatgacaaaaatgagacaagtctcgaggcaatacatttcactgcatttattgcacatttacgtctcacgcaaatctcaacgcaactctagtggtacttctcctagctaggtcaatattgcaatcaaacacaaatttttacactaatttgtatgaagtagtgagaaaataatttgatgcgttttgagagcatctcatgattgggtaattttatcatccgataccgataggtgagttaccgataggtgagtatcttcaagtaatatgcatgtatctagagatattaaaatatactattattttataaaatttagatatctcgagttaatgtactgtaattttttttctatccttaaaaatatcgggaagtataaaacttggtatcttctgatactatgtattctgatataccaaaatttttagtctaaatctcgaactaccttttcatttcaagaaccgtaaaatctttcctatcctttttcttaaaaagatatcgggaagtataaaacttaatatctcctgatactatgtattttatgtattttgagataccaaaatttttagtctaaatctcaatgtactttaatttttcaagaactgtaaaatttctcgaaatgacaaaaatgtgtgcgtaaacgtgcaggacacgctgcggtcgagcccggcggagaacgaggtgatgaagaaggcgtcgttcatcggagtctcgacgacgacgacgttctacatgctgtgcggcgtgctcggctacgcggcgttcggcaaccgcgcgccggggaacttcctcaccggcttcggcttctacgagcccttctggctcgtcgacgtcggcaacgtctgcatcgtcgtccacctcgtcggcgcctaccaggtcttctgccagcccatctaccagttcgccgaggcctgggcgcgctcgcggtggccggacagcgccttcgtcaacggcgagcgcgtgctccggctgccgctcggcgccggcgacttccccgtcagcgcgctccgcctcgtctggcgcacggcctacgtcgtgctcaccgccgtcgccgccatggcgttccccttcttcaacgacttcctcggcctcatcggcgccgtctccttctggccgctcaccgtctacttccccgtccagatgtacatgtctcaggccaaggtccggcgattctcgccgacgtggacgtggatgaacgtgctcagcctcgcctgcctcgtcgtctccctcctcgccgccgccggctccatccagggcctcatcaaatccgtcgcacattacaagccattcagcgtctcctcatgatcaaattaataattatttgttaatactgatgatgatgatgatatgatccatcgatcgatgaagaacaaatatatatatatagcgagatcgatcgatcgatcaagatcgtgaatgatatatataatacatagttaatcaatcagatgttaattaagtcgtgttcgtgcgtgtctttcagagttcagatcgacaggttgatttgagatgagtgctcaagtgtttcgtcagatgtaattaactatgtaagtggtaaatttagcctgatgatgatgatgatcagtctgaatggatgtcatgtaagtggtaaatttgacatgaatgtaacaaagtagtagcttagttgcagaatttcagtagcctaaatggatgatatatcagtctgaacttcaataacaagttaacagctagatttccgttgacaaaatcgccatatatatgcttgaatgtaaggtgaagattattactgttcaggtggtctagtttattgtagttaacctcaatggtcatactgtcacaaccatatgagtgtcaaagtctgaccatgtaaatgacgtaccagttattattaattgtgccatgattgtcagtatcaactgtcattgttgaatcctgcctctgtaaggattcaaaaagttaaaaagttttcagttgactatatttccctgattaaggtggaaaatgagacatatatatgcttgaaagtaaggtgaagactataattcttcaggtggtgtagtttattttagttaacctcaattttgtcagactgtcacaacaatatgaatgtcaaagtctgaccacgtaaataaacgtatcatttattattgcgccatgattatcagtcgatctcaattgtcattgttgagttctgattcctgcatctgtaaggagtcaaaagctaaaaaccaaggttactgtcagtcatgttgaagcagggtacagaacagaatcaccatatgatcttcttcatcttctagtaatttacttgtattctccttcactcaaccgaacaaaatatcccaactggttagacttatgaaaaagcaaaagaaagaaagggagaggatatcaagacttgcaacatctgaaaaaagtatacaccatgacttgcatcatggtattactcattagtcagaatcagcaggggatgaagtttcaagcaaagtgttgaccaacaactactactcgccaaactctccaaatcttttacagcattcaactctactgaaagacttaaaagtccaaaagggaattggtttttcacccaaatgatcagaaagttcatgctgatgatagcctgaatattactcctatgtcacaaaggcatgcagagaaattattttcaatttacagctgcacacaggatgatgcattggatgttgccgctgaatcttgtgtgaggtaggcatagtctgatagtcatagcggcgcagtcctaggcagagcagaatactcctattcctatacatatatatagcagatagatagagtagaagcgagtgcaaagtcaaggatgcagccaatgcttacgacgacgttggatttggatatattggtgtgaggtccaaggattgagtcattattgagactgcgtttgatgatgatttgatcatctttcttacacaaagattggcaccttgctagcatgcatatgcatgcatgtcatctacagactgctagaggcttatcctgcatgctgattcctgaacccattgacctttagaatggctctatctgcattcagattaaagtggcagatatgatatgagatactccctccgattgtaaatatgtgttgttctaataaccttaattttgaggtctatacaccaatgaaattcctacgatctggtagagcccttatcctgcaattttgaggccgttttcacaattttagccatctttgcattaactgatataattacgtaagtccaaggcatattaaaggatgagtctggcataggatcttcaaaaatcatattaatttattttttaagtttttcgttaatacttaattaatcatatgttaataaaccgctccgtttcgttgcttggagggaaggttcccaaccttagctaacacagccttagagcaaatacaatagcatatgctatagattagttacaagcacatatagaggagagagagaagaaaaacgggctgcttgtttgtagtcagctacagcataagctatatagcgtgtgtatgaaaggtaggccaaatattaatgttgcaatatgtatttatataaaactattgtatgcataggctattagattgggtgtaaaaaatgtgtcaatttttaaagctagcagctggttatattattaaacttgctcttagaggctaatctcttacaattggctataccatataataaaattttctttttatgaatggtaagagtcgatattaagccaacgtcattaagtttaacatggatgtttctgtctcctttccacttatttgccatgttagcaaatttatcatgttggtagccctaagagcgctattaattgttgttttttacacgtgtagaacgaccaccatttcaaaataaaggggttagatatgaaaacagtaacaatgcatcatgatacatgcatgcacaagctctagctgtctgtgtcatcccttgtttttcattcatggttactgaactttttagagcaattgttttttcataactttttctgaagtctactacctaaatccacgattccaacaagccattactggacctactatattgggccgtacttatgggccttacggttcatgcaaagcaaccgagtgcaagtccggcccggcccggcccatattctctctaggttgccttggttaccctagccgtgccgctcattccccctccgccgccgccaccgccgccgccgccggaattgctaggatccaccaccgccggaattgctaggatccaccaccgccggcgatctccagcattatattcgccggtgttctcaacgacgtggagca

SEQ ID NO: 45347 - DNA, 5046 bp, Oryza sativa
tttgctgttattttgtaccttgcactttgtttttgtcatactcaggtcgcggtttcagttgtgacatgaactgcatttttttttcagatcatgagtgtagtaagaaaattaagcccggtttcacaacatgttaagtacttcttgcagatacatgttcactttttttctcaaacaaaataattgtgcattactcgaataaaaatgaggatacaagacattgcaatgatgcaagaggatcatgctcacaaaacaaacttcatgagtttgaacctcaagacagcagtgcatgtactactgctattacatagaagacatgtattctgttgcctcagagaggcctaactaagaatcttaaacaacgacactttaattttgccccaaagaggcctgattaagtagtttaaaaaaactaattcagttccttggtgccctgcaatagcattagcatatcccccaccggaagaaaactctggcagcatatcatagaaccaccaagtgcttgaggaaggctgtaaccatcagcaacttgacctataaatttccatcgatagtgtccaattcagcaagccagtcgatgtcagccaaaaactggtcatcaataggaggagaacacaatggttcagcagtagcaatgccatcatcgctgacatcagccaacaactccaaaaggaaactgtcgctgaaggttggggtatggactgcattgtcattctgaggttgctctacgggagtgcatgcttgcacttcagcgggtggctgatccccaaaacgcatttgccattgcgtcagcaggggaaccgccgatgattgattagtaagtggctgttgcaccaatggagcatgcattggaggaggtgccactgtgttctgcggcggtgatactggtggtaattgttgggatggcactaactctggagaaggaaacagtggtggccgtagcggaaatatctgagaccatggtgagcccggcactggaggcggaggtatcatcggaactcctgatgtccctccaggaagtaatggagtgaatggacggtgtgaggccaagaagcgagaacacgagggctgctgatgtgcccacgcacttgatccaccaatttgcagcttgctgccacgacgtaggggaggcagccgcttcttgaaatcttgctggagcggcaagagtacatctaaaagttcacgcatatcatcgtggctgagatcctctagcctggagaatagatgcttggccatacccatacctaagctctcttcttgggcctccttgaagcgctggattgattcttcagtcttcttgtccttctcttcttcttcattctctagctggaccagctcactttgcattgacgtaagcttggccttcagttgttcatcggcaaatggctctgcctcagatacaaaagcatcgacaacaggtttcaccgatggtgccccaaagaattgtgcctgttgtaaataatgcaataatataaccaaatatttcaaacgaattccatttaacattacaataataataatacaattcaaggtacagcatgatgacatattcataagcatagtgggacaacagtaccttattgctgtcatgtaggcaaattgcgacgcttgcatcagtgagaagggagaggtcatttgcaagcttgaacagcccatcacgcctcttgctgagggtgaggctgcgatctctatcctcttcgatgtacctcacgcctttccttctacccctcctcaccatacttgactagtaaatagagagagaatactgtatagtatacggtgtagcttgctggctacatatatatagcgagaagggcatcctcaaatagaaatcaaattaatacgataccaacaatatctaattatagttttatggtgagagacatttttggatgttgaatggcctaaaaacgaaagcgattaactacataccatgtagctaggttgatttatatggtatgaaatgcatcctccaatggataatgggaactaccgcgtgtaagttgcaaatagttcctacaaatctacagcgagaaagccattttccaatggaggatgggaactactaatcgattatagcttgttggagacctattttgagaaaaccatactccagtggagaatggaaattgctatgtttgcaaatagcttagtggagatgtatgaggggaagacattcgcaagggagaacgagaattgcaattttattgctgcaaatagcttgctaaaatctatgagaaaaccatactccaatgagattggatactactatgtgaatgctatagaaaacttcctatagatcacatttaccaggaaatgtgctccaatgattgaaaaagaagtttcaatccttggaaattgatgcctaaattctgtctcataaatgtcctggaatggagaatgaaatccactaagctataactgcaaatagctttgcagagatctccgtttagcaggtatcctcaacaattggataatagatggactactattagtattaagtgattactgcaaatagttttatagagatctacgtttagcaacaaaggtatcctcagtcggataatagatactattaaatgattactactgcaaatagttttatagagatctgtgtcgagcaaaaatgtctcctttgatcgatagaagtgataggcaccttatatagaaggaagtaagggttgtacatatcaagatgcttacgttttatttgtttggtggataaacactctcataaaagctccacacaatatcactgacaggtggtacatccttcacattggcatggtgagctccattgtaagtaccagttacgaagtctttttgcacacaacactttgtctttagcatggtaacataattccaattcatcgaagtgtccacaaatgcgtaattctaccaatacatgctgatgagagtacaacttttggacattcaaatatttgcagataatccacacatgccaaaggaaagaaaaagaaaagcaacagggaaaaatagggataagttatttgattcataggttgaagagtagcttttatgtattattctaaataaatggattgagattaagtgtctggcattaattaattgaatgtctattggcagtgagtagaataaaacttgtattagatgcaaaaaattccttggggtctctgcctagatcatcccttgatgtatcagcgtgtataaatcgtttgatcattgaataataaattatatggtgtatgtttaagcaacagtgacagaaggtagaagacagattgttgttggaaagataagatttctgccttgatttccttctctggtattcctaaagaaaaaagaacatacttgctcagatccagactaatatagtagaaaatgccaccttgttgcaggaccctattgtgcaaacctaataatgctaggttagtgatccttgatttgaattatgatatatgtttgcttctaattggctgtggaagttggagaattctgatccagactagtatagtaaaaaaatgccaccttgttgctggaccctattgtgcaaacctaataatgctaggttagtgttcgttgatttgaatcttatgatatacgtctgctttctaattggctgtggaagttggagaattctgaaggacctcgacaagagatgataagtatgcaggcaaggtccactccattgatcactgcaaatataaagcttctgattctcgttttatcttgtttggtggctgttaaggatgtgtttttgttcttttgtaaaaaggtaactaaccggtaatgatctgcataggcatttcttggaagcagacaatttccttaacacttaagttaattttgacgggttaactttgggttttttggtgatctgaaaaagcaacagtgctgcttgttttcggaaagcgttgctcactggtctcactgagattgtgttcaaatgtgctattgtattgagttttggcttcccttgcagaaagaagaacgtcgtgtggaacttcaagtgggattacggtgagcgagcgggaagccactcctgggaggcagtctgtgcatttaactggaatggtttttccttttggagttgctgaatgctgattgttgacttctagaaaggtaccaaattggcaaatttggctctccatctctccacagaattccctctccatattccagtgcactccaacagtctctccatatcccaacggctagttcgctctccatattctaacacactccaacagactctccatattccactctccatatcccaacggctagttcgctctccatattccaacacactccaacagactccatattacaacagctagttcccaacagctattttgcaacactatatataggctccttctctacctctctaccaggctaccacaacattcttcttccttgtttgcttcttcacctccacaccacaaatgaatcactttggcttgagcttatccatgcaaattgtgttggagtcgtcgtcttcagatgacgacgatgaattcatggctgcaacaatactcctagtacacgcacactgccaaaccaggagacgacgacgacgacagtgatctgaaggcagaactaggcggaggcgacagagggaggagctggcgctgggtggagccggctatgcgtgggacgaggcggctgagctcaatgaagctcaggaggacacgccaccaagggaagaggcggccctggtaggggtgaggcggcagcagacggaggagccagagctggggggagccggcaatgcgcgggacgaggcagccaagctcaatggagctcaagaaacgcgcctccgaggcggcatgggacctcgagcctcagctcggtgctctgctagaagatggagatgatcatcaggatggagagtcacaggggctgccagatttagccacctgattctctcatttacatttagccagacagatggaatagcaatgcaaaaaaccaatctgttgagcacctgtttttgcatgtttgcttcttcttcttttgttcttttggcatggagaatgagatagcaagtcccttggagatgtt

SEQ ID NO: 45348 - DNA, 13009 bp, Oryza sativa
attgcatcagccatgcactctgttttctactcatggttcggctcctgtcaatgaaatgggtccttgtcgtctgattatgaaagaaacaattggggtccctgcgtatgctctgattccttgctactctggctacatccatccagttctgaagttccattgacatttgacaaataacgagccatctgatcgagtaaactggtcatcaactgcttattttgagaggtcaattcagattttttttttgtttgtagcattgatgtataagtggttcatctcatatcaagatggtttgaataataattactgtcgtaatgaattcgtccgtggtgtcagttctgtacaacaagcatttggcatacaatatttatgtatatatgcttagaaaattttctgttcatattcaaattgatggcatatatagggcctgtttagttggcaaaaaaatttgcccctacatgtcacatcggatatacggacacacatttaaagtattaaacgtagtctaataacaaaacaaattacagattctgccagaaaacttcgagacgaatttatcaagcctaattaatccgtcatcaacaaatgtttattgtagcaccacattatcaaatcctggcgcaattaagcttaaaagattcatctcgcaatttcctgtcgaactatgtaattggtttttttttctacatttaacactatgcatgtgtccaaacattcgatgtgacagcgtgaaaaattttgtttgaaaactaaacaggcccatatttacatgtcgactggtactggtacgacgccaaaaacttgtgtgttttttctccaagtggtcagcaacattgccctgcaagccattttactgggtcaagcaagacaaatgatagaacggtaaatgaacatgaaagaagccagaattactttactttcaaaggaacaaatgaacatcatatacatgtactattgacttggtataatcttcaaaagctcaatgtcaaacaggagagttttatctatcaacccttgattcctcagaacaaaatccagagccctttgtccctgaaaacaatgttatgttggttatttaagaaaattgatcgacataatttgtgcatccatgccaaaaaaaaaaaagaagagaaattaccgagaatgtcgttggttttggacccaacttgttgtagtcattgtctgggtatccaagatctggtggtactattatcctgaaatgcataaatttcatccatgttacatttacatgtcataaatataaactataaagatctacctatattgaaactggttcttcaaaaaagataaaatgactcctgacctcctaactccacctggagccatgtctgatatagcctcctcaaaagctggtatgacctaaatgttaaaaatgcaatttgtcagaaaggcacttgtacagagttacagacagcagctacaagattctcaattgggcagaattgactacatttctatggagttgaaattttgagcatttgtatacgaacaattgaatagttagttttcactaacatggccatgataaaaggaaaatagtatgaaccaaaaaatgatacactagatgctggctagattaaatttgtcattcacctgtcctgatccaatcttaaatttaaagaagtctttatcaccaccctgcaattcatattacagatgtggaatcaatcaaataaaataaataattcaaatcaaatctaaacaaatatctgtgctgcaaagcgttccaatattattgagtgtattcctttctgtagtgtaaactacagtctacaggtggcaatatgtacctcaaaggaaccacctttggtcttgtttcgagcttcaaaaatgcgaccatagtatccaattgtgtagccatcccaatcaaccttaagtgcactcacacaatccaaatctatatcagggttggcataaatcaacaaatgataacactaaagattgaaatatgtataacacatgcaaatatacagattatctatgggtgaacatcaaatgtggtgcttataactcaccactactgtttcccctttctttggagaaggcccatcaccaactctcaagtcctacaatttaccattataattatgaacagaaataaggaacatgtgtgatcatgcctggataatgctacaaaatgtaaatcactccataaaagtatatatatattcaccttgtactgaagacctgattctgtttcagtgtaatctgggtacttcatcttcgtctttccataatccttcccacgaagcgcaggcactgaaattgtgacatgaaagaagcaagacatgattaacagtatgtgctaagagtgattccattctacctaaaaagtaaacagatcactcaatggagtatcgagtgtgataaatgactcactatcagcaaactcagcttttgctgcccccttgtcgaaggagccaatgctgatgctgattgcaggaatcaacagcagtcttcttctatccaacattccacctgtacagaagtaattaacagtgtcttgtaataagcatttaattttggagtcaaaataatccattgatgcttttgcctgctcttcaaaaaaaaaaaatccatcgatgcaatataattattcttgcaacagattctcttcgcttattatttttcttcatccagtaaacatgcatatcatgcttaacatcattgttaatcccaagaaatttatcttctcataactcctcaagactacattgagttctcatattgcatgtacttgggacttggggatgtactattatgttgatgctccaaatgtttggccatttttttttactagtcccaattcagaattgtagtataacacatagtttaattggacaagggaaattaaaatgcatcccgaggcctaaagtggcactatcacaataaccaatggcttcttcaatcctaatcattcatggtttcaagacaagtataacatgagaaaatgcttggaaatgagttcctataagctattgagtgtattggcagcaccacaggactacaaattcccaacaaatttctgcagcagtatttcacactttcaaatgaagaattcttttctttttcccccagactgcgagctgcggccttgaagaaccctagacctctacacgcgacgcgagtttacctggcaccggcgccagaacggtcgtcgatggttgaggcccatggcggcgagcctttgtcagcgaggagggagggagagggtgacgagccgggatggcggcgagcgcgcgcaccaagtccatcggagtcgccggagctcgtcggagtcggaggaggaggaaggcgatggcgccggcgtgtggcgtcgcgtagccgcgagaaggagataggctttgcttgctgctgcctcatgcgtcgcttgggctgggctgggctgataaggcccaattagcccatttcttctctcttttatatgttttttctcttccaaaattttactactccctccgtttcacaatgtaagttattctagcattttctacattcatattaacatcgatatgaatgtagaatagaattacttacattgtgaaatggaggaagtatataggagtactaatgttatctagatttttatagctttgtagtactcttatatgtagttcatcgaaaaaaaattagtgttggctacttccttagccaattagcgcacttatcgaatagtaaattagtgtacgtttataaggatgagtttacgcgtgttatgagcgcatgagaggtttgttctgtgtttcttattaaaaaaatggtaacaagaacaatgcaatgcaagattccctgcaaatataggagagaaacaagttgccccaattaaacatttgctttctccttagtatttgaataatttggtcaaagtacaatcactaaccaggcttgactacaagctcgatcgatcatcttgtcctaatccctgcatcctaatcgccagtcaggtcgatcaggattaattactactcctaatccattgattaatcagctcaaggtcttcaagtttttgcaacggttcacctgtcgccgcattgcatcggctaccggtatcctcaatgcagtagtggtcaaagtatccaactcaactgaaacaaaatctgcaagttaattagcctctgacacagctctgacctataacaagttcacaacgagggtttaaactaatcatgccatcactgatcgaatccttgtaaactgtatgtttgattacatttctctcttcccatttgtaattaatcaaatcgggcgcatgctgcagcagtaaactactcgcacgaggcctgcaagtttgtttgtttttttcagaggtttgcaagttgctgtaaattgcagtgcaagcacactactcgatcggataaaattaatcacatgatctcctggcgtaaagccaagcccagcttggtgattagtggcgtggttagtagtagtttaaattgtacaatagacgagatcagaagagcacaggtggaatcctatgttgttgtactgctcagcttgttgtgtgatgcctgctcagatacagcatacgcagcttaattactgaattattcttcaattgaacgatttgtgctaattgtactcactgatcaacattgccaagcaaagcataagatctttaggccatgtttaaggagcttctggtatggtttcttttagaatctccagctcctcaaatcatctagattgtcttctagattctaaaaatatatgattacataataaaaaataaattagaagtgaaaaaaccatacatattttctcatggatcctagaaatatatgattatataataaaaaaatgaattagaagtgaaaaccttagaatttcagctttggttattcatcagtcgtatttcgaatcatgagctccttcaaacaaaaccttagcttaagacagggcgattacagattaatcacctgacagagtgacagtagtacaattgaacctaacggtagatcatatcaatcatgaacaacacagcgacaaacactgaattgccttcaaaaactaataaaaagcccctagtactactatagctatttaggatgcaactaaggatgcacttttggatgattaaaagtgcaccctttttcaaaacgtcaaactgttgataaagaaaagaagaaggatgctgtgggtctaagctagtactactactgtaatctaatgaagctgaatttgcagacaaaagctcttcctgctggggccaaatgacaaagaaactgaacccaaccactggctatcagcagctaattgccaatcaatttagggttaataatttaaggtgatggcattaaagaaatgattgctagctgcaacaaataattggatagtagaagatgatgtgataaccaacagctatggagcaagcaggagaattagtggccatttgttgctccagctgggagcaatcaggacaggacagagagcaagtcagaggacgtactccctccgtttcaaaatgtttaacaccgttgacttcttagcacatgtttgaccgttcgttttatttaaaaatttttgtaaaatatgtaaaactatatgtgtacatgaaagtatatttaacaataaatcaaatgatatgaaaagaataaataattacttaaattttttgaataagacgaatagtcaaacacgtactaaaaggtcaacggtgtcaaacattttgaaacggaggaaggtcatgcttagctcaattagcttggtattgatgatagtgcaggccccaaatcagcaggctagctagtaatctgaataacacaagatttagactgccatttagaagggcagtctagctcaacagttcaatctgaattacaaaatatcactcccagaatgcatataactttatgtataaaaataatctagataattatatataaaaaaactactcccttcattcctaagtactacttatcaccaagaactattcaagtttgggccacttatctttttttttttgcaaaaagaataataagcacttaaagataccatattatcaaagattattatgtccttagcattagcactaatcttcgttcatcgtagtctaaccattaaaaaattactattattagtcagtcagtccatttcaaaatataacaaccttaatactactactaaataaaacatcacataatataattaatctgaaacatgtccaaattagtcattatctaaaaaaaagtccagattagtagaattagatgatattctattgtgttgctatgtttttttttacagatagagtagtagtttaagttagagcaacgatttttttttaaaaaaagtgactggtatattttacaagttaaattatacattagcgttaattatattgtggaaatcgtggcaatgtggaaaacaacaatcacaggatgcgacagcacacgtaccctcttcctacctgaaaataactgtagcggcacgagcacgagctggtcagtgtagtagtacgtacaggtgggccccacccccttcggttggctctgcaacccaaacaaacagctgggaggtggtccagccagcccagcctacaccaccaccgcagcatgggcatttcgaatttgaaagaaaaaaaaacataataatttcaaaaattttaaatcaaaactagaacaaacccccatccatccagtacagcctgttcccagctgcccccctcctcgtcaccccttcttatcctctctctctacacactctcgctgacaggtggggccagcatacgtcgggccccatgacattgacagtagggtaacgtgagctcgcgggacggatagatgcggctgtacctgtacgcacgcacgggttccttttttttttcttttttcccttttttttctcatcatgtgttgtttggtactggtacgttctgcctctatcccgtgccctgctgtctgcactgcacgacagcaagattatcaaaaagggcaaaagaaaaaaacagagatagcgtactctgatcctttttgtgcaggtcaaatcgacaggctgtttaggtttcgtgattcgtcgagcaggaatttaaaccgcactttccgtatcagccactggcattctgtactccccggtaaaaaaaaacatcagtaacctccgtctaaaaaaagataaaccctgattttcgtgtccaatatttgaccgtccgtcgtatttaaaaaaattataaaaaaaattaaaaagataagtcacgcataaaatattaataatgttttatcatctaacaacaataaaaatacaaattataaaaaaatttcatataagaccgaccgttaaagttagacacagaaactcagggtttgtcttttttttttttttgagacggagagagtatgagtaaaaaatgcagtaaaagaactttctttttttctattgcaactaggagtaatccgttcgtcctataatataataacttttaatacttagaatttgcttaaaatataataatatcttcaccaacattcccttcttaaccaatcataatcctgcactattcatttttcccatataccttcacttctcaataattttatattttacatatttaattttacatattttcttaataatcgtctctaactttaaaattttttatattttgggatcgagggtagaattatttttgtagatggggttccgttatttttacccacgaccgttaacgacttgactccacttcaaatcgcaactaaccacccgagccccgcgggcgcgggagttccacgtactgaggctgacagtggggcccacgaggagacccccgatcccactccacgcacaaatcatcactcaccgacaccgtgggtcccaccgaactcccgccttccctttcctcctcccacgcaaaccctctcctttcttttttccttttccatccacttcacccacggtaaaaactgcaaaaggttgaaaaaaaagaaaaaaattaccgcggagttcgagttatttccggccacagcgatggccccgccgcaaaagcggcccgcaacccggatccggtgcgaccgcgccacacgcatccccacgccaccctaaccacacccacacgcacgaaacctaatagccactgacaggtggggtcacgaaacaccggggcccacatggaagtgagttgggtatgagctggatcgcgtgaaatagtagtagcctcgcgcgggagggggatccaggctggccacggcaatggcgcgcgagtcttataccctatgatccctcgtcaccactccttccacctcccccaccgccatcgccattgccgccgacgaggaagaggagaagcttcgagtggagcgatctcgatggacccgtgcccgttcgtgcgggtgctggtcggcaacctctcgctgaagatgccggtggcgccgcgccccgccggagccggggccggggtgcacccatccacctcgccgtgctactgcaagatccgcctcaacaagctgccgtaccagaccgccgacgcgccgctgctgctgccgccctcgccggaggcatcggcggcgccggcgccagcgccggcgacgggcgcgctcgccgccgcgttccacctctccaaggccgacctcgaccgcctcaccgcgaagccgtcgctgttcgggtcgcgcacggcgaggctgaagatcgtggtgtacgctggccggaggggcaccacgtgcggcgtcggcggcggctccgggaggctgctcgggaaggtggtcatcccgctcgacctcaagggcgcctcggcgaagccggtggtgtaccacagcagctggatctgcatcgggaagcgcgggcgcaagccctcgtcggtgtcggcggcgaacgcgcagctcaacatcacggtgcgcgccgagcccgacccgaggttcgtgttcgagttcgacggcgagccggagtgcagcccgcaggtgctccaggtgcaggggagcatgaagcagcccatgttcacctgcaagttctcctgccgcagcaacagcgacctccgctcccggtaaaatttcttgccctcatggtgttcgatcaaattcccagtcaaatgtcacatcgttctgacgacaatttcatacgattcaggtcaatgccggccgatatggggagcggcgggcgcaactggctgacggcgttcggctccgacagggagcgggcggggaaggagaggaaggggtggtcggtgacggtgcacgacctgtcaggctccccggtggcgctggcatcaatggtgacgccgttcgtggcgtcgccggggacggacagggtgagcaaatccaacccgggggcgtggctggtgctccgcccgggcgacggcacgtggaagccatggggtcgcctggaatgctggcgcgagcgcggcgcgggcgccgccgccggcgacagcctcgggtaccggttcgagctcgtcctccccgacccaaccggcatgggcgtgggcgtgtccgtggcggagtccaccatcccggcgtcgaagggcggccggttcgcgatcgacctgacggcaacgcaacagttcgggcggagcgggtcgccggcgtgcagcccgtgcgggagcggcgactacgggatgtggccgttcggcagctgccgcgggttcgtgatgtcggcggcggtgcagggggaggggaaatgcagccggccggcggtggaggtgggcgtgcagaacgtcgggtgcgcggaggacgcggcggcgttcgtggcgctcgccgccgccgtcgacctgagcatggacgcgtgccggctcttctcccaccgcctccgccgcgagctctcggcgtcgcgctccgacctgctccggtgaggcacacgaggcggcggtgaatcgatcgatcgatcggaatcgggaacaacattgtacagctagcgctagcgttcgtcgtcgtcgttttctggtctctgtcgtttttgttgggtgatcagattgtgttgtgttttttattttgtttttgaaatcactactcgtgatttttttgtggtttttttgggtggtgaaatggtgatgagggggtttgtaattttggtagacttctaggtgctttttaaagtctagaagcagaggaggaagcagaagaagaagaagagcaagttcgggatcatgatgaatgaatgaacaagttataaaaacttttcgtgtctattatgttttaaatttcaaattcggagtttattttggccaaatcggtcccggcagtcaaaaaggtgtgtgggttgttgttggaacttggaagggaagagagaggaactcgcgctctcaccagctggagtggagtggagtggagtagagtaggaagaagacgaagctgaggagcccgaagtgggccagccgagctggaaaagggtgattgggctgtggggtccacggccacatgggatgtctcgttggttgctttgctttggtcatgctgcacaggccgggcccacccggcgggttgtactcttcctatctgtctgagtatgcggggtgggtcccactggctcgtgggtggggcccagcgggtggcagagagagcggagagtggagtgaagctgtgtgctgctgctgcgaagtgggtggttgggatcggtgccgtcgcgccgcgcgtagctagcgcacgccatgcgcccatgctcatcgcaactttacaagccacaactccagccttcaagatccaagtatgcagggcaagaaaaaaaatacgtcatccatcctaaaatatataagcacttttagcaataaatccaaacaattatggcccattcgaatccactgcaaggagtggatgaaattgtagattaaaatggcacgcttttcaaactgctaaacggtgcgtttcgtgtgaaaactttctatatgaaagttgttctaaaatatcagattaatccatttttcaagtttgtagtaattaaaactcaattaatcacatattattaccacctcgttttacgtgaaacacttaatctttatatttattttcatcttcatgagattcaaacaccactatatatgtgtctaaatttatagctaaaagttattatattttgagacaaaagtagtattaccgtctccgtcccacgtaacctaagatcgaatgccatttaacctataaagacctttatgtatactactatgaaaaggtattaatggtggtggtggctcaccattattatttactttgacaaattgttctactatatattttctgatattacacgataaactaatatttgttttaatcgaatgagtactatgtattcaaataagcaaacaagtaatactagcatattttataaaaacacattattattattattattattattattattattattattattattattattattattattattattattattattattattattattattattattattattattattattattattattattacccatagaaatatgctaaagagctctagtacaatttctttcccacaactgctggtagcagtacatggaccagcagaaaaggaattccggtacaaatgtcttcttgatttaaacgactgacgcctccattttggaaaataaatcgaatgtgattggaattgaattgaagcaaagcaagagggtcaggcccagctgttgttcagcagctttcagccagccagacatgagacaaccctcccaaatccaaccaaacatagcttaattcttcctctacctatctcttgtctcgccttcttctcctaaacaaggatccaaatcatgccagctcaaccctcccttgattcatcaattcccttacctatatagctagctatagccaacactctgtctcgtcatcaaattaattagtacactaatcagctggtagcatgttaattacgtcttgtttagctaatcatgacagcttaattcaacttgttcgccattaatttagtttagtttagtctaatccagtcttgttattaacaaaagctttcgatcgcttgcattggagccatctgaattgtatcatatgttcttgaaaaattatatataaaaaggggattgcagctgctagctagctgttgatgatgcggaccactcctaattatgtgaaaagtgttatatgtacctacctgaaatcttgtagtactcctactacttagctgggattatgatgaatgcctttatggattagtgttcataaagatataagtatatccattagacattgcacaaaataataaaaatatataagtatatctttatgtttgtctaaaggagatcaaaatggattgacctgagaaattaatttttcatataaattagtgagattgcgacgtgcaaggcgatattggcacgtaatatatatatatatatatatatatatatatatatatatatatatatatgtgtgtgtgtgtgtgtgtgtgtgtgtgtgtgtgtgtgtctgtgtgtgtgtgtgtgtgtcgttgggactgtagtacattgaatcttagctgcaaagttttttgaaccaggtcagtactcctatatagcaatattattttcattgtcaaaagcagatagggctgtcattatattgctactttatcatcaatatatttttaattagccaaatccaattatagtgtcttgtaatggcgactagaaacagtggctctatcagatctctgtatatgaaatgaaacgaagaactagtagaagaatatatatggagattagctgtacacatatgcctttggagtcaaatgactgtaaaataattgatgtttatgattaaaaaacatgttggtcctacgacccagtaagatgatccggatcttgtttcttcctcagtgtattgtaaatttgtaatgcccgatgaagaaggatacgatgcgatcgaatagtaagcttcttggcacattgcagactctcacacgtcagtactcgtcccccacgtgtatagtatcagtctatcagattatcagaaatgattcttctgttcatgcatgcatggatcaaattcccttcacaatgtgcacttatagaaagttagaaaattgatatatagtactacctctatattttaatattttaatgtatg

SEQ ID NO: 45349 - DNA, 4006 bp, Oryza sativa
tagttttaaaaagacatgcaaatatttgtcttaaaagatatataagatcataacgcactataaaattggattttggcatatgagtcaccttctagcttacatcgtccacctgtgataatatcggtccgagaggacaaaactcgtatgaaaaagaaaaccaatttttataggcgaacttcctaacaggcccgcatgcgaaaataaacttattttcgtaagcggttctgttaagaggcccacctagcaccaggtcagctatcggcccatccccactccccctcttttttctcctctcctatctcttaaaaaaaatctcctcaccgcacactctcctcacccctctcctcccttcttctctcttctcctcaccccctcctccagcgcccccctttctcacccttcctccaccaaatatagtcctcagccatgacaatggtggcgatggtggctagggcaatgacggtgggcggatccggcgccagtggatggggcaatgacgacgatggctccttcgccgctccctctccctctctcttactctcacctccgctgtccatcctctctctctctcaatatgtaggccgacgaaggcgtgcgagaaggttggtggactgcgacgacgacgacggtgggtccagcgacgcgcgagaagaccaacggagcaggtgcgcatcgatgatgatagtggtgtgcttcggcaggggcagcggcatcacctcctcggggcgtcaccactgcggataaggatcatctgcaatcgaaatcacgtgactttgttactgatatgtgggcccatagattagtgacaaatgcaccgtgcatttgactgcaaaggattttaatcctttcgccgtctcgagagcgcgccccccacacccccgcgcgggtggcgaaggtgaataaagagattgttgctgaaaattattattttaaatagtgtacagagcattttctacaggaccacttgacaaagtactccctccatctacttttgatagtcatatttccaaatctgaaaaatctatttttgataggcatatttcaatccaacaacctatcatcttagtgtctttctcgaatttaatgcgtgattctctattcctccacacaagattggctacatgggcatcgagaaatgtaaatattaatgaatcgcttgttcacgaggaatgactagtagcatgtttaaatggatgataagtagaatcacttatcgttagtctgtgtgccaagataaaatatgactatcaaaagtagatggagggagtatattgctagcttgagattaatgagctgatccaaagcaaccagtaacattagtgtggttactacatatacgtacaagctagcaaagggtggttagatggaatgatggatggtagtagtttccaggtccagctgttgctcacaactccttccttccactgatacacacatcagcacacacaacacgtacaaaatcaggagtaactaaaagctattgatacggcagcatcacaagcaagctggagtagtagtagctcgatcaagagcagctaaatccgatatcgtccttaatttggttagttataccaatcgaggtaatcattatgaggatccaattgaagatccacaattaattgctgcaatggagtaattgcagtgtacttgttcaggttaattgagctggtagctagtaatagtagcagtgttctttatttattaattaaggcgagtatatgttgttggtatagtacttccatttactgtactagcaacttaattatcgataaaccttggccttatatatatgtaccttagctcaccgaaccatgcatgtaccagagctgtttcgattaaataatttatgcacctcatgtatgcatgagacaggcagcagtgtatatataccttttttttacataatggataggcagcagtatatgcctgatatatgcattgaacgtacagatcgatcgatgttcatatttagtttgtactactactccagctagtacgtactatatggcggggtttcccaaaccgccggggccggggttaccgcgcctcggcggtaagcacggtaaccgtgaaaaaccgtacgaaaccgtgtaaaatttatcaaaaaatcaaattatttttaaaatttatttaaatttaaggaggttaccgtgatttttctattaccgtaccccgtggtaaccgcgcggttatcgacggtaacatcaaccctgctgtatgctactccagtactgtcccggaaggctcactgacgagtgggccccacgtgcagtgggtgaattagcatcagctggcatgtacttacctgcgtctttctgtacataggctcgcattacttgatttttctcaacacttgtttttatttttcaagctgctgtgttattgattatggagtacaacgtggcgccgccgcgcagactgtgattgatttggtgtggatttggaaagtttaattaggactggatttggtgtatttgggcgatgtttggatcagatttggtgtggatttgggatcgatgtttgggattggattcgaagaagctgtcgtcggctgctgctgcccttggctgcgatttcttttttcggcgaaatttggtttgtgtagacggatggcataatttagccgcatgtgaagattgattactatgaaaataagcactttccacgtcttaattaacacgcagcacatttggccgtctgcagaaaataattttgcagtagtggacatgctaccgtgtacataacatacatgtattcagtagtacctgatcgactgatcaaggcaaggcatgcgttagattgggaggaattgaagcttgcaagcaaacttgtacagctgattccatcagtgagggatactttatttcgttttcttctcgagctagctcgttgatcatatatgcaggcagaggccgctggttttcaggtttggctagctttagagaggagcaagctaaaataagcttatagctatatcagtacgatctttagagtagtgcatgacagaggagaaccaggacgatacagcgagagagagaggaggctagaaaatttttagcctcatctttccgcttatgattgtatgtcaaaatttaaatttgaagtttattttaggattttccattgtggattattttcagcttttgcttttatattactaaaaacacatatataaatattttatttataaattatttttcgtttccatatatatcgtttggcaccgtttgttctatccttgttggtttgcttcaacggcaaatcagtcatggccctgtacgtttgcttcaacagcgaatcagacttgagttcaacgaatcaagtcagaggtaaacagtcacatgactttttgtgtggtgattttttggaacctgatctatacgatgaatcacgaacggacgacaggattaactaactcgctatagtacttagcaaacagtaaatccagagtgtatttgtgtagttgctacagtacccacgatgcacttgtaagctaatgtagctataaagtataaacatgttttttaactaggcgtacgtgtcaccggggttgcacccgccggattctatcggatcgagatgcttgcttttaaagacaccgttttctatcactaacaggtggattcatgattcataaggatcacatatcagtagatgacgtacatgtgaaattatagatcaaactatcaaattggcaaattttagtgttatcatagtatccgctaagttcgtggactggagataagcggactcgaactgctgatatccgccacagggtaaaccactggctctcaggtcttcccaacaggttctaccataaaagccaacactaggtttttgtctttgtagcgaagaaaatcacttgtctctgctttacatccttaattcaactgtgccccgctcaactcgacgggagtgtttccagccgataataatcccatgaggagtgatatggcaccatttacagattccaatagaagtttttctctgttgggtgcactagggt

SEQ ID NO: 45350 - DNA, 1438 bp, Oryza sativa
atgtttaggcacctgaaatataaccatacctattaatatgtaatttatccgtataattaattagatcatgcatgctcgggtgctctctcaaccttcaatcaattatctaaaattaaaagaacaggtaaattaagctactggtgatcatggttgtggtgtgcttcaccttcaaaccacatcccaatgagaagggctacgccatagagagaagcaacaaccttgagcatcctccaaaacctcttccgacctgcatctcgtctcatcagttcatccacaaaccgatcccgatctgcgcaacgcctacagtaattatcgcctcctcctccataatcacgatcaggcgaactacttgtgcagctcatcgatatattcaccttcttaattaacctacagtttaataacacaagaattggaacacatatagtatcagatatgctggagaaatatggctggggattgattgtgattgaaagaagaggagagattaataagagaaagaatcgagttgattaattaccgattgatccaggaacaagatagatcgatcgatggatggatggatgcaagccgcggtttatgttagcgagaatgcgagataaccacaccgtactgcagatcggttgagaatatcaatgttacatcgagaaactgttttatctctgtaaccgatttataggaacagaatcgaaatagattggtatagatgcggaccggactgtacgacgatctctgcctcaacttgttaggccactttaatctctcagttatgatggccttatgtgtatgggcttctttcttataatgtttgggcttcctctcttgaagcctattaggctgctaaccgtgctctttttacgccgagtttggttcccaactcatctaccacgtttttcacgtgcacacgcttctcaaactattaaacagtgtaattttttactaagaaaacgagatattatacagaagttgctttaaaaaatcatattaattgtttttaaaaaatagctaatacttaattaattatatgctaatgagttgttccgctttacatgcgcgaggaattagttctcaataagtgccgaacacaactttaaaagtttacactaagggtgttttcgagagtagataaaaaagaaaaagtggtaagatacacaaaataaggttagtcattagtgcatcattaattgaatattacttcctccatcttaaaatataataacttttagcatttagattttgtcatataaaaactttaaaaagaaatttcaggtgcatagcgctctaatttcatcgaaaaatccgaagtaacatcgctatagatcaatcatcaatcatcacaaagtgttactttaaagcagatgcatacatcatgccgttgcattgtaaattagtgaaaatcaacacaaattggtaggattagcatgcaatttcttaccatata

SEQ ID NO: 45351 - DNA, 18236 bp, Oryza sativa
ttcaatattcgcgtcttatgttctttttttttttaagaatacacacacattgagacatgagtactatatatataaatatgtaggcaccggataggcggtaaaaaactactactcgtacgtagatgttacatattgcgaagcttttccttcacttcattgcgcatagacgacagaatgaagagggcaatacaatatgctgaaacagcacccgttatcaccgtcctgttgaagcttatccgttcttcatatcgtttaaccaattcatcaaaattctgaggtggatcgtattcaaaataattgccccagcgccgccctgtaggagcttcagtcttggcaaatgtcgtgccgcccagcttattattatcctacagttccatcaaggaaagggataataataataataataataataataataataataataataataataataataataataataataataataataataataataataataataataataataataataataataataaactacgatgaataaacatcaaaattaacacttctctactattataaaaactagaaaagatgcccgtgcgttgcaacgggtagagaaaatttaatttgtacatgtgttgcaatggataaataatcacatcgtattgtttcatttattcatgtgcttattcgaatcacttattatcaaataaaagactatttgtgcgtgcaaatcttttatatacatgttcttagcgacacaaaagcgaatgttgtaaaataaagtataataaaaaaccaaaaagtcgaatttaaagttaagttctaaaatttaaaatttgacttctaggattgaataagccaaacaattaggctttcaaacacgagctcgatttgtcatccagcttgatcacaagtcggataggaattgatgatggacataattagctggcctcattggttcgctgttgctgaggctgattctcagcaaaagcccatcggttcacttattgggctgaataagcatcagccattggtagtgggtccaatcattcccgactcttttctacggctgatggaaatgcttatgccgataagcatcagactgcttatgctgagaagcaacaacataagccaattgatggatccgagcaacttcgattattctttattttaattggcatgttctttttgaaagtaaaacaatcacggcggcacgcaaagacgcgtgtggaaaacggactcaggagcagacccaattaagtcgcgtgcgtattagagggacactatatagtaagaaaaaagaaaatgatttgacaaaaacataaaattaaaaacgaaacatagaattaaaatcgattcaaatacggatgaagtactaaaattctggcggaaacgttttcaatttttataatagtagagataataataatttataatagtagaaatacagatgaagtactaaaccggtattttggtacgtcatccgtgtttgagtcgattttttaattttatgttatctctactacttaaatttccgctgtatgttaaaagaggaaagaaaaaagtccgactcaaataggtaaaaaaagaagatcgcgcctccctggcgcttttggttttttccgtaatttttttttgtcgtcggttttttctcctatgcgcttttggttttttcatctggctttttaatccgatctattcgccgcacacctcttatgtttgaaccctagcgctgcgccgccgccatatcgattgtgcgttttctcctccaatttgattgcaaaaatcgactccccactcctccctcatcattttctccgttattttccttttcgattcggtggatttaatctccgtttaacagttgcagatgatgacggcgatcttccatggtcgtttttattccgagttttacactaattttggaaaaaaaaggaaagaggagtggattagaaaccctcaaccaattttggatgatcgagaaagatttgaccggatttgatgggaacaaatagttttacactctgattttggaaaaaaaacagaaagagaagatcgaatgatcaaaaaccctcaaccataatgtgatcgagaaaaattcgactagattttatgggctgatttgctttggcaaccgtacggcccagatttaatggggagatttgctctggcaaccgaacggccacttgactatcttcgggaggttgatgatggtagtagactatgtgagctacactacagctccacttgtggcagatttgcgcttacggctccacttgtggctgggtcgaagggaagcaggccaaacggagggaggtagtagactggctgaagatggtagtagactgtgcgagctgtgcttcggctccacttgtggctgggtcgaagggaagcaggccaaacaaagggaggtagcggactggcctagggctgaaaaggaaggaagtctatcgacccaacccaggaaagattttcattaacttttttttattataatctatagtgatcccaatgttaaaattctcattaacgtgatcccaatgttaaaattctcattaactttttcaattataatgtatatagcgatcctaatatttcaacttattgctcagctcttaatatatcagtgaaaaacgtctttacccattgcaacacacgggcattttttctagtaaaatataaatatatatgattaccgtcgtcatcctcgcaaaccgcctccgttcttgttccagttcatcgataagccgatcccgatcttggcaacccttacaaccagtagtgttgcgagaagtactccagctgctcatcatgagcttattatcctatacattcagaattacagatacagttccacgacggattgaacaagagatcaagaacacatatatatcagacatggcggattgagaatatatatggccggatcggagggagagaattgaacgaagagaagaaaagaaacgaacctggtggtggagagaacgcggcggtggccgccggcggagagtcgtcgtcgtcgtcgtcctggccagagacagggacagagagcgcagcgccgccatagccatgccgatctaccgatcgatcgacgagaccgtacgtacgtttatacgttgcgtgtatacgggtacgttcggttctccgagtccgtcaccaattctttcttttgcttgtttgggctgtaaattacggccttttttttttgttttgtttggactgtaaatcaagttcgatcttgcagcccattggtactatgcgtaagccatcaaaaacgctttaactcggtcgttcgataccaccacaaaaatcggacgctccacacgtttctccacttctcgcaccacaagtccacaactcctcctcctcgttgtaactgccccttcttcaattccccgattcttctctctcgctccgtccctctctctcgccacacgccaccatcgtcagtcgtcgagacgccgccaccgcatacctcttggctcctaggaagccttcctgttcttctccttttcaactcgtgtactcttcctcctctcccaccctcagctctcccaacatgggtgttcctccggctagatctagccatccctgacctcgagtatcagatcgacagatccggggcgaggccaccatagagatggggagagaggcacgaatatggcttcagcttgggagcttcttgcaaccaccatctccgtcagagcaggtgaagaagcagatgctggtgctgacaaaggtgagactggtgtgcccgactagttgggcaagaatgttgcacgccatattcttttgatgttgcgcacaatatttacttgatgttgcgatcagtctcttttggatgttgcataaattggtacaataatttcttgatgttgcaatattctggttttgtgtgttgcaacaagtgttcttgaatgttgcatgtgattaaaacatttttcgatagagcaattaaacattcttgatcaagtcatggaacatgctaaaacaattctcgtcgaaacattttctcatcgaattatgaacatatgaaacatttttttgcatgtgctggaacttgtccgatgtttcgcctttcatcggacgttcgatttgtagcgctctccgtaagccatccctttgtttgtcttgtttgtttgggctttctgtatattaagctctctagctctttcctgaagctcatcagcactctacagtacccatgctcatcagtaatcaaccaaccaaccaaaggcgattgctcgcagatcagcagcttcaagtttattcaacatacgcgcgcgcacacacaacatatctctatctctactattataaaaattgaagatgtttttaccagtactttagtacatcatccgtgtatgagtcggttcttaagttcgttcgcttgtgttaatacatatccgtatttgaatcggtttttaagttcattcgcttttgcaaatacagaaggatcgcttgtggaaattcatgtccatatttgagtcgatttttaagttcgttcgtttttggaaatacaaaaggagtcatataagaaatctgtttaaaaaaactcgcatgctaacttgagatgcttggacagaaactgcagctcatgattttctaaaaatatatatatccaaacgaattcccacggtgaatttcatcttaactaaaccatataaaaataataagtttaaaatagccttcatccgttgcacgcacatgtgtgtaagcactttatcattcacaagcctctacatgcttgtaagacgccgccgccgctccaggcatagtatgggtcgggcaccccctccgtgggggcgtcgtggccgccgccgtagaggtaagggttaggagatttgctccagtccaacaaaaagtaccggtacctcgcagtactaaatcattttctatcgtttgatttagttggacaggatgggcattgttagattcaatgatcggaaacgattgatatcgtgagatacctgtacctcgggatactttttgttgaaccgaagcaaatctcatgtaagaaatccaacaactttaaagaacatttgaacacaaacgaagaagaaaacttactagctacccatccatctcacctttaggaaccatgcattacttttgcctactatgtaagtatgtagcgtggtcaaggatgaggcatggtggcgcctaaattggccgtcatcttcctccggacagacctgtgatcgtggtgaccaccgagggagagtagtctccaacttggacctggtcgacgtctttgatgcagagataatccggcgagaactccggcagcggcacgtcgccgtcgaggtactgcatgacgaggcgcataccgggcctcgcggcggggagcgggtgcgagcagagcagcccgagcttgagcaccagctccgcctcctcgccggagtactcctccagcctcgggtccatggtgtcgacgacggagccgccgccgcccgccgcccacgcgtcgcgcacccactcgacgagcacgagcagctcgccgcgggcgttgtgccccatcggccggcgcccgcacgccacctcgaggacgaaggcgccgaacgcgaacacgtcggtggccttggtggccttgccgaacctggtgagctccggggcgaggtagcccctggtgccggcgacgtgggtggtgtgcgcgtcggcgccgtggtcgtgcagccgcgcgaggccgaagtcgcccaggcggccgttcatgtcggcgtcgaggagcacgttgctggccttgacgtcgcggtggacgatgacctgctcccagtcgtcgtgcaggtagagcagccccgccgcgacgcacttgatgacgtgaagcctctgaggccaacccagcgtcctgcagttgctggagtacgtgtgctcgtgcaagtacttatctaggctgccgttgggcatgtgctcgtagaccagcagcagctcctccttgtggcggcagtagccgaggaggcgaacgaggttgcggtggcggaggcggccgaggatgatgatctcggccgtgaattgcgtcataccatgcctggactcagacgagacacgcttgacggcgatgggcatgccggacgcggagagaacgcctccgtagacgcggccaaagccacccttccccagcagatgcttgaacccgtcggtggcgcggcggaggtctcggtaagcgaagcggcgaggtcccagctctgcttcccagttttcccgactccgggcgttcttcttccagcaccaccggagcacaagacacgctgccatggctgcaagcacggcgagcactgatgcagctgcaggcaaccatgtgacgaagctcttcctgttggctcgtctacttctgctataatcctgaccctgatgagctcgtttcaggggcagcagcgagtagtcgagtggcaatccaccgttgctaaagctccagccaagaacttgatgggtggcgccagcgccaccgggatcaccacccgtcgaagcggtgaagccgaaatatgctttggtcgccatgggagaatcgtcggccgccgacagcaatcgcgagaggctgacgttgtaagacagtagcggcacggagggcatgaacatggggacgagcgcaagcgtgacgtcgagccgggctgctccggcgtcgtagctcacccacgcctgcatcgggtcgccgctggaaagcttgagcgcctgaaagctagagttgccgacggctccttcgtcgtcgtagatgtaccctgcaggtctagacaagttggacgtcaggctgttgaaatcaatggcgacatggttgccgttcgtcgcgtccgggtctgcgacggtgtcgagctctatggcgacgaaagggtttgacgatgcatcgtgcgggttggcaaggcccaggtacgccggcgaagaggcggccgggaagtcggcggtcgaggagatgacaaatgtcatcccatccccgcagctgccggagccggagcatgtgacggcgaagacgaaggtggaggtgaaggagcgggtctcaccaccggtgtactgcaggggaatagggtagggatagaagcagcgcccctgctgctgggcgccgctgctgccattcgtcagggagaggatcccatcttctcccacggaagcggcgccgtcgaggaggaggttcctggcgccgctgaatccgttgtatgtgaattcaggaaaggtggcaattaccatcatcacgaaattcatcatcaagagcaagacgagactgggcatggtggtgctgcagccttgccttaattctgttattgctggatcttgaaacttaactttctagtgcacttggatcagttgtttattcatcatgactgttctctatatgtgagtttgtttcattggactgccttcgtcaatggtcgtcgacccaagtcagtcaacaacaaagtctatcaatctatatcatacccactatcagcgccgttcaataaaggttatccgttttgatcaaagtaatatcgtatcgtaggatcgggatactataattttttttaaaattcaattaatatatgtattaattacatatagtcattatatataaaaaaatatagtaataatatatatcatacaaatagagacatttattaagagaaaccacattagttttgatatatttaactgatttttatataaacttgagcatatttatttacattattttcaaaccatcttattttaaataatattttgtaggatcgtagaattaggatattacccaagatttcgtaggatcgtgtaataatgaatagtacaatcgagatactatggaaattaggatacaagatgtgatcggtatcattccgggttggtaggattgtatagtatcctaagatactatgatatggatcgggatactgacaacattgcgttcaatgtatgtcaccttttttttttgaataaatatataccaacccatgaatccatgattaatcagttcaccagttgttcctgccctacacccctgccgattacgacaattacccgtccatcacttcacaaattttcctcgcaaacttgtctggtaatccatagtcatcagatcaggcgagtgaccgttaagaccaggggtggatctagaaaaatatagtagtgggggctgaataaactacatcagcataaatcaaacctccagtccctatatcctatggatctatggaaaaaaaattagtggggcttaggggggtctccactgtcccggggcggtagtggggtctcaagacccctctgcccccattgtgaatccacccctggttaagacttaggtctatcatgagaacagaaaaactccggtctatcttggtgactggaatggccacagaaggaggcaatgaataccccttcgttctcgagtcttctttcccctttcccctttctacagtagccctccccgtttctcctgctctccggcccctcttcctcctcgattccggcggcttgccgccggcgagggttataggggtccggccacctccccttactagtattgtgtggttaggtctgttattaggtcgtcaggttcttcctattgttagggtttgtctctagttggtgcttttgccggctagctccatgggtgccggagtggtcggaggtggtgatggttggtggcagtggaggtgcgagatccgaagatctgtgggcaaatcgtcggctggagctggctcctggtggcggcgtcggcagcgtcgtcatcctcggctgggaggtcgccgccttgtcccttgcgtcggctgcggtggcttctcgtgtccttcgttggtccctcctcctcggcttcttcctttggttcccctccatcagtctcacctgcgccggttgttgttgtcgttgacctcatcgatgatggtcctggtgctgggtggtcttgtggaggaggccatgtttggagttctggaggcggcggtggatgggtgtatgctcttgccagactcttgtagactcttgatgcagacttcatcttccccagccaacttcgtcgtctcagcaagacaggaggatctttgcagccactacaacgctcgcatgatgaaggttgattggtctttggttcagtcttctcttttgtgcctgattagcagaaaccatgccgagtttgtcattcgggttgagctcggaccacatgcgcgatttcggtcaacagggtttttgttagagttcctcagattcaatgacgagctccgtggagatcctttgctgtgtccggtgaagctcacaccaatatctacggctcagcatcacacctctgtcctgtgctgtttctgtggaggcagccgagatggggattaccggtttgtcaagcggtttgcacgtcttatgaggctctaggtagcagtcgttgcgacattgccgtagctccctatcgacttgctccttttctgctgctcagttccattaggaagtctacttctttagtccaattaacctcccttttcaaaagggtggctctttgctttaatttgttatcttctggcaacataatggggtttatcccctaacttatgttattgcttttattatctatatgtgtttcagaaaaatagtctatcttggcaacttgtctacgacaagatagactatttttctgaaacacatatatataataaaagcagtaacagaagtgacggacacgtaattgtcgtaagcagtagtaggagtgtatagggcaggaacagttggtgaacggacaagaacaactgggtccaatcaattaaattagttggtggttttttttattgacaattgcattcatgctctcactttgaatctcaactgctgttttaccatcagtttgtagggtttgtattttttccctctctttttgaaaacaaaccaattattttgtcctcacttttgatgcctagtttgacggtgttagttttagagcaaaagaacatttatacccttgattgttgttgtatttttgcaccaacttttatgccgactgcctcaccacgcaagggagatgaaacgcagctgccgccacgccgaagacttgctgtcgactcacacttgagtgccaccgtcgccgcgcctcccgccggaaccgccgccgtcaccgcgcacacgttagtttcgccgccatcgccgcgcttcttgccggaaccatcgtcagtgtcgccgcgcgttccgctggagccgcggccgtcgcacacgagttccaacggagccgccgccgtcgctgcgcacgccgatgctggaaccgccgccgcctcctctagagttttgggatgttgacctgagctctgtgaaggaatgggtgcttggatccttatccattcactaagggtacaacagtaatttaatatttcataaaatgaattttctatttctatttgtgttttttatcccaaaaccgtgggacccatctaacagggttaaaagtgagggcaaacggtgggttcgtttttaaaaagatgggatacaattgcaaatcctaaaaagtaagagtaaaacaacagctggggttcaaagtgagagcgtggatgcaactgtccctttctttcataaataaataaaaataaaaattaacacttaaaatatatctagttaccatcgtagtttattattatatattcatcgtagtttattattattattaaatattcctttccttgatggaattgtaggataataagctgggcggcacgacatctcccaagactgaagctcctacggggcggcactggggcaattattttgaatacgatccaccacagaattttgatgaattggttaaacgatatgaagaacggagaagcttcaacaggatggtgataacgggtgctgtttcagcatattgtattgccctcttcattctgtcgtctatgcgcaatgaagtgaaggaagaccttcgcaatctttgtaacaactacgactagtagcaattagaggtaagaagttcattacaaaagattgatagattgtaagggggaggagaagatctgtttccaaacagagattacaaattgatcatcttccgttaagttctctgcccagagagctgcctcggtgatgcatcgttgtaaggcaggctcttagtgaggggcttttcccctggaaaacaacatcgtgtcgatgattccaaatagcccacatgcaaagcaggaagaagacctgccagtgtagcgccagcacttgcatagttggacccaaacgatggaactgcgtgatgtcttgagcttgcggttgaatgttgatctgcgtccagaaagcctgagcgaacggacagaagaaacacatatgattagctatttcgtcttcctgattgcagatgtcacagattgcctcctgaataatggttttcttcagcaaattttcttttgtggacaggcgattacggaccagaagccatgcgaagagtttaacttttagaggtgctctgcatttccaaataagatcccagattggagatggcaagccagggggtaatcttgcctcatagaatttcctagttgtcaactttcctagctttgcactgaggcggaaatccatctcatcgctcagagagaagttctgcagcaattcctgtaagcagcccagctctgccgatgcagtttcagataaacgtggaacaagattttcagaaattcctatgtgaagggcttcctttactgagatttgtctgtcacacacgtgggagaagagattgctgaactgacttgaaaagctttcagtcgaaaaccatttgttgtaccaaaaggaggttcgctcaccatttcctaccacgacttccgtcaaagatcgcagttctggcaacaacttttgaaaggatgcccagtgatgccctagacgagttgaggacagtaacgaggaatctgaaatttcgtcccagacccatcgagtccaggaggtcttcaagttgtagagggcaaggagtcatttgagaagaattgcctcgttctgaatctttaagttcttaatacgaagtcctccatgttcttttggcttgcaaactgattcccaagcaaccagacattttgctcccgagcagacatcatcccctgtccagagaaaagccctccgtcgtctatcaatttcttctataatttttggtggaagtttgaaagcagacattgcatacaccggcaggctgctcaggattgcgtttatcagaacaagccgctccgcctgcgataggagagatgcttcccaaccagataagaaaccatcaaccttgttaaccagaggctgcaagtccgctgcagacagtttatgaattgataagggaagtccaagataagacatcagaaatttctccagcttgcactgtagcaatcccgacaaaactagttccttgctttgatcgacatttagagtaatcatagtgcttttagcaaaattgatttgcagtccagttgccttggagaactgtagcagagtctcctttagagcaagaacatcagcctcctccgcacgatagataatcaaggtatcatccgcatactggatggtggtacatggcctgtcttggtagattgcatgtctgatttcagtatttctttcaagcaatctttgtaacacatcagcaactaagataaacaaatatgaagatagggggtcgccttgtagaaggcccttcttgcagcaaatccatcttccagggactccattaagaagcactgcagacttggaggaggaaagcaaccccttaatccagctaatccagttttctgggaaacctcggacagcaagaatcttgaaaaggcttgaccaaatgacggaatcaaacgccttcgtgaaatcaagctttacaataatagtttggcacttccttctgtagcatgcttgaatcaattccgtcgcatatataagattctcagagatgcatctccctttgaggaaacccgtttggtctaaatgtatcatcctcaggaataccctttgcagccgtgttgcaagcactttggaaagaatctttactgagcagttctgaagagagatcggcctatatccatcgactgtgttttctttcccgggcttttggattagaacaatataggctctgttgattcgctctatgtctgccccagaagttgtgaagcctgttgctaaactgaagaacctcctctttaattgtgttccatgctgcacggtagaagcttggactgaaaccatccggccctggcgcactgttagaattcattgcctgaagagcaagaagaatctcttcctgtgaaaacggtagaccctgagcagccagcaagtttgaatctctcccttcatctgagtaaaggtgttgtagatcgaactcccaagaaggctgcaaagatgatcccaggagccggctgtagaaggaaaacataagttgggactttccaaagtggtcggcaacttctattccatcgtgttttattgtctttatacgagaattcctgaagttttttgtagcatgagctttgaagaaagctgtattatccagtcccagttttaaacgcttaacctttcctctttgtttcgagtatgccagcttgccttgcacctccaaaactaatctgtcttgcaccagacgacggaggcaccgttccccattcagatagccgcctgaattcttcaatgcaatctaagtagtcgatggtgaacttgcaatcctcgcataaaattcctcttttcctgttagcctgcatccagcctttaattgtggtgcgggtatgcttcagcttgaaagccacgcgagcagctgggtcagcaaggttggtgggctgatcccagttagaaagaaccgacggcagaaaattagggttaagaaggaggtgattctcgaaacggaaaagctgggagcgagggatagtggttgaagcattgagaaatagagggacatgatcggaggaaaaactagtagctttttaccacctatctggtgtgtacatatatactcatgtgtcactaccggagcatcgctagctcttccaattgatggagtagtagttaagttttcttcttcctttgtgttcaaatgcttaattaacgttactggttttcctataaaagtgaatattacaagcatgtacatatgcttgagaaccaggttgagacagcctggtgaccggagagtcgatgggcctgttcactttgatgaaaaaaaaaaccttaccaaattttggcaatgccaaaaatttagcatagttgtcaaaattttgacaacttgccaaaattggtaggatttcttatatagttacaaaaatttggcagcaaactaaatgtagccatttttttgacaactttaccaaagtttggtaaggttaaaaatgtcatcaaagtgaacaggcccaatgtgtcgtccagattttagtcccctcaagtattgcaaacggcacctgttggtacttacagtgacgtgccatctatattgttgttggacacggattctatatagtactacactcctgaagtgatagtggcaaaatcggtggatccggttccacgtccggtggatccgattccacgtgtcagcggtaactactgtatatgtgcaataccgcaaattaataatatgcgctaaacagtgttgaactaccttgtagtaagagcaagtttaatagtatagccaacaaccggctccaaatcatttatagtcaatttaatagccgattcatacaatagtacctataaacgtatactacacaattcatagttggtcccacctgttatacacacaagtatcttggagtccgtgctgcagctggctacaaatttgtagcccgctgctcttctctcctattatatcttcttgaaatatgtctatagctaacttatagtctgctattgtacctgctctaacaatacttagaccgcagtaaaaatagcgcttatgtatacctctctcttccgcattcgttgattgcaaatcaaacggtgaagaatactcactatactgctttgattctggtttttggatttccgcttgcacgttcatcaagctgttaaacagagtgtgtttcgtgcaaaattttctatataaaatcttcttaaatattttttttgtcaaagcaactattcaactttatagtagttaatccattaatttaaacctacaaatatatggaaaaaacaaattatccatccatcacactcccttctaaggggaaaaactattgtagctatctgaattcggttctactcagctctccacaaagacagaaacaaagagcttcttgtgtatgggctttctgtgaaagctctttcagcccatcaaccactattccaaatctccaatacggtccgtaccaactggctacaatgctacggcatgctcatttctcaatcactggcagcttcaagtattcgtatgcacaaaaaaaaaaaagagcagcattcattcacacgctgatgtaaaaatgtttaaataacagcatatatgatcacataagtaatgtacatatatacttctagctagcaaattgagtagtttaccgggtattatcaatcgccatcgatcacataccgtccccttcatgccagctagctatcaccttcctcctgagagtcctgacatgaatgtgccatggctcaccatcgatgacgatgggtacgacatcatgtacgaatcgaacccttcattggacatcatggcctgcatgccgaagcttaggtttgccggtatcagctccggcatcttcatgtctccgtcgaggtattgcatggcttgcctcatgctaggccttgcttgagggaccgggtgtgagcatagcagccctagcttcagcaccaagcatgcctcgtcggtgtcaaactcgccttgtaacctttcgtctaccgcctttgtcagtaaccccttgtgccaatgctcgagcacccggtcaactagcattacccggttatcttgcctgttatgctccacgggtcttcgtccacaagtgacctctagaaggaacgcgccaaatgcaaatacgtcagtaagaggggatgttttacctgtgcgcgctagctcaggtgctaggtagcccatggtaccgacgacatgtgtagtctgtgggttgacgccatggtcatacaactttgctaggccgaaatctcctagccgtccattcatatcactatcaaggagcacattacttgccttgatatctcggtggacgacgacttgatcccactcctcatgaaggtaaagcactcctaatgctattcccttgatgatatggaacctgtgagcccaatctaaggtgtttttatcttcttgtccatgcagatacttgtcaaggctaccattcggcatgtattcataaaccaaaagaagtttgccttttcgccgacagtatccaagtagttgcactaggttacgatgcctaagacggccaatgctaacaacctctgcaatgaactccttgataccctgccttgattcatgagatatccttttcactgcaacctctatcttgaagattttagcactcctctatacacactcccaaacccccctgaaccaagtaggtacttgttcttgaaaccttgcgtcgcatcgaacaaatccttgtaagagaatctatgtggaccaaactcgacctcccaatcttcccgcagctcagcatatctcaactgccttcgcaacaagtgaagaacgatcacgccaataacaagaacgaacatcgcagtggctatcggcagggtgatctccattactttggatgaactctttgggccttctctgggtagcttgggcagcttgctatgtcgatggccggagcagctccattgatggcaaagctccagccaagcacatagtactgtgagtcaatgtcacctgatgatgatgagaagccaacatatgcagaatcagttaaaactgtagaaagattgtagatcactgagccaaggggccttttgggttttgatatctcaagcggagcaacagtcacgtcgatccgtgtggtttcttggtcgtaatcgatccagattctcatcggctcatggctgttcaatgtcaagttcttgaggttaccgttgtcgccatcgtcgtagtagccagtggggtaggatctcacggagcggatgctgttgatgtcgacgccgacatggttgttgttgatgtccatgaagtcggtgttctggatggtgtcgagctcgacgacgaagatgtggttggccacatcgccatcagtcttgttgctgaagaggcccaggtagctcctcggcgctgctgcggagaggttcttggtcggggagacgaagaaggccatgccatgggagctcaggttggggtagatggagaggatggcgaagacgaaggagacggagaaggagtgcacatcgttgccattgccattgccgctgccaccaccaccggcgaccggaaggtcgcggaagtgcaaaggatcagggtggaacgcgtgggctttgagcgcgctggtgccattggtgagctggaggaggcctgccggagtgaccgtggctacgccgtcgagggtgaggttggcgccggcgaacccggtgtagatgaactggccattatcggtggtagcagcggtagaattcattgcaaggatgctgaggccaagaagtagaagcagcaaggacattgtgttgttcatggctgggtcgtcgccgggaagaagacgatggatcggagctacgaattgaatgatgatccgtcatcagacaaagctttagagagtgcagagatgatggcctagctagttgcaaatctgcatgtggtgtcatcactgtctttgtctgtggagaatttattggattggagaattttttgccttggtgggcagggaacggtgaaggtagacacaccacgatcattatctgtagaatggacagagataattagtgggcgctgtgtcgttgtcgacttgacctggtcgtagaacttggtcaaccggcacagtggtactgcgtagtgctagccttggggtgaaagtgaaaatgatatcagtaagaaaatttttaacacatactaatcactgctactacataacactccatatgtaccaattgagaatcccttataggtaccggtttctcaatcggtaccaaaataaggccactcactagtaaaaaacaattgttccagatggatcaaaagtagtttttgcgtgtggatctctggcctgtctgcccggaagggttgcgaaaaatccaattttaccgtgcgggtgacgcaccgcgcgcgaaaatcggattttagtatgcgggtgcttatgttgaccgcacgcaaaaacaaaaatccgaaaaaaaataaaaatcgtgaaaaataaaaagctgaaacattagctgcgtcgctgcccggcggctggatccggtgagccccgacctcaaggagc

SEQ ID NO: 45352 - DNA, 19477 bp, Oryza sativa
ctattccggtatgacttgctgagtacagtggatagtactcagtcttgctctatttccccccaaccccagagtttgagtatgtgtccgatggcgggttctccgaggagtaggcttcgtccgtgccgtcgaggatgcctgtggagtggtgttcccgctgcagttcaagtcaaggcttagctcctgttatctttcgtttttccgttgcatttatgtaagacttttataatgtttgtaagacgtggatctgtatgtcaacattgttgtttgtgtaccccggccggtcctggactggggttttaatgcacattctgcttggaattctattcgggaatttctaggcgtgacaagttggtatcagagccgaccttgaccgtaggacaagccaaatggaaacttaggagccctctgaatccttttcattgcataagttctttgcaattgaatttgttccgggaaaattcgggatctgttcttgtggttcaagggaaaaaatcttggtcgctcgtttgagtaagatttgtcaaaacaagtcagtctagggttttagtaaaaatatttgagacattttcgacagtcagttgggatttgatgggggaagtgcattaggtcctagctcaggaatatgggttgtaaggtatttatgcttttatagttattattagtatgtatctaatttcctcattactttatcgcgatgtaagtctgtcttatttattcgctctcatgcaaaatgatctctgcataaaatttcgctcttattcgattctcttatttgagtcctttattgctttatttaatttggatttgagcatgcattgatcctactcctttgtcttctctagatggccgagcacccacccaaccaccgcggagaaggcatggatgatttcgtggcagaattggcacgcatgacactggtggtgggctaccccaacgcgccagagtacacaactgttccaccgctcagtggcgagcttcctcaccgtgtccgcctggaggtccatggctatgtgggtacttgcctcgctaacatggtggttgaggcgtctggaggcacagcagatcacgcatgtcaggaggcagcatacctgatgatggccagagtacgggagcgccacaactacatcttccacgacacggcgtaccgcatccaccctcgtcgagccagcggcagcgatgtcagttctttccgtccgacagccggcaagaacgacaccacctttgttcacatgtgcgctgtgatgagggggatggacaggatgcactcggacctgcacaaggcgtccaaggccttgaatgatgggaagctcgtgaggatcatcgcactgaaggacgagatagcgcgcctgaagagggagaatgctcagttaaaggggctacccacgccaagaggagtccggatccgcactacgccccgcaagtcgacaacggcacccatgcgcatccagcttgcgcccaggtacccacctccgtcagcagctcccgcagctcctccagctccacccgcagctccagcagctccagctcctgttcccgtgtcagctccggcatccgctctctccttcgcgcctgcatcagccgtcaggggccccgccagtggcaatgggggttggttgccagctactcccagtggcagccgcgaccgcagcagcagcagttccagtggctcagagccgggcagcggcgagacatatctgccaggctccaggagtcgctcagagggacctggtgacgagcaggaggacgccttcgactccaccgaccgcaggagccgttccgagcattaggctcgatttcccttagtttatcgactgcttagtttctgtctgctagtttgtgtgtgtaggtctgttcgcttggggtcagtcgacggtcgatatcatgtgcctatgatatggctgtcttaataaggatggttgcttgctgtttaagtgttttaattcagatcagaacaattgcagtttaaatttctatataataaagcttagttcctgagtatctgtttttctccgtttccccgtctgctcttcctctagatggtctacaccaggaatggcacccgcacaacaggcgagggcagcaacggcgaagagcgcactgatggtgtgcaccccaacagtgattccgacaatagtccgccaccacttcccgagaatccgacgctggcccaagtgatggcacatcagactcagatgatggcagccatgatgcaacagatgcagcagcagcaccaacagatgcaccagaggatgcaacagcacgccgaacagcatcaccagcagtttggtccccctccccctcaatccaaactgccagaatttctacgtgtcaggccacccactttctccagcaccaccaaccccatggaggcaaatgactgggtccatgccatagagaagaagctgaatctcctgcagtgcaatgatcaggagaaggtcgctttcgccacacaccagctccaaggtcccgcgtcagctcggtgggacaaccacatggccacacgtccgccaggcacggaagtcacttgggcaaagttctgtcgcagcttcaggaaggcgcaggtgccagacggggtcgtggcacaaaagaagagggaattccgggcactccatcagagcaacaggacagtgacagagtatctccatgagttcaatcgcctcgcgcgatatgcaccggaggatgtccgcactgacgcctagaagcaggagaaattcctagcaggtctggatgatgagctaaccaaccagttgatatctggagactacgccgactttgaaaggctggttgacaaggcaatccgtcaggaggatcagcgcaacaaaatggacaggaagagaaaggcggcacagtttcggtccagccaaggaaaccatcagcgaccgcgcttcactcccggacagcagggtggacctaccaccatgatcgtccgccagcaccgcccgttcaactcaagcaactttcaccagggcgccagtggtagtcagaaccaccatggaggtcagccccaccgcggtgtagctccacgcccactagtggcaccagcacagtcagctccgcccgcgcaagccaagaaggagaccagaacaaagccagggtcctgcttcaactgtggtgagcttggtcacttcgccgacaaatgcccaaagcctaggcgtgccgggccaaggttcgtccaggctcgtgtcaaccacgcgtctgcagaggaggcgcaagcagcaccagaggtcgtactgggtacgtttcctgttaactcaatccctgcaacagtactttttgattctggtgcaacgcattcgttcatttcaaagaagtttgtggggatgaatgggttaaggaaagaagagcttagtacaccaatgagggttcataccccgggaaatagttcaacctcggtcaattttagcccttcagtgctaatagaaattcaaatatcaccatttctagccaacctcattcttcttaactccaaagacctagatgtcattcttgggatggattgactgaccaagttcaagggagtcattgattgtgcgaatcgcacagtcgccttgaccaacgagaagggagaaaccgtagtgttcaaatctctagtctcaccaaagcaaggggtctccttgaattagattgaggcggaaatcccagtggtcactgtggagaagaattcgaggaaattggatgaaatccccatagccggcgagtacccaaaagtgtttcccgaagacctcactaccatgccacccaagagagagattgaattctggattgatttggcaccgggaaccactccaatctacaagagaccgtagaggatggcagccaatgaactggcagaggtcaagaagcaggttgatgagcaactgcagaaatggtgcattcgaacgagtacttcaccttggggtgctccagtcatttttgtggagaaaaaggataagacgaagaggatgtgcgtcgattatcgcgcactcaacgaggtcacaatcaagaataaatatcctttaccacggatcgatgacttgttcgatcaactgaagggagctaaggtgttttctaagatagacctgcgatcaggctaccactagctaagaattcgggaagaggatattccaaagacgaccttcaccactcggtacgggctgtatgagtgcacggttatgtctttcggacttaccaacgcacccgcattcttcatgaatctgatgaacaaagtgttcatggaatttctcgacaagtttgttgtggttttcatcgacgacatacttatctattcaaagtccgaagaagaacatgagcagcatctccgtttggtactcgagaagttgaaggagcacgagttatacgccaagtttagcaagtgtgacttctggttgacggaagtcaaatttctgggccatgttattacagctcagggcgtagcagttgatccatctaatgtggagtcagttaccaaatggaccccaccgaagaccgtgtcgcagattcggagttttcttggacttgcgggttattaccgccgattcatcgaaaacttctccaggatcgcccgacccatgactcagttacttaagaaagatgagaagtttaaatggacagctgagtgcgataagagttttgaggagctcaaaaagaaattagtatccgcaccagttttgattctgcccgaccagatgaaagacttccaagtctattgcgacgcatcccgccacgggcttggatgtgttttaatgcaggaaggcagagtggttgcgtatgcctcgcgacagttgcgtccacatgaagggaattacccaactcatgatctgcaattggcagcagtggttcatgctttgaatatctagaggcactacctgattggcaaccgttgtgaagtatatacggatcacaagagtctaaaatacatcttcacccaaccggatctaaatctccgacaacgaagatgattggaactaatcaaagactatgacatgagcattcactaccacccagggaaagccaatgtggtggcagatgcattaagcaggaaaagttactgcactgccctatgcatcgagggcatgtgtgaggaattgcagcagttgtttgagcgtctcaacgtgggaattgttgaacaggggttcgtagccgctctagaaacacggcctacgctcgtcgatcaagttagagccgctcaagtaaatgatcctgaaatagcagaactgaaaaagaacatgagagtcggaaaagctcgagatttccttgaggatgagcatggcacaatctggatgggggaaagattgtgcgtacctgacgacaaagaactgaaggatatgatactcaccgaggctcatcagacacagtattccattcacccaggcagcaccaaaatgtaccaagacctcaaagaaaagctttggtgggtcagcatgagaagagaaatagttgaatttgtcgcactctgcgatgtttgccagcgagtgaaggcagagcaccaaaggccagcaggcttactccaacctcttaaaatcccggaatggaaatgggaggaaattggaatggattttataacaagactgccccggacatcatcgggtcacgattcaatctgggtagtcgtggaccgactcactaaggtagctcacttcataccagtgcataccacctatacgggaaagaaattggcagagttgtacctggcaaggatcatgtgtttgcatggggtacccaagaagattgtatctgatcgagggagtcagttcacctcaaaattttggcagaaactgcaggaagaattggggacccgtttaaatttcagtaccgccaaccatccgtagacagatggtcagaccgagcgagtcagtcaaattttggaagatatgttgagagcttgcgctcttgactttggtggagcttgggacaaaagcttgccatatgcggaattctcgtacaacaacagctaccaagccagtctacagatggcaccgtttgaagctttatatggccggaagtgtcgcacacctctcttctgggatcagacaggcgagcgtcaactgtttggaacagaggtgttagcggaggcagaagagaaagtcataaccatcagggaaaggttgagaattgcccagtctcgacagaagagctacgcggataaccgccgaagggagctcacttttgaagcaggggattacgtgtatcttcgtgttactccgctccggggagtgcaccgttttcaaaccaaaggcaagttggcaccacgcttcgtgggaccctacaaaatcttggaacgaaggggagaagttgcttatcagctagagcttccttccaatatgatcggcatccatgatgtgttccacgtatcccaattaaagaagtgtttgagggtacctgaagaacaggccaattcggagcacatcgatatccaggaggatctgacctacgtggagaagccaattcgcattcttaagaccagtgaaagaagaactagaaacaaggtcaccaggttctgccgtgttcagtggagtcaccattcagaggaggaagcaacttggaaaagggaagatgagttgaaagtcgcccatccgcacctcttcgccaactcctccgaatctcggggccgagattccgtttaaggggggtaggtttgtcacaccctgaagttctcctcccaagcctaaaattgaatttataaatgaccctaagaaaatgccggtgcaaatcaagagaaaaccctaataaattaatgcaaataataatcgaaactggcatgtggaatttttcttgagttctacatgtcgaaattcgctaacaagatttttagtggaattttcagagccctagaaataaatttaaccaattaaaatggagcataagcaatatttaatccctggaaaattctttttccttttccttattttcctttctcttttcttttgaatgggccgccggcccattctccttcctcccctcccctcccgctgggccggccgaaggccaaggcccagctaagccgcgcgggccggccgcctccctcctctcacccggggtcgctgacaggtggggcccacctgtcggacccgtctcccacctcgcgcccgcgccgccgcgccggcaaccgccgccgcgcccacgcctccgcctcctccgggccacgtcggccacgcccgcgcatgcgccgcacctcccgcgcccactccccctctctctcgcccgcgcccgcgcgcgagatggccgggattcgattttcgaatcccgcctctctctcctcccccactccccacattggctggcgaaatcccgcccctaccggccacgtccgggattcccctcccctatttaagctccaccgtcaccccctctctcttttttcccatctcgccgaactccctcgtgctccccatcgctccctcgccatgcttccgcccgccgccgccttagccgttgctccggccgccgctagccgccgttagggtcgtcgccacaccgcaccgtcgccgccgacgggttcgcgaggccgaactccaccccgtccgcccctcctccgtcgaggtccgtcgccggaacccgcatcccctcgcactccggtgagctctacccctaccgccgccttcggccatggattccggccgccgtggttcatctccctccctctaatctatctcttttccttccttagggcatcccgaagctcgtccgccggttgccgtcgtcctcccgtggctcgccgtcgccgttcgacgtcgtcttcctccgcgccggccaccctcggtgaggcatcccctcccctctattcccctccctctccttcctagccgccgctttagcgccgccgctttcgcgccgcctttgcgccgccgcatccgccgccggttgccgtcgccggcaacgcgtgcgcgcgcgcgccgccgcccttgccgtggccggtcggccggccttgtgccgagccgagccgagcgaggccgccgccgcccgtccgatcggccccgggtcgatctgggccgtcggtcccgtggaccggcggtggaccacccacgtggtccggtccacggtggaccggccgcctagtgccgctgacccgggggccccacttgccggcgcccctctctccccttgcgccactgacatgcgggccccgcctgtcggcgctgccccccttgatgacgtcagccctgcgatttattgtgcaataaattatttaaggactttttgttatagaaataaacacagtgaatcttctaaaattcatatctaattcatccgagctccatttaagcccattcaagtctcagtaaatcaagaaaaatatgtagaatccattaaaaatggttttgttctctgtttcagtagtcttatagcctgtttgcattgtttgccttgtatgtcgttagattccggctcttccgacgctccggtgtacttcgagatagtcgccgaggttcctccagcagcagagcaaggcaagtcatgcctgtcacttgatcatgttgatcctatattgcaaatgtcctaatgttttctttcaaatactgcatttgttttgcaataatactatgggatgtttacctattgttacagccatgctattttggtaccatgctcctttgttagcttgggtcctaacatgaatagactttggactaggaattgcttagccatgcttagttcaactagcacacaatggggaaatctctttaaaatatagactttaggttcaaatggtaatgttggtttagtaccaccgttttggtgttggttaattaaaatgaatcacatggtgggctgtgggtgcatggttttgctagtcgcacccatggcaattaaggaccggttcacgggaaaccctggaagaatttatcgtgcttaccacaagccagcgtgggcaacggctgggcttgtagtgtagcttttctctagctgacgcatccaggcaagggtgggcgtgatggagtttggatgggccctgcgacggccaatgcgtcttccggattcacctaggcacgagaggggactgcccgtcgcccgctggggacgggggtgaaacctgaggtgtggtgtgcttggctagagggggttatgcgaacggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtcttatcctagtttagtctaatgaaattggatagtacaggtggatggttgggcctgttgcaacgtggggtagcgttggacagtggatgattaatattggttaaattattacaacagtttttcgcatccaacttctgtttataaatgccagtattatgcaaatgaacatgtatagctatcccttgttaaatccctgcatcatacctctattccggtatgacttgctgagtacagtggatagtactcagtcttgctctatttccccccaaccccagagtttgagtatgtgtccgatggcgggttctccgaggagtaggcttcgtccgtgccgtcgaggatgcctgtggagtggtgttcccgctgcagttcaagtcaaggcttagctcctgttatctttcgtttttccgctgtatttatgtaagacttttataatatttgtaagacgtggatctgtatgtcaacattgtcgtttgtgtaccccggccggtcctggacgggggttttaatgcacattctgcttggaattctattcggtaatttctgggcgtgacactgggcgatagagatagagatgataaggcacgctcctctcctcactggaatatctccctcccacaccctctggcttgggtcggctagattaaaaaccgacatctataatatattatataaaaaaattagtttggtgtcgccgaaagtttacaagtttataaatataccatcaaaagttttagttgccttccgtttctataatttttttaatatgtttttcatttgctttctgccaaataataaagagaaactaaaggacggatttgcccttatcctcctgaactggattgatgcgtccgtatttatcgcgagtgtgcgtctcggcgacttgcggtgtcagcctgcagccgcaatctcctttccaccagccagcgctagctagcggtgaagtggctggtcttgtcacaaaaagctaatcggtgaccagtcacgcgcgccctcccgcgtgattgaacacgtgtcgcgcgcagaggggggcggcggacggtacccacgcggaggggttttccgggttttttattcggttttctctttctattttggtttttttcggtttctcttctttttttttctttttaagatgtacgtatgcaaagtttatattcgtatgtataccaagttttgtatttgtacgtatagaaagtttgtatttatatttttttctctcggtttttaatatgtacatatgtaaagtttatatatgcgtaggggtgaaaacggtacgaaaacggacggaaacaatctttacctttttgttttcatatttttttcagaattagaatcggaatcaaaaactccggatacgaaaacagaatcgaatattatcgaaacaaaaaacggagcgaaaatgaaccggcgcgaatacggtaacgaaaatttatcagaatacaaaagtccctcaagctaagcttcaaactttgtcaggtacaattctcaagttttaacaatcaacaatacattacaaaacacaatcatatcaaatgaaatattttaatggggcccgactgtaagccggtcaacgttgagtcaagggctgagggagaggcgtgggtcccactctctttttattttatcttcttttcttttctttctctctttcctcctcatctcttttctatctctccctatatcttttctttctccgcttcttttttctcttgtgcttcccaaccaggtagagaggggatgggcggcgacgcagggggatgatgcccgggcagcggggcggcgaggcgttgtcggcgttggtggcggtgaggaagagtcaccagtgggcatcgacgtcggcggcgtggatggcgagaggcggcggggacggcgacggtgaagcacagagaggggcgagacgccgggggcagggacggcgagcgacggcggggggaggacggcgcgagacggcggcggccgacagcgccaggtctggttgcgtgcggtgtgcctgcgtggtgcgtgcgatgcactgcctctggttctcactctcgtcaactagggttagctggttagtggccactggccagccagtagtgggttgggctgggcaagtgggaggtattatggactttgtaacttcggaaattccgagaaagttttcagaaagtttccgatcgatttcgagttccgacggaaattgctcttaccattttcgattccgtttccgaaaaaatattttcgtattcgtttccgtttccgaaaaatttcgactggccaattccgttttcgaaaacttacccggaatccggaaatattccgtaccgttttcacccctatatacgcgtatgcaaagtttgtatacatgtatatttttttatacgccaattttctggtacacataaaaattatatatacatatgcatatattttgtatacacatatataaactataggtatgtatataaagtatatatatacgtatatatacatgtagtagtactgttgtagtagtagtagcgcatgtcagcagaagcagtagtagtagcagcagcagcatcagtagcagcaggtagctagtaggagcggactggtcgctcgttaggggcacccggtctggtcgagctcgagtggccggccggagagcacgtacggtcttgcaatcagcaaatacgacgatagtgttgatggttagtgcacatctctaagctccccctgtcgacccccttggtgtatccattagctgcggggctctggcgatggtgtgatcgactgcacagcaaatcacaccttaattttggatttcttttttgaatccttttatttgaattcaaaaatttgttcctacaaaattctcatggaacgtacaggaagagtgatcatgaagccaagctgggccttattttacaagtggattaattggcccaagatctctgctgatcccagcccatccaaacaaaatccgatcggatcagaattagacagagtactttgatccccttatagcacatccttccgtctttaacctctgagacaataggggcccggccggcctttatttgtcagctgctgcagctggcaggagcatttctttccttcttgtgcaatatactctctccatctcataaaaaatcaaatggatgaatctagagatacattatgtccagattcatttatagcatttatttttttatgagacgaaaggagtatgcaacaatatgcatgatagatcagcatgatcggaagcaaagaaccatgttcccaaaatgaaaaggagagatcgagtacgcatacgcaatgcaagcgatccaatatattcgatccaaatctctttaagaaaagagggaagtgtcagaggaaataaaaaggaaaaggtgtggcaatgcaagacaaaagcagagccatgcaatttaataaatcactaaaacaccttacccatatatttactccttccattgccaattgattatcatattataggaatgtatacaaaaccaagaaaaatcagtagctctcccatattacatttaatttggtaacagaactgaatacatgtaccatcctctaagggcaagtactataaacctctacacatttatttctagatgccatataaatcctctaagggcaagtactataaacctctacacatttatttctagatgccatataaactcacataatgaggtggttgagatatgcaaggagagagaaggagccacatcttatgcaagaggcaatctctccacaaacttctagagatataagaacaagagaccaatgaattgataggaaacaaataaagtaaaattaatatatgatgtaccggggcaagtgtgctagaggtaatttgttatatatattgcctcttataattaatgagttgatgatgtgaactaaattaagggtgactatcatctccactataaaacttgccctaatacttcctagccactaccaaaccataaaagatattgcatgtttgttgtaaatggttgtatgcatatgcatggatgcatgcatcaatacatttacttcgtccatgcacacatagcgagcagatttagtgaaggaaaactaatacgatgattatttacgtataactaaaagaattatatatgcatggtgattaattgggaattgggggagtacgtagcgtagctatagttttccgagaaagaagaacactcttgagcgacaagcacgaggaaaaggaaaagaaaaagaaaaagacaaaaggcatatttgcatatgcatgagatggggtcatggggccggggccatcttaatttgtaaatagtagtacatttggagtgtgtttagatccaaagtttacatccaaactttctacttttttcatcacatcaacctgtcatatacacacaacttttcagtcacatcatctctaattttaaccaaaatctaaactttcgcttgaactaaacacagccttggagtagtatatataatccttgtcctgtctcgatcgcataatacaaattaacacgatatccagcgacctgctctgcactactgctagctatctgatacggagtaattatttagttgatcctatatattcattctagctgcgggccagctggcgatttgatcaggccgtcagtcatccgttcgatcgtataaaaatatactccctccgtcccaaaaaaaaaaacaaacctggtttccgtgtccaatatttgaccgtccgtcttatttaaaaaaattatgaaaaaaattaaaaagacaagccacacataaaatattaatcatgttttatcatttaacaacaataaaaatacgaattataaaaaaatttcatataagacggatagtcaaagttggacacgcaaacccagggtttgcctttttttggaacggagggagtaccaggtaattgatctctctcatttctagctattacttttctttctagcttgttttaaaaaataataattattaagaagcttgcatgcacgcatcttcctttaattagttagtttggcgtcagttttttttaccatccttagagtaaggtagtgggagataccacattttttaatataaaattttaatatcatcatatgctaagtaccttaagatagtagaaattttaatgtaaaatctaaatacctcgagatacttgagactcaaaggaatgtaagatttctcaatactcttacagacctgtttttataccagctagctagctaccttggaaccggatcctccaacgtaattcattctacgtcagagggacgttcaaccacggatcgtcgttccttgcgcattcgacggcaaccaccgtttcagtccgtccccgcctcagaccccacaagcgcgatgtctctgcttgctctccggcccattcgttgataggggcagcggcgccgcgccggtcggccacccggaagctcaggcagccgtgtgctgccgccagcggggaggacggactggaacacagtgctaccgccgtccgccggcgaggtcgagggcgaggactccgcaccgcctcggtgtttgctgtcggtgtttctcggaaccgtccttggtgagctacacggggaacaaaaagaacagaaaaattactcatcttctcttcggttcgtgccatgagatttctttccttggttaacatctgcactcgattgatctcttcttcaaggagaaaaaccatcttttaccatcttttttggtaattttttattgcaattgcagacttgctatgccgcattctatatgaatctgttggcaaagttctggtttcagctctgattttaattcttcaggttacttggtagtttctgggacaagccaatgacagcacgaatgccttagcaagaatttcaactagctgcctcttccatgagaaaaggcaacctgatgatgcaagttcgatagactacggatcgattccaatccaacctcgccggcgatggttccgagaaacagcagttgctgggcgatgggaccaacagcagacaccgaggcggtgcagagtcctcgccctcgacctcgccggcggacggcggtagcactgcgttccagtccgacctccccgccggcggcagcgcacggctgcctgagcttccgggtggccggccggcgcggcgccgctgccgctatcaacgaatgggccagagagcaagcagagacatcgcacttgtggggtctgaggcgaggacggactgaaacggtggttgccgtcggatgcgcaaggaacgacgatccgtggttgaacgtccctctgacgtagaatgaattacgttaaaggatccggttccagctaccttttacatacttacacacacctgttagtttttaattaattgttgcatgttgtgatgatgtgcatgcacacgagcttggtacatatatatatagtacttttgcccaaataattaagatcggaattgctagctagatttcttgcccaagttttttttttattttttttcgaggaagcaagttttttttaatttccctcttagttaaaactgttggacttttatatggcttacaacatttatatattatggtatttatttaactcaatgtggaaaacatttgtgctgcatgtgatgaggaattatatattgatgtggaatttaactcgaggaattaatactagaggtgccaagaacgactgtgctgaaatacagtagatgaataatagagatatactatagaatttatatgtacatacatatttatacctgggtatagcagaaggtggaatagcagggtttgtttacatgatctgctctataagccattgacccacatgattatattggaattaatctcatatacaatatgatcatggcacatgactcacacatttgtgctcgggactattatattgtagactcatttaactgaactgtcttattgtggttgggagtttaacggtgtaccgaagaaaattgcaatattgagactgcaaacattggggcttcgctgttttgatactccgagtggatggcaaataggcctatctgtatctatgaaatgtgggtccagtgtcattatagcaaagattaatgtttacagtatcattattgcaaatctcccaccggaaatagatatagtgtatatctggaagaagattctataaatagatccctaccctctagctagctagcctcaatatgcattatgtctgtgagtggcaccatggaaaatgcagaggaatacagggtacgtaggccggatagacacacgaaaacctaacaaaaactacaatcaatttgtggacctgggattcgaactcgatcccgatggtagccagctgcgcacactacgcgcgcttgtgtttcatgactataagttacttatatacaagttacattataattaactggaatatatgtagttagaataattgtactatagttatatttgaaattttgtttacaaaaattaatgtctctagctagatactcccattaattaagagtaccatatatatatatatatacagtggcgattctagcaggtaggctccattaggttctagcctaccctctaatttttgcaaaaaaaaatcaactaggtatcctcaagcatcagccggagtcctggagttcatggcgatatgtgctcggcgctgggaagaagatgaacagggcacatgagagagaagaagcgaagcggtatgcagataaactaggttggcccaattcgatagtaatggcccagtccagtggcccacttcccacacttacacactcacacaggtcaggtggggacttagggttgggggcgtttggggtgggggctggcggctggtggcgactgggagcggccgacgccgacggccgacgcgagtcgcaactcgcaagagctcgaggcctcgagctgcaggctgcagcgtcgtagctagctgtccggtggcgagtaagagcaagcgtaggcggccgcaggcgcgagcggggcgcggaagccggcaggctgcaggcggagcggccgcgcggggaagcgtcagcaggcgccgtggcagcgcgcggagcagcaccacagcagccgctagcactagcagagcagcaggctcaggatcagcgggtcaggcggcgtcgcggcgaggagcagccaacagcagcaggataaactagcgtccggtgagtcattgaataaatggaatcatggtcttgctggttgctgcctatttggctgtattggttatttctattattctattcaatttctgcaaactaatctattgattgagtggagcgcatattttcaagcacgagcatttcaagacagatgtgcacaataagatatcggatgggtggcttatagatttgaatttgatggtctgctatactgagcgagaaatattcaaaaaaaaatgatgatgacgacgatgatgcaatcatcataaatatattccaagcattagaaacccatagaatatccttgcctcttaaatgaattacatgtattttttgattaatggtaggccaaatctttcagttaatgttatttttccttcaatttatcactgatttctcatatgactgatgtaagcaattacttcgcattggcaaggtatttttctttatttctttcttttctattcaatcatgtatcatgtatgtgttgaacagctactgtaagtactgcaatttactttttattaacttagtacttggaggtcaagcctaccctctttgtctatcctggattcgccactgtgtgtgtgtctatatatatatatatatatataccactttattattcactactattcttagtgctgaattcactattatgagtacagaattactgttcacaggttactgttcactcgaaaattttctttaaatttttaggatctttgcagggtggcgaatccaataacagccggcgcttgatttagaaattttaaagtcctactcggtactagccgtatgcctcacttatctgcctatttaagcaaccatcttcaggtatccctagtcatatttgaactagctaagcgtttaccgtctccccaggcagttccacccgaggggaacacttctctacggatactggttctccagacgcctatgcaagatgcaggctaaaaacgagaacaaccgagaggtttctcctatagggtccctagcataaacgcttatctagagcaaacaaacagggaaacttaaagaaaattacttcatattaagcaaataggcttacatacggttttccctttcgggaaccccgaaggtagatacaaacaagtttttctcactttacaaacctttatattacaactccttgcttcaatatatattatgcaaggtaggctagaggaactactactaagaaagatggaatggagggtgagagcgcgcttggaagctttgctctgaatggtgtcttcgtggttgtgtgtccccggagtgaaggccaacgtctccttttatagaggccagggatggcgtcgcctgtgcctcctgcttatctcttcgctactgtatcttcatgagagctggctaaagttgaggcctttccaccgaaagttttattcttcacagggatatgtcattcaccgcaccctatattgtccccttatactttatagggtgtccttctggattctttcttgggtagtcttctgaatttcttttattctttctgaatttcttttattcttttattcttcttccacgcccaaattgttgatattctattatcaatatatattgaaaaacatatttagcttatatcaatttattcatctggttgcccatggtcaccaagatccattgtgtccaaatcagaaaaagaaacttctaatttctcatctactgccttttttatttgctcaaatttctgatccatttcttgttttaattctttaagtatttcttccttcaattccttctttaattgtggggaggcttcttcaaatttttctattatcttccaatcaatatattccccatctaatggatccactccttttgttaagcattccttgtatgtgggttttttaaaaaacccttcttcttttatagtcatcttaatgggtatttctgaagtcttctttcctttagcttttttgcatttttgaatatattcttttgcagcaggctctagataataatttattcctaatatttttctagcttggcttaatgcttcatcaatatccttatatttctggtaatgccttaatattatagttaatttttaggttctctagttctacttctagtttatttattctgttttgtaaaactcgtactctactagataatatcctttcatctgattctaattcta

SEQ ID NO: 45353 - DNA, 4548 bp, Oryza sativa
  unsure (1)..(4548): unsure at all n locations
atatatatatatatatatatatatatatagacacacacacacacatacctctggaattggaggtcgacgatggaccgcgcaagttcacttatcagaaactgtactgatgctgaggtgaggttgctggagaagcgggcgaaatgggagatatggcgagtgaactctctgtcaatggtgaacgccatgttgatgggagtggttgtggggattggagcctatgccccgcgctaccgacaccaccccttgactcgcttcctcttccagggtgccgctgcactcttcatgcctatagtgtcctatgttgtctctgatagtacttttgttacctttctcatccaacccattacaaccacagcgacctgcagatggctcctacacacgttttgtatcttacagtggacagtgcttgttcagattgccgctatcaacaccataacactagtggcaactgatgctagagaattaggacgaagcattgcaccatctgcattattgattattcatgcaatctggacttgctacctggtcatctacttcctggggacggaccttggtagtggcaatgatttttcagtcaaaaccatctcacaggatatgagtgattttcgtagaatatttgtgctggtttcagcgtgtcttatgtttgtcaaattggttttcaagttggttgcatttttcatggcccgacaatcgtttgctcttggacggaatcctcggcttgtgcttggatacatgaaggagaaggagaaggacgtcgtcctaccatcagtaatgcatgtaactggcgatgatgtgcctcctccgccacttttagttatgggagaggacactgttaatgtacaaaaagggcccaatagttacactagtgtagttgataataatctacagcagagaggagctgctggcttggtgaacttagatgaagtttggcagcaaatggatgacgagtacacgaattattctctgacaagctggacacctgcaggacacaaacagctgaaagatgtttgtctttcatttgcattgttcaagctgttacgttgtcgattcgcaaggtacacagctgatgagctcaagtttacctgggtcgagaatttcatttggcaaggcctgttgctgaccagtagtactcatgatggtggcagcagcagcagcaggagggtgtttaaggttatagcagatgagctctcattcattcacgattattactatgcatccatccctaccttttattcaaacacctgctggcttcctatcctcaccttctctacctcagtcttcaccttggcttacagcttacgtctagccgttttgtcgaccactcttgcttgcgtgaatttctccaactccttccaactatggtgtactatgccatgcaaagatgtcggggccagagatttccttgggcacttcaaaagattcgaagattattatacatttggaagtctcacatttgatctagtgccagctattcttctttgtgtgctacttgtgctttccgaggcgaggaatattgcttcccttttgttctctaactggaccaaagttgttgtcatctgccgctacctgcaaccaacaaatcatcatcaccagaccacatcttcgtctcctgctgctcctccagttgatatgccaagacgacgacgacgacgatcatcattggtaattggatgctgaagcttattattgcgatgcagttgcaagctggtgaataacccatggaaggacaacatcaacctctgctcaatcctggacatgcatcgtccaacagcaaagtggtcgccgctgccggagaaaaccaagatcgtcaaggtgcccgaccaagtgaagtccgccatcgtcgccaagctcaggagcagcaaggggagcctgcagctgaccaaagcatgcacggcgtctctgcatctgcagggcagcgacagccagctgctctgggaggatgtgacagccacaaccgacgtcctcctggtgtgccacatcgccaccaccatccttgaggtgaagtatccaaatccaagtacaactgcaagctcaagctctgacagcagcaacagggttgttgccactcacctgtcaggctactgcgcctacctggtggcctgctgtcccgagctgctccccgacgacgatggctggagcaaggacctgtacaaggccgtcaaggcagacgctcgccgtgctctcgccgccggtcgtgctccaccggagtacgagaagctggtccgattgctcagcgcaggctgcaggcacaaggtgttaaggaatggcgcgcagctcgcggagcaactggtggcgttggtccaaaaccaacaggaggaggaggaggaagggaataaggcgtggggggttcttgcggagttttggtcggagatcatcctgtacctggcgccgtccgacaacctggacgcccacgcggcggcgagctcatcacgctgctctgggcgctgctcaaccacgccggcatcgtctccaggcccgccgccgccgccgccgacaacgagactgcggcttcttcatctgctgtttaagtttatttaagtgctggttaatgcgtgtttaatttctttgcatggctttgttggctggctctttgtgttcgctacctttctgtgtctgctgcttctgattgtttccctttgattaatgccaagtgtgtggttatttctgagttggattgattcaaaaattggacattagtttgtacgtttccctttgactaagctgctgactgctttcgttttaatttcttgatggataatagaataatgaattgatttcctttttctttgaaaatccagtgataatcaacaaatacattacaccctccgtttcaagttataaaatgttttaactttggttaaaatcaaactgcttcaagtataataaagtttataaaataaatagtaatactttcgacctaagattaatttattataaaaacatatttaattattaatttaataaaattaatttagtaatataaatattattatatttgtctataaccgacttcgaccaaactcaaagtaatttattcgtaactgttagagagttgggcctctccatgcgctttacagcccatgccgcacctgtagcttgtccggcgtggccggccggtgaaggaaaaagtgtaccgaaggtccctcaacttatcatcgggataaaatacgtcctcgaaccgcaaaaccagatacacggggtatcttaactatacaaaaccgatcaccccgagatccttcggtggttttgaccacggttttggtttacgtggcggctgagtcagcgtgggacccacgtgtcagcgtgccacgtcatctctctctttcccctttctttttttctcttcttttttacttctctttgcggcaggggagtagcaagaacgggcggcggcgagcagggctgagcggcgggcggcggaggcggcgtgcgagcgcgcggcggctggtgagcatggtggtcgtcggcgttgccatagtggttgtcggtgtcctcctcgtctcctcctcctccgcggccggatccagccacggagcggtgcccggcgtcctcctcctccgccgccaccacatcgacggtgtgccccgcttctccctccctcgccagccatcgggatgacgggacgacccgcagcgcttgccgcaacctccacggccacctcctgcgcggccacgagctccgcgtcggcctcgccggccgccccagcagcaggcccctggaggacggggtggcggaaggggcggcggtggggttgcccatggccgctaccccgcccgacgccgcggcgatggccgtgcgcccgtcgatggagcggactgccgtggcggtggccccgacatcggccttctcctcggcagacagccgccctcctcgtcgcacggcatagcagcaggccagcagcgccgccctcctcctcccgcctcctcgccggccgcctctctcatctccgcacgcgtacgcctgcacggtcagggacccggagcgcccgtcgccggcgtccccaacggagaactccagcctgtacgacagcccgggcacggtgctcacctcctgcaccatcgccgtctccatgccggtcaccaactcaaccacgcgggcgccgcccggcaccgcgtagtgcgccgtgtcgatgtacttgacggacttggtggtcgacaggatcatccacggggacagcgacgagtagtcgtcctcgtccatgggcggcacccagcacgactccgatggcagcgccgccagcagagcacgggaacggcacgatgcctctgctctgcgccatctcggccgcgtcgccgccgggtccccacgccaccgcccccgtgtcggccccgatccgcagcctcttgcagggatcggacccgttgttgccgaccgcggtcagctcctccttcttggcaagcatggcgtgcagcacgacgcccaggtcgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45354 - DNA, 705 bp, Oryza sativa
caaaatagcactgcatgggtacacattcattcactgtgttgaaaggctagcagctgcctcgctatctgttggcatgggaggaggccaacggcctgctggtaaccaggtagccctatcggcaaatggtttgcggatatgacctgtcagcatgtgtttttgccaagaggacctgtctcggtgacggccactccggacacatgtccaccttttcagcacgccacgtgtcgacagggctagtcggcattctgcttgggtatatggcgtgctgagtgagtgctattttagcaaaagaatttgaaacccgatacttacaattttccattaaaaatattactaaaaaagtaaaagaactatttgacgacttatcgagtcattcaaattttattttgttgtgttttgctaatatttgtttgggtgtctattttcttaagaaacttttggcttaaaaaaacttctttgtgccatacattttacttaagttgtttgctttcaattattttaggaatttcctcgtgtgcactatcgtgttgccaggacgattgatgcttctactttgacaacactacgagatttggcacccacaaagcttgctgctggtgtgtggaattgccttgcaagatttaaggctatgatacctgaattccctcagactgaaacatgtgaattacttatcgtagaccgatcaatagatcaggggtgcaggaa

SEQ ID NO: 45355 - DNA, 2213 bp, Oryza sativa
  unsure (1)..(2213): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaacaatgcatttcgtgtaattttattttattaaaatacttttaataagcaatttttttagccttgtagtagttaattcatcgtttatacctcaaatagaaaaaaaaagataatctatcaatctttcaatttcagctatctcaaatggggccttactagctagcatcatttcagggaaaagccatgcaatattttccacatcatcatcccatcaaaacatgatctgttattttccatttctctgcctgttcgatctaacatacatgtgaatacatgttgttcgtccattgtttcaaagaaaccagataaaatcggttatagttattttttcttctagcatccccaaccaatcatttcactaatagtttgctaagctcactccatactccataggaaaggtatatggacactcctaagtgaacactccattttttaaaatacatatactccctccgtttttttaatatatgacgccattaaatttttaagatatgtttaaccattcgtcttattaaaaaaattatgtaactattatttattttactgtgacttgatttaccatcaaatgttctttaagcatgatttaaatatttttatatttataaaaattttgaataagatgaatggtcaaacattgataaaaaattaacggcatcatataataaaaaaacagaggtggtattaaatatagtgtatcagttctgacttctgagctttctttgatgttaaactataacaaccatctctccacttgggactcagcttcggtgacatcgtgtaaccatgtcacagtgtaacattcggtggatctcagccatccaaattgaatccaacgcctgttttggttgggcccgcttgcaggtaaaaaaaaattccccaatccatccatcccgacgggggacggcgccccaatccatccatcccgcgtgcggctctcctctcgttcgcccgccgacgcgagctgggaggcgcgccactgccgtgactcgccggcctcgccgcgagtggggagggctacgagcgtccgccgtcgtgcctcgctgggctcgccgcgagcgccacgcgaggtgtccgcgctcgcatcgtcctcgtcaggccgtcgcggagaccgaggaccgcctcgtccgtccgcgtccgaccgtccggatttgctaactcgcgcacacacgttgccggcgagcatgcccggccaacaaggcccacgcgcgcgcgagattttttttttctctaaccaatctctaacgccggtttttccgttttttcttccgcgttttttcttttggcgtttcttttcgcttttttttgcgttttttttaatcttttagcacacgtgttttttcaaatgttttgagttgaaagtttttaaatattgacttgaaaattttttaatttggccttgaaattttcaaatctcaagtgaaatttttcgaatctgagttgaaagttttcaaatttttcatatctggacttgaaagttttcgaatgttgagttgaaagttttcaaatctcgacttgaaaatttttaaatctcaagttgaaagttttcaaaattttcaaatccggatttgaaagttttcgaatcttgagttgaaagttttcaaatctcgagttgaaaattttcaaatctcaagttaaaagttttcaaattttttaaatctggacttgaaagttttcgaatctcgattctcgagttgaaagttttcaaatctcgaattgaaagttttcgaatctgagttgaaagttttccaaatttgactttaaaatttgaaacttaaatcaaaagttttcaaatctaacttaaatttttctcaatttgctagtaaaaatatctctcaaaaaatcttcagaatcttttctaattactactagtatcattagtattaagtgttaactaatagattaatagataatagatgtagttaaactactttaagggaggtgctcgcagctaggaggcccccccccccccccccggggcgtccagccgaggccctgccgtcccgccgcggacagggaggggtcaggggcagctcggcg

SEQ ID NO: 45356 - DNA, 12360 bp, Oryza sativa
  unsure (1)..(12360): unsure at all n locations
ttctccgcgacctccagggagaggagaagatgtcaaactccgacatgatcgctgttctttgggtaagtctcgtcttcgtcgtaaagctcgagaaggaaacgtccatggcgttttcatggattggtttcttgttttttctttctttaggagatgatctttagagggacggacacggtggcttgagcaatggcagccgccggcttccacgcgcctccctggccgcgccgggacggcagggtgccacgctgccgcctccgcccgcagccgcgcgacacgctcctccagctcggcgccgcgcctcgccgcattcgaggcctccgcctccttctccctccggcagtccggcgcagcctccccgtctgcaacaagcaagcaaaagcgacgccaccaccatagaaaacgcatagtcgaacaccaccagcagcaagcaacgaatcaacacgatcgacgacgtcgacgatcctcacatgatcctggaacatacgcgccatctcgttcttgtaccggtcgaactgcgtggcgagctcgtcagagaggagagacaacgcggaggaggtggtcgtcgtcgacacgtgctccgacccgccgtcgtcgaagtcgaggcggagccccgtcgccgccggcggccgcttgttgtgccgctgcgccaggctcaccaccttgtgcccctgcgcctggcgaggaagaggggaggaggcagatgctgctggtgctggaggtgggccggtgctgcttcccgttggattagttttcaacgccccagatcgctccaatgtcacaccgtgacatgccatagtaaagtcaccgaatccgaatcccccatagaacataaacgagtacctttacgatactctccactagtattattctactttcagtattatctctgttgaagtgatcttaactataaattaatttatgagtcctaccgctagtagaaaaaaataccagtagttaatgtgatagtgtaaatagatattatttattgaattagaaaaaataaatggcttacatcttaagataaacatacctccattcaacaagactaacagtttatgaaaaatgaaaatcaatcctaatttttttaaaaatatattattgaaaaatctaatctagcaatatctatgctcacatgcctaatccatcttactataaaatcataacccactaatcttaaaactcaatatgcaaacatgccatctgatcatccactagcaataattatatacaaaacttatacaagcatgcaacatcagactgagtttgtatgttgtagttgggaactaatctcgtgcgcacgtaaaacagagcgactcatagcacacaattaattaagtattagctatttttttaaaaaaaattgattaatatgatttttttaaagcaactttcttatagaatttttttgcaaaaaaagtactatttagtagcgtgcacacgaaaaaacgagagggtgagatgggaacacaaacaaacgaacacagccctataatttattgaattctacaaatcaacatccaatcatcttcttcaaattatttttcacaatatttttaacatatatacatccattatttttataatacttaatatatatccatccatataatcaaagtgcgggatatcatatttcatttacaatcttatacagagtctaataaatttatttctctctgaacatagtttgacaaaccagttttatttgttgttaataactaatataatttttacttttagcttgattattaaaaaatattaaaagtagtaattttcgtagcgaagcgcgtaaatcacctagtattataaaatcctaagtctgattttttctcattctccacaactagaggcgaggtttggctcctaattacaacgtgcagctcgttcgtgcgctaggaggaggtggagtctcacgctagagtaggagtgaagaggattgattctatttgatgtgtttttatgtggtctacttttttgttctgagaagtcaaattaatctgtaaaagcatatctaagagtctctccatttgcttctctaaaccaaaatttaatcaactttagaaaaaaaaagtagccctccaacattgccatgaggcaggccatgaggcatttggccagccaaccagcaattctcgtggtccacttccacttatgttgccccatccaccgtcgatgagagggcggcgagccagaccaagcaccaacggcaacgatgacacggaggaagcccacgatgagccccaggtcgacgcggcggagaaggctgcggagcacttcttgtaggggcaccggaccttgcctataatagcccgcgctccagaactacgcaacccagcccatccgacaagcaaacccatttacacatagcacctcacttacacttttatatactcgcttcgtgtatattgattaccgtgagcggtatatagttggagggaaaaataacttatatggtttcactcttgctcaactcgtaaggtgatactaataaaatgcacacaacatttaattatgagtcacataggccacatcctaattgagctaggatgtcacaatgccaaagcctaccgccatccaccgccttcattacttatcgttgtctactcaagctccactctatttccttcctttccccaccctcgttgccaatgatgtgatgtggtggccatggtgtgggtgggaagggaaaagatgtattggagaggaagaaaatataaataaagattgacatgtgaagcccacaattggattggagaggataaatagagaggatgttaaagttaaaggtaaatttcgctctctaattttttttaacaagctaactaaatagacatttagagagtcatatttaaagatgttgttagagacacttcatggaaggatattttcatgctcttagggcaatagcagtgcagctaccgtacttgagaagccaaagcctccagctagactaggaacggtgtaagaaacaccctccatagtgtatgtggtattaaataggttccttcacagtacatgttacttattatagtgggtctcaaccgtctctctcttctcacttttcatctccccctctcatccctttgccttttcccaccagccaccaagcaaaggaagtgagacactaggcggcccaagcggcgacgcgttaggcggggaacggagaggcggcgggatggcaccacctctccaggcgacgacgccaccaaactcaccggatccgaagtcggctagcagcggggtggcaccacctctctggacgacggcgctactgagctcgctgaacctcgcaataactttggcctaagccgccgccgagcttcacccccctgtctcgaatccgcggttatgtttttggttcatgcgaggttgaggtgagctccaacgagggctacggcgccgacaaaggcgagctctgacgaggtctgtggcatacgtgcttttgcctcccgtcccagtccttgcatcttgtgaccatcggtgggtggatcgagcaccggagctggagctcggtggtgcaagctggagggagggtcgcaaggggctgccaccgccgttgagctcctcggctgcgtgcgatgcggcctcctcccctgacagatctggccacttccttctcattatcctcctcgccgcctctccttcgatcctctcactcttttacctggtggagctagagtacgggacacgaatgtgtgggtctagacctgcgaaatctaacgaggaacctatggcaatatttggctctgcgttcttcatgtagcaatgcaataggtagacatggagtggaatctccgacgtggctagcttgggctaaattccacttcagtgcactatgaaaatccttagacacccctttggaagaaaattctatgcggcagcgtcgcatgacgcttctcgtgtgacaccgtgcgaactggcgacgcgtgtccggctgccgcccgcgtgagagtttcctggcctgctagctgctgctgctccctgcagacctgctagctctcgcggcgctgttgttgctcgcacgcagcgcgctcccgcgccgccgccgacgacctgctgcattgttgcttctactcgcgtgctcctgtggcaccgcgctgtcaccgacttgctgctcgtggctgcgctctgacgctccgctgcctgcctacctacctagggatgaaaacggtcggaaacgatcggaaaacagcctcaatcatttccgtaaccatatttttcttggaaatgaaatcggaaacggtaaattcggaaatgaaaacgatatcggaaatatcggaaaaccggaaacggaacaatacagacggaaacatgtcggtacagatcgaaaacaggtaacaaatacggatacattaaactataaaaacatatatttaactttacataagtatgttatatgtatacataaattcaagcttatactatataaattataaattaacttcattttagccatgtacaaaagttagagatttgattgaagagtcagtcaatatgtaagctgcgggtcaagtatagacatgctctataaatatcgacatatttagaatatggtaattaccatattataagaaacggtaattttcacaagaatacggtaaatacggaaacgatcggtataacagtaaaaccatttctgttttcatttccatattttttaccatttccatttttgtttcgatcgattatcatttccatatggctcggccggtagaaagtcgaaaacgaacgccggtcggccggtaattaccgttaccgttttcacccctatacctaccggctgccacaagggagcagcagggcccttacagaagcagcagcagccgctgccgtcgtcaccatagcagattagagcgatggctgcctttaagctgcggcctgcggctttgactcgtcccaataggcgtcgactcggctccagcaaaaatcgcgataggcatcggctcggctcaaagaaaaatcttgtgcggtcggtagctgtacatacgtcaccagttcgtacggtgtcgcacgagaagtgccatgcgaaactgccgcacagaatttttttttcccacccctcccccccccccccctctactcctacccctgaaatcacccacaggaaaaaccactcggaaaccgtagctaaagcccggaaaggaggataggaaaaccgtgcaaacggggccagcgagcagtaatgacagcggcggcactgcagcagcattgccagcgagctcctccactccacctctctctcttgtctctttcacgctctccctctcctctctctctctctctctctctcgctcgcttgctttaccctctctctctctcttcctcactctcactgtctcactgtctcactctctcttgcccacatttttttcccccggagagcgacaactgcagggcccaaaaagaggccggattctttggtgttttctgaaccttctttacttgtcctcaaatggccacctcttcctcctcctcctcgcatttcctcccatagctcgcattcgcattcgcatcgcactcaccctctcctgcaagcaaagctaaagcttcggtttggttatttcctttcctcgccgcttttttctttgcttcttgcggtggccatggcggtaaggaggaggaggaggaggagtagagccgcggcggttctggtggccgcgctgcttctcgccgcctccgccgccaccgcctccgcggcgtcgtcttaccccgcgagtaagcgagcgagcaagctctcggtttcttcttggtttttggtgttctactgtttcttggctgaattcgtgtgtttttttgggatggttggtggcagaggtggtgaccgggttgctgtccagcacggcgtcggcggtggtgaagcagctctggtcgctcaaatcgaccgccacaaggacgggtaattcgtctgctcctcctccttggagaaaagaaatttcagttcttgtgtgtgcgcttcttccggtttcttgaccggattattgacggtggtcggcggcggcggcagggtcggcggcggcggggaggtcgatggtgaagtacgagggcgggtacgcggtggagacggtgttcgacggcagcaagctggggatcgagccgcacgacgtcgaggtcaccccctccggcgagctcctcgtgctcgactccatgaacagcaacgtctacagggtccagctgcctctgtcgcgatgtgagcattgctagctcttcttccttccttccttcctactactagcttttcagctctgactcacagtcttcttcatgggattctgctaactagtactactttatgatgattgtcaactcgatgatgtgaggctgtgagtttggtttggttggtcagtttgtgattgatgatgtttgcatgctagattttggtccaggctagtttgtttgttgattgcgaaatgtttgttagtttcttgtttgcaattataggttatgatgtgattgtgctttgctacttggtcactttcactcccattgtttagggaaagatgacactggagttgtcctctatcttaggatttgactaaacaggaacctgaaaaatcattggtgaaatgaaatacatcgtaatttgtttgtccaaattagtacaaaagcttcactatctgatgtttttttttaaggcactgtacgaaaaatcggtgtcgacattttacttatcaattgacgcatttgagatcaccagattctgatgtatcttgtaaaaaatggatcaaacattacagatagcagaccgaagcttgttgctggttcgccggaaggattatccggccatgtcgacgggaggctgcgggaggcgaagatgaaccatccgaagggatttacagtggacgataggggaaacatttatgttgcagatgctatgaatatggcaataagaaagatcagtgatacaggtaagctaaagtgtctcttatatggggttgttgcacatgatactgtctggtccccaagcatcctatgtttgctatttggttttcattgtaactcttcagcacttgtgtccaaaggtgcatttgaaacaagttgtcagagtgcatggaaaggtcatacccacagttttaaatgccaaaatgatagtctaagtggggtgtgatccatggaagtgtttgtggaatcgtggttataaaactttctaatcagcatttgtcttatttacaatgtccccaagttttcagaaatcatgacatcctaacagttatgtgactattgatgtcagaaaattgagtatcacttgcttttgcaagttgcaacagtggaagagatgtcacacattgaaatgaacctcaaagtggacaggaagattacatgattggactttatatactagaatgatctcactcttgatatatagtgatgtctgtaacccatgacatcatatttactcattgagattgggtatgttatgagtgtgttatagacttgtagtgcacttataatgcacttatgcacatgcagccatgcacaaaacattttgtatatttgtaaggtagatttctttttcgtatgaaaatttatttatatgcttgcttttaatatctctatccattttaaattcttcaagtatacattttttttcttttaattaattaatttatctgttctgaaggaacttcatatttgagttttccttctgatgaactttgtttggacttctggaagggcctagcatgcatattattcacttagtcatgtaaatcaaaatgtctctgacaaaccgcttttatatgcaggggttacaaccattgctggggggaaatcaatgagaggtgggcacctagatgggccaagtgatgatgcaaaattttctactgattttgaaattcgctacatcagcagtagctgctccctcttggttattgatagaggaaaccaagcaattcgcgagattgcactccacaatgatgactgtgaatatcagtatgaagctggttttccactaggtgcatctacattacaataagctttctattagtacttcttgaccagacaatattgttgtcccattttctttttaaacaaaaatcgtctcagatctacacatttagtcgaatgacctacatattatatagataagggcatgttaaaactgtggacattaaccatttgagtttgaattcacaggcattgcattgctttttgctgctggtttctttgggtacatgcttgcattgcttcagcgacaggttttagggatggtatcaacagcagatgtaagtgcttcattttgttgcgttattatgcgaacaaaaatattgtttacgttttttcgaagcacaagaaatgtaaggccaagaactataagagcacagtccacagttgtactataaacaatgaatacagacctcaagtagatcatggtacagctttaaaatgaaacatggattgacattgactatgaaatagcatacgagcgtatggtcaaggacactgaaaaggtaacatacaaaataaagtaatacaatcaattttgttgtacctctagagtgtagactctagaccaatggtaaagcaaagacgaataccatacatgttctcttgcccgctttgtttttatttctaatttcatcgccaccttattttgtatggaaatttgaccatacaggaacctcagactcctccaagacccagcattgcaagcatccctccatatcagaagccactaaagccttcgcttcggcctccactgatcccaaccgaagatcaagctgggaaacatgaggctgaagaggggttcttcacctcaatcggcaagctcatcggaggagcaaaatcatctgcggtagagatattctcacgaaagaaacgcccaacccatcagtaccatcatcaccttcagcagcaaagagccaacccttggccggtgcaagaaagttacgccatcccacatgatgagacaccgccaccattggacatgagagcagctactcctcggaagaactacgccttcatgacgaaggagcctgaaaaagttcaccatgtccgccatggccggccttacttcaacggctgggacatgcagcatgcccctcagcaacagccagagcagcagatgtaccaccagcagcacctgcagcagcacaggcagtactccgcaggcccgcaaactttctacgagcagagctgcgagacgacaaacgagatcgtctttggtgctgtccaggaggtggacaccaagcggcgaatggtggagatcaaggccgtgaactatggggacacattctatgagcagtacgggatgcggtatcgcaacaattacatcggctacaacaacagcagcaacggcaacaacaacagctactactattaaacaaccaacccttctgccctcaattttccccctctctctttatccctgtttctttcctatatgattagatttaccgctcgcgttttcgcttctcctgacctccgcgacgcctgtaacaaaagaaagaaaaagcgggggggaagtagaggcactaatcttcttcagtcctgacctgtgcaatgcaatggcaaacacctggggaggggtttttgtactacaccctgatgatgatcagacactcttacactaccatcctgtacatatattttgttgttcaccagctcagctgttcctcaatccatgttggttgcagcaccaatcagtcatgctgtgatgatctctttgcactactgctgtatcctgtatggctgtatgttgtgttgccgcacccaccacctgatgagcagctcagctgcatcagtggagcaggcaggcaggcagctgccgagaccacctccactgtcaagaaagctttgggagtttagtggctgcatcatgtagcgttcgacctcgacacaggaaacttgcgaaaagcaccgcccttttttcagtcgatctttgcacatgccgatgcgcagcgagacgaagctgaatggcagcttggttgctgtttgcaaaaaaaaaaaaaaaaaaaannnacacactgcaaacagcgttacagcaacagtagcttctcactcactcaccttgcctcgtgacgccagtgaatgcactcaccgatatcaccgtctctccagtggaggaggacagccaggggacacagtcctatgtgaccgtggtcagatcagaagttttcagatgtatgtatgtatgtgtgtgtgtgaccagttttactgcgatgaggggtcggcacaccgctgacatgtatgtggacctgacatgtcggatcatggtgaaatgaaattcaagagtgaggacaaagcaatgaggcgatgaaaataaatcagattgtccatatctgaaaaaaaaattgagaagtttgtgagaggagaggtttactatggcacacaggtgatggtagatgctgtcgttgtagcaatggataatgtttgcagggatacgttgctgagaagccttggagggcagtgggcaccattgctggaggacagagtcgtacacttgtgcaggctctggaggtgtctctgatgtccatgaaagatagacatgtttctggcagattgctgcgagacaagcttgacgatgaacggtgacatgttttctgatcctctgctgcgagacaagctcgatgacgatgaaagacgacagggcctgaaggaaagacactcgatactgctactgcccattcattatcatgtggttgaatttacactcaaaacaaatgttgtcgatataaaaaaaaaaacaccctactacatccgtcacaagagagttcacttttcaacacgaatctgacaggcacttgtccagattcgtgtataaaagtgaattaattcttttgagaacaggggtaatacattatatcttatcccacccgattagtcgaatgaagcctcggcatgttcaagtcaagctatgcataccaaaattttgcttatctccagccaacaggtagttaatccaaggcaccttcttgctgctgtcactactaagccacctttatcttcgttgaggcagcgaactttgattcctctgtcatgctagctatttacttttcgttgaggcagcgaactttgattcctctgtcatgctagctatttactttcttattaggtagcaacacttcaatcatcactaataagagttcgctgaattatttatgaaaaaatggttcatctgcttcttcaattttcatgtcaactgtcccctctagatacatcaggaaatgatcccagtatctgaaccataaagctaccagctgaaaaagaaaaaaaaaacaagaaaaaaacatatcatcttcttgttttgagatcttccccaacgaatgatccttccatttcttggatcatggctaataactatttttttggtagataacatttctagtccagaatgtcagagaccatcatgagtaacaacataaaaagattagtagtaagatgtacctatgatgaagatagctccaacaaatcctgtcatgccccatctctcaccaagcatagcccatgcaaaagctgcaccccatacaggttccagaccataaattattgcagtttccgtagctgatacatcacgcatagcagccacctaagacaatgaaaaggtccacacaattaacacttcaaaatgttgtcctcaactgaagagaattgatgcagtgaggataaaatgttacctctgcccataaacaaaaggtagttgagaatatgcctgtgtatagtattgacaaccagggaaactgtatcatcacaccaaataacttcatcggtgactgtaattgtgaagtccactggtgcacattcttggcggagcatttaataaagaatgagactgcagatacaaatgctacaacaagcacctgggtttacatttcctatttagcacctcatctgtaacagagtaaaaaaaaatatcatgatataaattgcaaaaatggagaacaaacctggcatccaacaagagctggaaaattctctttcttcatatttcgggaaatatgctcagtcctgagcatatgaattgcaaaaccaaaggcactaaggaggttcagaagatcaccgacctaatgatattaccaagaaaacatcagtactccagaggaccgaaggaccaaattctaacaagaacgatatttgacagagaggaatattgtagtcataagtaaaatagacaaaaagtgcagacaaatttgttaacctgttcatgtggataatctgacttacacatggcggtgaaccacttaactccagaataccaaccccaataagggataaaagtgctccaatccatgtataggcaggtatttctgctccaaggatcccatccaagaaagggacaatgatcacctgaacatatttgagtaaagaaccatgaaaatctatatattctagggaggaccttattggactaagcttgagaaacatgtt

SEQ ID NO: 45357 - DNA, 9774 bp, Oryza sativa
acactctctcgcaactcaagcatatcccaaatgcaaacgtacaaatagcctagcagcatagaagacatctcaacagaaaaccactagttccatgaagtttgcaattaaatagaaggatcaaatattgttcaagtactgtccatttctctccgtaataacatcgaacaggtgatgtgcaagcgcggcaagtgcgttttcacaacgcagggtgtacatgacgtgcgtaccgaagacgatggtgaccagattgagcaagacgacgctcctcgccttccggggcaccaacgaggccaccttccgccacgccgcccgcgcccgccgccgcgccgtggtgcaaggcgaggcgggcggttcgtcggggacgggggcggcggattcccgcatcccgggcggcaccgacttccacctcccactctcatcggccgccttcttcttcttcttcttcttcttcgacggcggcggcggcgaccggttggaatccttcgacggagaacctgaattggaggcggcggccaaaggcgcgaggaggcgccgccgtctcgtcggcgagggcgccgccgctgggaggaggcgggggagggtgcggaggggaggggcttctagaagggaaggacgccacgggcggggagggttcggaagcttcgagaggaacatctcgccggtggggaaggttctagaaggttggaggctgcgaccggcggctggaggaaaaacggcgaggtggaggaggcgagcggcctacgattggcctgtttgggtgggccgaaatctaggcctatccacgtgtaaggtcgagattttagctcgagtactcggcccacgaatgtgtgtgggcctcgatttcggtccatccaaacaaagattatggcttctcttgtgatttcggattttagtttgcgcatgtcctaaacttctaaattgtatgttttatatataattttttataggaattttaaaatagtttcctaaatcaacttcaactttgtgtcactcatttataccttcaagtagttatcacaacatcagattatctattgatttcagctatctcaaataggacctatatggactacggagtgattaagatcccctaactttagggggggttaaagtcagatgaacagtatcatgactttggggtgttttcagccatccgattcacagcaaacgaacgagatcaatctctaaagtatgctacaatactaaagaaacagtagtgcggtacaatacaattgattgttttaaactgtagctataaaaataactgcaaaatcacttttttctactgtggtgttagactcatttattgtgcgtctctatctttagcgcccgaagtaagagcaggtacaatagcaggctattagccagctataaacatattttaataagataaacgatgagagagaagagcagcgggctacagatctgtagctagctgcagcacggactccaagacacactgtgtgtatgacaggtgggaccatatattaatagtatagtaagcaattattatatgaattggctattagattaaatatagatgaattggagctagtagtgagctgtactattagacttgctctaagtggatatggatccctatgaagtgggattgaggtaagaaatgagtggcacaaactacatttgcggtgcaacgtacactaatgcccatacggcagccagaaggtcacggcgctcccacaaaacattaaatagataaatcaatgtcataggagcatgataagaaactctgatgtgtatggcaaccatataacaacatcaataagaggtgtggttacatggactgccattgcaatcaggagtactagagggtggtggacaaacataataacgacattgatagaaattaagaagggcatgcatcatcggaatcatttcgataataactaccccctccgtccctaaatatttgatgccattgacttttttaaacatgtttgaccgttcgtcttattaaaaactattaattcttttcttatcatttgattcattgttaaatatacttttatgtatacatatagttttacatatttcacaaaagtttttaataagacgaacggtcaaatatgtttaaaaaagtcaacggcgtcaaatatttagggacggagagagtatatggtacctcgcacgttgttacgagaaaattatgataaaaatcaaagatatgagttgtaaaagtttcttacttttttactatatgattttctttcatgtgcttatatattttatatcttgatcaattattcaaaggttgtaaatgattaggttgtatgggatgtcttttgtagagaggagatgtaatttgcacttttgatgaatgatccaaaagctaaaaataattaaggtgatgtggctccataagagagagaattaacattaactatacttagtggggatgaactttatagatacataggatccgtttgatatgtgttaccaagaaggtcaaattcttatagcctaatataccttttttagattttaggaaaatagttaattaagttcagaattgtatttcataactgaattcaaattaaaagaatactttgcaattccaactctttcaaactttgtttagggttagctctacaatgttctatgtcaggtttgtttccgccatatattttcccatatatatacgcccatctgagaaaacattcttcaacccatccgtgacaaagaaaccaaccaaaaccacaaaaaaaaaaaaacttgcgaaatgcccagtattgcacattttgctgtacaacaattcatcaaaatgctcactgcgtggcaagtccagtgtcagtgtcttagagcatccataatgttcatacaaaatgagtagtaagaagtcttcgtactactttacctttagagaaaatccatgaaatgccattgacaaacaccctaatccaagaaatgccatcgacgaacgcgacttccagcaaatgccatcgtacgagccattttgtcccaaaaatgccatcgccgtcactttcactctgttagacaccgttaattttgtcaaaatgaccaaattaccctcctcaacaaaggataaatccccttctcttccatcccatcgccggccactattcctcccctccacttcaatcgccagctcccgatgggcgacagcggcaaggcgacgctcccaggcggtggcacatcagttccaggcgtcgacgcgacgggcggcgaggaggtggcaggcggtggcgcggggctcccaggcggcggcgcggtggtcccaggcggcgcctgtggcagcggtcccaggcgtcgacgtgacgggcggcgaggaggtggaaggcagcggagcgtcggtcccaggcggcggcgcgtcggcagcaggcgtccgcgcggtggtcccaggcgttgacgcgacgggcggcgaggaggtggcatgcggcggcgcggtggtcccaggcggcggcgcgtcggccgcaggcacggtggtcccaggcgacggcgcctcggcagcaggcatccgcacgacggtcccaggcatcgactcattgggggaggttggccggtgatggcgaaactgctcttcttctcttgccgcgcggccgccgccgtgccgggccactttgcgagcacgcggtggccgtcgctagtggcggatccacctcccggacaggtcgggcggccgcccgtgctccgtcgatgtcgtcttcactacgaatagctgtcaacacctatcaaaattagtcgatcaccgaaaaacgctattactcgcccgggctcaacgatgccgctagctccgccactggccgtcgctggcgcagtgtacgacgacatcgtgggcgcgtaccgcgggttcatgccgtcgcggacgcgcgcgttcctcgtcatccaccatggcccgctcgagccgcacgtccgctgcccctactgcggcgcccgcgtctggagcatgaccgccgcggggctcgcccgcctctcctcctcttcctccagcgacggcgagcgaagcgccgactccgactccaaccacagcgacgacgagtcattcgccgccgctgacgtgagcctcccacttcctctggctagccgcgtgtcaggccggcgccttcgaggcaggccggccatgtaacgcatcaagcattagcggtagttttttttttaccggtggattgggatagtattatttggagtgagggcaatttagtcattcttgtaaaatgttttgttctaacggtgtggactaacggtgtgatggcatttctgggagaaataggcttgtacgatggcattttcaggaagttgcgtttgtcaatggcatttctaggatcaaggtgcttgtcgatggcattttatggattttctcttacctttatggaggtgggtagttaaggatgcagtgactcctagcaatagcacttctacctggtaagaagcagtagataaaattaaactctctcctctctcacactctcttttttaaccattgctttagatatggttcatcctaccttactatctacacattgcgatttgtaataactagcaacaattataacctgttttgtaggtcacaccttattacacactggatgaatatatagtgatgatgtccttaaggaaattagcatggtttatttggatttctaaggattataattcttagaagtgtcattcgattgtaaaaatgagtatgcactactgaagaaaccatctttggtcggtcgacccaaatccacaatagtcctagtttcattgaaaaccgggactaaaaagcatttttagtcccggtttataggtgtaaggggacgatgtgatctttaaaaatcctaactttagtcccggttgttgttcctaaccgggattaaaaatctatataccgtatataatcccttactcttatcctcaaaaatttctatctcttattcctcctctctctctcacacactcttaccctctctattcctcttctcttctctcggtaacttctcttctcttctctcgaagtctcggtagagccagcgaggccggcggaggggtgtggcggcgggggcccgagcgtggacggcggtggcccgcggtgggaggcgttggcagccgcccgcggcaagaggcggcggcggcaggagctagcggcggccggtttcttcctttttttttcttttttttccttttttaaagaatctgtgattcgttggatctgtgatgtatttgtatttgatctgtgatgtatttgtgatgtaagtttttttagaatttgtgatgtgaatattatgatttgtgatgttgttactttgatctaggatgtaggggcatcttgatttagaatttgtgatgactagccgtcaacccgtgcgttgcacgggtcatatttgatattaatttgttatcatgtaaaacttgaatgggttaacagattaattattcatatatatgtatataacaaatatgagagtttttaatactatgttgaatatcctggtcattttcttagttcatatataatttgggcaattaacaatattaaaatgagaatctaaaatatacataattcagaaatttagaatatattattagatttttaaaaaatataaataaatggtcatatatttctagctattgcggaagcttttgaaaatataaaatgtctgatttgtatagatctaatcgtcaaaccgtgcatcatactgctaatattcatagtattttaacaataaaatttttttatcttcgttagcttgctaactgtggttttggtcaaaagatctacacatgctaattttaaattttgaatttcagaaataagtggatattgatactgtaaagatctgtaaagacaataggaaaaacatgaaagatacatggtaaagcctattggttgcttatagagaacatgggagaaataaacttaatagcaaacgaatataccttgcaaactccctcaagattatgctatcaagatcacgaaagctgagattaatttatacatagttttagatgaggaacctgtaaaaaaaaatcaaatcttgctttaaaacggagttgtagtagctgcagatcaacttgaatcaaatcttgatagataaagtaataccagaacatgagaattgagcagggtctggttgacagagttcttcgggtgcagggtcaaggagatcgacgtataagatactgatctgatcgccggcggagtcgaatgcggcagcagagatcgatacgacgacaaggggacaatatatagatgcctaacgtacattggatggaggcccagataagtcgttgggcttttaaaattccacggttacaatatgtaatctatggtcacgatttgatgatctagctaatcaacggttagattattctgattaacgtgagagctccaaaaaaaaagtatccaattagtataggtatagattttgtgattttggtgggattggtgtgaaatcaatattcaagcaataatgaaaaaagaaagaaaagagagacgtggcgctaccctctttagtgaactaaaattcctctctttactcccggttggtgttactaaccaggactaaagagattatttgaaccgggatctggattcataagggttccaaaccgggagtaaagagcatttctccaccagtgatatgaaaatcaaaagaaatttttctttccctccaagttatagagagagcataagaaaatttccatccactcgaaccccttgaaaaaattatatagattgatgtgtgcatttcttaccattccttcattttcttattcctaattccctatgaattaaaattcctctaaactgaaccagcccaacaactagactaatcaagctcagaggagcctgcggcgcgtgcacgcaatcccaccagattccgtccacctgggcgaatccccggcaagctgcgcgatcaccttcgcgccgcgagcgaccgcgagcacgcgcgcgactttcgagcccgccggccatggcctccgccagggccccgccgccggcgcagctggggtcgctgtggtcggcgctggaggaccagcgcggcggggcgcacgaggaggagttggtcccgttcctgctgtcgtcgtcgtcgtcggcgtcgtgggggggcctgccgggagcgcgggagagggagaaggagggacttctccggcgagccggcgcggcggtggagcgcgggtggggcgccgcgcgcgccgcggcggaggagctgtgggcgctggcgcgggccgacccgcggaaggccgtgttcgcggcgaaggtcggcctggcgctcgccctcatctcgctgctggtgttcgtccgggagccccgcgacatcgtcagccactccgtctgggccatcctcaccgtcgtcgtcgtcttcgagttcagcatcggtacgtacgtacagtacagagctttgggaccgatttcttcttctgcttcatcttctttgggtttcttcgcagtaaaagtggatatgcttttcgatggtttttgtgctggtcctactgttcactagccttttaggtttgttctaaattagacattttcaaaatttgatatcaagttaatagaaaaatatagtatcatttttaacacaaaatagatatagtggatggaataaatgtaattttggtgttatagtttttatagtttttgttatgtttttgctcgctcagcctccttgttgaaattttgatattaaggaagccataatttgcaataggagctctaaggagctaggcttagtgatgtgctttctgtggtcatttcaatgactcaattggttggctcgactgatctcaccacttctcctaggaccgcaatgacaatcataattaaatttgaacaaaaattaacttacgataaaataacttataatatgaaataggagtattcatctgcagaaatgttttcactgtcttaaaatgcttaacgaaccactatattttcgaagcaactccttcgacataaagttagaagaacacaagtccctaactgtcaccattgaccgttggcctaggcagtggcttggctgtcgccatttgccatctcgcgatgctacttgatgtcacacactgtgaagctaaggtagccctagttgttccttcttaggatacacttctattctggacgtttaactatttgttactttcaaccaaacaagtacaatctcattaacaatatactctctcacaaagtgacagattatttgccactcacgatcctctgaagtggcaaaggttaaaaaaaaatatctcttcctcgtctcaactctcaacctatatatcttcccactcctaccttacgttagaatccaatcttagtttgtcgtctaggaagaaggttttggttgactaaaatgagaaatgccatggttattgtagttggtgggcacaggttaaacattgggagttcaacgaattagtgtacagagaagaggcatatggaggttgaacatgttacaagaaaccaatgataatatcagttgcctaaaaaaaagctataaaaaagaaaaaaaaatgaggagatgaagataagggtaaatttatcctagtaagttgattagtacaacctatagttattaatgctaatctactcatgaaacattggtggtgttatactggagttgtgctgtgcacgacttcatttaataagtgttcaaatccttatacctattaatatgatatatacatgttgatacgttttaaattgaattttagtggggataggaatttgtcaagtctttacgtgttaaggaacgaattcatcctgaggtatgtcgtgtgtgcgcaggcctttttttttttccgtgtaatgaaaacaaaaacactaatatactcggctcaggagctgactgttaattctagtggtacttgaacagcgatatggttttgtctgaccaaacaccagagtaattaaaagcgacttatactttagatatataaaaataaaaaatatagtactccctctgtccctaaatatttgacgttattgacttttttaaacatgattgaccgtttgtcttatttaaatacttttgtgaaatatgtaaaactatatgtataaaaaaaataataaatacttaaaatttttaaataagacgtacgatcaaatacaaagggagtagtagacatggaagtcatgatccatggaaaaacaagtcctgaacggattcggttccagtgcagtggccactgtgactgcaagttaagcagtcgcaggagcatcattggatttaaaacagatggctcatatgcctcttagtactgtagcattttttatatgaaaattgtacggttctgattttattgtagtaaacaatttggaccattggatcaataaatatagggcttagattgtgtgcagtcacaataccaactgctttggatctcaattcgtcctgaacccattcgctacgaaaaaaaaaaaaagaaaaccggcaaaatctccgtgtgccacggccatactcctcgatacaactgctctacgggcagagacaagccagtgtgcgcgcgagccgcggcaaccgccagctttccgggacacgcacactactccactagtacactagtgcccccccggccccacacgagattgagattccatcgtcagccaccgaccgaatccttcgccgcgggaaccttctagagcgttccggatccaccggccatggcggccgcggggagcgcggggtcctcgccgccgccgccgccggggcagctggggacgctgtggtcgacgctggaggaccagcgcggcggggcgcgggaggtgcccctgctgtcgtcggcgtggggcctgccgggcggcgggaggggcgg

SEQ ID NO: 45358 - DNA, 29206 bp, Oryza sativa
acagatcagaagttgcatctgcaaatcaagactcacaaatcgtgtcacccaaactaatttgtctgtgtagtactagtgtgtagagcaagagcattgaggatgagatattctatttccaagggaaatgggggaacctgtcttccattttggttcatctgttgaccttctgttattattcttgtaagtagaacgtgcaaccgaacaaggagaattatagaaaacctgtgatagaataagatttgatgattaaagagttcctgcttgttcacttgcagatactaactacgattaagtattcatgtgctgggatgtttaccccgttttaaagtggttatggtccaccacgtcttagaacgtgtgcctgtggcctctctgaaacgtcctaaatttatccattagtgctggaaagtaccactaaattttgttgctagatagtatatgttgtttggacccactttgttctacaaccaactgtagaattaaatgaaataggggacacattgactaaagaagtggatgttgtttgagtaggacaaaaaatatagcattgaccacagttgctgctgaacgcctgcactggagacaacttctattttctgtaatattgttttaatgccgaaatattaaatacaattaataatgctttgctcataattctactgttggcttgcaagtttgcattttattcctttttgagtcaacaggacgctatttggaccacactctattactgcatattcataaaactttataataataacattattattcttataaaaataatgtttgcatcattttcatatatccaaaccatacattgtaagcaatagttttgcccaaaattaacttgattttactgtagcgcatgtcttttctgattagagggagtattttcgtatctacaattcacataataaacattttataattataaaatgatatattcctttgtgtgtaaaactgaaaaaaaataaagagtaaattgcacgttgggctacagtttcttaccaaggttttaatttgggccacccattatgctatgttttcactttggacttgataatatttcatttggtttcatcttgaaccacctccactattcatctctttcatctcctcctaaactatggctagctgctaggatccagaagagctgcaatgcgctcggctctgctggtgttgagtggctcaagctcaaattccggaggaaccttgcgcacactgccacgctttaagctcctcccatgctgcactgtggcctagcttgagctcaagctccacccacagctagggtggcacgagctccatccgttggcacctctgatgctcaagctccaccggcgttgcgctgcgctcgagtcaattgccgagcaccagtacgctttgcaacacgctaaggaaggagtgcctttctgagagggtgatggtttggcaagatagttgctttgagattgagctgtttcattgagtagcgtcttagcctcgattatatgactcttgaggtctgattgtgatgggttatttgcatgattttctttggattggcatgcattctttggcaagcacccaatcagaggcttgagcttgcatcatagttttttctttgtgtttgtatcataatttgtacgttcctccgtgcacacttcgtgctcacatggatgctgagctcaagccactcagggctggcagagctcgagcgcgtgcagcgtctttgggtattggctggccggagttcagggaggagcaagaagggatggaagagataaacagtgggggtagtccaatatgcaatggaagggaattatttagtccaaagcgaaaacatgaattaaggggtggtccaaactgaaactctggcgctaaaacatggctcaaagtgcaatttactcaaaaataaattgtcacccttgaataatgtggttcgtgttaatacaggtgcaacatttagcaaaggttttaataggggattgggtacccttaccgctggagggcttgcgctagcagtcgccgaattgtccaaacacctgggaaagctggaggaagtaattcttataattagcatatttattgttggtgagtattgcatctgttgcctgtggctgttgtctatcatttcctggtgctggctgtagtgttgacttgtgagtatatctaacttgtagtatgttgctttgatgtttttcattgttagcttttttcacaaccttgacgaaactgcatccaaaaatgaaggcctatgagtatgggttccgcgtattcttgttgacattctgctatgtcatggtttctgggtacaacacagggaagttcactgatacggctgtgagtagatttatattaattgctattggtgctgctgtcagtctaggaatcaatgtaggtatttacccaatatgggctggacaagatttgcacaatttggttgcaaaaaacttcattggtgttgcaaaatccttggaaggtatgaaactccaaccccgcaaaccaaccatctatagtattttttttccatgttgcgttatttgactttatgttgaaatgcgtggtaaaagaatattgtttgtggctttgtgctagcactgcaattgctatagagcatagatacatctgatgtttatgcatttcttgccaaattatgatatcaagtattgtatgcttgataccgtttttggctgttcattctaggttgcgttgatggatatttgaaatgcatggagtatgaaaggattccttcgaaaatacttgtatatcaagcatctgatgatcctctatatagtggctatagggcagcagttgaggcatcagcacaagaggaaactctggtttgatcttgctctaaatttaagagttctacttagatttcttgagtggtcaattgatcacattcttatctgtttgcagttgggttttgctatatgggagccaccccatggcgcttacaaaatgatgaagtacccctggaggaatttcaccaaagttggtggggcattgaggcattgctcctttgcagtcatggcattgcatggctgtattctttccgaaattcaggttttctcataaaatttctatagcacactttagacttctgcttttattatttttataaacaaaaatatatatcggattttgatcttaggcaccaccagaaagcagaaaggtttttagtgcagaaattcagagagttggtatagaaggtgcaaaagtgttgcgcgagcttggagacaaagtcaagacaatgaccaaattgagctcttcagatattctagcagaagtccacttggctgctgaacagttgcaaaaaaggattgatgagaagtcgtaccttcttgtgaatactgaaagatgggacactagcaagcaagccgaaggtatcaaagaagttctgaatggcactggcattatgggaaaggaaaacaagatcgaagtgaaggagcctacaattgttgaacaaactacagcgcatcattcaaaaagctttgctgttaattcatttctgagcagacatgattcatcatcaactgtagatttcaagttactgtcttggcctgctcgaagatcattccatccaaatctgccacttgaagacgaggaaacaaaaacatatgaaagtgcaagtgctctgtccttggccacatttgcctcccttctaatcgagtttgttgcccgactacagaacgttgttaatgcatttcaagagttgagtgataaggctaacttcaaagagcctgtgcaggagcctgttgcagttagtactagtgatggcggctttctccataaaatatgcaaattcgtcggaatcaagagttaacatcgcaaatgaccctactagtttcatctgaaaccttgttattcttttttttttttcaatacagttttgtttaagaattacgaaccacgaaatgtgtataaattctacacttgtgtatatgcaatgagaatattgcgagctttatttttgaatggagctccagtttgctaccactaaagtgatccatcatggtaaaaatggccattgtactactaatgtgtttaatcaacctgctaataatttgttgctcctggctatagatgcatgggccgctcaagtacatttggtacagtgtttcttgacctactccactgaggaagttatagtgtgttcacaagtcctcttcatccttttgttgtacttcgcccaaagttgagatcttttttttcacttattgattgctctattgccctttgctaagttttgctgttgcctgcaatatattgttgtgtgttttttatgctccctatgtaccattctcactatattccatcagatagcaatcacaatataaacaggagttatgaacgagaaatgccatggcttcactgatatatgcttcaccacttagtcttacaagtggatgagatatactctttacaggtggttgagatatattctacaaaatacatatacataattctgcttctttgtgtatacagaagagacaaattactaagtacaacatacttactggctatctctacttacatcttctttttaccctatgtcctgtttaattactttcactgatattgattatggcagctttgaacgtagaatttgcacgtccaaaagtaaagcatggtcagtcgagctggtggtaaatttcaatttctatgtgacatttacaaaagttgattttgcagcactcttttaaagaggaaaggaaatccactttgtttctgtggcttggcacagtctgactgaacccatcctatctgcttctcatcattgttatatacaactagctttcctcgaagggaaacatctgaaaaaataaacagcaagcaaatgcaagtttagaaactacagtgagtgaattcggcaacagaaatgtaccaaaggaaaatgtcagatggatacctccgattactatcgctgagtcatgaccaatctctgttccatccaacactcctaggcagatattgttcttatcctgtaaaaagattccagagaaaaacatgatgaatgacttatggtatggctttgctctccttgttgaaaattttcgagggaatattgctgtagatgtccaaaatttaattggacgtttgataaatatgaaagttgatcatggaaacttacactgatgattaagtagtcctcaggggggataacgaatgtccttggcaagatgaacaatctttttttgaataccagactcaagggtttgaacaggtgtttcacatcatccatagacctgaaaaatgcagaggattgtttaagaactgtgtgtttatttatctggaactggacattggaaatttgccctctttagcacatgagtagtttcaacacttattttattttggacgtatagtttcaacacgttacctcactggaaaattgggtttcatgcagaacggtagtgttcgatccgactcatcttgtaaaaggcttggagagagacttttaagctgttaaaaattgcaagtaaacatgagtaagatgagattgaactggctccatatgtaagggaattaatagaggcactcactgaagcaatcaggtttgtgtagtcgtcgtgtggtaaatacgtatatgagctcccactgtcaaatatcacttgagttaacttccctgcctttcgtcgcacattaagctgctgatctccatagttcactttctggacttctgtgctgtataggttcctgacagaatgaaaagggacaagtttcagttacatagatcatatcaatgctaaaaggaaataccagcctcgtatggcatcatttctttatttttgctggaacttatgctaattttctgacatctgaacatataggctcgccccatcttttacagcaaaaagattaggtgaattataagagtgataatatgcagagcattttgccagtttcatgacatttcttttttttttttgtgataagtttcatgacatttcttggaagtatgatcgaatcatcaatgcgattactattactagtgtaaaaaaaataaatctatatctagcatcagtgcaaaactgcaaaaagttaaaaatattatatcaaagagcagttgggcaaaatttcccctgtactttcagtcttgagggtgacaagagttggttaggatttctcaagatcttttgcagacagagcatattatatctagtaaaaatgatgcatagtatccaagggaaaagtaatgaaactttcacaaacaaaaggatgggacttactctggaccatttctgataggcatccatgtcattccccatctaggaacgtaatcgtcaccaagaaacatatatccaccattgctgggatctgccgcgatgcaatggccaaaaacattggaaattatcccttggctggctagctgggtaggaaggcttattgctgcattgctcaagcccaggatcccatcagtgtttgctggcgacgacaaaagatttccttgctgatcatatccacacctgcagatggtacacagatggcagatggttaccattcagaaaagagcatcccatcttcacaaatttcagagaattagttatcggaaatcaagtcatacccaaatacgaagtccaaattttccctttcaccgtctgcagtgatcagttgcatgttgtcccttgcaaggattcccatagaggagctccgatcggcataagtgatctcatagtcacattgcttgctagtgtcaccatagttctggttgccctgcagttcttgacaatatgaatctctcggaggaaccacatttggtttctcaggcttatacagaggatgaggtccctgcaacaacgttggatgatcattacacaaacacacaatgaaattgggaaatttagactcataataagatggtgaaataagatatccatgctaacttaaactcattctaataaagctaaaaagccaaattaaaaacaggacaaaaaaaaagaaagtgattgaatttggagcatacctttgcacagtttgtgcagggtgcatcacactgtatccatgtcaagtcgcttccggtatcaacatcaagaaaataaggtcttggaggattcccaatgtacatagaagtgtaatattgcctgcagattaaaagcagaatacccagaagggcaccaattccatgttagtatttgcaattcactgcattctggtaggtaacatcaatgaacatgaactgccaaagattaaacatatcatacaaagagaaagaagaatatgaacatcaaacgttgacccatgagccagcacattagaagccttcctacttcaacttaaactaatcacaaataaatactagtataaacagacaatttgtatagtcaagacttatatgcaatttgatatgacagtcaaaacatcccaatcaaagtgacaggacagagatgtaggaaagcaggaatgtttccaaatttatttaaaaatttcaactgtttcatgtgaaatcattgttgtaaaagaacaggtaataaatcaaaccatcaactttttccaagaaactcgagtcaccgtagttctaccttttccaaagcccaagcaggttaaaccaaaaaaaaatccacctcaaatcaaactcaaaagaatccgaaattctacctaaagcaagaatagatgaataaccccgcccaataaaaaggaatcatgaccaaccagcatccgatcgcgaaaaagaactccagtaatttgttcttcggaagagagaaaggatcaaaactctactgtttcatacgaaatggaatcgagttcttgcaccggctgcacgcacccgtcggggaacacattgcctctgatcgggagcagcgccgacgaattctccctcgcctccgcgccggcgccgtccggcttgacgctaccggccgactcccccgccgcgccgcccccgctggacttcgggtacagcggcagcaagaacgacgacctcccctcctcccgcgagaacgccgccgggtcgtggtacaggcagtagtgccccgccaccgcgagcgccgcgaccaccagcagcgccccggccacgcgccacagcgacgccacccgccgctccctccacctcacctcctcctcctcctcctccccctcctcctcctcttcctccaccccgaaccccgcctcgtccccgaaggcgggggcggcggcggcggcgagacgccaccccttcttgccgctgtcgtcgtcgtggtccggggcgaccgcgatcaccaccacgccatgggcgcgcggcgaggaggcgtgctccatctccggcgaggcggtggactcggactccgactccgacgaagtcgaagagatgatcgaaaggtttgggagtcgcggcggcgaggatgaggggggtggatttggtatatttacgggcgcgggtttgggctttttttcgcgaatgggccccgcccggtttgacttctgcgatagggatgcccctcaaaaggtagaaaaatactcaaagaaatactcctaactccgtttctaaatataagtgatatatatatactactcaatcccttttagattggaagatgttttaactttgaccaaagtcaaactactctaaatttaactaactttgtagaaaaaattagtaatatttataacactagcatagtttcattaaatctataattgaataaattttcataatatatttgtcttgggttaaaaatattactattttttttacaaaattagtcaaacttagattagtttaaatttgaccaaaatcaaaacgtcttgtaacctgaaacggagggagtatttcttttagctggagaataggtgaaactatccctcttcaaaattttaaccagtcggatttttataaaaaaaaatattttcaaatattttagacaagcatattaccaaattatattgcatcttaaatatataaaagtattgcgaagtggtgctatactttttggcgcaaaaaaaaactcaaatacttcacatccctttttatataagggaaactttcttttactgaaataaataataagtgaaactatttatctttagattttagccactcgtattttttagactgatgccacttatttttctaaacaaggttttcaaatattcaaaacaatattattctcaaattataaaagcttgaacctttgtttatcgtaatacaaccatgtaagaaatttttagtggtgaaaacgaaaaattgtccagccaaatacatgtcatcttcacatcttctactagtttgatccacctttggtgtttaatgttttcacaaaaggagtaagatactacgtcgcacaattttggaatcagttgttggaaataatttattctattttggatggcataatactttcagactttcattatagaatttactatatgatcattttttttatatttcagctggctatcatttgaagggatgggtgaatttatcccatgacattaatcccccccctccccctaaatttttataacttatcggctgtgtcttttatataccacagatatgaatcagttttcatcattattaaaaaaaatcaagacaattattttaaaacaatatttagcgcggagattcgtgctgggtcgtccacgtatgcagcatgggtgtcgctgtggggggtttggtgattgctggtcgttgtcgtttcgtggccggttgcagtttgtagccaagggtggtggcatctgatatctggccacacactttggttatggaatgctgggtttgctgctggtgtggtgatcaaccggtgggtgattggtttgggggtgtacacacctacacatcacctagtaatatatttggtccctttgaaaatgaaacttttttattgccttccaacctttcaccacccagctgtaatgtggattgacgtgtctggtgagttgttctgagggacataataaaatgcttgacccggatttttaaaatggaatttgttcttttcttaacgttggtttaaagatacgtcaatttataaggtaatcttctcgcattctctgaaaaaaaatacatgtattgaatttgttaagattgataattgtcatgtatttatagttagagaagcatatagtccgatcgcttattagagggttttttttttcttatatgggttatgagctagcatgtgttgtttgtttttctcaatgactgtcatgatcagtgggggaaaaaagcttggtcggcttttttatcgagctttcttcaaattacttttatataatttattatattttaccttatcagttcagcatatatttattcttaacgagctaaggagagccattgtaaaaactactttcattcaaaattgaataatttttatccaaatcaatcagggcaattttaaactgttccactgagccagctaaatgagctccccccacccctaggattaagatgttcaccgatttattagatagttagctttgtttcctaggagtacttgtgatcatccatcatatacttttttttattattgttttctggctatatgtacaaagtccggaggtgtaaattaattctccattcttaaaagcaaatttaagttttgtttgccatgcatgatgcatgtaccttctcctgccctattttgtcccacatttgttgtgtgctggaatttggttttgctgttattatgccacttgagtttgaatgaatataggctggccgtcttgcctcctgctcctcttattcccatcaaataaattagtatttgttatattccaccatctttgtctctattataccccgtttgtcattttttttcaacaattaattagtagtactctcaatttgtaccagctatgaccataaaatgcacgatataattgccatcatctttacaattgcattctcgcaagaacacaacgcaagtactttccaaccaaaacggtaaacaaccacacacctacaagaaaactaaatggcatgtgtactgaataaatgctataaaagctggaggtaatctctttatttaaaaaaaagtactgtagcgctatttgagttgtcttgctttatgtaaaaggacagatagggccactttggattgatgccaaaatgtgccatgttaatattttggtagtttaaatagtaaatatgattgtttggtttgaagccaaatgaatggtaatgcctatgcttaatttatccataacataaaatttggctatcaattggtatcaatccaaacacatcaataaaaattctaccctactaaattattggtagtaccaaaacatacgtaggttttagcattaccaatgttttggtacggcactaaaccaaacaagcccataaatgatttgatattcaagttttctggaaattaatttgctgtcaattcgatctgactttttgtgaataacattatatggatggcattttcattttctttgaaattcttttccgtctttttcatctatctcttttttttcctccctttcacattatatatggacacatgagctctcttcaagcagaatttaattggaaaattacgacatgaaaaaaagcatttttctttctccaaattaagatgacacggaaaaacttgctactctctcatgactagctcgttgttctcttattattatgatgtctctgcctgtccttatcatttgtgtctcgtggcggcttgtatcttggccgtaattgggtttgtggcatgagagttggtagcacagggttgcgtgatgatggcgttttgtcagttttaagcatgtaatttattcacaaatggtggaattgatatataatatgtccattttattggcgagcatatatgcatagccctgtgcgtggctgtggatttgtgatgcattgaatatatccaggattatttcagaatacatcgtcgaaatttcggaaattttagggagagggggggattcagaaatctactaatatttttcaagttttggacaaattttgataaatttgaattttttttgttaaaatgaaaaaacattcttttttttttttggatggtatagaacatcctcccgggatccaccgaggatttcaaatgttctaattttttttcgagaaggcggaaattttgttctaattgttaatcaatcggcttgtaatcgtacattatttcgggttgagagtcaatgtcagagagaaattcaacaaaagtttgctatattggattcctttgttattccttttattaaaaactagtcacctaaagcgagttgaacgcataatccaaaacgggcttgattgcatgattagatggtcttccttgatgacatcggtagagcagaagaagccaatgcaaataattaaaagctaacctttagtttctaagataactaagctaaataagctttttgtagaggtctctatagccgcctagctagcgcgtttgcctgagatttgcatcctaagcaagatgcaatcaacacatatcattgttaatttactaaaatttgtagttgctctatctgacggatatgtgtatagttagctataggcttagctgacggcgttcttagctgctagctcttgtcctagctaccattgtgtagttctccagtttaatttcatccatgatccacataatctattgaccgtcgtctaataactatgacacagcaccttttaggcttttggccgtttttatacatctaccttttcataagttgataaaaatatttggggaatacacctgatctatcgatcatttttttactgctgacggtaaggagtcgcctgaccatgcagtcggaagcaatttttttagccgtgtcaatccatggttttgtatatcactaaattactgataatttagtaacgggcatgtgttactctgtgggtatctcttgacccgccttagtctctgtttttttatgggttgaaaactaatttccggtaagtaaaacggagtgacttattagcacctaattaaataagtattagctattttttcaaaagattaatatgatattttttttaaaaaaatacatcgtttacagtttgaaaaaacgtatacacggaaaatgagagaaatgagttgggaaagtaaacaaccaaactcagcctttagttgagttaaacaaagtgtgtgaccaataaatgtcaaagtcagttttactccctccgtcccaaaaaaaaaagataaaccctggtttccgtgtccaacgtttgaccgtccgtcttatttgaaaaaattataaaaaaattaaaaagataagtcacgcataaagtattaatcatgttttatcatctaacaacaatgaaaatacttattataaaaaaatttcatataatacggacagtcaaacgttgacacgaaaacccagggtttgtctttttttgggacaggggagtactcactatcagtggtaagaatctcgtgcatttatggttgtcaaaatcttgattttattgtgtgactatgattttacgatccaactcgattgtagccatgtaggattgtttctatgattctagtcaatagaatctacatgattttacgattcaatagttaagatcctatcgtaagctttccgatccgatttagaatctgcgattttaacaaccttgcatacatcattgcacattttttatctaagaataattatttgcactccaaattgagatcctatagtgcatttatttagatcctgcagtacattttgtctaaacaatatccgaaagttgcaacgcacaaacacgatgctagctgaactataagatcctcggacaggatgcctgctgacaaaacggtaggatacaaccaccagagaaaagataccgagacagtgacgattcagcatcaaactccactgcccatctctctttttttgtttgaacgatccactgcccatttccaaattgagattctctaacttactccctctgatccaaaataccctctgttccaaaatataaagtattttagtcggatgtgacacattctaatattatgaatgtggactaagaacctgtccagatttgtagtattaggatatgtcccattcagcccaaatctcttatattttggtacgttgagagtaaatcatatgacacacatatatgttctctttgctatgaacccacatactccttccgtttcacaatgcaagtcattctagcattttccacgttcatattgatgctaatctgcaatgtaagtaccagtgacttaaagtcgcatgtcttaaggtagaggatagctgcaatctgcaagcatgtatccatggcggctgcagcgtcggtttcaccgtcgttgcctctcccctttgagtgttccagaatcaactcgattaggagacgcatgaacacaacaaaagcacaccaaaaaaaaagtcactcaaatgctgacgcttaaacctctctcacacctaataaagctcagcagatcataaaaagtgttctgaagatttttgatctgcacattcgattcaagaaaataaaaataagttggttgaaaaaaagtttgtgctgattttttgggtgtctggcagtggcaccaagcggtagctacctgcctgctgattcagaatcgttgttgtgcagtcagtttcagtttttgtttcagtttcagtgtctgcttttcccctcttttcccagtgcattatttgaggtcctgcgtgatttgcatcatggagtctaattgcctcccttaaggttaaccgcactagaaaatgtgtgattttgatgtaatctaatactagtagtaatctagtatcactgtatctttgtcagtcaaggaattattcctggtacatgcttctctgctagagtagtattacaggaactgactgagattgctgaagaattctatgggactactcaaaccagcatcgatgtcagtagtttgcaactgtagataaccaaggatgctacattgctgctgttatccatctgtgtcaaaaaagaaacaaacaaaaagagaacaatcattcagagatgcagtggtctatagacttatttttttcagagtgcagtgcctgaatatgtttttaaatgaaattgggtaaccataaacaaggttttgttcgtcctacatgcattggagaattgttgagatacaagacaacatgactcaatcattcaaggaagaaaacgctgtctcgttgcctgttttcaggcttgcgtaattggaaggcgacaattgcagttatttattcagaagactttggctgttaatggatgttgacaccttcttcagagttgagacaggtagaacagcaatctgctcatggcctgaacgtcgagtatgtcggtagctatggacctatggttttgacttcatacttctcaaccaaacaagatttgtatagtgtcaaatgccaaagataccagatacatctttatcactttatgtagaggctggattgattttcattgtcgaaaaaaagaagaatgaatgtaatattcaaagtactgtgaagttatcataagaatcatatgcgcgctctctctcttctataatgaaagatttattgaactcagctaattacatcaaagtgaaacaaccctaccaagaacaatcccaacctacaaatcatcctctaaatattcagtaccaaatgatttatagtaccttagcaaggagcttgtaaaatgctctgattgcaaggaaaaacatatgttgatttgggtaatgggaccaaacagtagatttatacctgccgactcctacgaatttgttgtgaggtcagcctcaggtttcagtgcctgcctgccttttctgtaagtgcacctgcatttgtgtgatatgatgtcagagtgtggcatatgaactattgaagttgttgagatgattccgggagaaaaagaaaaaaaatggaaaatgaagttgttgacatgaatgtcaaaatctttagctgcagaaaatgttactgccagaagtcaagagcaagatcaaattcaacgtttcgcgaccggcactttttctagacaacaaaatatttatatatcccagcctctacatcatgtgatgcacgcaaccgtttcgagaccgacataggtgtactccaccattttggagatgaaaaggtttgtaaaaaccgaataagtgtgctactaagaatatatggttcttatctcctagagcaggtagccagcaaatgtctctgcatttctaaattggtacttgaggaagattcgagacagtcctatattctaactctgtgtgacattattaggaacatctatgtaaagttgtgaacggaagctaggaagtttcatgctcacttttggtgaaggcagcgagtgaagcgctagcttagcacttactgttctttcagcatatatacatcagtcagagatgtcagatgattatgatccaaggttccaaaaggaagagatggtaatgatctgattgcaacttgcccagaagctaaagcaaaagtgacagcttcaattacgctgaaagaaagacgcccctggcaatgtggccactgcaacatgtcattttatatgttgacacggtcttcgacttgcaaatttgaccgttaatttcggtagtaaaatagttgcaaaccccggcaaacaaaaaaaaagtttattgtacttgagaaagtacctcaatatatataaattttattctaaaaattttcttatcttgaaatacctaatacttggagttaccaagttttacttaaaaacaatatgataccttccgttacattcagaatgtaaaaatacccccgataaagttatatggggaactactaatatgattttttattcataaaatctagatgtttaaaaacaattctgatatttaaacggcttcggttgcagaaaattatatgaaccaccgtatctcagtagaagagtggctggcagcatacaattggtcagtgagaaagccggtagaatctgtttttagttccaactcatcactcatcttgtcaagataaggtaggtaccaccattcaaagttatcatgcatggtttggtccatagccaaaaaaatacaattacaagagcaggtagctagagattagagccgaacttaatatactaatcgatgacgtatatctagagatttcttaaattcagattaggaaacatatgctagattatagcaatacactatatatatatgtcctgtttgcaatgtggataagtgcaaaattaagatacacagtagttacttcaaattaaattcaaaaaactactcctaaatcctaataaccaaatagggaacatattaaagcatcatatatgctcccatcatggcaggaagcagaaaaggactatatgcattttcagtatttcacctctccttgctcgttttcagacaacgtatgcagaaggcgacaagtgcatatagtcgctctattttatattaagttgttgtgatttttttctaatcaaacttttaaagttgattaaatttatagaaaaatatagtagcactttcaataaaaaagccaaacatatcacaataatatattcaatgttactaatttagtgttatagataaaatcttagtcaaatataaagaaaattgactagaaaaaaatcaaaatgacttataatatgaaacggatggaatattaatactccttccgtccgaaaatataaagacttagaatcggatgaaatattttctattactataaatctgaatatgtattttctataaaatgtcttatatgattttagacttttatattttggaatagaagcagtaacaagcagagaaaataactcctgccttttcagcaagcagataaaaggaggtaaggttgacgcagatgtgtgcgtgccctgaacgagccgaggtccaaagctagcagcacacggcttgagctgtcgtgaaagcggccactgcatcgctatttcgctacgagtagtagcgagtgagtacaatttgcgttgaagaaatggccgggtcgtcgtctgtgtgctgccggctcaccaaccctgatgattcctactctatcaatatacgagaagctgttaccttccttttaaaagaagaaaaaacctgctgattgttcatatcgttcctagctagttagctagctagctgcaacttgcagcagattgcaatccttttggactgcttggtagtagtatggaccatggccttgagttgattgctgatatgggagtagtatggtctctttttgttttttctttgttgatagatgatggatgaaaccgagtttatgataattatttaaggagagaattaaatattagaaagcaagttaaaatgctgatttaaaaaagttctctaagaaatgccaaaggataagtttttctaaaagaatcgtacaatttaggagcttggaaagtgtgtttctgcgataatctatatcatgtaagctaaagaaaaggggtatgggtatgaggtttttgaagaaatagaactaggactgcactgttagacggttacaagttttagactttttaagaaggatgggtggcaaatatccttgtggcacaggatatgggagataaatcacatgctacagcaaattttctttttttcccctctttttggtttagaaagactaagcaatcatgaggtggaaaaaaactagttgcaagggctgcgtgtaccaaataaaacaaagaacataatttatccgtgttttgccatgtttttgaagtacctaaaacaagttggtattgggggcaaaaataaagaatttactcatcgggatttcgtagtataacaaaaactcatagtttctaaaatttcatcaatcctataaggccaaaatacctgggattccctcgtgctaatgcgcatctaaatttacaacttacaagatgggtgttgttacaggattacacaagtaacacgactcttgcttttgttcagctcaagagaatccctagtttgtcattgttgtatttgtccagacctccagaaaaaggagagaatcagaggcagccaaaaacattgtgactttgtggggggtttttgaagagggaaaaatgttacttcctccgtttcacaatgtaagtcattctagcatttcccatatttatattgatgttaatgaatttagatagagtatgttctttgagttagttcatcgtacacaagaacgggcctatgttgtgttcttctaatctgtgtcaaacctatcaaaattagttatgatgtgcaattttggttttgggtcatacgcactatcaaattcatgctttgcaaatttatgtacatgattgcatccatatagtaagttcatgtaacgcccatacaatttgctttaaaaaaggattttctcatcgtatacagagataaacgaccaaccagaaagaatatccagcgcatgcaggtgcctttgagcctcacccgtaatctccacttgctactaaagcgaccatcaaaataactacaaataattaataaattctcatatgtacgctggggaggaattaagaaattaaagcccacaattatttgtaacagcgtgagattaagcccacaactgcttgatcttagccagaaaataggccatctaaacatttaagatggaatgatattttcatggaacaagtctattttgcctctctcattctattgatcctaattgaatcacaattctcaaccaaaaaaccagatataacgcttctccatcttcggaagcctgtgcaaattgactccctcttcctctctttcaccttccagaaggggtagagcctaggagggcaacggcggtggcgagctagatctggggagggcagcagtggtggtgagccaaagacgaggaagacggtcccccgaagcagttgagctttccaatgggttgcctcctcccattgagtccactcatctttggtcatgctcgtcggaggcgaatcggtgcagcgtgtccgcgacgtggtgcagcgcgtagtcgccactgtcctaattgcacgacaataggtcgaggtcgagcaggcatgacatggatgatagcaaggtgatatgaagatgccaccatggaagcaccaccatgcgtccacggattagattcagatttcgatggacgtgttgctggggatcgtggcgtggtcggacgtcgtcaccattgtctattgcgtcgccacctccaagctcctccgccgccacatcatccatttggcgtgtctacagaaaaccaaattgcagcatgccctcgtgcctcctcggcttcctgcacaagtgaggagggtgcggacagccgctcaccttcacgcttgaccaccgagcaacactcactgcaagtcctttgccagtagccacctaacacccttcctatcatgcgacgcagccagttgcctagcccgatacaaacccctaacaacgcacggctccggctcgcctctaccaccgccttccttaggtctggctcaccattgtcaccaccctcccgacgtctactgttgatggaaggtgagagagaggaagagggaagagaggaaagagagaacagggagaggtgagcaaaaggatgatataaggagaaagtcattggcatgtatgtcccacctaggcacctactgacttaacaagtcaactgtgatcaacctactacgtccacagaaactgctctccgctctggtttttgaagaggagaaggcattatacgcggttttgaaattgagggagacgattcaataagcagttaagagatgagggaggcacctaacacccttcctatcatgccaattttagtcaggcaaatagactcattcctattttagtccacgtgccaacagatggtcaaatatgagccaaattttggcctacagtcaatagtagctgcaaggaaatttggcccacaactaattttgaatgaaccgcacgaagcccactcgagaaattagaccgaatcgggccagcttatgcgcacctttggaccaatgtacacatatttgggccgaatgtatccattaccatttactgtaccaagtaatagacgcgtgcaacaaaaaactatttacagagttttcacataacacatgtttcaacattactgatccaaatgacagacatctcaaaaaaaaaaaagaagaagaagaggaggcggccaaaaaaaacccttcatcccaaaataaaccaattcctcttggaggaagagaaaacctatgtttgaacaattaacactaagattcatacatgtacctctgatgtacctctgaggtgccaaatgacgttcacatcatttggtcaccacttcacttgccagtcctgtctcatcatcttccaccgtacgctgacgatcaaaagtgcataaccagttgtggatgtatgcacagttgcacacagccatgatcaaacaaaacacagaacaccatcatcgggggatcagtccagccagaacatctagcataatatttaaatgcctaagttaaatgttcataggcatgctacgcttggttctgtttcgacagttagcacacacatggctttgagaataagaaagttcgaattcttgtgaaaatttggcatagtagtggaaatagtacatctgccagacgatgtggtagtatttagtaaatcctaaattattcggcactaggcaaacatgttttaaatttctagcccgtacaggtgcatgggttgataactactagcaattacaccataaaacaataatactaacgtacaatacaggtcacaagctgacctgaaacaagcgggtcatgttaatttttttcccaagaaaacagtcaatggtagtcatgtgttcataagataaaaatcttaggaggatcaaaagctacttataatttatcgaggacatagtaggtgttccatgtagtcatactcatattacatagaatatatactgtgaacaagatcatgattcaaataaggagaatgaagatcccaaaatatatcgcactcttaatgtgaattcgatagttttatactgcacgtatccaattgaaaaaggtgtcacgaagaggaaaatacaaaagatagatctattgttagcttccttaaggaatggacatggtacgtaacaaactataacagcaagcaataaatagtaatgcagtattaggctctactcaaagcaccagtaatgatcgtgtttaaacatgatgtttaaaaaagactatcgatccccatgaacacaaaattagtattcattccttaagaaatcattactacattaattgtcaacattgaatttactgttcaagataaaaaaaaaaaaaactgattgaacttcctagcttagttgcagttctgacagacggaggcagcaagcttgaggcaacaactgcacaacttgcaagaaagtcatagtatgatgacccattgattctgcaaagagttaaatcacaggtcaataacgaagctaatgctttttcaagtcaattatattttttcaggcaatagcaaaatcatgtaagaactgtatgaaacaaaagtgtaaagataaatacgttcaggtcaggaatgaatcgttttatatgtaaatgaaatattctgcaatggaaagtgaagcagcttctcttccataatattagtaagttagtgagaaagaatacatgtataagaaatcaaattgtgacaatttttctcagaatgttaaatcaactccgtcctgtgtttattgataaatatggacaggagcttgctggcctaaatgcaagagatctctggaatttagagaaccaactcaaaatgagcgtatgtgatgtcaatagtcacatctcagatgaaggtcaccttagcatgtgcttcattaatatctgcaactttgttttaattccatttagattgaagcaatcaatcttctgccataggaccacctttgacacaaggaattgaagaactaagtaggaaggttcaacctgctgatggtgcgctttgaccataccaacataattttatataatgagactgcccgctgccttgggtgtacctatcaatggaaaaggggctctatgcagtccttaacatggaaacttattcacaagaaaagttttgagctcttgagaggaggaatatactccctctgatcttgaacagagccaaccccaacatagctccagaaaaggagaaagtcatcttttccttaatttagaagatataccattccactcacaaaggcaatggtatagcaataagccatgctttgcttgcagcaaaactacatctgcttaatgcagatatgctgcaagctgggttctgtacacaattatcttgtttatccatcagaccatgaaacatttacacacaaagaggttcacttatctatcacagcatactgaaatatgatagcctgaaaagttggaaacttatggtggcaaaaaacagggtcattttctgaatattaacaacagacatcatatagtatgtattagactgctagtacagcacaacatatatctggaaaggtgattataagcagaatagcatatcactgttacttctatgcaaactttccatctccatttgcaggacagatgcccatttatcttaagttacaaaaagatactctttaaccagagttcacatatgacaatgtatggttgttcattggtgagttgttgttaaagacaacatcaatgatcatgtaagttcattttatttaaaaaaaataaaactattcactgtcgcaaaatcatgggaaaataaactgggaataaaaaaatcttacatccattgtaataacatgtgtttcttgtgacttgtgattcccttgcaagtaatgcagttgtaacctcatgcttggtgccaccatatgcaataactggttgaaaacattgcaatgatcagaatatgcaaagcaatagttgtaaacaaggcacctcgattgaaatcactcgttaatgccctatgagctattttagagatggtgaatgcacaattttcaaaatatgacaacaacaacaaagataaacatcacataaggggacgtcagtctaaacctttaacaacttagtttggcttaaacacagtacaattcaccaacgttacaaagaaaaactagtcttgcaactaggctgaatggttctttattttcctttcagcctaatagactacaaattaaatgttcagtttaaccaaacaacatctcatgacctcctgtgtgtatcctaatcctcaaataagcaaccaagtaattaactcacactgtcacacgggctactccacagtttccaactgcattgcacaacaagcgcattccattgatccaggttagcaagacttcggcacacaaacatcacccctaccgccctcctagaattagattaaaccatagaagcttcttgctacggaaactgttggaagccgttcatctaatgcatataaagcccctccttctatgaactcgtcgtcgacctatccatgaaatctccaccgaaacaagcctatcgtcacaaagcacagcgaactcaaatccatctctaatggcggatccacatttgacactcacggagaaacttcataccaccacaagaactagaaggttctagaagcaaaaccgcgacgcgcccgcagaggcaaattaagccaaccgcagcgagatagaaaggaaaaaggagggtaaggttccagaagcttccactcacctcgatggcttcgcacctccgccggcagctcggtcggtggcgtgggggggcgggggaggtggcgcttaaaatgaggggcaggagaaggatccagaagcggcggcgggttccactggaaggatctagaagtctcgagacggcgcaatataatacgcgagcgaatcggaaggtgggggaggcgaggcgaggcgagtggaattggaatttcgacgagagggagagggagagattagtggggtcgttagctgtgttagtgttaagtatatttattaattgattgattaattaattcggggtgttagggagagctcgtggctgtcaaggtggccacgtcaccttgtggagttggtggattctacaggaagtccataaccgaggaggtccattgacttgacctagttgctcctacttctccaccccataatctccttgtgatctcaatcgatacgctcgttcgatctcatcgaagtagcgagggcaagatcaaatccggagaagtaatcgaggactacggcagcagcgatggacgccgtggaaacgatcatctcaaccgggatcaacatccatgaagcgacccagctgagcaatgaactgtcccgcctccaggccaccttgcccaaggctcgcttcctcatcaatcgcggcgagtggggcaggttcaagaacaaggacatggcgctccttctgtcacagctcaaggacaccacctacgacgccgaggatcttctccgcgagtccgatgatcaggcgctgcggcaaaagatggaggatgctgaccggaactggttcggtaaacgctattcttccattctaaatcttgcaaaaattttgatccgtggtagcaaaacaaaaataaaggaggcccgagagaagctcgacaaggctgtggctgatttagaaggagtgcttaattcagtgggtgttagtatcgaggcagttcaacacatgccagagacaagttcagtcatatgtgtgtctcaggtgtttggccgtgacaaagaacgagatctagtgattgagaagctgggtgtgtgttcgatgattggatgtgacagtcaacgagatcatgtgattgagttactgggtgtgccactgatcaccagaagtggtgttgcacgagcacgggctaaaggaaagagagcagcagccccggtcattggcaacacatcagcatcatccagagcgaagcaactgaaaagagatactagggcaagacccagacttgctgaggccaaatgcatcgacaatgttcccgtcttgccgatttttggcattggtggggtggggaagactaccctggctcagttcatctacaatgatccaagggtgcaagctcactttggcaataggagggtatgggtctgtgtttcagacctctttgacaagaaaagagtaacaaacgagatcattgagtctttcaatagggaagagtataagccactttgcggtttagatgctcttcaggtggaattgatggagcagctggagaggcaaaagttccttttggtgttggatgacatttggcaagaagctattgacgagtgggagtcattttatacaccattcaagaacggacctaaaggcagtatgatcttagtaactacaagatttacaactgttgttgatcgtgttgccaccaacaattgtaagcctatccaactcgaaggcttggatagagatatattttgggagttctttagcaagtgtgcattcggagaagagtgtccagaatcatatcctcaattacaagatattggtcggagcattgcctctaggttatgtgggtctcctttagttgccaaaactactggacgtttgttgaatatgaagctgactgtgcaacattgggagactgttcagaacagtgaattgtgggagctgccacatcgagacaatgagatattaccggccctccagctgagctacttatatctcccacaagaacttaagagatgctttgcattttgctccatgtttccaaaagattatagctttgaacgagatgagatcgttgacatttgggtggccgagggctttgttgcgtcaggaggaatcatgcgtcttgaagatatgggaattaggtatttggatgatttgaggagcaggtttctttttcaaaccgatcccatgtaccctgatcaaactagatatgtaatgcatgacttgatccatgatatggcacaatccgtttatgtggatgaatgcctcttgatgcaagatttgaggtctcggaatgagaggagaatgctacatgtagttcgccatatgtccgtgaaggtggctgatgaatccctgaagaacggaatgagaggcattcaggatttgaacaaattgcattcacttaggtttggaatcaaactcaatgttgagattacctggttcaatcagctctccaacatcctatatttgagcctaaagggttgtaagctggtcaagctacctgagagcataggcgagttgaacagtctccgttatcttgatatttctcgtagcggtgtacaagaattgccgaagaaattctgtagcctttacagcctacaggttgttgatgcaagtcgttctagtctgaaagcaattagtctggatgtcataaagctaatcaacttgcgtcgtctagcattgccagtgagttgctctccaaagttatcagagataagtaggcttggaaatttgtctcgtctatggaacttaaaacattttagagttggaaaaggggatgggcgaaaaattggtgagctgaggggcatgaatcagctcagtggaacgctaactatcagtttatttgtaatgttaagaatgataaagaagccgctgaggctagccttgttgaaaaacaatacctccaggaactagttctactctggcgagggcatggcaaagagatagggaagagcagtgagaatggagtggtcgaagccttgcgtcctccaccaagaattgtacgccttaaagtccaaggttttgggggtgatagcttttctcctagttggtttagaccagaatgcctgttgaatttaaggagtctggagctttccaagtgtgatggcttgaaaaatctatcgatcgcatcgttaccttctctcgaacggctaatgctagaagcaaatttacggatggaagcagtaacaattcttggtggttcaactggtggtgaaaagacgaagcatacaagcagcagtagcagcaactgcactgcatgccttagaggactcactactatacgtcttgtcaactgttatcagctacagaatcttgatgggtgcttgtccccggaatacttgccatccatcgagtgcacagagatcaacaaatccagccatctaggactgtcaatacatgtcgatagtttcgtgggattcgaacacctacaagagatgaaaatatggcgctgcaaattggtgtgtccgcaaggaatggttttgccaccctcactccgacgactctctattgtgaattgccgtaagcttgatttcccggcctacctacagagcctcacctctctcgacatcctgcattttcgtgcctgtaacaacatggagtccattccgctaggcacaaatcttcgggtcaaatgcctgattctcaagtcgtgctcggagctgtcatccatcggtggatcgcgcgctctttcatccatgcaggtcgtgagcatatcggacggcccgaagctgcacgaagtagagcagccctttacaaagggcctgctgactaaggaggagaaggtggaactgttgaaatttactggttccatgtatgaattaatgtaacatagcagctgattcctaaagacttccgtggtatttttcttcatgctacgacacccacagccttttgtttgtaattgagcgttggctggtttgggtgagccatcgatgtgtgccttgagattgaaacggccaagaacaaagagaagtttacaccatgtatagagttggagtgtgaggggggatgtggtttttgatgttagaaatgagtgcgaaagcgggagtaggtttggggtcagccatggcaggatctgccgcggtggaagagcagatgatagctggatcagtgggtatctcataccatgaagacattttcttctgttcagcgggtagcccggtaccaaatctcagcccttcattctgtccaatcggacaattggcaaggtgcggtaccgccagatacatatttgcccatgaggtggtaccgacagtgttgagaggggtggaaagataatactatatttgtaggtactacttgaatcccctctgtccgatgagtggtaacggcgatggttggtccatgggcgaacgtggcagcgaccgtgatgacgaggtggtgttggcggcagcggcagctggtgcgtgggtgaccatggcggctgcggtgtgtggtgtcgaggtggtcatggagtcgtcagagccggcgatatggcggcagcggcaggggctttggcggttgcagtgacgaggtggtcatggagcgaggtgctactgggcatggtgtcgaggtggtcgtggagtcgtcggagccgacgatgtggcggcgacggcggggactttggcagctgtagcggcgaggtggtcctggagtcgtcaatgctgtggctggggcgttggcgacttggcagccatggcggtgtagtggcggtgctccagttgtcctccgaagctgtaggactctccgtttgctgttgcagcgatgccggtggtcgaggagattgccgatgtgcagtggtgttacataagtttttcgttgaagtttcattccaagcatatg

SEQ ID NO: 45359 - DNA, 46227 bp, Oryza sativa
cacttgctggaacgtgccaattgggtaggctacgtattgagtggacctgttatgttgaaaaaacaaaggcggaacaagagaggacgaagctaaagcaggaaatggctgaaagacgaccgtcttttagaagaagttgtccaagcagaaaaaggagactgatgatattagaaattggtttagaattaattgggtcattggaacaatagttctagttgtgctccttctcatgaaattatttgaatcatattggaatcttatttctagatatcatttagccatgctaactcacaatatattccccaacttacaatatcaatatccatttttaactcgatgcataaagttgccatcgcaacaggagacaagtttgttgatttcggctgctggctgctcatctcatgctcctcagggccaagcctgattgtactatgtggtaccataagccttgcaagataggttctaggttcgctagaaaacaaatttgttaaccttcaaacaagttcaggtgcacatatccaaattttccagaacaaacacacaaacagacataaagatgacagaagatcatgctctgtccaaaataagctcaaattttcccattcaacaacaaaatgtgtccatcataagcttgtgctcttttcacagattcaatacaagaagcatggttgattgagtagttcattccaaaataactagaccatacaaaagcactgcaccagcataagtgtctacaggacacacgctcataagtctcatagtctgatagaggcaaacaatatataattgactgtccaacaacacaacttcccacacatggaaatcaaacattaaaattctacttccacaagtgcaaagaactcctgattcaacttccaccggtgcaaagaaacacttcttaggtctcatacatcgtcttctactttgctgaaaataaattaaattcacttcataagtctcatacatctgatagaaatcatcgttttgtactcctcttgttcttctaagttgtctcacatttcatcacccataccaaatctatcaaaataaagacacacaaaatactcataaatcatctaaaatcaaacaaactactatgagatttggtatgatttctgagtattttgtgtgctagaaaatcacatacatcttgagcaccacttgggaggaaaccctaaactggttaggggcctaggcagtgccgacggcagctccattgctcatgcaccaagggagggagagcagcagggcaggtacttgctggagccatcgaggggggataagggactcggactgccgtgctgatggcatcattgatcctgcgctgagggatggggattgttgggtgagggagaaaaaaagcgccaaggagattgggccctgcgcgatgggctcgtgacgtttcccgatcctaccccctcacgatggacggatggatttgattcaacacccgtcggtattacgtgctggacggaagcaccgctctaccatgaaagagtgaaagcaacaatgataattcatgttttggtggtttttgaactttttcgttccggtgaaaaacatcgcacccatgtgtgtgctaatatcggtcaatattgacattaaatgacaaaagttagccgcacgagtcacaaagagatttttcaaaacgaacacacccaacccacttcaatatgtccaaaactcatatttatgtgatttttgaaatttttctttctagtgaaaaaggtagcacccacataagctagtatcggtcaatattggcattagtgttgtacttacaggttgtttgtcaatggtagaagctaggagttgttacaacagaactagtaacaactagagctaaactagtgcctgatagattacagcgacgtgccagatagagtgcagtgaccgccagaggagtccggctcaggtgcagggagcactcgttctactcttatcttacggctttgtttggttactttctatatatagaaaaaaggattgaagagaaacgaaggaattacttccatgttccgtgcatcaactatggtcattgttggcgacggcgtttcatgccttctttgtcgggcagccgtccttcctttgcacgaaccaactcggtgggccaatcaaatgcaagctctttctttgattggcattaattgaaacaccgctgctggacggctaacaggatgatccttcttcgcatggacagccgtatctaccctataattcatcaactcactcttacacctatctaccctataattcatcaactcactcttacacctacattactcattcatcaaatccaacggtccagatcatccaacgcgtcagatcaaacgaaccagagctctcccacctcccaccgcgcaccactcacacctcttgcggaatcaccgtattccccatcccacagaaaccgcatccgccatcatcgccgtcctttcatgatatcgagtccaccgtcgtccacctccgcattctgcccctccctctccccgcgtcgcgccgactccaaaccctagcatcctccgccccgcagatccctctatcgccgaccgctccctccgccagcatccccacccatcgcggcccttccatcccgcatccattcctccggcttccccctaccctgctcacccgccgacggcagcatctccacctgcgccgccgccaagtcgacgggagccgccgacctcgccgcacagcgccgcgcccacctgcgccgccgccgaatcgacgggatccgccgacctcgccgcacccccatcctgtcagccgtcgggtcacccgcgtgtttgtcacggcggcggcaacacctcggatagcaagagtaggggtggatgtcgagctggctcggctcggtctggctcgttaggataacgagctagctcggctcggctcgttatcctaacgagctagaaacccagctcggctcggctcgtttgaaagctcgagccagctcgttaggctcgtgagctttggggacaagagagaaagcgaacaaggggaggagccgaggaggggcgccggggaggagcggcgcggccagcggcatccacgacggtgtcggcgccggggaggaccggcgcgggcggcggcgtccacggttggttgcgtcagcgccggggaggagaggcgcgagcggcggcgtccacggccagccgcgtcggcgccggggaggagaggcgcgggcggtggcggcggcggcgggaaggagcggcgcgggcggcggcgtccatggccggcggcgtcagcgccggggaggagaggcgggggcggcggcgtcggcgccggggaggagcggcgcgagcggcggcgtccacggccggccgcgtcggcgccggggaggagaggcgcgggcggtggcggcggcggcgggaaggagcggcgcgggcggcggcgtccatggccggcggcgtcggcgccggggaggagaggcgggggcggcggcgtcggcgccggggaggataggcacgggcgagcggcagccatgaggccggcggtggcttgggtggggattgaggatggggacaagccagaaggggattgactctagggttttcacaaggtgatgggctaggtgatgggctgttgggctgggctaggcgcctgggcctcatctgctctggctcgttaaggctcgcgagcggctcgcgagccagctcgagctggctcgttatctcaaacgagccgagccgagccgagccgagcctgtcacgagccgagcgagctaacgagccacgagcttcctgtccacccctaagcaagaggttcagaccaggagaacttgggctgcaccaaggagcggcccgtttgactccgtcagcccagcaagcgtttccctgtgagtgagtggactcagtagagattggctgggtccacagatagagagagaggctttttggcacattgctataaagccggcagcgagagagagagagattacgtacttttgtaatacacaaacagaaatcaattcaaatctctctgctgcttctatcgtcttcctcctctgttcgttctttcccttttgctcttctctctcgaatccaattctctcctcaaatctatctccgattccgattagctagcaattcctcgggaagaagttaggatcgtgacagtgttccccgtcaactgtggtcgcaccggcggattccgctgccgtggctgcgattgcgatggcatggaggcaaaataccatacgggtgtgcagatgcgggcatggcggcatgcagctgaccctggctggtaaggagttcttgctctcgttctctgccacagtcaatctattttttgatatatgtaagttttatttgttctagagagggcacaacagctgcagttaaccctgatagcatgatgcttggttttaccctgtactcttaccttcaaatacagctatactgcctgcgaatccaaagttcctctgattactgtggccaaccttggaaatacatgccattttgtgtataatgtatttgctgaaactgagtgtgattcaattatatccatctactatcggaatcaccattagctgggatcatgtgaagccacatcatcagaaatatagcagccgttggattgttgtgcatcttaaatgtcagccgtcgatacaataaaaatgctttactgattactttaactgctgtctcaccatggcatcacctccatggcaaccctgacccttatcaactattttcccccattgctttatagaatcaacagtagcctaaattgcatggcctaacctttctatttatatgtgctacgagtcaatccaagtaaggtataaaattttaattatcgttgtccaattctggttctgccttgaattttgggagaaaggtactaccgatgtgctgaccatgtcttctctacattgtagatgagatcattatggtagtgtccagactcgtgaaattacaagtgaaaatatccaaactgaatgaagtttgttttgctataagtgttcatgctgatttaggaggtcagcggtatttttttttttgctctcgctgaattggttttcatttaggtggatactgtgctaaatttattccatagcaaaattctaccttttgtatgcttgcaacagattactacaaattggatcattgatatattaatttatatttgcagactgatcttttgtctgctcaccagcttcacaattgattgatcaagatcagcgggatgcctcacccggcccccgtagtccatcaatcctgcccacaggcaaggtaagttgctctcaatattgttcctccattgatcgcatatattaataagctaattctacaacagccatctacatttctagatgtcaaccatctgtagtgtgtattcttatctttagtgctatttgttgtaaccaagccaaaaggcatggtgtctattttattcatgttaccttcaaaatcctaggccatattcagttacatgtatgttttcagattgaacaaatttgaccaaacatcagtacatatagactacttgagaatggcatgctcatgttcctataattttcaactgccatccctaagagaaaatacaacttttcttgtcacaactgttcagtaatttgcagcaatactgtaacagcgaagagaatggacaaaatggatcgatggtatcagcggtactaaagctgtgtagtaataaactattttttttggttaagtccatagtaaatgaatctaatcttcctaactattcattttttctcacctagactgaagaatgcatttctcttttacctatgtgtattcagaaatatatatgaggtgagatatgcagatatgcttcttctgctttagaaatttgtggaatacaaataatgaaatatggcaggttaaactatccgtgcatatacagtatgtcatcaagccttagatttttttcgagattatcagaaaatgttcttggagaacaagattactagaaaatggaagtgtcataaacatgtctacttgttttcttttgtcaaacagaccgcttttttggattttattttaaaactttgtgatggttaataaatcttgtttttttttgacccatcaagctggagaacctgatggttagttcctgattccattcaacagggagtctggcctgctgcatcggtcactgacacagcatgcggtttgccttcctcacacccaagctcctccaatctccttaggatttcctctttctttttgttttcttctgtgttttctcctatcctcctatgggttgttgtggaatcaggggggcctatggctgtaaggccctgtttgattcagcttaggattattataatctagcttataggagtaaactgaaacaaacaaatagattattatagcagattattataatctataagccagattattataatctaataagctgctttaaaggagctttttttagattattgagtggctaaagacccactacccttacatatttgagaaaaattacccatctatgccatcaaccgaatagatagctgagggcattatagactttagcctttcaaacccaataatccatgcctccaataatccagacaaacaaacaactcacagcttattttatatcagcttattataatctagcttatagcaatctggtttaataatttagattataataatcataagctgaaacaaacagggcctaagtctgatgttcacgtgattttgtaacaggtagcttctggtgtctaaatttggactatctcacaactgatttgcactaggagctaagcggagttgaatttttcatttcattcctaccccccgaaggtagaaactgtggcatggaagatgtgtacctttgaccaaagaaagaggtagacctatagggaaaagcactaggaatattgtgtataaagatgtcttggactggttaacaacgctaggtacctaggctaatatgtatggcatgtaaaaaaggtgcatttcaatatttgtgatatagaggataataaaatgctaatcagaatgttacttaccgttgtcctttggtttttacagcatgccgcaaccatttgggtgggatattgcgtgattggaactgacatactaccttgtgctacatcatgatttttttagtaaaataaatgcatgtgcaggaaggtgactagctaagacaacaaaatttgctgtatccattgacgtacaaatagaatgtggcgcataagactttcttaagtatatcgcaaatattcaaagttaggattagttgattagttgcatagtatattctatattgtatcaaatgttttatttttgtacttgtttatgcccgcaacaaggtaatggaataactctcgattattcctttttgggtagacttatattgccctcatatctttacgttgagatattgtatattgaaatgataatatataatttttgatggttatgaattattattttcacgcaatatgatattgttgttctttgtctaaatatatttatatatgatatatgacttgaatcaaattaaagctcaattggacagattatatgaacattattcactaacatgacaaattttcatagtattttctttttcaaaaatataatggctccgtagcgttagcacaggtatattactagttgtggataattcttctcctcgaacgtccgaagcaaggagaaaaatcggacagcatcctctgacacacatacacatatccaagcctatatctctatctctaaccatataacatgcacctttaacgatatttaaaatgaattttctcttaaattacttatttaatctataatccgatcacaccgttgtattcgttgtaattaaatctttacaacaagatgtcgcatgattatattttgataaaaaataatcatatgtttcaatacgttaacactttttgtttcatacatgatagggacatgtttcaatatgtgtctttagcgtgtttcacaaaattcacaaaactaactgttactactatttctcctctctctctctctccacctcatgtatgcatgcatgcattttagctagtttcaaaacgatttttctcttaaactaattatctaatctacgatccgatcacaccgttgtattctttgtaattaaatctttacaacaagatatcacatgattatattttgatgaaagaaaaacatatgtttcaatccattaacattggttgtttcatatgtgatagcgatatgtttcaacttgtatttttatcatgtttcataaactttttaaaatatttcagttgctgattttttttgtttcaccctacatataacttaactttatgtttcacttattagttaactgaaatatttgactgactgatacttttttcatgctgcatacgtaggcggtcctcaactccggtgacaagttcgccggcgttcagggtcacgacacacaggtgccagacgagcgtcggagaagaagctccgtgaaaaaaaaagggacaacacgccctatgcttcaccatctccatctcctcaggcgaatatgatgtcctcctccaccgctcgccatagtcaccatcttgtatgcgtgtggagcaggtgcaggatgtgggagatgccctggatcagcggcaaagacgaggtgctcgatgatgaagcagtgcagcggtctccgggctccgactgctccggcagtcaccggcggaggtcggagacggaaacgatgcagagaagctcgtggcagagcgacgctagatccggaccggtgagagggattcctaccggcgcaaatgtgtgctgtgctggcgccaccggcgggcggcggcgaggcctcctcctccgaccagcacaagaagctttggaaaaaaagatgtctattcatgtgttggggccaacaccaaccaatccactagcccttcctctgcattagtgcttttttttttaacaaaacttttggcgacttacatattttaaaccatatattattatttttaaatccgcttgaaccatcacacttcactcaaaatatatatgacaaaatgagtctaatattgaatatgtttaaacatccaaaagtaatttacttaaaccccataaaagttggattaaattttagatactcatggtacgcttttcaaactgctaaacggtgcgtttcgtgcaaaaactttctatatgaaagttgttctaaaatatcatattaatctattttttaagtttggaataattaaaaatcaattaatcacatgttattacaaccttgttttgcgtgaaacacttaatcttcaggcctgtttggaggagctttagattctaagaagcagctgtttggtagccaacttctaagaatctggaaaagctctaaaacacagcttcttcttagttcatttttcagaagctgtatctatacagattctcagaagctgtgtattgtttggggcagcttctagcagaagcagcttttgggaaaacttgtagctgggacaagctctcccaaacagggccttcatcttcatcttcagcacattcaaacaccacctaagtttacaatagaagtaacttttctatgcaacgaaagtaaacatagttgatgatgttgaaataagaaactgtgtgaagtaaaatgtatagaagacagtaaagaaaagtgtagaatattcacgagtaaataaaattattttctatatttttgaggtaatcactatattatttttttaaaaaaatagttattttcatcgtataggaagtagagaatagaaggaaaccttgacgattagaactatacagtaagggaaaaataactccaaaaataattacattatttttttcgcgggaacgggtagggagctcctgcaatttcacaatagaagaagaagaagagagttatccaacttataaagaaaactggacccaaaatccttactacggcccggttaatttatgaaaaaccggcgaaaaccccggcattgacggagtgaacctaaaatttaagtacaaccgtccagcaagggaaaagcacctaaaacgaagacttcgagaagaacacgtcgacagaacggcgacatcacccgatcctaacgaatctatggttttcacccagagaaatcccttgatatggagttgaacaagggctccaatagcaatgccctcgagaaggtgaacggcgccaagggcatcatgctgctaggattggcaagccgagcaaggctttcacctcggagtcccatccaaacatagcgtctgcaacgaaagccatcgaatgccacctgcacactggactcgcatgaaaaaaaatatacttatgaattatctgatttatatgatagctatttgagggtataaacgaatgaattgatttctaaaaagttaaaatgttgtttaaaaaagacaccatttagaaacatggaaagcatgcaaacaaaaacccaaactacggaatcggggaaaaaagagggttaaactcccttataacacccttgtcttagtaaaagttctatattcgttaatattgtgctcacatttataacataatgatttctttcacctgtacgaataaatagtataaaatccaaatatgaaatgacacagtacattataattattctgtaatcaactctcggtttcagcttagacagagctaagtgtgaaaaaatacaacccacggtgcttaattcttctctcacggcatcacacctttaattttcctttcatgatattaacaaaattaatcatctccatatatgacttgatatgtggcaaagcggtagcgctgcggtggtcgtgatcaccttagatgcctcagacacgacgctttgtcacgcgtgcaaaaggcaaaggtacagacgtgcattgtgtagcgggccaagaaagagaactttgaacgctttatttattagcaaacaatagatccgataatttaagtaatgggtccatcggttctagtgtaagtgtaaattagttaatataggttttaaattgttaattcaatgggtacacaatataatggtgtagactttattttgaaacagtgcattatttgagaataatagtccaatataataaaaaataaatacgatgatttaaataatgggtccattggtttaagtgcatgtataaattagttaatatagatcttaaattgtttatttgataggtacacaatataatggtgtaaactttattttaaaatagtgcattatttgaaaataatagtaaaaagtaatgagtacaccggtttaattggaaattatcttacattattaattttatgagtaacatataatggtgtaaattttatgttaaaaattatagagctaatttagttacctgtgagttgtatgatggtagtttctttgtttgtaaaattatgattatttaaaaaaatatatccattatataaatggcaaaatgaagaaaaaaagaaaaagaaaaaaggaaagaagatgtacttacgtatatatacctagggagaaggaggagaagtgggacctcatagcatttggtttgttttaagatcaactagctaggtggcccgcgcaattacgcggctagcacttatacaaaattatctattatttaatatgaatttactaaaaaattgttaaatagctattttgttgtatcaagactttgaaaggtcaaaccttatcatctacgtgtttctaattttatagtttttaaaagtcacgctagttgctaccccttatttcttaggcacccttcgatgtaccacttcctcgatgtaccttgtagtttttaaaatttattgtctcatcggatttcgtttttataatttttagaagtctcgtccactacctcctctttttattatcattggaattttcaaaatcgaacaaaattattgttcgggttcattttttttactttctagaagttccgccaaacagccagcggctttgccccatacttctctatgacctgcccgttgcctcccctcttcattgtcattgggattttaaaaatcaaatgcaataccttatagttttaaaatttattgtctcatcggatttcgtttttataatttttagaagtctcgtccactgcctcctctctttttattgtcattgggattttcaaaatcgaacaaaattatcgtttgtgttcatatttttactttctagaagtcccgccaaacagccagtggctttgccccgtccttctctatgacctgcccattgcctcccctcttcattgtcattgggattttaaaaatcaaatgtaattatgattggggttcatttggctttgccccatacttctctatgacctgcccgctgtctgccctcttcattgtcattgggattttaaaaaacaaatgtaataccttgtagtttttaaaatttattgtctcattggattttatttttttttactttttagaagtctcgccaactgctgtaatagtgctatttaacggcccgcccgtccctcatcttaatcgtcgttggattctatttgagattttgtttatagtttatagatgacccatcaaccgtcaccgctctacttttttacggacatgttgttttcccctttttattatcatttatcattgttgtattctagatggatttatttttgaaaattcaatatttttcattccgatgttttgttatttataaattgtatccttactttaactcttataattattttatattttacgaatttattttatttttattttgaatttcaatttatctcgtgatgggttttagatgatcttttctttcaatagtatttatgttttatttcgaaatttggttatttttaaattgtattcctaattgaactcttatttcattttttctaggttctcaatatatgctactactatgtgcttaatttggtctggtcataaggtgcatggtgctgacggtggcccagtggcttgcatgttattgtattttatataactttgtttagttcaaaaaattcaattgtattacatatattaatatttatgttatcaatcttcaccgttataatttggttctaccacaatctaatggcttagattttttttcttcgattaacatgataacttatagtagaaaaaatataggacgactaagccgttgtcttaataataaagatttcaactactatgatggttttctaagttatcttaataatatagatagataaaaaggaatatctagcaaagacgatttacatatttattattgggattatatttttattccaaatattatttttatgtttattttggaatctatattttttaaaaaaaactttttaattgtatttcttaaggagtgcacctagcttgctgtcgtgcacatgctatatatcgtgccttctggttgctgacgtgcatcaccgagtccggctcgtcgtgcagccgcacggttgacccactgatgcggatttccgtccctcacttctagtgtctatcttcagatcaacaaaacacatctaaaaattgagatctacagtgctttgttgcttgctgctttttatttcttgcctaattcatttaggtcctaaatctggttagtttaggaaatcgtacaactcttttgagtccgtttgcatgttggtcccagttatagattgattctaattcagcacatgtagggtgctccgtatctcttacttaacatgttagatttatgttaaatctcatacgttaaaatacatacctaacaatctaacagtgtaaataattcatattttcccgattaatgtgagaatttctagcctctacggtgaacgtggtgccttcttttaaggttgttttaataatataatagatagatagatttcatctaacgatgtataatattggacccaccaatataatattggacccaccaatttaagtgaaaatcaaggggtatatgttttgctttttttcttagaatttataggattttctttaatttattatagcgccacgtgacgacttgaaagtgtttgtaggaagtttaatgtacttttagtatatatttagtatataatagatatatatatagatagcattgttagttgatggacttatgtagctacgtaggctttgaatacaacccaatcaacaaaactaaaagggagtagctatatttatggcgccatatttttcaccaaaagttagtcggcatgtatttacattgtaagtcaataaattacatatgtaattttagggtatttacaatgtaagtcccaaaattatatatgtaagtactaaaattacatatgtaagtcacaaaattacatactaattacatatgtaagtggtgtgtaaatagggtgtaactactgtctaaatatactactaatatatactaattactatttatactttaattacatatgtgtttcgctggtcggtacaaatactcgtacttgattgagtgcatgcagtgaagaaaaaaatagtagcaaaattctccagtagaccgctaattagcgacctataacctatgaagcacaactagttacgcgtaattaagtatgctagcacgaatcctatgactgatccaacggctcaacaagcgactgtaatcaaccagaaaatgtgtcaccaaaaatttagcaaaaccgaactaaaattaaaggcatatatatatatatatatatatatatatatatatatatatatatatatatatatatcacgtgaggtaatcctagcccacaaaattaagattaaaggcataatatcacttgaagacctacggttaacgtgggagctctacgatatcactacggatgacgatgtggatgaaaaaaaaaagctacgaaaatcaaaatccgtcgtaagtttttttttaagaaaaaacattcaaatgtaattataatacaattataatataattatactataactactgttactatagtgtaacaacatgcaactatgagataactacactttaactgtaatttatatattcattgcttgtaagagcaagtataatagtaggctataagactaaatgctgaggtggaggagagaagagaggagagagaggagaagcgagctataaacttatagccggcttggatataagaacaaagaaactctgtgaaagagacaggtgggtcatatattaattgtaaagagctaactattatatggatgagctgagagaaagttaccaaaaaccttatagccaataaatcggttgtattattacccttactctaaccaagagaaaactttgatagctcggttgtgcatggcatatgcgcgtggtgtgagcgggaagttctgggttcctcttccccacacggctagctaattctttctcagctcagcacaaatcttcaagtgcattgaatggttaaaaaagtcgaaagttttcaaccacaaaaactgccgccagtttttttagcaaaacggtagtagtagataacgtgcacatcttaaggccgaggataagatataacgggtagagtttatttttttctttagcaaaaccgtaatagatatgcacctgttaaggccgaggataagatataacaggtggagttttttcagcaaaaccgtaatagatatgcacctattaaggtagaggataagatataataggtggagtttttttcaccaaaaccgtaaaagatatgaacttgttaaggccaaggataagatactccctccgtcccaaaatataaatgttttaggacttcaacacagtctttgagatgctactttgaccaacaatatctataaaaataaaaaaaaatcaaataaaaagagttacatattatgatagcttgattataaatctagtaagatcaattttacacgattgatcttttttattttcttgctattagtagtcaaagttagaaatgattgacttggcactatttcaaaaatgttcatattttgggacggagggagtataacagctggaggagtgcaggtgagttggttttggtgccattccgtttctcgtaaacttgacttatgtatatgctgctacatttttcgcttttggaccacataatctccttgtaatcttaatcgatcgctcctgtttctcatcagaagtagcgagagggcaagatccggagaagtaatcaaggactacggaagtgatggacgccgtggaaacgatcatctcaaccgggatcaacatctatgaagcgacccagctgagcgatgaactgtcccgcctgcaggccaccttgcccaaggctcgcttcctcatcaatcgcggcgagtggggcaggttcaagaacaaggacatggcgatccttctgtcgcagctcaaggacaccacctacgacgccgaggatcttctccgcgagttcgatgaccaggcgctgcggcaaaagatggaggacgctgaccggagctgggcaggtcaactcttatcttcctctctaaatcatgcaaaaactttgatccgtggtagcaaaacaaggataaagtaggcccaggagaagctcgacaaggctgtggctgatttagagggagcgatcaattcagtgggtcttagtatcgaggcagttcaacacatgccggagacaagttcagtcatagatgtgtctcaagtgtttggccgtgataaagaacgagatctagtgattgagaagctgggtgtgcgttcgatgattggacgtaatagtcaacgagatcaggtgattgagttactgggtgtgccactcaccaggggtgctgctgcacgggctaaagagaagagagcagcagccactgtcactggcacgaaatcagcatcctgcagaacgaagaaactgaagggagagagcagcagggcccctagacttgatgaggccaaatgcatcggcaatgtttctgtcttgccgatttttagcattggtggggtggggaagtctaccctggctcagttcatctacaatgatccaagggtgcaagctcactttggcaagaggagggtatgggtctgtgtttcagacctctttgacaagagaagaataacaaaagagatcattgagtctttcaccaaggaagagtataagccactgttcagtttagatgctcttcaggtggaaatgatggagcagctagggagacgaaagttccttttggtgttggatgacatttggcaagaagctattgacgagtgggagtcattttatgcaccattcaagaacggacctaaaggcagtatgatcttagtaactacaagatttacaactgttgctgatcgtgttgccaccaacaattgtaagcctatccaactcgaaggcttggatagagatatattttgggagttcttcagcaagtgttcatttggagaagagcgtccagaatcatatcctcaattgcaagatattggtcacaacattgcctctaggttatgtggatctcctttggctgccaaaactattggacgtttgttgaatatggagctgaccgtgcaacattgggagacagttcggaacagtgaattgtgggagctgccacatcgagagaatgagatattaccggccctccaactgagctacttatatctcccacaagaacttaagagatgctttgcattttgctgcatgtttccaaaagattacagctttgaacgagatgagatcgttgacatttgggtggccgagggctttgttgtgtcaagtggaagcacacgtcttgaagatatggggattaggtatttggatgatttgaggagcaggtttctttttcaaaccgaccccaagtatcctaatcgaactagataggtcatgcatgacttgatccatgatatggcgcaatccgtttctgtggatgaatgcctcttgatgcaagatttgaggtctcggaatgagaggagaatgctatatgcagttcgccatatgtcagtcgaggtcgctgatgaatccctgaagagcggaatgagaggcattcaggatttgaacaaattacattcacttaggtttggaatcaatttcaatgttgagattacctggttcaatcagctctccaacatcctatatttgagcctaaagggttgcacggtggtcaagctacctgagagcataggcgagttgaacagtctccgttatcttgatatttcttatagcggtgtacaagaattgccggagaaattctggtgcctttacagcctataggttgttgatgcaaatggttcaagtctaaaagcaattagtccggatgtcataaagctaatcaacttgcatcgtctagcattgccaacaggttgctctccaaagttatcagagataagtaggcttggaaatctgtctcgtctacggaacttgcaatattttatagttgaaacaggggatgggcggaaaattggtgagttgaggggcatgaatcagctcagtgtagctctacttattagttctatttgtaatgttaagaacgaggaagaggccgctgaggctagccttgttgaaaaacggtacctccagaatctagttctacaatggcgaaagaaagtcacaagtttagtgaagagtagtgagaatggagtgctcgaagccttgcatcctccaccaagaattgaacaccttacagtccaaggttttgggggtgatagcttttctcctagttggtttagactagagagcctgctgactttaaggagcctggtgcttttccattgtggcgtcttgaaaaatctgtcaatcccatcgtttccttccctcgaacttctaatgctatcaggaaatatttggctgaaaacagtaacaattcttggtggttcgactggtggtgaaacgatgcagcatgcaagcagcagtagcagtagcagcaatggcacaacatgtcttagtggactcacctatataggtctttacagttgtgaggacctgcagaatcttgatcggtgcttgtccccggaatacttgccatccatcaagtccatagagatcgacagctccagcgatctaggactgtcaatgcctgtcgatagtttcgtgggattcaaatacctacaagatctgaaaatccactgcaaattgttatgcccgcagggaatggttttgccaccctcactccgacgactctctattgtgtctggccgtaaggttgacttcccggcctgcctacagagcctcacctctctcaacatcctgcatttgtctagctgcgatggcatggagtccattccgctgggcacaaatctttaggtcaaatgcctgcttctcgagcggtgctcggagctgtcatccattggaggatcacacgttctttcatccatgcagttcgtgagcatatcgatctgcccaaagctgcacgaagtagagcagccctttaaaaagtgcctgctgactaataaggacaagaaggaactgcttcaatttacctatcacttatatggataaagcatagctgatttctaaagacttccggggtatttttcttcacgctgcggcacccagagccttctgttgataattgagcgttggctggtttgggtgagccgtcgacgtgtgccttgagattgaaatggccgagaagaacaaagaaaagttcacaccatgtagagagttggagggtgagcggtggatgtggtttttgatgttagaaacgagtgcgaaagcgggagcaggtctggggttagccatggcgggatctgccgaggtgcatgagcagactttcttctgatactatgaagagattttcttctgttcagcaggtagcccggtaacaaatctctgcccttcgttctatccgatcagacgattggcaaggtgtggtacctccagatacatatttgcccatgaggtggtaccggcagtgttgagagaggtggaaggtgcttgaatcccctctgtccgatgagtggtaacagcggtggcttgtccatgggcaactgtggcggcgaggtggtggcggccgtggcggtgaggtggtgttggcggcggctggtgcgtgagcggccgtggcagcgaggtggtggcggccgcggtgttgaggtggtcatggagtcgttagagctggcgatgttgtggcagcggcgggggctttggcggctgcagtgacgaggtggtcgtggagcgaggtggtggtggccgcggtatcgtggtagtcatggagtcgttggagccggtgatgtggtggcggcggtggggactttggcagctgtcggcggccacagcggcatagtggtggtgctccagttgtcctctgaagctctaggacttttcgtttgctgttgctgcgatgccggtgatcaaggatattgccgatgcgtagtggtattacataagttgtacgctgaagtgtgttgataggtaagtttcattccaagcatatgtcatttttttagtggtaattcagtataaataaattttcttttaatttagtcatgcatgtcaatataacagtcctgtttttttaaggaggatgacactctgattggagtagatctggcatccaagagtacaaaagacattcaagcagctttggcacttgctggaacatgtcaatctgggtacactggtggagaaaccatctttggtccgtcggccgaaatccacaatagttccggttccactaaaaaccgagactaaagatgatctttagtatgaagctagagctggaaatggcggaccgtttttagacatggaaatttcactcaagaagttgtccaagcaggaaaaggagaccaatgacattagaaattggttcataggaataatagttctagctgtgctccttctcatgaaattatttgataatatgtactatgactaccgttgttgattttctggatgttaaaatggaaaaaaatttagtcatattgctagatgttattagctatgctaaatcacaacatattccccaacttacaatatcaatatcaatttttaactcaatgcataaagctgttcttgatgtcctcctgataacttaggtgtactccagtttgtcagtttgtttcatgttcttgtcacaggaagcaactaggacagttgcttgtgtggaaactgaatgacactaattttttgtgtagtctgttcaattttttgtgttcagttcttctcaccattagaaattaaataacaatatgaatgcaagtacctaatgacaatatgaatggctgtgaacttctttgaatgactgaaaagcaaattggcagcaatgataaattaatgaattccaatggaattgcatgttaataagtgcccatccatctgaaaacacctgcaggaaaatatttacatttatggaattgcagtcagaagatctcatgtgaataggaaaatattgacataactgaaagtttcagatgcaaatcagcaaatgtgtcaccatatggctcgtgacgccatgatccatgctaaatggcgaaccagaaaattcgatttgcctggcaccaaattctccaatcccaatacctactcaacaggttagcttgcatctgagatctgaccatctactgaaagtctgaaactaatactccatccaacactagtcctcactcctcagtcgcacccaatacattgcactaggtatttagcaaatgatataggcggaaacataaacagaggataaacaatcaaacccataatatgcaaacaataagaggacaaataattgaaacatatagacttaagaaacagcaggtgcatcaagtaaacagatgctgaagcctaaaggttccctggctacagaaagtgaagttgtgaattcttgcagtgcataacacaagattaagtcagggcatacacaaagcgcagctcatgaatggtgtcatacgcttaatggcattacatcaccctgatgccagctcgcacaatttcagagtattgacgagtctcgaagaaattgaatgccaacaatcaagctccaggaaaggtgagacatgtccgatgatgccccgtcggcccgtgcagttgcagcggagaggcgcacgtggctgcgactgccatcgacggccggctgcgtagcctccgaggatgtgggcgaccatccgcagccgccgcactactccacatctgccctccgcctgccgtcgtcggccggctgcatagcgccggggatgcggacggactaatccgagcgccggtgaggaaaagaacaaaggataagagcgtcattttatagcttacttattttttacggttttactacgtggggaatgctataaagtcttatattataaaacagagggagtacttgcatattttttttacggttttttaggcttaaaaactttcaaattgtagactgttagatcacatcaaaattcgtgcagatcggataataaaaattggcgcaaagtgcacaggagcaaagaatcaaacctacaacctctcgtttatgactgaacggagctagccgattgggcgcatttggttttcgtttagatacataccagttacatattaattaaatatttcctccgtattttaatgtacggccctgttgatttttttaagaaacgtttgaccatttgttttattaaaaaatatgtaattattatttattttattctgacttgatttatcatcaaatattctttaagcattacataaataattttatatttgcaaaaaacttttgaataaaacgaatagttaaatgttgataaaaagtcaatgctgtcatacattaaaatatggagggagtactagttacatattagttacaatagtagtaactcactgtaactatattgtaactacattgtaattcaggtataatatatatatataaatatataataattacatacagtagcgctaagggaaaatttcatctatacctaccgccaccgccaccactaccgccatgtttagggttttggagagggagagacgagtgcatgaatgaaagggataagcctgaggggtaatcctgtctatcgcgctatttcccgtgccgccccgttccgctcctgttctactgtggtattgttgggaaggtgggaagttctatgctattttttgggtaccgctcaaaagtttgtggtatagatgaaattttccctagcgctaatccacgcgctgcatacggaatattagttggagtgccgcacaatgctccctccttacggttttccgcttttttaccaccacctttcctcaatttgtttttttacccccaccttttttgtttcttttttctcttttacatcttatccgtgcttgatcgaagcgcccgctaaaaaattaaccatccagatttttccgtttttggttccttctcttcagtttttctgttttcgtgttttagtaaaatatttaccatctagtttttcttaccgagttttctgtttttctagtatctcctcacatttcaaaagtaacggatttactctatgaagttttccatttactcccagcctcccacatctactcctcccagcctcccacatctgctccttcaaaagtaacaaatttactcgcatgaatgccccattcaaaagtaacaaatttacttgcatgaatgcccccacatcatatggcaccattcctagatggtggtaaaagaactactaccggcttacaacgctattaattttttttactagtgttgtaaatattgtttcaatttcgtggtctgcgagtaaaagaattaccacattcctctcgatatagcccatgatctcgtagcaatcgtgtagtaatatgtttactaatgtgttcaatacacagtataagagcaaaaactgatactaacagtattgttaatttgtatcacaaaatagccatatgaataaaaaaattacaggcttaaccacacactacaaaagaaaaaaaatgattcagcgaaaaatccatcacgaaaataggatcctggtggttttgctaatggagaggctagtctgtgtcttgtgacgggtagtggagagggtaaccgggtggcgagcggtagtttgacgatggaatcatggaagggtgtagcggtgtggtatagagatgggctcgacgttgcgcagtagcagccatccatcatctagcaagcacgaaaaaaatgtaagaacattttcgttcatgtcatagagatgacaagcaaaagaaaaatagcaaacaacatccatcaccggcaaaagaaaaatagcaaacaacatccatcaccggcggactccaccctatcctctgcggtcagccacatggagcacgatgtgcaaatgtaggacctgtgcggcccatcaattcagatcaagtaatattggagattgcacgttaatttgatttctttgagaatattcttcattccttggtttcttggagacaatccctcaagggtgatctccttcttttgttatttagattgaatgagggtgataaagatgtagtcttaaactggattaggttgttgtaatcttttttttcaattatcaatttagatttttttttaacaggggcttccctttctatgttcctttcagaaaaaaaaaagagaagattttgcgaggcatgcatgtgccaccgggaaattgatcacaagaccatccgtatggaaaatgaaggatgaaatccctgcattcttagcacgaatacagtgggcatatgtggccctatacagcacctataaaggccgtttagatacttcatggtgctcattgatgcttcctcaaaatggtcgcacgtgtgcctgctatcaaaacgaaaccatgactttgcaaaattgatctagcagatcatccaaattaagaataattttcttgatcatcatgtgcagtccattcaaatggacaatgctgcgaatttatttcaaaagcatttcatgaatatttcatggcaatgggaatcaaagcagagcactcgatatgtcacgtccatacgcaaaatggacttgcagaagcgttgattaaaagaattaaattcatcaccaagccactcttgcaaggttgtaaattgccaagcacgtgttggggacatgcagccctacacgtggtaaatcttattaatttcagatcatcggcctacaacatccattcaaaaatgaaactggtgcaaggggtcacaccgaaattgtcccatctgttcaaatttggatgcctagtctatatacctatcctaccacctcaacgaacagcaatgggtccactcggaaagattgggatatacgttggttatgagactgcatatataactaagtatttggaacccatgacgggcgacacgcatacagtccatttagctgactgcatcttcgatgaggatcatttcccctttttatggggaggaaatcaacccttggatgagaaaatttggaaatcacatggccagacatggggatccatgcgcatgatccacgcaccaatgaagcaaatggagaggtactaaaaataattgatttgcaaagtttagtgaatcaactgcctaaccatttttgtaatttgaatagcgtaaccaagtcgcatgtgcatgcacgcaatgcaccggagagattgaaataccaaaggaaattggtaaccctcatccagtctggaggcctcagaacaaaaggacaagaactccagtctctcgatcctcaagtatcaagaaacgtctagagaaaagggggacagggggcttggtacagccaattgcaaaaatatccaaagaaaaaagaggagccagcggagatctggcactagtatggaacctatgaaaagaggcataccagacctaagggcccctttgaatcgcaggaatgagaaaacataggaataggaaaaacgtaggtttttgataggaatgtaagtgtaaaatagatgattgcaaaacacaggaaaaacacaggaatagtcgtttaattgaaccgcaggaaaaacgcaggaattagaggagagataaagacttaaaggaaagtttccaagaggttttacctcatgttagaattcctccaaaatttacatggcattaggcaatccataggaatttcataggattccataagatccattcctttgattcaaagggctgtatagaaaaaattcctataggaaagaaatcatctaaaattcctatgaatttcctttgaatcaaagggggcctaaaccttcccaccgagagagttgtcagtgacaatgtgtgtgcacacatagaacctagcaaactaaaggaactttcccctgtaacagagaacaacaggaagcaagtggaagcttcagaagaagtagctcatgaagaaatggccataaacacatcgggagaatcatttgatagagcaacagcaaatgtagatatctactttgctaagaaaatagcctctgtcgtgaatctcgactgcgagcccatatcactcacagaatgcaagaaaaggtcggattgggacgaatggaagaaagcaatcacaatcgagttaatttctctaaacaaaagagaggtatttgaccctgtaagccgtatccctcctcatatacgggcataaatggttatttgttcgaaagaaaaaatcagaataacgagttagtgagatgtcacgtccagaatttctatccaaaattccaaacgcttacatgtgtgttaaaccctcgtccagaaattaaccgaggcacacaataacaaattgataatagagtgctaacaaacaactaattaatattcgcacaataataaaataataaactattatagaggtggatagttcctctcaaagaataaaattatacgcagcggaaataaaaacaaaacggaacagctatggcgactccactccacaagcaactcgacccgaacaaagcctaatcctccagatcatcaccttcattgaagtactcctcctctgacgaatgaatattgcaataatgagcatatgacatactcaacaagccacacagcaaatatgcaagtgcacaggataacaaaagatggcatagtaaagctcatttgcataaacagcatttaataaacattttaaagaataataaaacagttgaataattaatcagtattaaataaacactatacaacacacccgtgctgcataggcccaacctcatctgagcaaccaaccccggttgtacaaatcaaacctccataccaggaatataccattccaaaccaaaagtcaaattaattaacacaatattatcattaatgaatagtgtggggctaatcacgaaaaacattgttaaactcacccataaccgcgggcacggctattcgaatagttttactctgatcagaggtgtaccactgtacccacaagacacaactccacaacatgtcatcatgcgcctcagtaccactacggtaccttggaaaggaactgtgacaatacccctcgcacaacacaactcatcacagtgcaccgttcctggatcatgatctccccctcaaaaccagaggcaatggactccccagcgacccccacagacttctcgccgcttcacagtctggcacaccataataaatcatgctatacaaaagataaagccgttgcccatgctggcttgtggttggcacggtaaatgtttcacaacagtagctcgcgaaccggtccttaattgtcatgagcacaaccatcaaaaccatatgctcacaacccaccttaatcaggttttagttatcaattaattaacataacacaattaaccattgtgagctaccattaaatataaccataattaataatgtagtatgattcatcccattaatgagctaatgtttctaagcatggctaagcaattatacatatagcatctaactgaaccaatccaatatataaggtacaagctaatcaatttattacccataggaaaataaagacatctttggccattaattaattgggaaaggctcaccacccgatgacattcgaaaataatgcataagttaaaataaaacattagctttaaacgggttcaacatgctcaaagggttgtttgggatctatattacttgccttgagcttccgcaaatgcttccgaaccttcctcaacgaaaacgctctcctccggaacgtcggaaactaaagcaaaagaacaaaatcaaccaaaacagtacaaaaacaagcataaacagtacatgtggatatttttaacatgtagatctcgattttagaaaaatttagcaacttggaccactcgaatccgagttacgatgatttagttatgaatttccgaagtttaatcgatttgcatctaataaagaaaacctagaaaaagggatttatgacgtcatgatgacgtcatcaccgccggccacggcgcgggcaacacgaccaccggcgctagaggggtcggccgggctatctaaggccatctacacgtagagaacgacgacgcgaactcaccggtgcaagaaaacgcgacggacgacgatgaatgacggccggcgacgaggtcctatggcggcgcggctcgggtcagcgacggcgacggcgctacggtgtccggcgacggcggcgaaggggcggccgagctttccctcctccgtgcgcactcgacggcggcgacggcgctagcggcggtgcggcacgaccggaggatcgccggcgacggcggcggctagagcaaagcggcggcggcgctacaagcgacgagggagctcgggagttggggcaaacggaagaggacgactaggggaagctatttataggcttagattagggagatcggactccaaccgagaggaatcgaagccggaaaatcttcgggttagtttggagagataaactcaaaacgaactcgatttggtttatccgggcgaaattggtctccgaaaccttaggggaaaggaagaggataaggaggagatgatttcccctcaactaatcggactcgggggcgaccgatagaggcggatttggcagagggaggcggcggctcgggctcggcttgggcgaccagccggctggaggtaggggatggccccgacatgtgggccccacatgtcggcggctaggggaaaggaggggcaagcgggtcggctgggccggcttgggccgctcggcgcgcgcgaggagagagggatgttgggccaaatacggcccaacggcttagaggaggatttttaaaacttttccaattaaaataattcgtgaaatgatgtttcatttattaaaaatacttcccttgctcaaataattcccagaaaaatctagaaaatagataaacaagcaaagtatttaatgaaattttatctagctcaattttatgttgaaatttttcttagattattagagtttaacttgtaggctttaaaagtaatttctaaaaatgatttaaaatatggattattaatttaggcgatttttagggcgtggcatgagatataaagcaatgctagtagctcaaggtttcacccaacggccaacagttgattacaaagaaacctattctccggtcatgagcagaattacctttagatgcgtaatctctatggtagtaaatttgaatttggaaatgaaatttatggatgttgtaattacctatctctatggaacttggacacggacattcacatgaaggtattaggagatttccatgtcccaaaccaagacagagcaagcaggaatctgtatagtgtgcaactcaagaagtcactatacatattaaaacagtcaggaagattgtggtataatcggcttagctatttcttaagcaaaaagggctacaacaacaatgaagattgcccttatgtctttatacggagatcctaggatggaatttgcataatatttgtatatgtcgatgatctaaacatcattgggacactcaaggatattgaagaagcaagctcatatctgaaatctgaatttgaaatgaaatacttgggcaaaactaagtattgcttaagcttgtaacttgagcatacccccgaaggggtcttagtgcatcagtcaatctacacacagaaagtgttagaatgatttggctttgaaaagacatatccttctaaaacccctatggtcggaaggtcactccaagtagaccaagatccgtatagaccaagagaagaagggaaggaagtccttggattagaatatccgtacttgagtgcaataggagtgctcatgtaccttgcaaattgcacaagaccggatatagcatttgtcgtcaacttacatgcaaggtacaacacagagcccaccaagaggcattggaagggcatcaaggacatcctccattatcttcaagaaagtaaggacatgaaattgttctacagaaagaaccaggacctcaccttggtaggatatgcagatgctgggtactctctccgtcccaaaataagtgcaaccataagtttcaatgtccaattttaattatccgtctgatttcaaatttttttttgaaaaaaaataaaaaacataagtcacgtataaagtactattcatgttttataatctaacaacgataaaaatactaattataaaaaaaattcaaataagacagatgaccaaagttggacacggaaactcatggctgcacttattttggaatggaggaagtacctatcgaacccacacacagccaagttgcaaactagttatgttttcctatatggaggaacaaaaatttcctagaaatcgtcaaagcaaaatctagtagcaacttcgatgaaccacttgaaaatcatcgcactatacgaaacctctcatgaatatgcatggtttcgtcgaatgattcaccacatttagcaatcatgtgaattgaacaccatccagactcctataattatctatgaagataatgcagcatgtgtcgcacaaggacaaatgggttacgtgaaaagcaatctcaccaagcatatataccccaagttttttttatgctcatgaactgcataagacgaacgaaattaaagtattgcatacaagtcatgtgaaaatatcgtagatttattcactaagtcattaccaacatccccttttgaaaggtgcatctgagggatcgggatgttgaaacttagagaaatgtaaaattcaggaggagaatttcactgactcacttgccaaacttagtccagaatgacaaagtacctaataagaataattggaggggttgtactctttttcccttagataatttttcccgcatttctttatcaaggtttttaatgaggcaacccgtgcaacacaaaccgtatgttatgtactttttctctattttttttccactggctcattaaggagctttaatgaggcataagcaatacatggtgacggctcaggagagtgttgaaaaacttggccaatgaacgcccaatacactaatcaggcctcaccctactttacatgtataagaattggctatataaagaaaaaagaggagaggctttatgtaccatgtataagaattggctataaagaaagaagaggagaggctttatgtaccatgtataagaattggctatataaaggaaggagaggagaggttttgtggacagttgaaagaatgtgaatgacaatactgtaccccttctcatatctcgtatctccaattttctgtagattacataaccctcaataactacttcaggtagcagaagcgttgcgtaataatttggacttccatcagttactacaaaagatcatctccagacacgcacacgcgaaacaagcgcttatatctcattgcagcagcacaaaacctgatgatatttacacttgtagagtgagagttacagtgagcagtttctcaaaccaacaaaaacgtaaatggaaaaccgagaaacaagagagatatttacatttgcactactcagtaatcaccaccaaatttatgtacaagagccaccgagccaagctccctgtgaccctctctctctagccaaatcctaagcaaggagtcaacaaaacttccacccgctccgggtggccacgtttgtgattacaaccgtgatcgtgtgctagtaatttacagtatgaaggttttcgacgtggcatctgaaactgtacacctgcagaggagatggattatgaactccaacaagaacatcggagatggcactgattcacaaatggttggattgctagtgtggaaatctgacttatcctgtacaagtttgcccaccaccctttgatgagattgcacacatgtgctcttgaaccagttcttccaggtaaatacgagatctcgcaaaagaatgaacagaccacctcttctcaatggaagtctacaattgaggaggcccgtggtatttgtacatagattctttcttgcgttcaggatcaaggctgtgaatgtagaagaaaagaaaatattagcaaaccaacattagcagtctgtggtcatgccaaaaatgaagtatgctcaagagttgtaacattcgcataggacaaatatgtattttcaccgatgctgatcggaagagaactcaattccactaatattataaatcaaaccaagatcacaattagatttttctgtagattgttccatagttacctagtcagttgcctagcctaattcatgcacattattatttttgcaattcgtaagagcctagttaaaaatcattggttacaagttctcccagttaagtgagcttgtgtcaatgtagggaatgccaagcaccttctgaccctcataagtcctcggtgtaaataaactgtttttgctcaaacacatattttacccagagtaacaaatagttttatcagtgcacagactgataatatttaggacgataaatcaactatattctcattcttttgcatagatatacatttttcatttggggcaagtcagttacagttatttagctacgaagttttattgattaatcctaagctgtccagatccatgaactttgttaccttccgttgctaacttcttccagttccaacagaagacaaaaatatactaatacagtaaattgcaagtcaatatatttctattttcaaatctttttaatatctatttgtattactccctccaatctcaaatagaaaactattcagaatttgtgcaatcagaccttgagatcttgctcaccattatatgggggaaaaaagagagaggagattttatttttttatttttattttataaatactacctccgtttcatcatattataagtcgttttgattttttttcctagtcaaacttcttaaagtttaaccaagtttatagaaaattttagcaacaactacaacacacaattagtttcattaaaactaacatttaatatattttgataatatgtttattatggattgaaaatatttctatcttttttataaacttaaaaagtttgacttaaaaaaaagtcaaaacgacttataatatgaatcggaggaagtatatgattacaaaatgtaataactccattttttaatagatgacgtccttgacatttggaataacgtttgaccatttgttttattaaaaaaaatagtgtaaatatgctaaagtataaatcatactttcatgataaaacatgtcacaacaagataaatgatatttatataaattttttgaataggacaaatggtccaaagtcaacggtgtcatctgttaaaaaacaaagggagcattatctaacatgtgcatggagactttgctgatatatcataaataaacaagtaaaaaaagaaaacaagttagattagaaaatacaaatttttatgccatgttttgagtctagctgatggtctcatgtcacatgtgaaatgtgatcagaaaaacttagtcctattgcatcgagtaaatgataacagaacagaccgaggagtcaacagtgagttgggaatggtctggactgatttaagaattcaaaataaccgtagagcttcacaatgtttgctgatttgaggtttgaggatgagtgaaatcacctattccttataccaagaagtgtataatgtgcagcacgaaaagacgctgataatggagccactgcagcacctggagctccacagattgcagtagccaaagctgatccggcaccagccccacgattataaactttaataggatttccaatcaaagcagaggcagtccttccaaacccatcggtcaagctttcatatgcctgaaaaatgttcagcatatattgaattattgataattacacagcaaatgaaacttatactggcagtacttaccatattgatatagaaagtaaacgcaaatcacaaacaaaaatagaattgcaaatagttaggttaaagcaacatgttattagcagacaacagatgagttcatctcagaaaagatgagttcatgtgcaatttggatgaattcaataccttcttcagcccttcttgcgcactttcaggctggttagctcttacattgtctttggttctttttgcttcacgtgaggctaaaggtggtggaattgctgtaagggcactttctgtctttagaagcatatcatgagctcctgccgccaaatgtacaccaagccccacagcttcaatggaaacacttctaatgaaagcaaccgcacctgtcaatcaccatcaagtgtaatcagggatgcatgacatcaagaatttcacaataccatcatatattaacacatcaacagaaatgtcaaacaaaatatttcagcatagtagtgcagctatatgtggcttacctctttgcattcccttgagcaacttccgatccttcttatagctctttatgggtaaagagaccaatttcttagtgcctgaactcacagcaactaatgattttataggtggaagcccttttaacaatttatggacctaaacaaggaacagattgtcgatttggatgagaatagaaaatttttgaaacaaatgagaatagaaaatcatctgtaagacaggaagatatgagattctccttttttgtgaagaaatacgtgtatgccaacatgcaaattttaaattctctcttatagcattgcatgtcctgaatcggtattggtgtacacaacagcaggcatctttaatataaatgtaagatatgtgtgggaagattaggacctgattttttgagatgtcctctaaccattctgcagctactatttcacatatattattgaaaccataaacacccatggcagaaacctgcttcagctttaaatcaattccctgcacagcaaatttagtatcagggttgcctacaaagatacgactggctatgatgtatagttctgaacaatgaattaccttccatggaaaaatgttgagaagttctgcataatttcctttgctaagtgcaacaggatcaaaatgccgaggaatataattaatgtgcagaacaagaggcttcacatcaaatttctagcatcaaaagaaataaattagaccataatattgtttactaaacaaagaagatccatgctgctaattagtagaaaaattttgaaaatgaaaagaaactaatagttgctgtaaaaacaattgttaaaatatatcaggtaaagtaggagaaaaaaaattaaaaccatatgtccatctcaagtaccatgagtggggaaaaaaagaggaaataaaaactgaaaaacttcaagatacctgaaagaaaggaagtaatgcctcatcagcaattgtatcgcttcgatacattgtactctgcgcgtcaatattctcattttcgcaagccaaattagggttgttgcacaagtcattctggaagaaactgataaggaagttaagttgcccttgatcaagatgcaactgtagaggcaaaatctcaagatgtaacctgaaatatttaggatagtgcaaggaaatcagtcatcatactgagtctaaaataagtaccaaaaatagagagtagaaaaaagacaccagtactcaaactcacttatacttcagcattcagatatggtatatggacacaaaatgtgtgtggagcaacggctaaagggctaaagggcaaaagggtgaaataatatctgccaaaagaaccacgcatgcatgatttttttttatttggatctgccatcttctatgcgtttctttattttacatgcactcaagttaaacttgttgacgtgtggggtgtatagccaactcagctcagtttgttaaccttagagaactaaaagcctagcttagctcggctcacaagctagatcgttaagctcgttaacaagctctatctcatttgtatcaccattataattttaaatttaccattttatcatatactaacatgataaaaaacactaattaataaaggaccttcatgttctatctgctattttacgttactccttgaattggacttgagggtacagaattgcgatcaaagtgcagcagtacacaaacactggatttatatcgaatccagaaacataaattcatcataaaagagctaattattacattcagaaatgtgcctctattgttcagctcagactcatcatcttgcatattaccatgtgctgaggtaaaaaaaaaagtcaaatagctgggtacactagaaattattcctgcaatatgatctgtaatgtggaacctagtccactacataggttttttcctacatctacctgggcaatgagtgccttcatacatcgagggcacaaaaaggtagccttgtagtttcttttaacaatgcaagcccattaagtatgaggcaaacgcaatgttcactatggattaacagaaacaagcaaaatcacaaatgttttctgatagtttaattcagtgtaaagaaacaccatatttacctgtaatcttccaaaggagcctgtggttcaggtcttacagactccagttctaacatgaatgcactagaacaagattctctcgggtaatcctttgagttgtagcaaccaagaacctttgattcgaaaatggatagaggatttagaaaccattagtccagtggtaatagtaaattctagataatttggacagaaaaatgcataccattttccatggagcatgtgtactttggtcgcaaatattgatgtctttggcagagatggatagcttagaaacaaaaatatccccatctggatacatattgaactggatattgagcgcagacataataaactctaaataagacctcttgtctctgccatttgagcacggccggctaatcgtatctttctgagctaatttccagtcatttccctcgtacatccgccacttgacatctatatcatgaataagaacctttcctttcagactgcacgattcatcagaattcaagatgaaaatagcaggcttcagtttttgttgaaatatttgctcttctcgtggtttgttcctttgaacatggttttcatctattgtgggaaaattattataccattcaccttcgtcacactctacggttctaggagcacaattgccctggtcttcattgtatagagttgatgatgacgaaggtggcatataataagattcaattattagatcatcactagtactggcttcaggggtaactagtaatgattcaagtgaaatacaggcatcatttgcctctgggatggccttactcaggccaaactcttcatccatttcgctaccactcaatgagtagcttgcgaagtcctggtcagtgcaaaaggcattctcaattatatcatcaagcaaaccatctgacttgcactcctctgaatctgtcagattatcaatgctactctctgacttttctgacacatcagtgcccatattttgcttgtttgcctgttggacactattccatctggattgtagatgatctaaagcatcccgcatatctggagcatatagctgctgaagctgggagcacaattgaataacaccatgtgtcgtatcgtgacaagtaccaatatcgaattgcgagtctgataattcgagtttccaaaaggaagtatcaattcttagaacagcttcaatgaatgtattctgcacaatcttagcatagcccatccgacggaggtaatctgcaccatagccacaactgacatttttaaaactagaggatccacaaatgagaaccccgagatctcgcagctcgatatcaaaatcagtagctgtagagtttgatgcagatttgctgtgaagtttaaacaatgatgcagctaaaaggcatgaaaagtatttgcagtctggagtttcagcgctgagtgcagaacttctgaaatgaggttcatagctcacagcaacatcaaccagctcaagaaagaacagtgatgaaaaaggttcaccaccctgggaatcgttcattgtgctactattagctggttgttcagttccatctgaagctgaactaaacaataggcaaatcgcgcttatccaatccatgcggccaccaggtgcaacggctgttgcagaacgaacattgatagaagtataattcttctgaaactttgggttcatgatatgagtcacagaacagcccgcagttccaaaagacaagatattgctaccttcaccatcacctcgtctacttgccgaatccttgcaaacaactagaagaacatctttgctttcttcatagtcatccgtaccagtaatagagccccagagctcaccttcaccatgattgacccaaagaaaattggcattgttaaccccgccaacattagaagaggatagcagagaaaattttgaaattgacaatttgagacagttccaggaaccttctagttcagtctgcaataaaggaccaacttcaacagtttcatccaattcagtgcagatatccaagatgctgcattcaaaaatgacagatgtttggctagcagtatcatggattggcatacaattgtcactgtcattttcaaaatttccagttgctccatctgaaagaccatcaaggatgttttttagcaaatggtttagtatcccacagtccttcttactgagatgaactgagacacaagaaagtttaatgtgcaacaaaaactctgtgctccggaggagctccctgcgtatactggaacttgattcctcaagatcttctgaggttgtagaagaggaaacaccaacccatttaccatttttgttctgagcaatcttttgctcatgcaggtttggcaaactccaagttttgctcaccatctcagggtcttttaaaggatacttcttccagagcatcgtaatgccagtttcatgacaattggatccggtaacagagaaaatcttcagagaagagaaagtttgcctactcagagaacaggttctagcattcagttcatcattaactggtctaaccaaatagatgtcaaagttccctgtagccaaatggaccaaagtagatggtgtgattgcattgacatcattaggcatttcattttgatgtggagatgaatctgctcctgatttcagagatggtgtgtggtcaatgacaaggaacttatccagcatggatgggcagctcaaatcccatgattcagaaggaaagcaaaagatgactcttgcaggcgacagggctatctgaaccttttggcttcctcccaaagaaacatttgacttcatagacaaattgacatttttttcgtcattcttcctatgaattttatcctccccatgcaaaacatcagactcgattttactgataaaattcagtagcatatatattgtgtgaaagtgcacccagcaaaccaaaggagccaaacagactgatagtgaagttgagcttactgggttgccatcttgacctgaggaactgacatcatagtggaatacgcactcaccaaacgtgtttagcaattcgaccttagtgaggtcatttgaattgttggtatgacggcgtgatgtttcctcatggtaatcttgataagcaaatacagattgagggagagaagcttgaacttctctgcaaaaattattgttcaagaaagcagcaccaagatttggatgatctgaatcattgttcttactgccatagtattcatcaagctttatagcagcaattgatcccttgagacttaggttttcaggatatgtctgcaaacatcaagaacataacattagaatcaagcttcataaaattaggagatataaactacgaaaaagtgctattggtggaagcagaccagacctccagggaaagatgaatgttctgacacttggcttcaacgtgatgcatattcaagctggcagcaggagcaggagatatcattgattgctcaaaatgtgcaaaggaaaggcagcttgaaaacatttcagaatttctcatgtcattgaattgactgataggaacactggaattgccagcatccatttcatcactgaacaaaagaacaacagatatctcagcaatggaagcccgcaggttttctctatcggcggttctgttaggaaatgaaaaggaaaaataagtaacaaagtgatgcaatatataaatgttctgataatttagccagaaaaagtaaaacactgcagatacttggttcaatgccagaaatacatccaacagatatttggacatgcttgataggtttgctaatagcaagagaatggagagaattcattactcgtaagttgcatctgttgataccagactgttactgtatcttagaacatataacatctgtcattattcataagccaacataacctagcatgtgtaccttttacctgaccttcattcaagagataacagtaattttcgtttttctgcatgtttcaagtattcagttcatgcagtatggttttgtataaggtggactagtccaaggtagggatggtacaataataactttaaattgtaccgtgcagtttcattggtgagtatcagtgctattccctgagtatcaccagtgtaataccaactaacaggagatgttttcagtggatcaatgtattattactacacaccagacaaaactgttattttaaccagtggtctacaacattttcctttcagtctactcaggagctaacagtcaaacattgtctttcatggaaagtgcaaaagatcctgcttgatatgaatgatgttcaagagtaaaagaaaattgaagctgaagaacattgtccaagaatactccacaggaaagagtgtcaggagaaaaaaatatgtggtaaacaggcacaataagaacaataaataaatccatatgataagggttctgtatccctgcaagagaagtgtataatgtggacaaccaatagaaaattgaaaggtttaaaccatagtacctttaggaatttgatctgatccagaagctaaagtggatacaaaggtaattgcattgaacactgaacatgtccaatcccatatgccactgtttcccagattagtctgggagttcatcagttcctcaaaacattcaaagaactggtcgatgctgtccaagataacaacatattagtagtgtagttatgtatattctttatttggtttaaacaaactgcttcccgtaagaaatttaaaggcaagtaacttagcaagaaaatagcttgcacaagcacccaaaaatgtttttcttttttttgcacggaaagaaaaggaggatttgtccatggtcaaccttcaagagtacatagtatataacgaagatggggagaaaagttctgtgtaatacatctggccaaacctattcatggaaatacaaatgggaggcaaatgcatttcatttcaaaaattatttatttgacaacagttctgtcaaaagtatactcttgatgaaatgtctatatgtaaaaaaggatggcagttgcaaaggtgcagtgaatatcattgaactttcatgaaaagaaaggaagatgaaaaacaaaaaggaacaaacctttcatcacaaactgaatcagggtcaccgtgatcctcatggataagcactggaatccagtccggaatcaagtatggcatagtcagggaaggctcttgtgttttttcttgcctgagttgagaaaatgtgtcctctgtcaaatgttccctgctagctatcacagaacctgaacctgattttgaagagcttgatacatatgaactggcagatctagatatgtctgcggtattatgggcataactctgttcatgtactagatttcttctttggagagaatcccacacatccatgagccattggatactgctcagttgtaaccgcaattctaatgaattaagagatatatctgcatcaagtttcttaaagttcaagccattccatgggatgcttaagttcaatttccctgagaatccaccgataggacctgtcaagaccgcggtagtgctatgacctgatgaaatgtctgctggtcctctatccaaatcatcctgaagaagtgcatgcgcatcaacatcatccatcttcaaaaactcaatgaccgcctcatggaatgtcacaaaattgtgaagtttgattataccatctgttgaaagattggttccaaattcggtctctttgattcggaaaaccagtgatcgattaaattctgggaccttgttatccaaaatgttttgaggatcaaatacaacataagagttttttaacttgatgttaaagttggtaagaaaacatgtgacagcattagctatcctctggacacctttgtcgacatctcgagatgcagaggtagaacactgattgccatcagattcatttcttttggcctggactgatttctgtgtgtcgtcagtattactaccagaaacagagcattcagtatcaccagaaggatcttcgctagaaacagatgcagcaagcacaagttccaaatcctccacgacaatctcgcaacagtcgcgcatgtttaatagtagaggaattctaactagcagggattttatcgatccttccttcatcatgatagcagatcctgacaactggaaagggaaaaaaatagaactgttttaataaagtaactggaaaacccaaaatctagtgggtttcacaagttttgcggtataagtttctattcaagtatgcaacacttgtgaatgaacaaatgtatcatattgggctaccagcagcgccatgatcctcatggatcgcaaaatgttgaacatagatgtgtctttagtggtgaattcatgcacatataagaggactactgtatgctactcaccacaacaaatcaggttagcagaaaagaacaatcacctactccagctttgatactttctgttaactttattgtattctagaagctttgcattcaacataatttacaaacattacactgtatcggattagtcccaacactccaactgaaaaaggtgaattgcaaataagctttataaccccttctccacttctcctaaaccctaatactctacctgcgatcatgagctttagccatgaaatgaacacaaataaccctgaactgtacccatacccgaggttactgattgaaaggaaaaagccttccttttttttcctgcgaacagattatttcctctgcaacaaaaaattctagaccaaaatttcaagcccacactctcatgctagcaaccaatcgagatcaaaatcatacagagttgaatccaccaagcaactaaacaggaaaattcttttttctaacaaaaacaaaaaaaaacaaaattcccatccccaaacacccaattcccatctctgccaccagaatttcaacctcgggcaaatagcacactaatcacgacgggcgggtgcatcctaatcgaacacacgggtcggggcacgagatagagagagaggggctcaccttgcggttgacgaagtcggcgttgagggcgatgtcggagaggtggagcgtgccgcgggtgagctgcaggtcgaactggtcgaggtcgaggtcccccaggatcagatccccgagccgcttcttcagcagcgacttgcacagccgcttcatcatcgtcctcacccatacccccgagaagaaattcatgtctcgccgcctcgtttgctcccaccccaacccccacccttcccaccacctcttctctagatgtaccggcgggatacgcctcgccggcggcggcggcggaaggaggaggggagggggtcgccggtgacggcggagtttgggggttggcttcgtttcgtgcgaggagggtattttttttcccttttttcggattagaccttgcgtgttgtgaatatgttgcgtcctgatccccgggaagaaggccgcgctgtgttaactttgcgtgtttttatatataagccgccgccaaggtcgagtcactgtccggtggggcctacctaaatcggaggaggacaggaaggttatttgggttgtgttgtaatgcaaacggttttttatgtttgtttgtcttcgtgatttgagtttctgtttaattagaattagaatacggttttgcgtgtgtttcaggatggagatcgatcagggctttatctatagttagggcgtatccgaccggagtgcaaagtagcatgaattatttataaataataatacctatattatgaagaataaaaatttatatttatggcaccaaatactctgataatataatatatttgaacgtaaattctataacgtgaggcctctcgatctagtcttacgcagcgacgcctggcgcggccatccgatttagtcgagaagcatcagagtttagaatttgagagaagcatcgtagtgttaggcatctatgtctttttctcccttcttataaaattttctttcaaattacttatctgatctacaatccgattacaccattgtatttgttgcaattaaatctttataataagatctcacatgattatattatgatgaaaaattacaaattacttttataatatatctaaattatttttagatttcactaaagtacttcttggacatataaaagtaaatttaataaagtctaaaagtaatttacatatattataatagaagtaacttaagacaaaaggaaagtaactttgtcataacattagaagtaaatctgttgtaaggataaaaacataactctatctagagactaaattaatcagcacaaattatggaattgactaaaaacaataataaaagtaaccacctcatagcattatgaatgtataggaagtaatttaatcaaatctaaatctaaaagtaatttatatatatgataaaagtaacttagtatataataaaagtattttacaaacataaatattttttcatcataatataatcatataagatcttgttgtataaatttaactgcaacgaacacaactgagtaatcggatcttagatcatataagtatttaaatgaggatgcatgtggcaggtgctactacttttagtaagaggggtaatgagttgatacacactgtactatttttggtaaaaaaggatggtcgctggttagcactaacgagtgcatgcgctccctgtagtcgtgtccatatttgtaatttattaatgaaaatacaaattgataaaatttaaatttgaatagtgcaagtatcaattattcgagatcaaagggagtatatattactatttggaattattatttcaacaaaattaatgataaacaataaagtatctttttaagattcggaggaattgagaggatatgcatgcataggtgcaaagtcaagggtaataaaatgttccaaactatacactataagcatgattgcaatccaaatgagacataataccgcgtaaatcattctgataaaaaaaaaacaattttgcaaaccgtcaaaaagaaaagaggcttcaagacttcaatatgttacttattactccctccattccgcattgatcatcacataagttttttcaccacgaccaagaaagatttgacttctctacattttatttcatgtgaatatgtagtggaaaaaatcaagaaatatacatagtttaactccccgctagggctgtcaatgaaccgagctcgagcgagctcgtttgcctaagctcgaactcgacacaagctcgagccgagctcaagccgagcctattgcaccttcgagcttttaggcaagctcgattcgagctcgttcgagcttgagctcggccataagtagcataatatatattttaatgataatctcttgataagtataattattttctagttaatcgcagtaataaaagagtagaaaatgactaaaataaatatattgtgctaacacatgctaatttattgtgtaaatagatactaatatatatatttatctattagtttattatatcaataaggtgagcatgcaatataaactatacacagccaagctcggttaagctcagtagaagctcgagctcggctcggtaaagctcgcgagcttttgctcatgtgctactttcaataaaaatttatcagaaaacctacaccacgacatcccgtggagacgggatcccctcctcctacctcactcctctccccaaaatcatccgaatcctctcctcctacctcactctcctcccccaaatcacacagcactgcagccctccctctccctctcccccccccctctctctctctgaagaagaccgagcggagacgaagccggccgggaggaaggggtcgtcgtcgtcatctacggcggctgatgaggacgacgacggcactgcgtcagcaaggtcggccaaccctccgcggggtcaccctcaagctcgcctcccctcg

SEQ ID NO: 45360 - DNA, 9435 bp, Oryza sativa
  unsure (1)..(9435): unsure at all n locations
ctcgccgtgcctcctggacgccatcctccgccgttgcggccctccctcccccacgtctcctcctctttttgacagtaccctttgataccccacaagtatcaggcttgataccttggtaccaaggtttgatacctaggtaccacccagtaccttaggtaccaggcatcaggtatcggttgatacctagtcggtaccaggtaccaggtaccaaccgatatctaaggtaccaggtactaggggaacacacgtccctcacctcgccatgcctcctcgacgccatcctccgccgttgcggcgctccctcccccacgtctcctcctctttttgacggtaccctctgataccccacaagtatcaggcttgataccttggtaccaaggtctgatacctaggtaccacccggtatcttgggtactgggcatcaggtatcggtcgatatctagttggtatctaaggtaccaggtactaggtaccaaccggtacctaagatagcaggtatcaagtaccaaccggtacgtaaggtaccaggtactaggggagcacacgtagacagagggaaggaaaaaggagagtcacttaaaatatttcgtaaatattccgttgcaacggtatcccgtgggctagcagccctcaattttattgatgtcacggatctattgttagcctcccattctttgagtgtatgaattcgtgaatacattctttgagtgtatctagtgtcagcgatgtactcgtgaatacagtgtacatgaataattatttatgcatggccacgccttccacataataaaaaatatcacattattgacttactcaatccatcacataggaaaaacatgagttgctatgtcatttctaaggctttccttgcactcaattccttgcagataagatttgccaaaggaaaaatattcccaggggtgtttatctaacaaagaagtattgacagggtgcaaagcaaataaaacaatcaggtcacctttttttttctctttttgtttgcaaaaggataggggctgaggtggacctggatacgaaaaaaacgtaccgtgtttgcgaaggattctccgttgtaacggagagagacgccgttacggttttttccgagacccacggtgtccctctcagcctccgctgggtggtgggcccgtcgccatgggcttgggcccacctttatccacacaccacacttacctgtcgtaagagtcgtggtcaacagctaggggacccaaagctgagccaaaattacaccgtgcatcagctgacgttggtgaaaaatttggttatttggttttgtcaggtagagataaaatcacatagagtattagtgagaacaaggtattgtgatattgtcacggcaatcatggaaagaacaagcaattgatgcttagatgtttagcctgtgttgttgtgctatatttgatttcataagcctagtcattgtgaaaacaataacttattaaattcgtaaccgttctacgtatcaaattaatgccattgatcccatccaattgtaatagttattagaaaaaaatattgaggatatagatttcatttttaagaatttgcttttatacatacataatcgtagagaattgagaaaatatacacatcccacggagcgaagacatgggtgggtcaatcggcgcggcgtgaagctgcaggaccgacaacgaggacggtggtaccgttgctcaacagcgtgataccaactccaccctgcgcctcggctgcggggcagtgggttagtcctgtggcccagcaacgcgggaccgaaggtagcaacagtcgggacggcgtaatacccaatcgattccatatcagatatagctccgcaccactaggtctacatgtcatctcaaaaccttttttttttgttcaaaatggattcaaagtttcagaaaccatgcagattgcagcatattataatcttgtttagtccggggtagtgaagttatgatgcatcatgataacatgtgctcttcacataaaaaaccacttgtagttagctatgtccaaactttttttttacggagggagtagggattagaaactcggtagagatagatgaactgagaaaatcaatatgcatcagtgtattaagattcccatcgtttcctccatacaatatcagccgctgccaaattttgaattttacaactcaattttgaagttgattttgatttttttattaaagtttatttttcagcattgttatttaaatcgttaagagcacatatataaaagtttaattacagtgctattattacttataaattattattacagtgctattatccatacttggccaaacgatggggcctgtagacccggtgctatgggaccgacccacggcgcggtacttgttgctgccctcagtctcacgtggccgggctgtgggaccaacccagtgacgctcagccaatgcgcggggtagatttcttaccgggaacagggcctatcacaagaatattttttttattgggacgataactctgaaaagagagatttcctatcttttctttcaactcaggagaaatacagtcgggcggcgctaattcggatccctcgggcaaaataagaacagcacccacattcaaccctctctttttcccattagcaagaacttgttggttggtcccgttactccatagttttgcgccacatgacgtgtatattttctcaattttcctacaatcatgtccatttttttaaaaggaaaagtatattctcaaatttctttctagttattgtgtccatactttttttaagcgtccattaactttgttaccagtaggatcggtatagctttgttttatagaccttgttaagcttttttcccttttaattgatcggtggagcttctatctcatgtttaaaaaaatggtgttcaaattttcgaggagctatcatttgtaacatgaattaaaagaaataattttgataatgaaaaaaaaatacttcctccgtttcatattacaagactttctagcattgcccacattcatatttatgttaatgaatctagacatatatgtgtgcctaaattcattaacatctatataaatatgggtaatgctagaaagtcttataatctgaaacggaggtagtagaaacaatttcacaaaacaatattagagtaatccaccataatgccaagcaaaattggcggccagtagtagcatcctcatcctagtccattcgtatggtcgtatccgatatcttctgtagagtctcatgcatagttcatgctcattgcccgaggaaaattagatagtagtaatgcataggaactgaaacatggaagttatctgtcacaatcttatgctgattactgcaatttacaagatgaagcttgcacgagattctcagccctgctttaccacaagctccagaaaatgacttgtgtccacatttataaataataggcactatcatgatggcaaaagttattaacacgaaagttattggagtaatcagttcaaccagaagcaaaagttccccttgtaccaccggatggtccagagtatccaagcaaaatgagacatccaccatcacaatttacagccaggaatatgtgatctttagcattgaatagtcaccggtgcacagtccatatgcatcaagggattcaggggcaagccagcgcataagctcaccttttgcctaccccggcaagccgccgggccaaaattatgactttttactgtccgagacaagagttgcttcaccacatatatcgacagcattttactgttgtctcgcagaaggaagaggcttcagttgtttcttcaatgtacaaaatggtgttgacagcaccttggagacatgtcaatcgatcaccttgccaccagcccatgccgtcgtaaagctatcctgcgaaaactcctgcaagtgaagcacaagtttagcaaagtaaaggatggagagaaaactggacgttttaacatgagacaatggaaacgtacaatttggctcagtcgaaattcagacgcattttcaagctcaagatttgtgccatctgaggggtccaacctctggcattcttccagatccttcttcaagtcctctactggcaactgggcataaacagcaagacggggctttatcttatcggtttcatcatctccaccgccgcatgaggtctggctctgactctgaaggaactcatcgcaaatcgcaaggttctctgccagttgctgagagtctaacaggaactgggattcaccttcccaccatttcggatcttgcgatgaggggttatctccatcctcaggtttctcagtagccatatgcgcaacatcttctacagcgttatcttcgttgtttatttcgctagtctcttttccctgtacatttgccagcaaaagaaggcacaacatttatccaattccctttaatatcattataaagaaactatattgacattttctttgctatgtcgaattacctggaaatatgtgctgcacatagggaaaaggtggaagggaaataaagaaagcttagatgttcaattacctggtcagtgatagtttcagatttctcaagaacttctagttcttggttggtaaaaacatgttcttccaggggaagtggaggaatatttggaagatcttcagcaactatagattctaaagcatctgcagaggttaagtcctgtgcgttcttctccccaggtttaaactgttgctgaaacaataatttagagacaacatactgcccttctacctcatcttccccagttcctaggtggtactgatgcatcacccaattggtcttttcaggtttaccacctttcatggtgctcatatatagcaccatgaatttcttacaaccaaggtgttttccatcaactactactggccttgtcttaccagtcttgtgccagcggacatcagcaagatcaccagtgtttatcttccggcgctttcttattccagtattataggccttaaatgttctatggaaaaagtgtgatacgcttccatcttgcttgacacctgaaaaagaaaaaaaagtcagttgaagaataccacaagcaatacaacagaggtacaaaaaacaacaattttccagttagaaactgagattcctatgtcaaaagaaagtagaatttgaatgctctatcggaaccatttaagaaatgcaaaccagtcaatgagaattacttagttgtagagtgttgctgagtggaatagtgaaaaatcaagggttaataagccaataaagagaagtaaaataagtagccttattgccacacccgcactaccgccaaactttgtgcatatggtgtgactaagaaaataaataccaaaagaaaacggaccaaaggcaagcatttgatacaagctgaaaaatgtgaattttactcttatatgaaaataaaattggacttctcttgctcaccccacgaagagagaaacaaaaatatatatcctttcactaacggttacctggaagtttctgtggatgggtatagcagataccatcatcttcctcgactgttggaataaattcatcaatgaacggatgagcttttgcaccaactttgccatgctttgcaagcaaatgccaaagcaattcttggtcagttggatcaaactttacacctcttggcaaaccaggccattgatgaacaacctgtggtgaaatattaatcattagaggactgcactcaatagcacacattatttattaatactgagtggtgtatctgaaagtatacacaaacaaagcttcgatgttagagagaaagtcagaggacttcagaataatatacaaaagagtcactgtcaaagtgataaatagtaagttgctaatagcaaaaatccattcatttattgatataggcgactcgacgaaaacaaaggtgcataacaatgacactatcagtaggtgttcacatgtagttttatttgattgtttaatctgtttagaatggtataaagcaggaatgaaatacaaatgatatactacgtgcgtatttggttcttatacatgataaaagaacacatctcttacatcactgttatcaatgatgtggttgcaccttggacaagccttagttgggttgctaacccatttgtgcttactggcatccaccgatccagatgcattttttatttttgaagcaattctatggctgtcaattatccaggatgtcctgcagaaatattgattatagagttaagacagatgaatgaagcagatttgttcaagaacactaactgcaggaactcccatatagatcggcataattaaccagcaacacaccaaatgcaggtaaaggcacatctaatatcattaaaatgatcccaaagaatgatccaattaatcctgaggagacaagtactcctaaaccacgattcaatctacaacaaaatgtagtttctcagaactgtatatctatactaataccaatcatgcaccagcttacaaaaatcaagagacattgatctccggtatggatgacaggcatatgttcaaaactatgctcttctgacacaatttgaaatgctggtcacaatgatacgtaaactaagaacaatagtcttttttcaccattttgtgaagggtactaaagtaggaatacaaggcagtgggcaacctctagctttcagagatgtatatgcatacctgatggcccaaagacaagctaacaatagtaaaattagcaaaatttcaacccaaaggctatatccaatgtctttccaacaaagatttgataaaataggtaccataccaccagaaatggcagaaaacagggagatgcctcctttcaactataatgaagtgcaaaaacgttgtacttctgctagacaatctcaaacttaactgcaaaagcataaactacaaactagtgacgatattcaatcattgccccctccaaaaaaaaaattctaaaaaacagatcccgcctttcatctgaaacagatagcgacaaaatattgttccacaatgcatgacatgatcttatcagcaggccacatataaagaaaaaaggttatctattgctacccacgactatatgaatatgaggaattcaacctcatcttggagaggtgtatacccaaatacaagctactaatagttggcacattttaactcaaaggagtagtaacaccactagtgttttttcaaactaaattgatataatggagaccgctataactagcacaaccacgctgtagaaagaagcagcagctaaactaaaacggtgcaacacctagcagaactgggtgcccttcaatcaattgcaagagaacagaatgcatacgtagtgcataactgcacccccaccacgccccccccccccccccccgaaatggcaaaaacaaaagtatctcctttgaactaaaatcaatgcagaagcgtcatccttctactatacaatcacagaccaagctacaaaagcctacaacactacaagctagtgacgaaattcagtcatcgcctgccagagaaccaaaaaaaaaaaaaagacacaacctttcgtctcacaccgaaggcatgagcacactgttccacgaatgtatgacgcggtccgaacaccgggcctcataaacaagacaatgcatctatatcaatccaaaaaaaaaacaatagagaagtctgaggatcctgcgataatctccatgttttcactgtagcacacagcaaactgtccccaatccaaatcgcattcaccaaaccgaaatgataaacaacaacaaatcagtgaggataacaggggaacgcaatcccgcgaaaccctagaacccaaaaggacgcctcctttgcatcccgcccaatcccaaatcgcattccctccgatgacctaggggaacagctcggggcaagtgctacacgatccaatcaaggagtgggggggcaggcagacgcacgcacccggtcatggcggcgcccgcgcctcccgccggcagacggagacctcccctccctactagggatccgacgagggcgaggcggcgcacctgaaggttgaagcggatggaagtagagagacgatgagtggttggtctctctaaatttttttttgaaccggagttgaccggcgatggcggcggcgaggacacaccagcacataaaccaggtgcacgcggtttatgctggcattgcttggctggaccgcgtccatggtgagatgaatcggcatccgttcgattgcattttggacggtcgagatggcatgaagtgcatgaggtgtgtccgtccccgtaagacttgagaatccgtgtggggccaaatgttgtaaacggcccatatccaagttgggccaaatcagacgattaagccccaaaagttagctcaatctttatagaagcccaggcccgatggtccaaccagcaactaaggccgtgtttaggtccaaaagttttggcgtgtgatatacagagatatatttgaagtattaaacgcatactaataacaaaataaattatagattttgtctgtaaactgcgagacgaatttattaagcctaattaatatgtcattagcaaatatttactgtagcatcatattgtcaaatcatggagcaattcggcttaaaagattcgtctcgtaatttacacgcaatttatataattaattatttttaggtttatatttaatactacatgaatgtatccgaatgtatccaaacattcgatgtgacagggtgaaaaattttggcagggatctaaacgggtcctaatgctgcatatggaaggggaaaaggcacgtgcctgaaatctagcaaatcccctgtggaaaaattggcaccggccaacgtcgtcgtcgccattaatgtgatccatggttgtattacgtggcatcatgcctctccccgccatgttggatttgcctcctcgatttgcatttgcatttgtatttcccgcctgaattttttttctgtgcccatgcgttgatgcgtacttcttaacttctatagtgcatatcttttttttaatgaattgacgagcgccaatttcattgaattgagaaggagtagctttacaaagcgaaaggaaagaaaagaagcttaggacctttggtctgagctaactaaaagaaaactaattacgaagatttttcgtttctgctaaggcccaagttttggcctcttccttgatcttggctagaagagaggtagctgaaagctccttttgttggaaggttatgcgattcctttcgttccatatcttctagccgaccaacagcatcaaagtgcggagtgccttattgggtgcctcttgtattttggcaagataacttttgcaggtgtcgttcatcaattataatcttttaggaggttttctttctctgttctctcctcgttgtattctccgtgtattctgttctcctatcctccagggcccctgcgcttgcgtaggtannnnnnnnnnnnnnnnnnnnnnnnnnnnnnnnnnnnnnnnnnnnnnnnnnnnnnnnnnn

SEQ ID NO: 45361 - DNA, 10363 bp, Oryza sativa
  unsure (1)..(10363): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcaaacagtggtatatattcatgtcacaatctaaccaaactagcaaaagcaaaagacagtacattcgtaggaagaaatttaatgtagtaacatacatgcgccccaaaggaggccttccatcttaacattcctcacagcttcttccaatttggtcatgtcagtctcatcgtcccatggtttgacatcaagcaacactgaggacttcccagctgaataaaaaggtgttgacaagttagaagtagcactttgcattataatgaatagtgatgatttggtcttaatttacagctacagatgagaataaaataaaatgaataattgtattattcattgcataaaaatggtatagtataatgcaggatggcatacattccttcttcttgccagaagccttgacagcagcagcacgctcctcagctgccttcttctcctcttcagtctcctcaccaaaaaggtcaacatcgtcatcatcgtcatcatcagctgcaggagcctgaaattagaagatatgatgatatattagagatggtaaccagcaccattgaaccacaaaaacgtaatttgcaaacagcatcaaatcacaattcacagtactatgctagaacacttcacagatttcaggcaaacaagacaaggctagggttgtatgacctttgcatcagcaacatcaggggttgaagctgaaggaacagctgtcgactcgacctttacgccttgaccatcagcagtaactccactgaaatacaacattcagaaaattcacaacactgaacataaaatgtaagagaataaaaaaaggggaaaaatgcatacctcagacgtaggagtgcatcaatgtgagtaaaccacctagcaacattggtatagcttgaagagggcgcagttgaaaatgcagagtacacagccaagtcatcgttggaggcttggtacctggaaacagataattgaagggtttaagtccagtgaacataaatggcaattcagaaaataaggtggacagtggacactgatcatatacccagagatgtagctgcgagtgagaaggtactcatcgagctttttgaggcctgcctctgagctaacgttggtgaaagaaaccgccatctccccctcaagaaaaaagactgaaagtgacctgttggcacatagagaattgtttcaatcaaccaaaagagctaattcacaataaccaatgcatggtacaatttacaaccatagatgttacttaagttgtacatcagtactgaatctaaacctttcatttgtttctcaagtttcatatcttaactaaaagttgaaacatgacagcatttcacacattggacttcatacccaactaataactaggcattcagaaataaaagcttctagtgcattgaactacataaacaactacacaattgaacaccgcatccggatgctatggaagagcaccagcaaatcaaaaacaacactcctatatccactacagcagtacagctatgcatctcttcactaatagtatacaaatctaagcacaggaactccaataacttaaaactttgcttcaaggttcaaacagcactaactcatcatgatttcaagaaccaggagaccacgaacagcatgtatccactaaggccagcagcttccccactcacactaccctagatttcaaaaaatctagctacaaaatcacagacgaaccaatccccccaaacctaatcgccacaccattcgacggaaaactaactaacacaaggtgaatccatcagagctaaacaggtcaacaaacaccggaaatctcgcgcacggctccaccaaacagaacaacagaacggcgccaaatcggcgagatgcctgacgaggcgacgaactatccgggggagggacgagggggagcttgcggcggcgaggcttaccggattggatcggcggcgaggggaggaggaggagaggcagcggcggcggctgctggcgacggcgcggtgtaggagcggcgagacgcagcggggggcgagcgaatatatattgagggtttgtgtggctggtctcagccgtcggatcggatccaacggtgagggggattccttctcggggacgggatctgatgggccgtcgtattgcatctggattgatgggccgtcctattggcatctggattattgggccgaatctgattcgtatgcttgaatcgcagtaccggatatctcgactctccaactattaaaccctaagccctaaactgtcggagatatgggcccgggggtatgcgaagtgaggggaatctacctttccatcctaccacgtgtccctacagcatggtcctgtccccgcattccacgaaccgcaggagcggccggggtgtcggggcctcggggtgccacgtcatgcccctcgggcccttgcactgctttgccccgaggccctcgcccagccgccgtttggcggggggagcaagcgaggaggggccccaggctgaacttcctttaatccgcacagcgcctcaactgccccatgtcacatttaatgcagtggggcagacgtgcggcgtgctaaactgacgcgcgatggtcaagaatgaccggtctgtgaccggcctgacgccggtcacgtctgactggatggacaaccgtgctcccacgtcacatctgcttccggtggagtggaggtaggtatggcccgtcccgtcggggggtcattcggacggcggccaccacaagtcttcacctattaatgagggaatgacagggctgtcccccgtgtcaggcgagggacggtgctgggccccgctcaaggacaagctatggtttagcttccaggcgaaggcacgggtcgagttccagtcaagatatggtgggtcccctcccgaaaaaagagtaggtagaagcggtgcatgtggtatccccttgaggtataaaaggaggaccttacccaccgagaaagaggacgactctcagaaaacctgagcttgtggaggagggaagtaagagtgttctcccgagtttaggaaccattgtaactctcagtctaaatcccatacacaggagtagggtattacgcttcatagcggcccgaacctgtataatttggttgtgtgcgagctagctaggagccttggggacggatacgcgatttctagaggcgagcttcttccccggccgaactcacgaaaggggggtctcacgatctcctgctagagaggatcactcctcgacagacgcttacaacaccgccacgtatgctccatgatagtgaacagtcctccaaaaccgttgagggagacaaattacaccagttttaatagttgggggtcaaaatatccgctattacggtttaaagatacaaattaggttaagacactagttaagggagtcaaagtagacatattccattttcaattgggtgttgtttcaaattaggtccaattggagggggaaaatggttttgtttgctaggctattgctttctcccctatgttttgaacttcagtttccattttaaaatgcatgtaaaaacaaggtcaaaattcatgtcaagcttgaacttgaccttttttttttgaaattgaacatttgaaaaatcacgtaaaaaaacagaggcaaaatagttgggctgttttgaattaggcccggttgaaggcgaaaagtttttttcctttttgaaacttttcccattttcgttcggtcattgaacatcggtttatatagttatatgggaaaatcctccatttttaaaataaaattacagtaaataatgacaacagggtaatcaacagtaaaatatggttatttgtcgacacccttcaccatgtcatctgttagatcgatacttaaatacccttatataatacttctattttagaccgttgatttttttttatttttgaaataaaaacaccagtaaaacttctcctaattataatactcacgcttatttataactactccaattgatctcttgtcactcgatcggatgcgtaaaggtcatgaagcttagacgagacgatcacttaattctgaaagcaaaaacaaggtaaggtaattattgattaaactaattaggcgtgtgctggtggttaggttgtgagccaaacggggcatgcagtacacacggtcatgtggtttcctgcccaactggtgtgagtttctgtcttgctgtgcgacttgttgcaggcttgcgatgagtaccttttgaccttttccttttgttttggacttttttggttgattattaggattaggatgatttttggctgcagatatttgctagtggacttatgcatgtcaaatgcatgcaaaagtcactagctaacttggtttatgcctgaatatcttattcttaattagctcagtcagcacatctgcaatatcccttttttttcttcttcaatgatcacgtttatgggaaaaaaatattgtaccttatgctacaaatcaagaactcagggcagtggtaccggtagaaatataacaacgcgtagcaaatacaggctatatgttttttttaagacaacaggctatatgttagctacaagtaaatgtcaagaagagataagcgtagagaggagaaaaacgagctatagatatagtcagctgtgacacacggatttcaatatatcatgtatttacgtgtgtatgcgaggtgatcaaatattgatagtaaaatatatatttataaatttattatatgactaagctattagagtgaatgtagataactactccctccatcctaaaatataagcatttttttttactctaacacggtctctgagatgctattttaaccaacaatatctataaaagtaagatgttttaaataaaaaaagttaaatattatgatagtttttctaatgataaatctactaatatcaattttacatgattgatttttttttatttttttgctgttaatagttaaaattaaaaacatttgactcgtcactatgctaagaatgtttatattttgggacggaggagtattagatttgttcttattgcggtaattaacatcgtcgttgacttgacatgaccaagaaagtgatggtgtaagtgtaatcaggagaggacacacacgtggctttcaaaccgctaaaaccccagtggcacgtcactaaaacctcaacttcagctctggcattacaagctcacggtcatcccttagtccacaagtaaaactgccactaaacaaagcaagaggaattaaggaaacttgtcacaatatcactgctcttctcaaacccctaggtcttctccacccaggagcgatgtttatctgctcaaggtaccaaacatttgcccacataacccttgtaatgttgagctacaacctatattaccacttcggttttaggttagaaaatcgttttaaaacaataggcgttttggtcatggttcttttttctccttagtccgataatatcataactatgtgtattcttacttgatttagagaatgatatttccctcgaaatctttgtttaaaacgcgtgatcaaacgatccccgtgtcacttcatattgcatagtgctcaacgaaatggagccaatcatgcaccaagataatctcaatgctaaatcttgctcatatttgttccctctcatttgtcatttttgtcatgcatgtctgcctaattccatcatggttttgtcactgttccattattattgcaatggattctctgtatttttttctttttcttttcctctgtagtttagggtgtggacctaacaaaattcatggctgcctcccaacgtcaaagtcgtctcttccgttctccctccacttctcgggatccctccacctctcgtatttctactccacgccgccgccgatgctgccgcggcggcggtggtggtagcagcagtctcccgtctccggcgatgtcagtgatgccttcgataaggcggctcctcctcgccggcgcggcggtggcggtggtggtcgtttcttgcgccgtcgtttgtgcggaggcgtcggtgcatgagtacgccggcgagaggttcgccggcgtcggcaatggcttcgtgctgcacggcggcagcgagggtgtctacgcgtcggccacggcggagtcgttcgtccggtacggtggccggagctggttgtgggtgccaagtgtcattgcttcgttgtttgaattggttcttgggatgtgacgcgctcgccatgggggggtttcttggtgcagattcgagaaggtggcgttcaggaggacgccggaggcggcgtcggtggcggaggaggacggcaaccggacggtcacggtggcggcggtcatcttcgaggccggcgaccgcgacgccgtcggggcggtgtccgacgtcgtcggcggcgagcgcgcgctgtgctgcacgccgggcatggcgaggcgaggcgggtgcacggagggggcggtcgtgtaccgcgcccccgcgtcgtcgaacgccaccggccgctggcccaaggtgctcgccgcgtcgttcctcccgggcagcctcgtcgcggcgttccccgacgagaccgtcgccgtggcgcgcaccgggatgtacagcctccacttcgtccactgcgacgcgtcgctcgccgccgggcaggtggtggccgcggaggggaagaccatctggaagaacagccgcggctacctcccggggaggatggcgccgctcaagccgttttacggcgccatgtcgctggcgttcgccgcgctcgccgcgctctggttcgcccggtacgcgaggttctggcgcgaggtgtcgccgctgcagaacttcgcgacggcggccatcgcgctgggcatggtggaggtcaccacctggtacctcgacctcgccgagttcgacgcgtcgggcgtccggccggcggggacgacgttctgggcggcgacgtcgggcgccgtgcgcgccgcggcgtgccgcgtgctggcgctgctcgtggccatggggtacggcgtgacgaggcccgcactgggctgcggcaacgccagggtggccgccctcggcgccgcgttcctcgccgcggcggaggtgctcgacgtcggcgacaacgtcggcatcgtcagtgaccactcgccggcgaggaggctcttcttcattctccccgtcgccgccctcaacacggtgttcatctactggatcttcacctcgctgtcaagaactatcagcaagctcaaggtagcatcatttgaacttcccactttcaaaattctaccaaaattcgaataattcttcgagaatcatcaatgaattctgtgattaatctgattcttgcaggcgaggaggatgacggcgaagcttgaaatgtatcggaaattcgcgaattctctcaccatcgccgtggccctgtcgctcggctggatcacatttgaggtataacttcgctgcagtcctagctgttttctgatggctcagcaacttcagagaactgaggatccagggacttaactttatatttaatactaatttagagtattaaatatagtcttcttacaaatctaattacataaatgaaagttaattcgtgagacaaattttttaagcttaattaatctataattagataatgtttactgtagcatcacatgggctaatcatggattaattaggctcaatagattcgtctcgcgaattagtccaagattatggatgggttttattaatagtctacgtttaatatttattattagtgtccaaaaacatttgatgtgatagggatttaaaagttttagtctcatctaaacagggcctgaacatttcagcatttgtttttgctctcataaatgactaatcattttcttaggccctgtttcaactcatttatttaaacttccaacttttccgtcacatcaaactttcctacacacataaactttcaacttttccgttacatcattctaatttctttaaacttccaattttgcgtggaactaaacacaaccttagttgttttcgtccacattactggtgacttttatcgtcatgacactaactgttcatgtggtacattagtacaagctcgtaaattaattaacataagaagacttttagcacttcaaaataatgtatgaaaaaaattctaaaatcaaaattcaggtccattttaagacgactgatgagcacaacgagcggtggcgagtggcgtgggtaatccccgcggtgtgggagctcatctccttcttcctcctctgcaccatctgcatcctatggacgccctcacaaaattcaatgaggtacatgctactactgctcaccattactacagcccatcatcttatatcaatatgaacaaaagtttaccgactcgtgggtgtgtgcgtgtggtgtgtcaagcaggttcgcctactcgagggaggagtgtgaggatgacacggagcacaatgacgaggacgatgacgtggaggacacgcggccgctgatcagggccgggccgctgtcctacgtggacaactgggcgtgctacgtcacgcaggacgccaagatcatactgaggacggactctggcgtgtacgctaaagccggcgaagagtacaaacgggtgtgagcctgtgaggaggaggagcgtgctagcagatatgggacagaaaatgtctaagtgattaagaaggagttgattagtttaaacactggtaggtacactgtcaagtgtcaactgagtacttcaattaggggcactgtttgttaaaaaaagagagatgaaagaggagtattagagggagggacgtatgatcgctaggaggagagggaaacgattacccgcccactaacagcccctaggaaaaagggtcattctaaaagctttattatattaatcaaagaacttaattgtttgtatcatctttcctcatatatctatccttcaaaccgtcaaaatgacgagttcaaaaacttttctattacatcataaatttcaaaaaaaagtaaaagacaattagaatctaatactctcattcatgtgcatagactttataccataaattttgcacgtataaactttgtgtatagaaatatttttatataaaatatttgaatctgaattcgaatttgaatcgggtatataaacttttgacttatacacattcgctctacaaactttaggtggataaagtttagatgtgtaaactttaggtataaacttactaaaaagaggaaaagaaaaaaaaaacgatcgctggcagcgatcgatcgcccgttagcctttcggccttttccctatgttttcatttgtgtatgaaattgataactaccctgccaatgcacagcttcaaaattgcaagtaaccgaaactgtgcacttgccaatgaaaactgaaattgctaagtagtatatttgaattgacaacacttcaaattaagattaatgaacaataactgacagctgaaatttctatgcgaattttctttgacgtgctaacacttgaaattgatttggttggggtgcgccaggcttaggctgtagtgcaacgcctaaacgacgcttgagggacctagtggcaagccactattgtgagccctcccccataaaaaataaatttaatatcaaagtgggcacatggtccacatatcagatattaaactgataagaacagatactacacttgatcttagccaaaaggccgagaaaggtatgagttgttgcgtgatactaaccctggtattatagctctcctgatgctcctttctctgaaaactgacggtgtggtactaaacagagcactgcacctggtctgttacttgggctaattgtcttgcaatcataactctccagaggcccaaaaaagacacaggggcccatgtagatgcccttccaggcccaaaccacgggaaggccgaggtaaagccttccatgaatttttttcatttttaaatgtttcttttaaaatatttacagaaataatctatcgttggaaaaatttacaaaaatagaccctactactctagtgaagggcggcaaattgacgtggcagatggcagctcgatgacggccgattgaaaaagttgaattttttgcattaacacccttgccgcgcactgccagggcggcaaggggcctccatgcaaaaaagccaacccaggaagggccatatcaacagagttggaaagaagcatttgacttgatttttttttgcatctag

SEQ ID NO: 45362 - DNA, 18036 bp, Oryza sativa
tagatgcaaaaaaaactagccaaatgcttcttttcagctgggcaaattgcattacgccccttgccgccaccaaagcgcaaaatgtgcacacggcgccgtcgagccgtcgtttgccacgtcagcctgccgccctccgctagggcggcagggtctattttttaaatttttgtaacaatagattatttctgtaaatattttaaaaaaaaattaaaaatgaaaaaaattcagccttccatgaccatgtaaatgtttggctcaacttttttttctcactcttaaaagccgaagcagtttttaaattttgaaatttggattttgatattaggtccttttttttacatatccttttagcaatcacgaaaagcgtgaacgctgttcaacgaaagtgacaagaaaaagggccaaaacgaacacaaaaccaaattcaaaatttcaaaatcagctgcaaacctgcaagctctccctaccaaattcaaaattcaaaggagtatgtccctttctcaaaagctgtttcagtctgtattccgtaaccagttcttgcctgcctccatgaagcgaggagatatttcagtgaggaattgaacgagacaccggcgacgctgcccaactcctcactgacatcggcaaagtctatttatttcttactccatctctttcagagagtgtgtgatcttgcagaagcaacttggcatcaaaagatcaacccacatttgttttctggagaccaggcattttttgaggaatatcccaagtgttaattctttgataaatacgccggcttttcgttggagttatctgcccatgccaagaatattcctgccatcttccttccggttatcctgagaagatgggagaatggctgaatggaagtgtagagacttcatttgtcaatgaagttaggccgagttcgtttgcggttgttcctaacctccacttccttatttcccgcgaacacgcttttcagtttccaaactgttaaacgatgcaattttataaactttttatatgtaatatttaccttaaaaatcatattaaccatttttataaaaaggttatttcctccgtcccgaaagtagctaccttatgtgacactacctagtactgtgaatctggacagccgtactatctagtactacgaatctgaacatgagaggtagtgtcacacccgtactagctacattttggattgtccagattcgtagtactagttagtgttgcataacgtactaggtagctacattttgtaaccgaggaagtagctaatattgtcactccgtttttcgcgtatgggattacttcccaaaccacaccaaaacacacagcttcagtgggaaagttgggggcatattattatatcttccaattgacatccgtctgtttgacggttcaccgtagacaaactaaaactttgccatccctcttatgccactatgtacctactttgcagctactcattttgttcaataaaaattaatttagtattggatatgacattcgttatattataatatatcacatccagtttagattttttttttttgacggagtgagtaactcctgtagtacatgtgaggtatatccgtccgggccaagagaatcatcctgcatagctttcgatttgaattttgacaattggcatgcctgcctattattgtaaccgtttttaacatgaagaatttctacgctgcgttgtgtcaccgagcactaatttgcaggtgaggatcgctgcgaacagttgaggttgactcgttgcatgatctgaagattatgaaataggagtatatatcacggccactcgagcgtatcaaatcacaaatgattttttgttcaacgcttcgccgccgcagcgacatcgtccatgtggttttcttcttttttttttgtatttcttttttttctctctttgacgcctaactctgtcaaactgcccctaacccaataacattcgaaaacaagaggaaaattcgtattacatttgaatatttgaaagccaaaacacgtatgaattcgtctgtatgtatgttaactcgcatttttacattatttagccgctcctatttaagaagcagcaaaaaaaaaaagaaaaagaaaaaagatcaagaagataattaagcaaatttaattacagatttcgcagcgcagaatttcccggcaaagcctccgccgcggccgacgaggacgaagaggcggtggtcattggatggggatgggggacggcggctggaaggagcggagccagtcggagtccggcagggtgagcggcggcagcgagtggcgcccgtgggtggagctgccgcgccgcacgtcctccatggtgagcagcgccgccacggtgttccggaatatcccgtgctccgccgccgcggcgagcgcctcgggcgccgcctccgccggcagcaccgccgcctccgccatcatcgcctcgcactcccgcaccatccgcgacaccgtctccgtcttgaagaagtgccgccgctcccgcaccgcctccgccaccggcgccgccagcgcgccgccggtgcgcttgtcgtgcttcttgaggatcttgcccaccccgatgtagttgatgctgctgtagctcagcagcagcaccatctcgccgtggaagtccacgatctcccgccggattccggccacctccgccgccgcctccgccgccttcttgatcgcctcctgcaactcctgcaaccaagaaggcaagaacccatttcgccatcagaaaacttatctaaattcacaaacgaattgaagcgaattggtgtacgtgccctatggcggatgacgaactcctcctcctgctcgaggaagaaggagtcgatcttgtcgatgtcggcggcgagggcggcgacgaaggcggcctcgtcggccggcgagccggagatggaggcgacgatgcgcttcagctccttgtagctcacgaacttgtccctccactccgggaggctctgctcgatctgcctcttgagcagcttcccaaacttcatctctgcaactgatcactgatcaatacctacagataactgattaatcttgtagcaagaacagcattggttagctaaatctgtgtttggtggatttgtgcgtggtgagtgctcgtgatataagagcagagtttcgtggaatatttaccagcatatgccaagcgtggtgactggcgtgattgcccaaaacgtgctatggacaccccgtggatctatttgcgcgtcgggtgtcacgttttaagtttgtggttttattatacatgcgtatgatttgtagcatggatttgagatagagtaatattattacaatatagatcgagttctctctctctttccttttttttttgaaaataccgagggttatttgtcatcacgtaatcttataatttataatttcaggtaacatattgttccatcatgaaatttcataaaaaaacctatctttattcgtgcacaattgttgcataataaatataccatatatgaaaatatctagacccaaagtattgaatgaaattccatcttataagaacatcaaatggaattaactccttgtatttgccccaattttcttgtttgaatataaagttttcttgaacttgacaaaaatcttgataaaagtagttccagatcattagggttaaaagtagttccagatcattagggtttctgtgtatggttttatttggtgtgttttaactttagcagcacctccaaactccaaagtagagtaagaatgtcgcaataggcaggatggctagtgtggatttagtgatttttggtaaaaggtgtgacatggggggtccctagagcacggatagagaaagagtggtgactaaaattctaagcatacaagaagcatattctaggcgtatagccaaaaccatgggtggctagtgacttttgctcccacactgcttctaggttttgtagagcatcagatgaaagggatatgattccttggggatcttcttgaagttacactgctagttcagcatgtttggaggcagaggctaccccacatggtcactcgtttttggcaaagcgagcctcaccatagaaaattcttggtacatctaaattgcggtttgtagtattacattattattttcgatttatagcatcactccaaggaaaaaaaatactcgaagcacaagttgaaggaatatatatattatagattttatgtctttttcaagaattacaataacgatgaagaactatatatatggagatagttccaaattatgtgtgacaaaggttgatggttgctccaagaaaaggaacaagtataggatattttgtgaattatgctttgttggcaattttattatcttgggccataagttatatttgcctattcgagattccttcacttttgagaaattttgccgctggaaaaagaaaaaaaccaagaaaaataaattttaaaatatatatcttagaagtatgaagattatatgtataaattaatcttaaaaactatttaaataaaataatatatttattgatatttctatatacattataactgggaatagtggtcgaagttatttttcaataccatgttctcgttcaaaacgataattatataagctataggatattattaatatttctttcttggaaatgacctctcagcattgaaatggcaactagcggccagggaagaaaggtacaaaattgcaaagtcatatcatggaaccttgcatcacatcagcaaatcatcccaaaaagaacagagcacacaaacatgcaggaccattcttttgacatcaatatttcttttctttttggctatattcttccccgtataaaagggtggctgttagggctaatgagttctcagttcatagtttattcagagcatatccacagaaaatattgcttttgatgtatatatagtgatgtgttctcttgtttgcctttttttacgtcattgctttagtggagtcatgtactacttatttatagtggctggaaggatagctggttaactcaagtagcatgtgttctttttccctgaaaaaaataaagttagccatccataagcctgagtaaaggagcaaatgataagaccagaagcaattttaagatagcggcaacatttgctagggcaatttatactactacatcttaaaaagtgcatctttttagatggtcttaataaatataggcaaaatttgctagaagacactcagaaaacgtgcaattagctatgggacaccacaaagacatgaatttgctataggatatcgcaaaagagtggtaattagctactagacaccgaaggtattattttattattttcaaacaacatggagagagaaatgatcgaaaaagaccagattgccctcacgcacgtggcgcggacgcacgccttgccgtcatgcaacgccgctccagctccatctgccccgccttgctgcgcggggggagggggccggctggagagtcgcggtggcctgtcggcaccaggggcgaggcggtacagtcggtgctacgagcggtggagtgggcgagtgcccatggtgagcggccaacgtcacgagtggccggcgctgacgtcgtgagtggtcggcgctgtaagcggctggggcgctggacatggcaacgtggccggatgcgacgggcacgggtgcagctgggaactgttgcgcgattaggggggtgtttgggaactagggactaaatttagtccctctcacaaaaacataagtctctaccgggaataaagtttagcctagccccactttagtccctccaactaaataccacctagatacgatgggttcacgcgttgtgggggccgggcaacggcgccattcgactatgcggtggcggcgtgcggcgacgcccatcagcgccttttcctttttttttttccatttcttcctccttttcatggttccttgccatgtgcggcggtggagcaatgaggaatggtcggacggcgccggcatgaccgtgcgacgacgagggcagaggcacggcgtgagcgacggtagtgcgtgccaaggcgcgcgtgtgagcgccgcggtctcggtgtgggctgcccggcggcagccgtatgccgtggtggcgtggcacggcacggcgtgctgttcgccggcggccacgcgatggctacaggttgctcttccttttttttttctcttgtcttcttcttctatttcttatctctttctctccttgtttagtccggtcatggcgtggcagctcgctggcatggggcagcggcatcagtgggactccagaacaagcaaaacgacacaggggtattttggtactttcaacactctctctctccgtttttataggaaataataaaataatacctccggtgtctagtagctaattatcacttttttgcggtgttctatagccaattcacgtttttacggtgtcccacagctaattacacgttttttaagagtcccgtagcaaattttgccataaatatatactccctctggacagaaatatacgtcgtttcagacaactcaattaaactacactcagtgcaaattgcttctcggaaacgacgagtaatgttgactagagaaagtatatttggacttgcagttaggcgtatatactaaatgttttaaattctccattttcttctccctaagattattttttatagggcactaagattttatttgaaagattgtcaatgttgacaaatgacgagctagtttgtataccctgctagtgccaaaacttagataaattttggtaccaccaatttttttttctgaggtagagttgcctttttaatgtcaacttagagcaaagctttgagtggaatctagaaattttaaattggacattggtaatgccaatgatataaaccaccgtatgcactattccaaataccaaaatatatctagaaaactatttaaatattggtagagtatgttttggcattaatctaaaatggcctgacaaacttggctaggatgtattccctccgtcccaaatccaaaaaaacctaacctagaaagggagtaggatctaacatctcacgcaagtaaaccgaagtaactcattagcgcacgattaaacatctcattcatcgtttctctgtcttttcttttttgttttgcaacatcgcttttagcatttttatctgtagactgcaacgtcccaaactccaatcccgtcaatgggacgtgaatgcctgcaagatcaaaaatcaagactagttaattgattaattaattaactagcatggtggcccgtgcagattgcgcagctagtattattatattttctctcgtataatagtatatatatgttttttttctcaatttattattaaaatatattaaaatgacaacataattttaaattttgtactacctttaccaaactaccaatgtgtaatactcatactgtattttatatatgtgatacttatttaagtattatctttttttcgaaaaaatagattaatatgatttttttaaaacaatttttgtgtagaaactttttataaaaaacacaccattcagcagtttggcgtgaaaaaaaagataggtgggttggaaaagtgagactcaacctgggggttgctagtctcgcgcgcgcgccagctactcccagcccaaggcccattagcctatttgttcttttttcgtgatttatttttcctttttcttttgcgattttttttcgctttttttcccgttttttctgattactttttttaatctttagcacacttatttttttaaatgttttgatttgaaagtttttaaatcttaacttgaaaatttttaaatctgatttgaaagtattcaaatctcgagttgaaagttttcgaatctggatcgaaagtttttgaatcggagtcgaaagttttcaaatatcaagttgaaagtttttaaatctgagtcgaaagctttcatattttttcaaatcttaacttaaaaattttcaaatctgtacttgaaagttttcaaatctcgagttgaaagttttcaaatatgagttgaaagtttttaaatctgagttgaaagttttcaaaatttgtcttacacatttaaatttcgagttaaaaattttcaaattgagttttgaaagtttttaaaatttggcttcaaaaattttcaaatctaacttgaaagttttcagtcaggtagtagaaaaaatcttccgggaaaaaggaaatcgtatcttaattatcgtcattatctactaataacttagttagttaggctaaactatccggaacgctcaaccgccaacgggcacgcgcgttagcttttcccactcagcctaccctacttgaactgatgagctttggtacggtcggacgggccgcacgacggtatgggctggatgttccgtaaaccgaagcccatatttgaggcccactaactcagtacacccgaagaggagcccatccgatcttctgagccgcgcaatccggcccacccatggaaagcagatacggcccaaccacatccttaaaccccaggagctgcacggccatcgcctctcgctcttccccgcctccccgccgccgccgccgccgtggatccctccgcccaccgccggcgagcccttccgccgccgcctcaccctagcgctgctcccgtgggacggactgcggtccgccacttcctcggcgtgctcctcctccagctcacctcagtgtcgtccctcccggtaagctccccatggcctcgccgctgtgcccgcccaccccctgcccctctcatccagctcgcgcccggagactcggagagtggacggctgcttcgtcggtgagcgatgaccgggctctcgttcgcgggagctcactgaccaggggattctctggaacacacaaacttttattatttctttttttaaattatttctttgcttcaagtgagagcttgactggtattgttatagcgatatgattttgtgtttttgttctctttgcaggagatttgattcaaatttgtaaacctgggcgaattctttctcggaggcctggtccatgaagtgtaatttctgtgtaggatcttcttcctgctcatatcctgtcaatgtaaggaggggattgggcgtcccttgtctatgcacagggcagtgccagggttcctgcgtcgagccctcataaccagaaaccacccacaggcgtcgcgatttacttcactggcttgttgcttgaacaacctggatcatcaagagcccactcagagtaccatttctggtgattatagacgtcagtgccttcttcccttgatcacactagcagtgcggacttcaaactgggacggcgcaagaaagataagcttcagggagtgtgagaggttatatggcctttcccagtcaattgggttgtttgcattgcttatacagtcattcttgcctcggagagtcatagaggtccggtgcttgattcagagcattgtcaattactgtggaaatgctggtccggagttgtttgagttggcacttatgctggtgaacaatttgggtggatcgataacattgcttcaagtttatgctgcgctcatacgggtttttatagagttgtcaatgtttgaggatgctcttgtcacctacatcgaggccaagaagattggagttgagcttcagctttgcaacttcttgctgaagtccttagtcaagaggaatcagttcatgtatgcgaggagtttgtttgatgatatgaagagcactggtccctcaccaaatgtctactcttattcagttttgatgagtatgtatacacatggtgataaaccatgtttggaggaagcttttgatcttctttgtgaaatgaaaatcagaggcgtgaagccgactgcggcaacctacggaacctacctttatggactttgccgtgccaaacaagtcgaatctgcatgggactttcttcaagtgcttcggcagagaggctacccttgcaacagctattgttttaatgcagtgattcatggtttctgtaacgataatcaggttcacaaagccatggaggtatttgatgagatgaagaaaggtggggttgtcccagatgtccatagctacagcatattagttgatgcgctttgcaaacaaggtgctctatcattaggctctaatttgcttgatgaaatggaaagaaacagagtcagtcctactcttgtcatttacagttcacttctgcatggtctttgcaaagctggaaaagttgaggaggcccttgaacttttcgaacgtctcaaatatcaaggtttcaagcatgaccaaattacttacagcattgttcttcatggttgttgccgacatatggatatagaggttgcctatggtctttggattgacatggttaaccataattttgttccagatgtttacaattacactagtcttatatatgcattttgtagacatagataccttaaagaagcattggggttatttgaactaatgcttgacaacaagataaaccccaatatcattacatgcactattctagttgacggcttcatgaaagaagggctgattagtgaagcctttcttttcttggatgaagtacgccaatttgacattgtccccaacctttacacatacaaagttatcatcaatggcctcttcaagggtaacgaatctgatgatttgtggggattctttggggacatgataaaaaggggatatattcccgatgttgtcctatacagtattattattgatggctttgtgaaagctttggatttgcaggaggctttcaggttgtatcataaaatgttggatgaggggacgatgccaaatatctttacatatactagcctcataaatgggttgtgccatgatgatagactccctgaaatgacgccactgttaaagaatatgattttggaggggtgacacccgacagaattatgtacacttctctcattgcatgctattgtaagcgttcaaacatgaaaaaagctatggaaattttcagagagatgaaaaatgggggtatatcgccagatacttttgtttatacatgtttaattggtggctacaccaaagttcgtgctatggattttgcggagttgttgatggaagaaatggaaactaaagggcttacacctaccgtagtaacttatacagatctaataattggatacttaaaaacaggagatgagaaaagtgcctataggacatatcataatatgattcagagaggtattacaccagatgccaagctgagctgcatattggaccttggcaatgatgcagatgttgataattctccaaaagagaaggatgtatcttagctatttccattgagatctacaaattgttcaagggatatcttttaaagggattaacccacatactgtggattgattattaggtctatttatttctctactatggactgtggagataagaaatgggcaagacatgacagttttatccataaacagcacctggggagctcagttgagctcattcagggatttcaggcggatttggtctaagcttccccgtactctccggcgcctgcagtttcatgtgtctatggctgctgctgggtgaccaaggtgggtggttctacgagtaaatttctttggatgcctaaagatgtaaaatcccaaaacatgtatgcagttacataaccacttcttctgtagattcatctgactctatgtgatgatactgcaatagagaaaatgttagcttgcgattccttccattggttaattatgctgttcgtccttcatgcattgatatatggtttctcaaattaatcttcaattgaatatatccattaaaattgcagctgacaaattagtgacagcatattaacacattagtaacttatatgtcattgttgattcccattttgcgctgtatttgttgtttatcatatttttctttgtcaatcggcactttatttgctgttgaaggcttgaagtgttgatggtctaggttatatagtgcatccattacattcagacagttgtgccttttgatttctctgtaggtggaatggtggtgccttttggcttcttcaggagtcaagattgcagggttcagatccaattgtgattaggcttgatgcttctactgttaacgctgttcttgctgatcttttctcctctgttgacacattaactaaaagtaggtgctactgtttagttttgctcgatgcttccatcctatgtaatgcaagtggtacatgcggtaataaaacctctttggtctttcttgtttcccttttgcaggtccaccattgacccatgaagaggaagatgatttgggttagacaaatataaatgggtatgactataaacaaaaaggtactcagccacattaaccagttttctgttgtgtcaattcttgttctgcttgatttggtcatacaatgttgggacttgagatatgtaatatttgttccgattttagagttttatccttgcatgacattgcaatactgattcttgtgcaggtgatacatatctcttattcccttggcatgttagattgatattattggggtcttaattagtcgaggccaatttacactaattgaatgactggaataatgttcctggaattgtttagctgtcgtattttctcatatacttggtgtatatctgttttcaacttacaactgaatgctgtctgctccttaactgtcaacaagttgaatcctggaaactgttagaaagaaaattttaacctccattcagaagtagccatagattaagtacacatgatgctccgtttttttttcaatctaatgaagtggactttaacctctaagcttagtctgactcatttatgtacatctctattctgttcactggttttacctgacacttttttatcgcaaatccagtgttctttcattggcgatgatttcctgatcaacaccattggaccagctggtaaagagaaggtactgggcaatctctatgacggcacaccagtaagaatggtttcatattgcagtctccatttgtaagtgttttcgatctatctgcttgatgtactaggaaaactaatcggttttcttttattttgttatgcaggtgatgatctcgactagtctattgctattcttctacctgatcatccaactgagatggtaagttttcacgtgtacacttgttccagaccagccatctgtgatttcttttgccagcacgtactagataatctgtagtataatttaaacttatttgccaacagaatattgttcttttaatccaaaggaatatttagccaacccgattctggaagcaagatgttttccagtttgttacgatttaactgaaccttggaagatgaattttgtttgtgcacttgatgtcagatatgctggaggtagcttcattgtcttagggcccgtttagttccccaaaattttttcccaaaaacatcatatcgaatctttggacacatgcatgaagcattaaatatagataaaaagaaaaactaattgcacagttatgggggaaatcgcgagacgaatcttttaagcctaattagtccgtgattagccataagtgctacagtaacccacatgtgctaatgatggcttaattagtctcaaaagattcgtctcgcggtttctaggcgagttctgaaattagttttttcattcgtgtccgaaaaccccttacgacatccggtcaaacttccgatgtgacacccaaaaatttccttttctccaactaaacacacccttagttttgaggttttctccaaaatgctgccatgcttctatttcatttatatttattgcagtatgtttcttgtgttttgtgataatctgctttgtgaggcacatgaagctggagatatctgtcaaaaatgggttatgatcgacaggttcttcagcttatcctgaactattgcctgctactttacaggctgatgaagagaggcggcggcgctccggcaagcctcccaagattgtcaagcaccggcatcctcgacttatcgacgtgatggaatgaaatcgcccgttctgtgtagcagcagcattagcagtgagccagatcgagaagcagctcggccattgcaaaagcgaagtaggattccacgatgtgaagcagctatgtgactgcacaaaattaccttctttttttgagtttgagcaaagatcttggaacagcaacagccagttgtgttacttccagacatggtttaacgctgtaattcctatactaaaatatactatcagtatattttctgaacttatccaattgtagctatcctaaacgggggccaaactggaaaattacggctcgcagtattcgcttaggccaaattgtagtagcagactttgtaatattcaggcccatacataataatcggaatcacgggggcccaactacaaacttctggatccgaagtagggcccaaatggatttcaagcccaagcccactctctccttccttcccgatgcgctctctcttcaccatgccgccgccgccggcggcggcgccggcggccggcgagggggctcccccatcctcctctgcaccgtctccgctctaacccaccgccttcgagtctgacccgtcgagtgcggcctccggccggcggcggcggagcgagaagagagaaggggagatgacgcgccgccgcccacgtatccgcgcgcttccctccggccggcggcgtaccacggcgccgccgctcccggggaagaagatgcccatcgtcctcctcttcctatcagcaattcaacaccgcgaggacaacaagagtcacatgattccatgaaccaataaggcagcagtgttgtactgttcttcgtctcctctctctctctctctctctccacaaggtgattgatctccatttcgtgtacaaaatcttctttcattacatgatgatgatctgcacctgatcgaattatgatagttgttacatgttcttctcatttcggttacagcaaaatgaaatgacaggttaactgaatatcctcaaatcaatggagcgaaactctgaactcctgactcaaacaacatttcagagattcatcctgaattcctgatacagagtaagccctcccatcccttctttcttgcttgccttgggcaactaccaaaaacccaccaatcatgcaacaatctatgtgcacacacaaaccaggcagttgcttcctagaagagtgagttagtgtgtaggtaagaaaaatgtaggaaaagaaactctccctgatggggactgcagtgcatcagcatgcagttcagttcaggcacgttccctgaaagttctatgcctcccttgcggcaactaaactctgaaaaagtctagtcagttgtggcgtgcagctgagggtgtgtttaggcgctgtttagatgggattaaaacttttaagtccctattacatcggatgtttggatactaattataaatattaaatatagactattaataaaacccatccataatcttggactaattcgcaagacgaatctattgagcctaattaatctataattagcctatgtgatgctacagtaaatattctctaattatagattaattaggcttaaaaaatttgtctcgcgaattagctttcatttatataattagttttgtaggtagtctatatttaatactctaaattagtgtctaaagacagggactaaagttaagtccctgaatccaaacaccaccttagttcacgctaaaattggaagtttggttgaaattgaaacgatatgatggaaaagttgaaagtttgtgtgtgtaggaaagttttgatgtgatggaaaagttgaaagtttgaagaaaaagtttggaactaaactccgcctgagtaagagtatatagcacaagaacttccatatcacaagttcacaaccctctctgacactgacctcccaattcactttgcctcacaattaagctggcaatgggtccataggagcacagatccacatcacacacaagaaacttactagtactctatttcaacgagttcactgactgtaccgcagttaaaaaaaaaaaactactgtccatgttcccatatcttcagagtaagccttcttttcctttttcttttttttctttttacaatttgcccagtactatcaaagaaatcacggatttggaaaatagcactgtatgtgtcattcttacgtacagtggtatttcgcaactcatgtacctttgcaatgataatggtatttcctaatattttttcattttttccctcctgaagaatcttcaataatcacctcacacagttttgggcttctggccgaagcttggctcatcttgtcaccagaaatttcattttgctgggatgctatatccaccaattgcacgtaaattgtagtactactttttaccgtttaggtgcaactcaagtatcaaattagctcttttgcaaaactcttcaaaagtgtgttgatctgtttggttggcttccccgtgtgtttggttcacgttctgtcactgccatgataataggccagagaccaatcattcaacctgcaacttccatacaacaaccagctaagctgatcgattgggttttggataaccagatttaacacgtgttgtggatctttgctacaggtgttctaatcttttcattagtaccattccattattcaatatagtaacagcaattgcgatccgtgcagctgctttcggaagctctcaggctgttttcctgcagtacttggcctgtggaaaaaaatttccctttgctcctcaaagtgggttcctggcacgttgcacacttgtgcacaaatatccattgtaagtactatatatattctgctttgcaaacacagaaattattgtacaccactatctccaagtacttattagactttcccaaatggaaatggtaccagcaatttttcattactaccaatgtacggtcgagatactaaaagataggaatatgtcacatgatctgagtttacaaaaataattatactctaacaaaaaattgcatacatataataataccatccaccgataaccacgcatctacaaattcacatgtagaaaataatacaacattttagtaatataaaatataacagacacatgtctaaaatatccatctacagaagatctagattgaggatgcatacatcacaccaacacgaatttagagaagtgcatcggtttgtttcatattcttttatttactactagattattgcaaagaaaattaaacataatagtcaaaatttgagtgttcgtttgatcgaaagcatgaaaccgatttgagtgttttttttctcttttttctgagaccgaattgagttttttccctctttttcccgagaccgaattgagttttttttcctctgtttttctatttctgagatggtacgcacgtcttgaagctaatggtgccatgccgccctcgtgcctgaaccgagaaacatttgctagtgggaggcaaggaaggcgatggccgatgtaagagcactaattgtctcattgtttccatcacagcaaattgcactgtaagtcatccaacttgtatgccgtgtacttcccatctcaaggactatataacctcaacatgccacctaaaaactaagataatctcgacctctctaaatcaaacaaactggatgggctaacaactctgacttgttcgtccaaccaggcttacatagtcactgttgaaatttgattgggttcagtacaagtctagctagattttttcagtcaattatttgataggcaggacagggaatcaaacgtgaggaaaaaaaaaaggaacagtagaagtcttagtcaagatcgattcccatcgattctaaaagggtaaaagaaaaaggagtcaactaagcaaacaggagaagtcgatggagagattaattttgcaccaccattatttgagctcattttacgtggtatctagctactgtggagtctggactagtctaggaatgcaaaccatttgtcaatgtcattgtattattaccacacactttatttgttctgtttcttttccttcttttttttttgtgagaatgccttgcatgtgctttgggcctttggggttgaatactgactagtcgagcacccactttgaaagaagctacactccaacttccattcaagaaa

SEQ ID NO: 45363 - DNA, 22388 bp, Oryza sativa
cccttcgattactgcggtaaccttgtgcgataatcattttagttttaaaatctttacagttttcttggtaatgtaattgtttttgcggttactgcaataagcctaagtagaagtaatcctaccaaaacagtaaggaaaaccctcgcagtacgtctataatttctttgtagaattcactgttcatttcaatgtatttacccgttgtgttgaagacaagactcagctgacattatttaaaatggttgtatgtgaacaagacagccttcaagggatttggtgagtgtgaagaacactgatcactacagctaactgttagttggaatttcctgtaaactaccaagaccaaggttaaaggtcattttctttacctcaacttgtgcatgactaatgacaaaagatataaataaataaataaataatcagtgggaataattgctctgctcggtgcacgtactattcgagataaagaagacgatttggtccaacaaatccatctgttaattactccttttgggaaagctagtagtgtgcttccctttgcttttataattaatttatagtatcattgatctcaagatactgcaatttgtcagatataattgttctcaccttgattttcacctcagtagtatcaccacgaacacaagtggctctatttttaaactcgccacacacgagaaacactgccattgcaacttttataaagactctgcaacttggaaaacaaaaaacacaggggattataatttttcctctgacttgactgaactagtatacgtgcaacacgagttcaactctttttttttcctgtcagacaacagcaaggctgattatttttctttatttctgttaaaactctagaaccctaattcggtcggttaattttctgttccatgcagttgcgttgccgcgccgttttaaaatcttgaattcagaattagtccagaattttttccagggagaggattgaaaaaatggcgtcgactgatcatcaaggccaaaacgagttgccactgattggccagtcgtcgtcttgtcgagcactgatgatcaatccacaaataattgccctctcgctccatgctcgtcaacactcaacgcattgtgagatgagacccgtgaagaagtgtactccctccttttcgaaatgtttgacgccgttgactttttagcacgtgtttgaccgttcgtcttattcaaaaaatttaagtaattattaattctttttctatcatttgattcattgttaaatatatttttatgtaggcatataattttacatatttcacaaaagtttttgaataagacgaacggtcaaacatgtgctaaaaaatcaactgtgtcaaacatttcgaaacggagggagtaatatataaccttttggtatctttcgactgtgattgagtatgatattgaaatttaatatttctccaaacacaatctcccctaaatctcatattgtttttatatatagaaattttcaacaaaaaacttgagcttgttttacatggatatttcaccgattcgcatatatgaagtttcaaagaaacttgagttgacttaaagcacatttcagggaggcagttttaagaccttaaatggatattgtcctgttgctcctaaagtgccatgtaaatacttgaatacgttgatacaaaatgaacctattattcccacacacacaaaaaagtgcacctatcatctgaaaaattctactccaaatttgttttaccacccaccatcaccaaaaaaaaaaaaaaccgtttcaccaactgaggaattatacataaccgattttgtttgtctatgttaatatgtatagtttcaagccttatgttagcctcccttgcttaattctacacttaagctgtgttcgttttaggaggatgggaactaatacctcccgcacggaaaatagagcgttccagtagcgcttgattaattaagtattaactatttttttaaaaaaaagaatcaatatgattttttaagcaactttcgtatagaaactttttacaaaatacgcaccgtttagcagtttaaaagcgtgtgtgcagaaaatgtgagtgggggagttgggaacgactactggaaactaacgcagccttaacaccatcccaataacctagacctctacttgatctcctatatattttacttgaatgaataaatcgctagctacactaaatggatcgatctgatagatcctacaccgacagattgattgagccctattagccatgtgtaagcaagcaaccctttgaaaatcatatatcaaggacttgcaaactgtagctaggctgttggggaaaggaacatcgatatccgacaacgatatgagatgaaagcgatgctaattgtaatttccatgaggttggaagagagcaggaagtttcagcttgacaggcaccccccccccctacatccctccaaaaaggctgttaatttaggcctcaatcacgttcatgcacttcataacttattatttcaccaaagtgttgtacttaaggttaaggacacaatttattgactaatctctctgtattatgtgttggtgttactttcctttaaagtacaatatgggatgtgtgcacacacatgcgctacactcacaccacataaatttggtgaacatgcacctagtggtaattcttaaatttgaagctacactatttagccatctggcaacaaaggcacctacacgtgatttggtgtttgattctttactattaacaactgttacatacatttgtcaataatcacacatgcataatcaaaaagttctactacctctatctcagaataattacatttatatcatttaacatttgtcccaaaaaattgtatttctgcgaacttgggatccaaccttctttttaatcaagtttaagaatggtaattatgtgggtttatggtcttaaccttctgtctgtttcacattataagtcgttttgaattctttttctaatcaaacttctttagatttgattgagtttgtaaaagaatttagcaacatctcaaaaaactcaaacctaaagaaatttaactaagaaaaagaaagtcaaaatgatttataatatgaaacaaagttatttagacttttccactctaaagtaaaaagaataggcacgcaaaaaaaattacttcatcctaacctagattcagaggcgcctactgtaaattaaaatgtccggcacatagaaaattactttgtatcctcacctaaattcaaaggcaactatttggatccgaaagtctgacagaaagtatacggcaatgtttagatacacaaaactttctagtcacttttacgatgaacacgatcaggtaagttccatcctacctaaccttttgtactctacaagtaccagtctcaaagtacattcatcctacccatgacaaccaatccaacacttacatttgttggcacttggcagcaaaacccgacctgaaaaattaaattaaagccaacccaaagctgctgctactactaaaccactatcaagaaattcaagacggatcatggattcccccccagccaggtgtaaccgggtcgggtcaaacccaaaaccaaaacccgacccgacccggatccgacacgtctcgcgctcaccgcctcgtgctgcatgtaccgacccgatcgatcgcgcacatggggggcgcgggccccacccgcaattaaggaaaagggcgaaaaatcgctataaaataaatccggagaatatttaaaagaggagggggaggggagcagtcgcggtggggcccaccaccccctcgctccgcacacgaaccacgtgcggaatccgcgcatttagtactcgcatcgtcccccccagcccgcgaaatgataccgaattgaataaaataatatttaaaagaagaaatctgttactccgttccaaaatacagttacttgtaataacaaaatattcttctatagtaaacctatttatccatcaatatccttctaacccatcacaaagttcacaaccctcgtccatttatttcattcatcttattttttatctcaacaaatcataatatttctccaataaattttacttactttcttaatacctactactatgtctaaaaaaagataaactttagctacgaatctagacacgcatatattcgtagcttacatacgtgtctaaattcgtagctagaattgaattttttttaagacgctagggtaccatctatctattttataattatttactccatctgtctcagaatataacaaccaatgattgatggtgttcatcatctatctattttataattatttactccatctgtctcagaatataacaaccaatgattgatggtgttcatcattggttgctatattatgagacagggggagtatatttctagaacagatgtaactcccttcgttctaaaacgtagtactcttattatgatataataacaaagttggatagagatgaatccagtggtaataattgagataaggtaaaaggtaatttataagtagtattttggaacgaagagagcaactattttctccattccaaattaaattatgggataaacatatcgtaataatactataaatttagacatatttgtattactacaatatgtcacattgtgttagattaacttattccagtacggagtactccctccgtcccaaaaaaaaaagacaccctggcttccatgcccaacgtttgaccgtccgtcttatttaaaaaaattatgaaaaaaattaaaaagacaagtcacacataaaatattaataatatttttttatttaaaagaattataaaaaaatttcatacaagacggacagttaaagttggacacgaaaatatatagggtttgttttttttggagggaggaagtaggtaattaggagaagaaaaaaatgggaagaaagaaaatccgcgaggttaaattgaatcgaattgagtggtgaccagaaaccgcagcggctgcgtcgtctccgtctcctctccttgcttataaacgctcgcgcacgagcctctctctctctagctctcgctctcgcagctcaaccactagcagcagcggcaggaaggcgagaggaggaatcggaggtagctggacggcggcgaggcgacgacgagccggggtggtgcagcaagaacggcgcggcgagcggcggggaggagagattggatcgacgccgggtagttaggaagggagcttggagagatggcggcttccgcgaggcccgtcggcgtcggcggggagagggcgacgagcttcgccatggcgtgcagcctgctcagccgctacgtccgccagaacggcgccgccgccgccgagctcggcctcggcatcagaggtgaggaggagaagggaaaaaaaaaagaactcatccctttttttgtgggtgtgcttcggcttggttggatcttcatcttcagcttcggtttcgtgttgagatctgatcacaaggtttggggttttggttcggttccaggtgagggtgaggctccgagggcggcgccggcgacgatgagcttgctgcccggggaggcggagaggaagaaggagaccatggagctcttcccgcagagcgccggctttggccagcaggatgccatcaccgccgattctgctgctgatgctaggtatggggccatgccacttggttctctgcttcatttttgtgcagttcctgctccttaggtgtatgtgtgtgtgtgtcctagttcttggaatcacgcagagaaatgacaaattttgcagtctacaaaacttagctgtaagtgcctcaataggttgaagccactgtttttggtatcaaatctagttgaggggagagagggttatgagtaaacattttgttgttttttgctttgggttcagatactaattggaattaggcaagcagagttactaggtcattcagacttcagggagttgttaatggatctataaaaactttacctatctttgttaatagaaaattttaaccccaaacttagggttttttttttgtttaaactggggcactgaaaacgtagtttcaaaaagaaccctttttatgcttgccggtgaaaatagagttagtcagatggtgcagaattggaggggtgatatactggtatcccaggtgttcatagtgttctctgtgcaaatgaatttcagggaacaagagcctgagaagcgtcagctgaccatcttctatggtgggaaggtgctcgtgttcaacgacttcccagccgacaaggcaaagggcttgatgcagctggctagcaagggcagcccggtggctcctcagaatgccgcggcacctgcaccagcagctgttacagacaacaccaaggcccctatggccgtgccggccccggtcagtagcttgcctacagctcaggccgatgctcagaagcctgctcgcgcgaatgcttctggtaattactctgccctttcttgatgttcatgtctgtcggggtattgaacgcataaccagttgaattttgttgtagcagttatcaagtgacctctttttttctgtgtagatatgcctattgctaggaaggcatcactccacaggttccttgagaagagaaaggatcggtaagttgttttgctgtgatgatttgcatgatgtttaagttcagtattttgatcactgcagttcatggatctaatatgcgccttttgttgtcacagtcttaatgcaaagacgccataccaggcttctccttcagatgcaaccccagtcaagaaggagcctgagagccagccatggctcggactagggccgaacgccgtcgtgaagcccatagaacgcggccaatgaggttgcatggaaacttcaccaaagctcttcaaaaatatatgaaatgcgcttgccgttagagtaccaaatcatatatgttctctcataccccatgttttagtgttttttctttagttcgtgcttctatgttgttcacttgtcacatagttctgaatgtaaaggaaaaaggtagtagcattgacgaccagtgccgagagcctgagagaagttttggcatgttaacacatggtgactctgaaaatggccatgctaaggtaaaaagttattgcaaaggaaacatatatgtatcttctgaaattctgatcatctggctttgtccttggctctagccttgctctatgcaaagcaaagtgattgtaatggattcagaatataattcatattcctattgttgatttctgttacatggcttattggcttggtcctcctccaatatgtctgcattatttggtccccattatatgtgcctgcagagtcaatttgctcttggactttcttttttccttttcttgacgcgttttcattttttcttaaatgcaaacctcattatttagcataaaataataactacatacacaaactacaaactaatggaatatttgatgttccacaaacacaattattagtgattgcctatgaatcttttctgttttgtagctatatattttatcatcatgcaaaggggatacagggcagcacaggaggcagcctggggtaggttggatggcactgtcaagctgaagataagggttttgcgaaggaaggtgcacaaggcaagacttgtcaccccatgcccaattctttaatcaaaagatatgagcacatgtgagaaattgggggtggagatgagttgataggattcttgtttgacagctaaagcaaagcaaagcatgaagagcaaaacaacaggaagctgtttggaaattgcaaagggggggggggggggggggaagaaggatgcattgaccgggattctctgcagtactgtcgatatgataatagcaactgacatgtgggatcggatccacctgtcagtgattgctactgaaccaattgtactgcggaggatccatgtccagtatgcatacatgatacggagtacatacatacaaaagacatttttcagagagagatgtttgttggacgcatgggagcccacagtgagccaagttgcctgcttttttctcctttctcaacttgtttgtattatactcctaacaaaaggacttgatgaactagtgctcacattcctgcaacttgctgtctaccaattgtcaaatcttttgattagttttttctcttacagaagattttgcatgccattctcgatcattcctttgtgacacaattttgtcagagagcttgtgtaactctctctctttactcttcactgaatcaatttcaaattcaggaatccagccaatctggtcagactacttctgttccacgaaccgataaaattaacacatcttggcagctttacaataccttttttttttcttgcaggcttctgccttgtaatttactcattgatttgcccggttgatgcatgcacgtactaccaatcgtcctttgtgtgtttgaagaattatcaaaagagaaagataacaacaaaaaggcacaccatgtgctcaagctgttcatggttacaactaacaaaatccgtgtgccgtcctctgtggtccaggagacatgctgcccttgtttccaggatgcaattgcttgtttaatccgaggcactaatgatgggtttattgggtccagtaatccattatccatccaggtcaaaattcagagcgttcttcagaccacacggccacatggggggcatgaagtggactgcaaatggcagcatggaccatttgaatcgagctagctgttcatcatctgatggatgaaccaacgacctaccgatgattcagtagctaccaaacagtgggaaaaacgaattggctgtgtgacttgcaacagaaagaatccttgcaagaaagagactgcctcaaccttgtctaagttcttggttgtgttctttaatttcttctcacgcaactgtagtgatggatttagagttcatacccgcacgcaagaatgaagaaaaagaaagagagggatcttgacaatcgtggaaaaccgaccgagaaccgctcatttttcgtgaaaccattggttatctgtcgtaaaatccgagcggttttagctggttttttacgaagttgactgaaagtggtgattttatcggtttccggtaaaccaacaggtatcggtttttacttcgaaaacgataacgtaaaccctggtgctactttggaacaccatgtgtgtaattggttttgggggaaaaacttgaaaagactgaaagacattgattcattctgaagccattttaattattttcaatctgaaaaaacagggggagcatggtagctatccggaggcagggggaggaatctgtccattgcttgctgctcctttttatttcagtaactttagcccaggtccatttcatcacatgctgattctttagaactttagtaatataataatatgcatagtatgatgatgaattgatacagtatgcttctactattctgactctcctgtttgtgtctgcaaagcaatttctgaatgcacgctgtttatttaagcagtgcacgcttccgtagactggactaaataggccgagtttagatctaaagtttttcttcaaacttctaacttttccatcacatcaaaattttcctacacacataaacttccaacttttccgtcacattgttccaatttcaaccaaacttttaattttggcgtgaaactaaacacacccataacactgcactctgctgttgtgtatcagcagtggttgtacagtgtacagttactctgaatgactgaatcattcacgtactatactgcttatccacgggcttgctgttattgtactgcctcccatcttttaatttcttggacattgttgaaaatactatatttttctttattaattggcccgattaatggaatgtggcagtgtgtggttgtggagacgaggaatactttggatatttcatcactaaagcacccttggtacttgataaatagctatatttcgatacaaaatttgaacacgcattgaaaatgagagattatatatttaataaaattatttaaaatataactatatgaaactttttcataacaaatacactaacacaaattttaagtttaaaatcctaatagtttaacattattaataattcaatattttaaggtttgactacacatattcttcatgtatatcatccatttttagaacgaattaggtgtagtaagaatataatgtactatatgacggcccatactttattgcaaaatatatatggatggatatatattaaatgttatataaatgatggatggatctgtgttaaagtattatgtaaatgatttgagaaattatgatttagcgtgcttatatgttgagttatgtctgtatgttgactcgtaagtgtttagtgggttgatgtgacatgtttgtaggttaggttttagaatatactaatgattgctatgtttgtatgtgttttttcgaaatttagtggttaaaactatatagaaataaatagaagatacggggtataatctcgtatatgtacatcttgacgtgcagagggggagataggggggcccaggttacaacccatcgcagaggcatcggttgcttacttgggctttttctgtgtggatgcatatgtgggctttgagcccaagaatggttggggcattggcgatgcatgaagatgccactgtttatgctggactaatcgcccgtacagcactacagtgtgctgcgattgttccattatttcaaaaactttatgttcagtagtacgcgacagtgagatatttcgatcaagtttttcgaggatgtttataaaggtagaggtaagtgtgtgcgtgttatgagtgttacaactatattatgttattttttaaaaaaatcgttgtcatgttccattgctccagatgatagttttttagctttcaattttttcaaagctatcagtggttgtaattctccgtaacacgatgcgctcttatccgaaccaccccgatgccgaaagctaacaatggagttcttctacattgcagctcgccaggggttgttagttggcgcgcgccagctgttcccggcccatcagcccatcagccctctttttctttttttcgtgattttttttttcgtttttcttttacgatttttttcgctttttttctgattacttttttttaatctttagcacacttatttttttaaaaaaagttttgagttgaaagttttcaaatctcgattttaaagtttttaaatctgagatgaaagttttcaaatctcgagttgaaagttttcaaatctaagatgaaagttttcaaatctaagttgaaattttttcaaatttgagatgaaaattaaaagttttcaaatctgagttgaaagtttttaaaatttaacttcaaagtttaaatctcaagttaaaaattttcaaatgtaacttaaaaattttcaatctattagtaaaaaaaatctcaaaaaaaaatatttccttaattactactattattatccttaacatagttagttacgttacttaaaaaatgccacgagaaaaaagatcgatcagcatcgatggccgcgtgggccgtgggcctgaagtgctagcccgtagcgcgtatgcacgaattaggaatctcgagctcgccagccataggagcactttattgttcagaaccgagaataaaactgattttaaacgtaggggtgtatttaaaaaaaagactcaaagctgcgagcttgctttttctaggttaggttcgagctcagcttaagctctaaatgagccaagcccaaacccaaactcacgaattttatctagccgatctcaagcttctaaccatcttgaccatgtataataacttttatggtttatataccttgttaatttgataaacttataggcactagtggagaaaccatctttgatcggtccacccaaatccacaatagtcccggttctattaaaaaccgggactaaaaagcatttttagccccggttgataactgtaaggggactatatcatcttttatcccggttcgtgttattaaccgggactaaaaatcatctttagtcccgattggtaacaccaaccggtcccggttcatgtcgtgtcagaggctgccagtccctagagatctttagtcccggttggtattaccaaccgggactaaaatcctaactttactctcggttgttgtttctaaccgggactaaaaatcaaatataccatatataatcccttgctgctatcctcaaaaatttctatctcctatttctcctcttctctctcacacttatccttatcctcttctcagtctctttctattcctctctcaacacttagccggcgaggagctcgcccccggagcgcggcgacagggacccgagcgcagtcggcggcccatgccgggaggcggtggcggccgtccatggcaggcggcggcggcggccgcgcacggcatgaggaggcggcggccgcccgcggcaggaggcaacagcggcggcggccgccctcggcgaccggatttttttttaataacttgtgattcattggatctagatctggatctgggttatttgatctgtgatgtatttgtgattgtgattgtgatgtaattttttttaagaatttgtgatgttttttttctgacaatttgtgatgtgaatattatgatttgtgatgttgctatttgatctggggatgtagggagtatctcgatttcgatttggactttgtgattgattttatgattttggagagagtggtgtgaaatcaatattcaaaagaacatgaaaaaaaactgggactaaccctttagtcccagttggtaacaagatcgatctctaccaatgagataaatatatgtttacctacacaataatttagcatgtgtcaatggtaatattttttctacctttttttaagtgtggttcactagagaaatgttatccttaccaaagaattatcattgaaatatatcgctaagcttgatcgagctcgaaacaaacttacctaaaatatgaaataggctcggctcgagcttatgttgagatctgattgttcacaactctttagaagcaagaaccaccaccccgcaattccagcaccgaaccacctccttttaaatatccacaaggtgccaaatacacattgtcttatcattactttctctgctcgtaattttatgtttacaaagcttaatgaaaatataaccgtaaaaaatatttttcatgataaatccacgtattaaattcaaataatattttaagtctattactgattcaatagtttcagatttgaatgtacctattattttctattttctacgataggatacgttaaggaaatagataataataaagagatactacacaaagaaagtacatgtggcgtttgatggtgtactcattggtgtatgactcaacccatcagaatttaaaccctatttaaaaataaacattactatttagtgtcatttcaatatgattttattgagaatagagtatgtgttataaggtgtgttcggttatatctaagtgaagtgcgtatgtgcttccaatggaaaaaaagaagagaacttgaaaaataaaaacaatatatccatctctcactccgcaagcgcggaatgcaacaaaattggttgggggtttgatgttaaggcagtcccaaacctccacctaggatggtgtctatagtattaaatacattgtcatgtaggacttttagcttatgtagcactatatattaattaagagagagagagtgaagagagtaagaaattgggtctcatgcaagacacaccttcaacacaaaaaacctatgcgctagatactatcaagttttgcattgggagagaatagtgtcttcataatagatgaagaataaatattattggtagagaagagagatgatgtatttattaatagcccactttaagaaaccatgggttgtagagtatagtttctattgtgatatcaccatagacactgcttatggacactatgggttgggactgcccttagaaaccgtcgcacccaacacgtaaaatggagcagtaaaatagcatataattaattaattaattaaacacttaaaaaaagactaacatgattttaaatcaattacctatataaatttttaataaaaaaaaataaaattactaaaacaagtataataccatttataagcaggggcaattgctcatttcaccatgttatgaagcctatactaatttgattatatttttttcaagtttgctcatttgaccttgttttttaaaattgaagatcaagactgattttatttcatgatgataagataatagtgttaactaaggggcaaattatcctttttgtccttactcagttgaccatgcttctttttttatccgaatccttgacatacttgtaataaaatctagcatagattcgatagttttgatacaagtttcatagttttggcttgaaatcgacaaaatcgataaaatcaaattagcaaaatttgatacatttatggctgaactttcaaaaggattttcgtagcatatttgtctttttcctctcctctctcctactccatccgtcccattttaagtgcatccattttctgtactcaattttgatcgtccgttttatttgaaagtttttctaaaagaaattaaaaatataagtcacgcataaagtattattcatgttttatcatctcataacaacaaaagtactagttataaaattttttttaaataaaacgaacgattaaaattaggcaaaaatgcacttaaaattggcggagggagacatggagtacttgctctataagggtggaaaataaaagaaatgcagccaaaatctctcaccaactttactagtactactctatcaacccttcttcccagtcagtccactccactccccaaaccttctcgacccttcttctcccctcccctccccccaccgtcgcgcgcggcgtcgccttcctcctccgcctccgccgcgctacaaccctaggccctcccggcgacggtggggagcgcccgcgcgatgctgccgcagcagcagcagcagcagaagcagcaggcggcggcgctgatgccgccgtccatgtacgcgatgccgccaccgccgccgctccaccaccaccaccacccgctcctcgccgccgcgccgccccagcagcaggtccgtgccgtgcccctcacacagttagctgcccgcgaaagaggctgcgggtttcgcgggagtttggtcgggtaaagcgggggagctttgctagtctcgctgattgatcgcttcgtttcctgtgccttggctctgctagcgtcgaatggtttccaactgttgggttcctagatttcgattgattgacgggtgttgtgtggggtgaaaaagtgaaagcattggtggtctctgactctgatttacgggtgttgtggaaaatgacggatcttttgagtgataccgaggtgatttgcacgaaattgaggggctttctagttgtgtttcatgcatgcttgctgcttgtggggagggtagtgcaatttggaattcaaagacaccttttttctttctcttgtttggagaatacaagtctgagaatttgagtgatccgaatttatgcagtgttctgatacttgatcagttaattttgtttgagattggtcttcaggtgatctggaagttttgtgcttctgattgtaacgagtaattaatcgataaaatcttgaaggacttagggagttttgtgtttctctttgtttgattttgcaaaggtatagcctttgggacttttgggtgatttaggtccgtttggtttgaatccttgcagggttggggattgtttgggcttaggtgcccacttttttggtgcttcttgttgtcttggttaggaatattttgattccttttggttggttaagttagttcaaccttatctagttgggaatggagatcacattactcttgttgctgtgttgcacggatcacatcattgtgatgtactgatgtctaagtaaaacatgcatcattgatgaggtctgatttccttttactcaggttaggatttgtagggcttggattttagctctcatttgtaaggttcctattttattactagctgaaatttttctatatttgacatatacgtctattctgtaccctgattgatcgggagcgccgtttttacccccttttgctggcaaataaagcatgcagctttctcccttcctctgttacatttatctcattggaactttgctgtagtatctgcaggatgccttgtgtagtttgcatgtaccaggcttctttttgctaaggcgtttcctattatttgtagatttttatttcttctttctttgtttttttacatttttatttttgcagatagagccaatccttactggaaatctgcctcctggctttgatacgagtacatgccgcagtgtgtgagtcccattagggattctttttattttttttattttcttttcttcgtatgcttgaaaatgcataagttcatgctttggactttagggcatcttttcctgtacacatgtaatgtaatttaatacatctagcaagaatcttccattagctgtgtacacaagcacatattttgttggtgaagcttttgcaagtctatctgctagccactgttttcttaattgcatgttggccatgtatacattaaaactttgacacaatggtattttggtaacatgaaattttacatactatatttatttcatagctgaaagtaaggtgaaaatttgtgccttgaatacatttacaagatctatatgcattaatccttactaaaaattgaaacatgtctaatgttttctgttcacaaaataacacggcaaatttattaatctttgtatttcttatgtaagagcatattttgcatggaagcatggtctaatgttttctgatatgctctattttcataattttagatatgttggcaatgttcatgttcaagtcacagaggcacttctccgagaggtttttcagagtactggtttagttgaaggatgcaagcttatacgaaaagagaaggtttgctttcattacctgatttttctgtttatttcagttatatttttgaaagcgtatcctttgtggggtgattcagtctgacacaactattgtcatgaggatctcatgatttacttttaaacatatgtttctgcagtcatcttatggctttgttgactactatgaccgcagatcagctgcattatcaattttgacacttaatggaaagcaaatgtaagagaaaagctattcatttctgctagtttgttgaagcttaattatgtttttttttctccccaaaaacactcattgaagaaaaatgatacagttttgggcagcttatcagagttaattgggcatatgctagtgggcagagggaggacacaacaggttgatactatgtttgctttttataccagtattctcagaattttttgatataacttttggcaagacatggtaaattttatcacttttgcagaccatttcaatatttttgttggtgatcttagcccagaggttactgattccgcattatttgcattcttctctggatattccagttgctcgtaagtatttattacctttatccactagtgttttctgccattggcccaatttggcttttcctaccccagctttataatattttgtgcgttgtcagctgtcctcttttaattcttctgttgtcacgatttcataataatcatcagttgtgtcagtagtacctctaccgccactaggatacatcctagttcacttttcataccattttctttatcttactaattaaattaaggtttatctggatcttaaattgcactactttctggtatctagtgatgcccgagttatgtgggatcaaaagactggaagatctagaggttatggctttgtttccttcaggaatcaacaggtatggtaattctaaaagcacgtgcatttgtatgggttctttgtttactcctgtcacttaaaaaaaagttttttggtgagcttacaggatgcacaaagtgccataaatgacctaaatggtatgtcatgcacaaactccaaatatttctcatttaagaatgtacaatgtttttgggttgtgtggttttggatttggttggcttggtgccttattcatctgatcttattcataggacaatggcttggaagtcggcagatacgctgcaactgggcaacaaagggtgccagcaatggcgagcagcagacttcagattcaaaaaacgtagctgatctgactaacaatttgacaggtaatctttatggatatgtaacatatttgtgttagtcatattttaatattttaaattccttccatttgctagtatgtactttcagaagacagaataaattaaagcatagtgttttagctgtgcattgcaaatgtgagaggtttggtaattaaatataaaaatatagaataatatatagagagccttcaaacatattgcttcctgcaaatggtagaggtttggtaattaaaaaccacttcctctttgagttcttctaacaaataactcaggcagtaacattacaaaacattgcctggtttaaccagaatatttttgtaacgaatgatggtgttgatctgttctactcctattttcattatgattttgctgtgtgcgtcttctttcgttgttgtgctgcgcacttgcatgatactcttagccctgctgttggaacgaagggctgcagttcattgttcttaatacgatgggcttcagtatgaatatatgatgagttgtgctgttcttttttaatcttgttcagaagacgggaaggagaaagcaaatgaagatgccccagagaacaatccacagtacagaactgtttatgttggaaaccttgctcacgaggtaattctatttcagcgttactaaatgtatggcatattgaatccttcgaacactagacgctgtgaatgttgttccggttgtcttactgataaattgacgtctttgaatttcaggttactcaagatgtgctccatcgtcttttccacgcacttggagctggggccattgaggaggtccggatccagcttggcaaaggatttggcttcgtcagatacagcaaccacgcagaagccgccctcgcaatccagatgggaaacggtcgcattctaggtggtaaaccaatcaaggtgactcacatttcccgcttcaccgttttcgcgcatgccgttatcattcctcttaactccattgaaccctaagattcacctttgacacctggttacacttgtctctccagtgttcctggggcaacaagccgacgccacccggcaccacgtcggcgcctctgccccctcccgccgctcccagcgtgacggcggccgatctcctcgagtaccagcgcagcctcgccttgagcaagatggtgtcaagccaggcgctgatgcaggctcaggcacagcagcatctgaagcaggcaatggggatgggtgcaggcgtgagccaggccatgtatgatgccagcttccccaacgttggcccctcgcagcagcagctcatgtactactgaataaaattcctgcgagctcgtcgctgtaatttgtgactcgatcagtctgatctctttttttttctggttttgttttagctaatgttactttttttacgtctatatttagagtgtttctggagctattttcgatgttgtttcgtacatggatggatggagaatgtgtaatggtatatgtgtgtgaaggatgtaagctgacaattttatataatcttagtctaatgttattgctgccagcctgccatcagtggtttgtttattgtatttttgcattagaaatgtgtttaaaaatagcaatgttgttccaggttccaaagagtgtgctctgtacaagtatcgctgctcgtgggctcgtcggacgggccttgctaccggcccgctaaagttgggcccgaacgagatagcagaaagcgtacggcccaatgaagttaggccggaacgggattcgtcgaagatgcggcccatacgagttgggtcggaaggggatttctgcttacgcgcggcccactattatttgggccggaacagatcccagcgaacgcgtggcccgttagaagcgttcaaatatttatctgaaaacgagttcgtctcgatacgaactgaattcgtagcttttgctacgaggcaacgatacacagattaaccaaaccactgcgcgcgtctttaatttgttttggacttcatagcttcgcctaatttttcttttcatttccttttgctggtgaaacctgaaaacggctgcatgctgtaatgagacaaccttgcagcctgcagtaacgtacattcggctagcagtcgtgtttcactgcttaatcacatatataatgtgtaagaagaatccatcaccctacatatgtatatgcattgtggatcgatccaaagataaggattgcatctatcactacctatagcatcatgcaagtatatcgttcttacaaattaacggacagatcagaaaagatacaaatggaaaaaaaataaaagtatttttgtctcttaagaaaaagttcctttgtttttatgcatgtcactttaaaaaatcacaaaaaaaagagcaacacaaaatactcagatatatatcgactagccatgcatggtggccttgatttgatcccctttattcatcctcattacagtacactaagtatattactattgtattatattatggtggagatcgattattattacagccaagctccgattatcatccgccatgcaatgcacgcatgatgcatcatatccatcacattcttcacaggtcgtcggcgcagatgaagaagatgctcccctccctgcactcctccccgcccttcctcgccgccgccgcctccttcttcttctccggcgacgcggcggcggcggcggcggcgcggcgcttctcctccctcgcctcgcgcagcgcctcctccaccacgtacctcgacctgcactcctccttgcagaacgccttctctccactgcatatgcattccaacaaaacacacacacaaaaaaaaaacatcaaattaatgcaatgcagtacaagctaacatactgttcagcttctttcaatctctactattttagttgagttaattactgtgcaatgcatgcttaattagttactaattgtacatgtagatgaagctggggcggccggcgagagggacgccgcagaggttgcagcacagcaagaactcggcaatggcgaacgggttattcccggtgcagatgctgcaccacggcacggtgcagtagccgcccgaggcgccgccggagctgatctgcttgtgcgtcccctccatgatggcgcgcgcgctggggcgcgcaggccgcgcgacgcggccgacgacgtcgtccatggcggcggcggccgcggccggaactgggcggtggtcatcgacggcagcgatcgccgcgttgacgccgacggcggcggcggcggcgcgctctacgaagacgaagcatcggcggcggctcgccggagcggcggccggtggcttggctacgacggcggaggccataggagttcagtgtgagtgagtgagtgaaaatggtgagattgggagggtgaggcggtgtgggtttatatagctttggggggagaagggggttgcttggtgaggaattctaaatgcctttatttgttgcttcctttaattttgttggtactttcggcgcggctaaagcaacaccaagagtgtacacaagttattatgtgcttgggaggctttgtttggcggtggcggcgctggtaggatttatggcggtcattttgtaccttttagatgaaaataaaagcatttaacacggtctactctagggaggagcgtcccatctatcttatttaagacgtaaatgttagctatttgagatccctttcttgacgattttatttatcgtctaacttatcaaattttgaaatcaaacctacccaatcctctacaattagttagtcagcacatgtttccaacctccaccaattctacaattttctcagatggtgaaagttggaaactctcaagtttttgcgattagaggagaaactcgctcgcgttgtccctcttctcctattatccttagttacataaatcaagcacgtcaccccgtacctataccaatctctctcttcttaaataaatcataaatcagtgaacaaaaagttttgtccatatatcttctttgagatgaaaggaaaaaaatgaaatatttggtagctaaattcattctcaattccttctctattttttttcatgttatttgcttttgtgtgaatgagaatctttacatgatttcctaactcatgtatatatggagagaaaaaaatttctcttaataactaaatactggtaaaaattttcccaccaggtaacaaccttataaacggagatccatttaaaacaatctagaaataacattat

SEQ ID NO: 45364 - DNA, 11911 bp, Oryza sativa
aaggttgatgtggcaatgctgacaggtggggcccacgttgactcacccgccacgtcagacaaaaccagggtcaaaaccaccaaaggaccttaagcgaacggttttgttagttgagggacctccggtatctggttttgcggttgggggacgattttgtaactcgatgacaggttgagggaccttcggtgtacttttccctttcagaattggaccaaagtgacaacagggtccagggcacccaacaaccccggacacattaagttgacaagacaatcacagcagttaaatgacctcggagctacatcagtcacacaattcacaaactacattacttgtagaagttccagtccttcagataacaccgggtatgagcatgaacacaagaacggccaagattcagcaccatgaaccttgccgtcaatccctccacctgtgaccacagcttgggttgcagcagatgaagtacagtgtcaggcctttctcccccttagttggagcctgcaagttcaacgggaaaaagagtgactgattgcatccacagcttgtggcagatactaggattctgaacagagttgtaatatgtcacaatcaccaccactacgagaaaagccaattatgtaatgaaacggtttcctgaaccctgtggatacgaagcgatacatactatactaaaaactttaatatgctgacagaaatgtagatttgtatgttcatgctttcatattgctattctattcttgtatcagtgactgtatagaactatagatgatacagtagtcacatcgtatatagcaagaatcgcatagagaacaataagtaaacaacacaaatacactgacctgaaaaaaagcagcctctggatggccacagttgtaacatttaatacttctggtgcgaggcagggtgggatcagttgctgcatcttttaggatatctttgggttccccagcaggtttacggagaacccttttgtacacacaagtgtcagtggcaggctcctgcttatatgaacgatccaaataaatggaaatcattagtcaacctacaagaaaacttacacacaaattttttaaaaatgtcggaactacgaaaactataaatgcaatatagctgcaaagtatgtaagccttgagaaaaactcagcaatcacttcaataaacagaaaaaaaagagaggacattttgtggaagaatgcctaaaacaccaaggaaatctgtcttatttctatcctgattacattggttcttaatgaagttaatatgtttcagaagctacaacaagggacatatcaaacttcttttaagggacacttagttgtgatttgttacattgatacctcaggtaggttgttgcagtgtgcataattctggcatatgtttgtctctttccaatgagtaacatcttaagcatagtttgtgattacaagacaagttcctgattttctgagggcattgtatgccagataagctagaaacacttctcaaggaaagagagctaaagcccttgtaatatacaggctctatgtgggagtagatcctactttcaacagttctctgaccacagattttcagcagaaagttcatctcaaacggctagtgggaagccacttatgtaaccttaatccttaacttgaaagggaaaattggtttcataccacccgaaatatttcccttttagtcttaccaccaaaattttggggcatgctttgataccacctaataagattccgtttctttttttaaccaccagcacccattgccattcaatttttttttaacctctcctgctccgtatcgcccattacaccctcatatcccgcggtcccattcatccatcacacctctgccttctgcgctccccatactcccaactcccaagtcagcaccttccattagttgaaggaggcaactgagtttgtgaaatttattgctgaatccaccaaggatatctccttgtatatgctatttcaatgctacctcaaaatcttagtagtattaaacaaaataggcgatacttgcacggtacggaaccagccaattttgctaacatagaagccccaaatttggacaaatatgtcggcagtaatgacaaagagattctccgcctaacctttatgtatgagatcgagaacaaagcatgataagctgataactacctacaaaggaatattagccgtctaccaattcatcataaactcgccaagtcccaaccagaacccctctactctatcaatcgaacaaagcaagcatcaataacattatgggacatcaaattctttcctcagcgaaatctcccgcatgcagcaaccgtaaaaacgtgcgcaccaaacaatcataaatccatcccaaataataaagaaaaaagaaattacgatctcaacaatgcaccattaaacctagaaacctccatatacatacaccacatcactaaacccagcctaaaccctagatcaccattccccaaaatccccaatccaacctagggtcccaagagtttatttaccacacccaatccaaaaccatattaatctgagccgatgaacaaggcaaatccacctggtgctcgcaggaattgcaggcgtagagcagggtgtgcgtctccttgtcctcccgcgggtagagcatgttgctgctgcatatccaaccaaaaaaacacacaaaaaatcaaacctccaatcgaatcaaatctcggactacgaatcacaagccaagagattcctccgcctcaccattcgccgcagaacttgagggcgctcatggccatcgatggcttcctcctcctctccaattcactcgccgcagccgccgccgccttctcttctgcgctctcggctacttgtactcccgagatgcggcgccgcctggcaagcgggccccaggatcggtgtccccacacgtcagcgataagtgagggtacaggatacagtacgagatgggaaagggggtacacgtggcaccacacggtgggtcacatgccccccaacgccgcatcggatccgaccacctcctgggctcctctctccactaccaacctctcgcggagacccaaaccctagctcccaaatcccgaccagccgaagcatttccaacggaattcctctgttcggctcctcctcggggttcaaatcgagcttgaatttgtggttttttttggggagggttttttttttctttttggtgttgtttttggatgcgagtgtggcttggcagggttggtggtggtgatgccatgatgcacatgctggtggcccccgatggaggcggcggaggggagatgccgccgccgtacgggggagccgcggcggcgccgccgccgccgaggagcaggagctggagctccaccgcgacaacgccgacgacggcctcgacggccacgtgcggtgagagcttctctctgtgtgtgtgtggcaagtcacttgtgttcatgagttcatcggcggtgaggaggtgggcgaggtctcgtagcgtctcgcctttgcgtggtattcggggttcatccattctggcgtgctctggtttaagctcagaagattttgtttgtcctgttgcacgagtgaattttagtaaaagaaccttgggctttccatttgtcgtgttgatagttttactgtgtttggccaggtgcttgaggtgtggtatatccggcaacgcgacgccccatatgcgccgcggccctgatggcccaagaactctctgtaatgcgtgcggcattgcgtacagaaaggtatggctgcgctctaattttcgatacagaataccgatgagcctgttgtgtgataccatgttcagctataattcatttccgaggaaattttatagctgtctcttggccattttcctcctgttttggtgcattgatgataatctaaaatactaaatgtgtctatttctgtttatttactcaagtaatagtatgattggttttctaggggaaaatgagacgaatgatagaagctgaaccacctatagatgaagctgcacttgctaagctggttcctgaggtaggcatggaatttgagagtgaggacaaggcctatgaattctacaacaaatatgctggacatgttggttttagtgttcggaaaagtacatcacacaaatcttccggaaatattaccaaagtaaggacttttgtttgctcaagggaaggttacaacagggacaaaaaatcattggaagcaaagaagccaaggctggatacaagaattggttgtccagcgcggttgattattaaagtcacaccagagagtaaatacagagtcactgacttcaaagcggaccacaatcatcagctggcccctccttcgacaatgcatatgttaaggtcacagaggatattgacagaacttcagtctggggaagcagaattgtcagatgattctgtcatgacacctacaacaaaagcaaccggtgatcttgttgtgagacaaattggtttccttcgaagtatctctctcctcccagcagattataagaattatctccgttcaaagcgtatgaaggctatgcaactcggtgatggtggcgcaatattgaaatatttgcagacaatgcaaatggaaaatcctgctttcttttacaccatgcagattgatgaagacgacaagctaaccaacttcttttgggctgacccaaaatctagagaagacttcaactactttggtgatgtcctctgtctagacacaacttacaaaataaatggatatggcagaccattgtcattattcctcggagtgaatcatcacaaacaaacaattgtttttggtgcagctatgctttatgatgaatcatttgagtcatataggtggctgtttgagagttttaagattgctatgcatggaaaacaaccagcggtagctttagtagatcaatctattccacttgctagtgcaatggcagcagcatggccaaatactactcaaagaacttgtgcttggcatgtatatcagaactctcttaagcaccttaatcatgttttccaaggttcaaaaacatttgcaaaggattttagcagatgtgtatttggctatgaggaagaggaagaattcttgtttgcctggagaagcatgctagaaaagtatgatcttaggcataatgagtggctgtctaaattgtttgatgaaagggaaagatgggctttggcatatgagagacatatattttgtgctgacataataagtgcacttcaagctgaaagcttcagtagtgttctgaaaaagttcttgggccctcaactggatttactgtccttcttcaagcattatgaaagagccgtagatgagcaccgctatgctgagctccaagctgacttccaagctagtcaaagttatccaagaatacccccagccaagatgttaaagcaagctgcccatacatataccccagtggtgtttgagatctttcgtaaagagtttgagctgttcatggactctgttctgttcagttgtggggaagctggggcaacctctgagtacaaagtcgctccctctgaaaaacccaaggaacattttgttagatttgactcgagtgactgctcctgtatctgcacttgtaggaagtttgagtttatgggtattccatgttgccatatgttgaaggtgctcgattacagaaatatcaaagaattacctcagagatatctgttgaagcgatggagaaggactgccaagtctgcaaatgaagaaaaccaagggtatgtggcaaatggaaatggttcatcattaaattccattgtacctcctgcaaaccatcatggtctccaaggcttcagtgcaatgattcaagtaaccaatctgcaagattcattctccttgttttccccctgtatgtgctgtggctgataaagttttctatcttggttaactgcaggacactcctgtttctaatatgcatgagaattcatttcgcagaagctcatgatgcaggtatcatacatgattatgaattattaatatgccaatttgatctcttgttttgtttggactattactgagcctatctggttctatccattgcaccaaaacctagggcattgatttacaaccaaagtttcccccttctgagagatgcatgacaaattttttagggagatttagatagaatattttgtttgttgaatattgctcacttggttctggattttcctccttcgaggtacaattattaaagcagtttggcgatgacacgtggacaaacttagctctgttggatcaaacagattatttatgtgatcaatttatcatgcaggtgacttgaatctaaacattattccttctgcacggtgcctgctccacgatactggcgttgaagcagtgagaacaggccatgcggagctcccccgaataaaagtttccaacttgtaaattatgcagctgtaggaaatcccagctattgaggcgcccatcctacttaggctcttagactagattctggtatgaaatcatatgattgtgctgcccacctgcacccagggaaattttgtgcattctgtaaacagtctatttatcctagcccattcataaaagaaaaaaaaaggtgatcagatgccaatgcagagagattgctcctttgaaactttgcagggcaagcagacccatcatgatcatcaatcctaggagggtttcagttagattcagatcttggggtggtttcatttcgtttcatttcacctgcaggtgaggtgagctggacagctcatgcaataaaacgttggaagcaagacaagcccagcttggcagtgtggatctcaagcccggagagctaccggccgagctaggagctgcctttgacgctacagtggacagctgtgctttcaagcctggctttgggcgcatttgtcccatatgcacagttgcataatgcgtgcaaatgttgttcattgtcctcaatgcatcgtatatcttgggagcttcgataatgctgctaccaatgtgtccttgaaaaacacattcgaggtgctttcgtgctcgctctcttttttccaactctgtcaggtttcttttcaaacaaagttatttcagacatttttctataaaatgtctttgaaatatatacttccattcaaaggaagcctcaatgcgatcattttaacggttctaagtaaagtatcatatatttagtcttgttttgtgttacctctatggtgaagaggggcatatgtgcgctggtgcatgtgtttatcttaggccccgtttagttctctaaatttttttttccaaaaacatcacatcgaatctttaaacacatgcatgaagcattaaatatagataaattaaaaaactaattacacagttagggaggaaatcgcgagacgaatcttttgagcctaattagtccatgattagtcataagtgctacagtaatccatatgtgctaatgacggattaattaggctcaaaagattcgtatcgtggtttccatgcaagttatgaaattatttttttcattcgtgtccgaaaagccctttcgatatccggtcaaacatccgatgtgacacccaaaatttttcttttcgcgaactaaacaggccctgacttagtacctgtaaaagaaaagtcagtgttttcggcatcaacttatcgactgtaaaaataaacgatcgtgttggggccttggggattgaaaatgagatcttgaggttgaaactacacatccctggtcactttacacatccctcgtcacggtaacatctcatatccttgacaactgtaaaaatgctctctcagtaaacagtaaaattttgtgccgggcaactgtcctgatgataatgtggagcgattggctgctgtgccgtagcaatgtgtcgttcgctgttgattgctctgccgtcacgcgacgcatcaagcagctagcagagcatgtgacctgactatatgggcaacgtgctgtggctgctctctgcttttcttttcctcccctgcagccactgtactgatcgactgatatctgcttcctttgcgtgctttctccgtgtaaactcaagtaacaatgccattttttctcttcctttttttaacgaatattatgagataatgtaatatttcacattgatatagcaggaaaaagagccctaagagaccataattagaaaaagaaaaaaaacaaacagcaccacgtcacggaggaaagagtgccaatttttattcctcggtttgaaaaaatacaagagatagttcaaggagatttgtccaagtgttgcttgagtgcaaatttgacgatgcttttcagcttcagtctgaaggtgtgatgaaaattcaggagccgtcacatttgatcccggtcgttggtcggtcaatcttcgtcactgcgattcaaaacaagcaccatctgattatttctgcaatggttagtgagctaattggcatcaaaggctaaaggttaatttggatgtctcttttcatgagaagcagccaaggaaacaaagctgatttgtgcgttctctgaaaataaaaagacatgaaaaagtttgagttcaggtgcttgctccactattccctacttaactccaaagcaatgtcatgtggggagtctaatacgtgattatttcgcattaaccttaagctaagcattcttctcgccgtaatcactgacatgcagaaattcaacgtcctttcttgatggatacatcacacgaattgggtcaagtgtttgttcaagaaaaactccacatatcaagtcattttctttttctgatttagatcactgtcagtgtcaattgctagttggttagtgtttaattttgaggattacaaggggaataaatgctgaatttataccacgaatgacttgctggcagggtgtcattacttgtacccgaatttcagcaagattgtgtatttatgtgtttgtcagtaattgatttgggatgctatatgtgcatcattttcctgagtaatagtgttactagtacccaagttgttcatcattgctttatcattacttcaagtattatgaagaaacctgaataggagtagtacctgataagtatgccacccattctgttttttcctgaaactcatcattgaagcagcccctaactctgaattttcttttagacggatggtcagactaactcagaatttaatcatgatgtttaagaaaccattagctttattagtatatgtactaactcgagattatccaaacagaacaggttaagcaagcaaggaaagagagatggccccaaaatcccagataagtgacacgttttcagctttgctaatcacttctgaattctgacagggaaccaactaatcatctgatggagatggacacgaatcttaaagctcgacctgatcggattagtcgatcaaatctctggaggaaaaaagaaagaaaggtgatcagacaaatggatgatggatttgttcaatcccacgatatgcttgcaagagtacaaagcaagatacttcctaatcggagcatcaacaactttctattaaatatatgtgagaagaacactttggtcactctccatcttgtctttggcgtcggctagttaattacttttggggggcaaaatggaatcacaaatgtttttccatggaccacatgaagcacaagggtataaattttcaaatacataatatttgagggacctatttgtaattatgaattagatattatttttttttataccgcaacaaagtcaaataccagaggtgtacagttcctgtattattcagagatatgggacaagagatagagctaattaagaagttcagtcacaaggccaggctgacttgacagagggagcatacaaagcagaagactgtactgaagaatgttttaatgtgccatgcacagtatagcatgttcagattattagtttttatttgttttttcttttctttttcttgtctctttgaccattactgtgtgcagtgtgccatgctaagctcaactcctaccaattgtgtcggtttctttgttttattaatcaatcagttgcttggaatcatcagccagtgtttcattgagagatgcacccctcacatttttaatggtagatatgtactcttttcttcttgagaaactgaaccttgtgaagaagtgtgacccttattttaaccaaggaacaattggttaaatacttcaaattagttgctacatgcatgttcagattgattaaaggatttttagaagaggggggggggggggatgcagtggatgttattttctagacatagatctaattgacaaagatccaattttttctcctcataattgcctagctgtatattttgcacaatgagtccagaattgatgatcagcaatgccaccaacaaaccatgactaatcaacatctacagtactatgaggcaggtgatcaaaccctgtcctggagttgacctgctttaagaaaagctagatagggggtgaaacattgcaatcttataaacacaattagcagtaaatttatccatgcacatgcactatttgtgatgcaatactagcttacagtgtttatgataaaaattatagaccttgtatctatcaagtcaaggttgcatcttatcactgtttgttagaaccgagcacatcatgtcacctgactaggacttgacttaattttgctacgacaacgataataaagtttcatgtattatcaatttgtcatgaaaacaattgaaatttcgtgtaagcattcagtgggtcagagaaatttgtggtactgttttcttttccttaaaattaaagaaagtttccaatgttacatcacaggaacctataaacaaaaccaaagtaatggataaatcaatgtttgttagaaatcttgagccaaaatccaatgacctcatgtgaaagtgactgtgtggggtaatacatgagcctaatgttccaactactcactctattgtaccattactctgccccactgtcttttttttctctcccagtcccttcatatgatttacaaacagtactaatgcaaagacattttcattcttgagagatgttacatctgctgctaatggaggttaagatgaagatttgctataataacctagaaacaagtttgttggttctgttctaagggccatggttatgttataattattctagattaacttgattctgaaccttgttgtctgggacaagctcccttggttgcaattctcaattcctaagttgttttcaccgacagagaggtggaaaattagcatcatgttgcatcatggttatgtgagttactgtttctctcatgttttttttttgagcttcccgtactatttgcacattggattcctttttttctttcttggtcttctcgttttctcaaaaatcaatgaacatcaaatgtcggtcaacagcaagacctagatttttgggaattagttttggaaaatattgccaagagaaaattggaaaactaatccttttgcatttgttccgtactatatgcatctttttataaagaggctgagagtgttctctgtacaattctattatctttatataattaattgagtttaataaagcttcaattatcgaaacaaatctaccatacaatgcattgattaggctaatttagaagaatattagggtcacttagtcacaaataaaatgctcaaaaatcttttaacacaaggctgggctagctgtcactgtttacccctttggggcccctgttaattgtctagaacaatcggtgcatgatgcttactccaggtcagatgacctgatgtttagtgcagaaaccaagaggtgctcaattggaccaccgtttatcgtaccagcctctcttttgcctgttggaaagaagaaaagttgtggttgacactacagggatttttgggtcgagaaaataagtgtaccgatttccttcaatcctcccttgtaagttactagtagtatgttggtaggtgagtaaaaatgaaaatttctatctgttcctattatcaaattacatt

SEQ ID NO: 45365 - DNA, 1092 bp, Oryza sativa
taaagattatatatgttgatagcatagccgatgttgcagatctaacatgtatcggctaatactccgataccactaagatatcaaaatagacaaaatacattaaacatggattaatcaagtgttaaagtagattaacagattaataacaagcttaatatatttaattacagtgagatcttgatataaatggcaaatttagcatattaagtaaacctaaagtaaacaaaataaccaaatcaggtaagatcggctgaaaccccgatgaaacccaaatcggcaaccaataaactggctagagattgatattctaattacgacttataagatcaaacttaactgatgtagcaataactatgaaaagaagaacaatatctagaaaatcaagtcattggatgaatcatagagtggtagatatgctatattgtaggatcgaacaaggccagacaaacctaccagaggggggtgaatggtagggaaaaccaaaaacccaaaatcttttgcggaataaaagattacctcgaacgaagttgattatcgccggtcgaaccgctcaatcaccgccggtcagactgccgtattctcgccggtcagaccgtgtgcacacctacgatcagattgctgcactcccaccggtcagaccaccgccctgcctgcggttagaccgtcgggacccagaaacaccggtagatgacaaactcgaaatgtagattagaacttttcgactttattgcatcaactagtgtttacgaagtgcaactatagcactcctcaccaagatctcgaattaaacttaaaaccctaactttctctcaacttgtatctcactaaaactgatactgggagaccacaacctccctttctatttatacatgaggtaggctgtgcaaagcccacgaatctaacacaacttaggactcctatccacgtaggaaatcctctcttgcaagtatccaactcatccatttccttatctctttcaatcttcccgaattcggactctcctccaaattcgactcctctttccatatgtacacaatccacttgtataccctatgaaatcttcatcaccacgtgcattatcctctagccttt

SEQ ID NO: 45366 - DNA, 996 bp, Oryza sativa
attgtcaactgtaagtgggtttatacagtaaagcaaaatcctgatggaaaggtggaaagatacaagtaaggttggtggctaagagatatagtcaaacatatggaattgattatgatgaaacttttgcaccagtagcaaagatgagcatggtaagaactcttatatcttgtgcagctaattttgattggccattgcatcagttagatgtcaagaatgcattcttacatggagatcttcaagaagaggtgtatatggatgtcccacctggatttgccacttcacaaactaaaggaaaggtgttgagattgaagaaatctttgtatggtgttaaacagtcaccaagagcatggtttgatcggtttaggcatgcaatgtgtgctatggactataagcaatgtaatggagatcatatagttttctatcatcatagtggagatcatataaccattcttgctgtctatgttgatgatatggttatcactggaaatgattgcttggagataactaggttgaaacggaatctaagcaaagaatttgaggtcaaggacctaggccagttgagatattttctgggtattgaaattgcaagatctcctagagggatagttatttcacagcgaaaatatgtattggacttgcttagtgaaacaggtatgcttggatgtcgcccagtctctacaccaattgatcaaaatcataagttatgtgcggagtctggagatccagtgaataggaaaagataccaaagattggtgggaagactgatatatctatgtcatacacgacctgacatagcatatgctgtcagtatggtgagtcgatatatgcatgatccaagaagtggtcatatggaggcggtgtatagaatcttgagatatctgaagggaagtccaggcaaaggcttatggtttaagaaaaatggacatcttaagatagaagggtattgtgatgcagattgggctagctgtcttgatgatagaaggtcaacttcaggct

SEQ ID NO: 45367 - DNA, 6450 bp, Oryza sativa
agtgagttgttgtggttaagaaatcttctagttgagctgaaaattttggagaacactcccatgaagctattgtgtgataataagtcagctattaacattgctaataatccagtccaatatgatagaacaaagcatgtggaaatagatcgtttctttatcaaggaaaaactagacgagggagtgttggaattaggatttgtaacgtctggtggacaagttgctgattgtttaacaaagggcttaggtgttaaagagtgtaattgttcatgtgacaagatgggtatgatagatatctatcacccatcttgagggggagtgttgggctgtaaatagactagttatgtgtgtgtgtcttgtgtgctggcccatctattgaagagggcccatcccatgtatatgtaagtgagaatggcaatagagaaagtgaagcttccagagaaaaaatcacaagacttcattcctgccactcagataattcacagcgaaggtgggtaatagcaacataagcacagttttgcatagcagacttactatcccaaccataaccagtgtattggcgatccctttctaaaggtgttctaccccgaatgcttacgcgagccatgactgcagtttgggaggtaccaatggacttgttgagtactatgtggtactcaagtggataggtgaaacgggcatattgcagcataagccagagcatgtgctaagttgagtttccaggtgaacccgctgcagtagtagaatggcgtatacatggtaggcatctacaagaacaaataaagaacgaggattagtgaaagaacctaggtgtttacatactttgccatttctttaaggctagctagtcagaattaaattcccattttaccaatttcaagattttatctcctggcctattattacttttaaatggtttcatgttaatttctaggtttacatgaacaaggtacactatcccccttaaaatagaataaaggtttgttctaggtcttattaacaaaacatatagatgggaggtaaaccaacttttgtgctagatgcagtccttcatagattagtgttgcaagctgaagctaaaggatacgttttagggttgacaagctatgaaaaattttacctttgacatcctaacaaatttgtctatggttcaagaagaaatggtgatttttggtgaggtggtttatcttacgggcagtgttttggatgaatgatgcagtgctgtaatgtgtcggcctactgtttcgtctaatatttgagtaaggttctgaaggctcaaaactttgggtaaaaatcggggtgatgggtatgcaagattgtaagttaccttaaagaaaccaagattttatcacttataatttgggctacacaaatttttcaaccgggttaccgactgttttcatattgggactgcgcattactatatgaatttttatgccatgatatgcaatctactgtgaaaagatgcacattttatcaattaaggtttgggctacacaaaatgttgaatgcaactgttgacaaattccagaattttttttgcaaatccgcgctagtacataggagtagtttgcaaatagatttcaaagcttttcgaaacattttgactgattagttgagattaacaggtgatttcaaactcaattttatagagatgcaaacttttaaaaggtttcgatcctaaagacaagataagaattttcaaaatttcaaagtagaaacataagggaaagtaatctctggagaagggtgagatataaggttgaatatggttttcgcaaataatttgtaactgagagcaaagcccacaaaataattttaagaatccattctaaacgaccaacttaagggtttcctatggtcggtacttgctctgataccaatgctgtcgtaggctgtcctgaccttccattatattcgaaagatgaagtgattatatttcaaatcatcaatgaacataatgaaacgtcttaaaacctcgagagaacattattcgaaacattgctgggcctttagcctgccagtcaacttcagcctgagatattctcgtcaaaccactcgaaggcggcgaccagatgtgttacacattcaggagacttgacaatatgactaaagatctacaacaacttaaataatcttaactcatactcatgtgaatccccaggatgtgcactagattcacactttcatctcaagcatagatatacatagcaaacacaaataagagatgaaagcaattacatctacatctatgattagaaacaatggctgaccggccaaataaatataagaatagcggaagcttgtctatccaatccacaagcacaccgactaggggtataccctattaagttcaactcctagaagaatcaatcggaacccgcatcacttaaaggctaagtctaaacctgcaagcaaagattatatctgcagcaagagtcagtacattaaacaagttaatgtactgacaagcacaaatcaatcctaacatactacatgtaaggcatatattcaaaggagggcaatttgtagttcattttcagcataaagcaagttttgtttcacaaatcttttgtaaaagagttgacagttcaactaacaaaaacaagttttaattttcatcatttagttcatcgaaattccatcataatcgaagtcttcttgtcatccatgacaacaagtcacattatatcaccacactcacactactcaacacatttcatcatttccaaaccatgtcacatgttcacaatttaaaacatagagtctatactcatgacacttcaccaaatcgctcttgaccgtgagcacggctaatcgattaattttagactctgcaaagtttgtacagctttatccacatgatgtgaatcactctagtttgtccggtacccgtcgacaccactatactctacacattgagtacagtctagaggacacaatgaagcctttacactacttaatatctagctttgcaccagcacgatacgtgttcctccatcctaggcatactggaaataatacttagaaccgttaaatggtgggcccacaccttaaacttaacaccgtggtggcggacacgatgggaacccaccacgtggcacaataccgttgtattgaacaggcttagtcacctaaactaccacgtcggggcaaataggaagctcctctgagttattcgaacccatacacactagcctaccagaatgcaaggcttgatgctaagtagattaattagcttaggccatcccatactagcacatgtggacgtacgggttactttaagttggtgatacaagttcggtccttatggacttgggcaaacactccccctatcggtatgcaactaacacaatatgaacaacacttgctacccaagtcaaaatcacatttttacacattttagttcacaaatactcatcacattcattttattccagcaagtatccacatatttaaaatcacatttgaagtgtagatggaataagcatttgcttatttctaagcatggctaagcaagtagttgcatatagagcatatataaactcatttgagcacaagggatgtactctaaccatttctaagggtacaaacagcatggaacacaattattcaaaggagggaatgcatcaacttggccatagctaccatattcaaatttttaaataccgatatagtctaggttcacatgcaacttttgcaaacaaatattttcattcctcaaatcatgggattcaatgtgttcaaaggttgggaggagagaacttgccttgatccaaggaaatgttagcacctaatcctctctgttgatggtcgttaccgacaaagttcgaccatcaatttaactaaaataatggagaattagctatgcttacaatgcattttatttctaaataatatgtatttccacttgtacttggaaaataacattttgcaggaattgccaaatacaataaaagaaatgaggaaaactcactcccaagcaagccatggataagatggtggcccacttgtcaggtgtaaccgtcgggaaacggttttaactgcttaaccgtcataaggtcccacctgtcagtgccctggccaaggttggaggcctgctgggccggccaaggttcggccgaaccgaactctggctgcagcggcgcagctcggccctccacaaggacgtccaggatgcatccccaatgacggttacaggggcaaaaccgacaactcacctttcaataaccgtcataccggccctataaatagaggagctcatttcacttcaacacacactcaagcaagcaatttcctcttcatactttagtattaatagtttagtgctaagtggagtagaaatagaatagtatttggagtccctcggagtcttcggaagagtttcggtatggctctagcagcttttgtaatctcttctgtagtactttctgaattaatgaaatattcttctttatatatccccggtattttaacacgctgaaaattcgactaacaaaatcaaaaccctaaaaatacggaccttcaaaaactttttaaataaattgcatcatgccggttttattcgcctattttatttggatttgatttcggagttcattaatcgtgagtaaggaataattaattaggaataaaccctaaaaataaattgtcaaaataaataattgaaatataattttaaataaagattaggtgaggatagaaataaataaaatattatcgcaaccatattggtaacaattaaatttaagtgcgatggaataagaattggccctaattaaaaattcaaataaattatataaaaataaaatatgggtaaaattaatctagggtgaatcttttggttaaaatagcacaaatattgagtaaactccatttgtgcaaaaattaggatttatagaatgaaatttatataggaaataggctaaattagggataaataggactagcactgttcattgtgcagtaggtgctcgatgaggttccctagccctgccccctcctctgccgtgtgcgcctagccgccccgagcgccacgcccccgtcgccgtcgcgtcccgtcgccgctgctacgccgcgcgccatcgccgtcgtgtcccatcgccgctgccgcgccgcgcgccgtcgccatcgttgctgcgccgccctagccggcctcgcgccccgagccgccttcgctgtccatcgccgtcgacgtcccatcgccgcgcgcccgtcgccgtcacgcctcgcgccgcgcgcccgccacctcgcgtcccgcgcgccgcgcgccgtcgcatcgccgcccgtcgccttcgcgcctgcgccccgccgcgcggccgtctcgtcgctgtcgccctgcgccactgccgcgccgcccgtcccatcgcgccgagccccttgccgccgcgcgcgtcgagtcgccccgcctgtcacgtcacgcgccgctcgcccgtcgccgtcgtctcgagccccacgtgccgcgccgtcgcgtcgccattaagccggccgcccctccccgcgcgctataaccctcccccccggtcgcccttccatcccacaccaccccagccccttttcccctcttttctcctctcttcctctccaccgcgccgccgcccttcgtgccgccgcgccatgtgtcaccccgccttgcgccgccgtcgccgccgccgtcgtcggtaagccgccgccccctccccttgttcggtcgtcgtcgccgcccgggtaggcagagggccgagagggaagaagaagccgggagagagagaaaaagagagaaaaagaaagaaatgaagagagaaaaaagaaaaaggaaaggtaaattgaaattagggagagattaaggaggtttagaaaattaaaataattggggttagttgtagatttcttttagttgtagaattgcaaaattttatataattatagattattttgggtaatctctataagtaattaattcgcggtaaataatcggatttaattactaagaattgtattcttcattgaattttaaagaagatacttctaaatcacaaaatgacttaggttgaatgagcttaaaattggaataacgacatagcagatggtttctccactttggctagtatgaggaggtgaagattccgtggtctgcaaacaattgaagtggccaaatatcaagagatatcggttagcaataaagaatttgacaaaaggaagaatacttacttgcggaaccatctctcagaacatgttagtcaggtatatggaagctgattggtgaaaaagatgttttttccactctgcccaccatcggttaaaagttgaactcctcatcaaggctagcacaatattatccatactgcctagtgggggccctgggatgttcaggagtctatccatcatgagggctgatgtgatttctcccctggtctggatcttgtccacgaaatataagccgattgatagctgacctatttcaagttgtctagc

SEQ ID NO: 45368 - DNA, 10376 bp, Oryza sativa
catcctcgacggcacggacgaagcctactcctcggagaaaccttcatctgacacatactcgtgctctggggttgggaaaaattagagcaagactgagtactacccactgtactcagcaagtcatactggaatagaggcatgatgcagggaatcatcaaagaagagctaaagtggtttatttgcataaagtgagcatttataaacagaagttgaaagattaaacagttgtaataattaattaatattaactatccactgtccaacgctatcccatgttgcaacaggcccaaccatccacctaagctatccaaattcaaaagattacactagggtgagactaatcacggtgaatctggttgaccgcccataaccgcgggcacggctatttgaatagttttactctgatcagaggtgtacaactgtacccacaagacacagccccacgacacgtttccgtgcgctgacatgccaccatgacataccggaaagaggtcgtgacaggaccattagcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgctacaagcccagccgttgcccacgctggcttgtagtaagtacgataagttcttccagggcatcccgcgaaccggtccttagctgccatgggtgcgaccagcaaaaccatgcacccacagcccaccatgtgatttattttaattaaccaacaccaaagcggtggcactaatccaacaataccattagaaccgacagtctaaacattaataggatcttccccatttgtgaactagttgaactaagcatggctaagcaatccctagtccaatctctagtcatgttataaccccaagctgacaaagggacatggtacaacaatagcatggctatgacaataggtaaacatcccatagtaacattataaaacaatgcaatatttgaaagaaaacaatagagcatttgcaatataggatcaacatgttcaagtgacaagcatgacttgccttgctctgctgctggaggaacctcggcgactatttcgaagtacaccgaagcgtcgggggaaccggaatctagcgacatacaaggcaaacattgcaaacagactataagactactgaaacagggaacaaaaccatttttaatggattctacacatttttcttgatttactgagacttgaatgggcttaaacggagctcggatgaattagttatgaattttagaagaatcactgtgtttattactataaaagaaaaaccttaaatcatttattgcgcaataattcccagggctgacgtcagcacggaggggggtgtggtgccggcaagcggggcccactggtcagcggctcaggggggcggttcaccgtggaccgggaccacgcaggtggtccaccgccggtccacgggaccgacggcccagatcgccctcaggccgattggacgggcggcgataaaggcggccgccgggctcggctcggcatcaaagccgaccggccggccagggctagcggcgacagcacacgcgcgcgaacgcgttgccggcgacggcatccggcggcggaggcgacggcgcaaaagcgatgcgaaagcggcggcagcggacggcggcaacgaccgaaggcgacggcgagcgcgagcggcggcgacgcacggggaatcggggaaggaaaggaaaggggagggagtcctcaccggaggggacggcggcgaccggcgacgaggagcgatggagggaagtcgacacgcggcggacggcgaccgggacgacctaaagaacgaaaggaaagagataagagaggaagagaggggccataggagacgggaatgtcggccgaaggcggcggacatggcaaccctcaccgtcgcacgatgggaatggcgctccggcggcggacctcgacgaaggaggggtggacggggtggatctcggccacgcgaacccgacggcggcgacggcgcggtgcggcggcgagcctagcggcggctagcggcggccggagtagcggaaacagcggcggcaagaggttgcacggcgcgggagcgatgggaggctcgggagagttcggcgaaatggggaaaaagcgagagggggcgacggcagagcttaaatagggagagagggggccggacgtggccgggagaggcgggatttcgccggccaacgtgggggaagtgggggaggagagagaggcaggattcgaaaatcgaatcccggccatctcgggcgcgggcgcgaacgggagagagaggggagtgggcgcggggaacgcggcgcacgcgcgggcgtggtcgacgtggcccggaggaggcggagacgtgggcgcggtggcgcggcgggagcggcgggaggttggggaaggacccgacaggtgggccccacctgtcgcgaccccgggagaggagggaggggcggcttggctgggcctcggcctgcggccggcccagcagggaggagggggaggaaaggagaggatgggccagcgacccattcgaaaaagggagggaaaaagaaaaagaaaaaaggagaaaaggattttccctggaattaaaatattgcttgctccattttaattggttaaaattatttcaagagctctgaaaattccactaaaaatcctgttagtgaatttcgacatttagaactcaagaaaaattccacatgccaattccgattattatttgcattgatttaaaaggggtttactcttgctttgcaccggtattttcttagggtcatttataaattaaatttaggcttgggaggagaacttcggggtgtgacatttagccaccttgatggtatgaaggttgagccatacttgcaaaagccaccaagggccaccagtgccaatgacagaatctacagcaatcttagccgatgcagaattcagagtttgatacaatgagcctagcagatatttgcccaaggggaattgcttcttgtctacaagggctttggctatgtgctgccagttggtagtagggccacaacttggaccacagaacaagaacttttccaaccacatcattagaaaggctgtgtgttccttaggggttacagaaccagttcccatgttctgggtgatgaagccaatccaacctccgatgctcctagttttgtaagagaatttgcccttggtattcatactaactgggttagccgatgatgtgatgtctaagtccatgatcatgactatatccaggagagttggtgttattggtccttggttgaataaaaaagcattcaaagtattggactagaaataagctgcagccgatagcacaggctcatctctattcatatcggctacagtgaggactaggcactgttgacagtcgttatcgaacaatttcgaccgtccatattacccaattaatgaagactagctatgcttgcaatgcataaattccaattaaaatgtctatttccactatgtactatgctactaacatgtatgcaggagaagcacatataaatggaggagaatcgacggaaagcaaacgaacgatcaatcggaagccatcgagaagcaaacttgtggacagatgggctaataatacagaattcacacgagtaaacaagcctaataattcacatcagtggattgaggaatcaacaagaagtccacctacaaagttgtgggctgattgggcttggccagggttcggcctggttcggccgaaccagtagctagcccaattagcccaattcttcatcagctggtagttatccttgtcccaaggcggttatgaccggttaaactgaagaaaccgtcactggacacatgtcacaaagagatgaagctaaggagaatatgctccttggatgcttggagcatatccactctcccaaggcaactcatgtcacactgttaacgaccaaatttggtaaatcaagtatcggaattggagataaaaccgaagcagaatcaaagggaattaacagtttcggaaatagagtacacatcggctggggtccgaatcggctacaatctacattggtagagtttaagtcggacagggtagccgatgaagtcgattccgacaatatggcgatagaaacattgtcggattgggttgatatgcttcatatcaattgccacgcacggattgagtcctaagaaggtaatttgtatctattaattaggatattttatataattttcttgtactttgagtcggtaagagtccaccttaaggacttgtttgtttcctaagttgtaatagagttaggagtcgtgtccgacaagggcatatcatgtattttgggtataaaagtagcccaaaaccagtgtaacaaagtaacaatcagttcaataacactttcgacgcatcgccaacctttcactttcgtttactttcgatgagttcttgctttcgagttgggctgcatcagtttgatctccgacgacaaggtaaaacttgttatggcggtttgtgttctcgggattagtggttctatcttcatgatactctaatcttgtaatagccctagctcataaccaggtatttagaagtgcatttgttgtcttttagattgcatatttactatattgcaatttgatcatatgcgataacaaaattaactctaatcggtaaaattgaaaccacttctatttgaacaataacttgaacagaagtgtacatgtttaataatttattcaaatactagtttatttatcaccaacaaatataaattttgtggaatttttcctctctttttagacctcctaaaaattcaaactaactttcagattaactgaattcactttttcactagaattatttaactcaacattttttagtgaaaccaattggattagaaagcatgttccaagacccatctctggaccagaggccaaaatttgaatcccctcctaagcaattcgaattagcaggtcatgagtgagaagagggaataaatcttagttttgtcttttcttcttgtctcttcctctccaacccctctctctttgacatgtggatcccaccagcagtccctggcccacatggcagtggcccaaccctctcatactcaggggacaagcagaagaatagccatgccacgttttggccatgcaagggagagagacaagtgtgacacctctctctttactctcccttctcctctaagcttctggccactttctccactcctcccactcccttccagagaaataaacgcaaggtgagagcacctcatttcgcccccatcttccttcttcctccttgctggccgagagaacttcgtcgtcgccgccgtgtttctggtcgtcttcttcgccgtccaaccctcgttccctgctctcctatgcatgccctaactcccctcaaaatttcatcgattttcatgcagtgaatctctgggaacgcacatctctttttggagccccggagcgcggccggtgtcgtcgcgtcacccaagcttccagtgttcccgacgttccaggccgagatacagggtggtgctgctcattctaattcatcttcctcccagatgtaacaccgtcaagaatcagcccaagccgagctccaggcgtggagaacgctcgccttctttcctcagccccgatctagacacgttggctttgttcctccctgtccggtgagctccagatcctttaccttggccaaaaagactctgcatgcaatgttctagctcattcaagcgtttatttggggtttttatggccagatctagtcgttctcgggtcctcatcgtgttcattgtgttgccgggcatctccaacgccgtcgatgcttcctggacctctccgacccctttcagctgcacggtgagacactgcatacccctgaacaccccatgcatgcacccatatagcccattcagagctgtagctcgacacgcatgcacataccaagaaccaccgccgctgtagcttgtttttcgcgagctacagaccaccgctgtagctgtagcttgttcatcagcgcggacacctacgtgttcgcatggtcctcctctacagtttctctgttgaactcgaccccatccgagcctccgttcgccgtcggcaagctctagactgagcccagccatggctgcctccccgtgagctcgagccagggacctcatcggtgaattagataaacttgagggttttttcccaaaaaacagaccaagacacataacactgtagccttgaccactctgtaatattcaggaagttcgaggactcttaatggaaaactgttttcaacatgtgctgaaattgtactaacttcaaaaatgtgtagaaaattcatctgaactccgtttgagctgaaccaaatttctatggattaataaaaacgtgatctacaatgttgtaaaataaaaatggctaacttatgtactggtttttcctctaaaattgtgaatagatctaggtatccttttagtagtctagatcttggacaatgcataagtaaatattggaatatgataaaaatataaaataattttgttgaacttgtaaaatggtactcttcacttctgtggaaaagatcttgacaaaactacctcttaaatcatgcttagaagtttatttagcattcctatgatttaacttgtaaaatccataaataaataatgacaacacttatggttgtgaaataatttttcttaggacctgtgagtgatgtactttactctaaaaataatcattattatgaaatcttggtttgaaatgcatgttaattgtaatgtactccctccgtttcgaaatgtttggcaccgttgactttttaagtatatgtttgaccgtacgtcttattaaaaacttttgtgtaatatgtaaaattatatgcctatataaaaatatatttaacaatgaatcaaatgataggaaaagaataataattacttaaatttttttgaataagacgaacggtcaaacatgtgttaaaaagtcaacggtgtcaacatttcgaaacggagggagtactaaaggaaatattaatatttacagaactgccatgttcagtactgagagcttatcattttcatatctcccaaaccataagtgataatctgttgattctttcacctaaattcaagttaaaatatgatctacccactgtatttatttcatagtttattgatcattttgcatgtgcatgtttacttggctcttattcgtatattgcttcttttcgatagattcggagattctggagagtaacgagccatatccagaggatgatagtgactaccctcagcagcaaggcaagcacctaagcatatagaacctatactttctctaaaaatgatttggttgcaatctatacgtatatatatgcatgcattgcctagatattaatattatcggtttatggtgtatgggtagaacctatttatgcatttagttcttgtgatattgctgtccttataccctactgccactggtcacatcatgcacgcacgtgactaagtcgtcgggaaccccagcatgttataggtggttggggtggggctaagaatgggcatgtaatgagcttgaatcacttgtgtaccacactcgacggggtgtgtagcatttgatctttgttcatttcatgtgggtccagttgtacacctctaatcagagtataatctatttgaatagccgcgtcctcggttatggacaatgcttgatgtgttagtcagttatgttagcaccaaatatggattattatggatgggattctatttgatggtggtgttgccatgttgtgccatgttggtatggactttggtagtccatggttgataatgagagcgccgtttgggctcatttgcttatacatctcagaattatatacttgctgtccataaataaaaatgatgctagatttacttgtccttacttattttactcattaattgctcaataaaattagctttatgcaaatgttgaacctagagacccactgttggctagaaagcttgcatacttctctctcccttatgtatatttaattttgggtaagacttgcgagtacaatcttgtacttaacccggcgccgctgtttcaggtgaggataccggttatgagttatgcttcttgtgtggtcattgctctgccgagggcggcgagggcgatgagtgatctcttgcagtttggctcttgcccggttggtttgccctagtggggttgtggcaccaccggttttatcttttgcttatgaactctatttgagactttcgctgctatatttatgtgttgtatgttgggacctcggaccctattatgtgtcatgtatcttgctgcacttaaaccctattatggtacttgctatgtttactaatggcttgcgatgaaagtgtgaggctagtcgcattcctggggactagctaagcatgagtaacaggttttgatcgcttgagatacttggggatagcgcttttggatcgagttactggggtatgtttttggtcgccgccttcatatggtttgacgagcatatgacggagtggactggcaagctatcttatggttatctctcgcagtcactactcggcattccggttattatagtagaaggtgtcaactgtgataatggacacattgaggatgagtggctatttatgcgtgtatagatcccacttctccaatagtatgtggtggtcgcgttggacactggatggtataatactagggatgtccacaaatcttgtttatgtgaatcgtcaagttatcatatattctatataatctagatcaatattgctatctaacctcaaatcggctaacatctatcactggaaggcggccgattaagctagatctcaatgttgacttagattatatagcatatccaccactctatgaatcatccaatgacttgattgtctagatattgttcttctttttatacttaatgttgtatcagttaagtttgatctattaagtcgtgtttaagtcgtgtttagaattataatttctagcctgttaattggttgccgattagggtagtatcggggtttcagccgatcttaccttattttatgtttacttgatatgctaaatatgccctttatattaagatatcactgtaattaaatatattaagcttgttattgatctgttaagtcatcttaacacttgattgatctctatttaatatattttgtttatattggtatcttagtataaagtggtatcggagtattagccaatacatgttagatctaaaacaccggctatgctatgaacatatataatatctgattcaagttacttttaaacataagtgatttatactatctcggcaagctgtccgatctatcccaatcacttagtttaaatatatcttgaggtatatattatatactgttgatatctatagccgatcgactaggtctaaccttccttttaccttatatttcattgctgatctaattcacgttacatcggctaagttacaattgatatgtcatcggtgactgcccgatcggctatcgtttatggatttaaatgtgtttctttatttcttgttcgttgcaggatcaaaccaactggcataccctcgaactcgaaaccaagatttggacctgcactagagttaagcatatctcaggccggtgtgtgtttttcgcatcaacacacaccctgattttcgtttcaggatttataaattatttaataaattatttctacaatttatattaaatattcattaatttacaagtaaagttaaatgtgggaaataaaatttcctaaatgttaagaatggctagatttaatttttattaaattctctacgattaattatactctctggaattttctcgtatttttcggagctcaaatcctaattttaataatacaaagagcattttagcaattatataaatactaaatcctaattttaatcattaaatggtctgattataattttgttgaatactttgagtgtccaattattttcaggatttttcttggaattatgtgagcgttggaagtatagttaataaatgaaagatcatttcagtatttatttaaattgaaaaaaaaaatcaaaatcctcttctatgccttgggctgaatctggccgatctctctccttcagccctgccgatccagcagccctctccctctctctgtcgtagtctgattcgcgtcccttcttcaatcgggcctagtgaaggaaaccgcagaaaaagtctagtgtgactccctatcgctacagtgccttcttcaacctccagccgcccagccgagctcgagcagccgccgccccctcgccaaagggctgcagg

SEQ ID NO: 45369 - DNA, 9437 bp, Oryza sativa
aattcctgcagccctaatcaaatcaaatcggattcgaatttctctttcctaatcaaacgctaatccttccatgtcgccgccggcttgccatagccctccccggtgcctcttgacccatataaaaggaccccctgggactcctctacccctcatcacctccaccttcgcccgccgccccctctagcgccgttcccgcgtcgtcttttgcgccgccgccgccggagctgcttcagctgagcgccgccgtagcctcggtcgccgcagtcgcacggggttcacgtccacgggttcgcgtgaccgtcgccgacatcgtcccgccctccgtttgtgccgcaacccgccggagcaccatcgccgccgactacccgaaggccgccgccgccaaaacctcgccgccgtcgccgttcgtcgtcaatctcggccgttctagccaccggtgagttcgccgcgttgtacttttcgcattagtgccctccgttcgcgcccttatgccctagatcgctggcgaacttcgtttcccgagccaccgtccttcatcctctttttccttttatttaatacattaataaattagtaaagtcttttctgtattaggcaaaaatcatattaaacttagaaaaatcatatctaattcattataactcggattaatgtgtttcaagttgctaaatttgtataaaatagagatctatattaaaattacttataaattgtgttgttaatctgtttaatccttttaaataggttttaattgtattaaatcttgtaaaattcataattaatccattggaagtcagaatgaggccgttcaagtctcataattcatctaaaatcatggtctacatgtttatttactttttacgtactgtttatttggagttccttagtttttttcctcgttttgcgtattagtttgtcgttttcgtcgtttggaaggatcatgagtgcatcggaagtgatccagaagactaattgaaattattgcaaggcaagtcacacagatactaaacacaatcctttgagcatgttgaacatataattaaattctctttttatttcaaatatgcatttattttcgaatgtcattgggtggtgagccttttccctatattatggccgaagatttattttcctgtgttataatttgactagcttgggccttatatattggttcagctagatattagatataattgcttagccatgcttagaagtattagttaactattggggataactaatgcttcattattacttaatgattgctatttaatgtttgcacacggtggtcaatcgtgtttggttaattaattaattgccaattaaaacttgattaatggtgggttgtgagcacatggttttggtggtcgtgctcatgacaattaaggaccggttcgcgagctactgttgtgaaacattaaccatgccaaccacaagccagcgtgggcaacagctttaccttttgtatagcatagtttattacggggcaagagactgagaagtggtggagataagcccacgggggtcactgaggagtccatgccttgttttataaaggggtgactacgatccaggaacggtgcgctgtggtgagttgtgttgtatggggtgtattgtcacagctcctttcctaggtaccatgatggtattgacgcacatggtgggtacggtggtacatctctgtccagagtaaaattattcgaatagccgtgcccgcggttatgggcgggttgagcaatgtttttcgtgattagtcccacactactcactaatgtgaataatgtgatacttgatgattattaagaatgctaggtcttttgctgtgtgttactctactcttggattattttaacccctatatagaccttgatgtacacaactaatatataaattattagtataattctctcttatcatatcttccattgggattaaatacgataccttagaatacttccgggtgaaatgctacaatggtacattcgtgcgcttgcggatcatatctgtaaccatagtataccgggattatttctagtgctattgctgagaattatatttccagtactgtcgctaagaaataccaacaagcatttctagcgctgttgtcggggaagataaatcattcagagtttactacttgctaataattttatatttacctctgtataatcactatcctatgtaggcaaaccttgtatgttttctcttttatgtgaaaacagggtagtacaagactagttctgatctgccaaccaatttcaatcttgagtcacttgtggagcgagcctcgaccccgtgttgtccctcctcaagttactctatcagcaaccagaccatccattttcgtgccactagagtttaacgatatggctgggaagatcctccgcaagttcgcagctccctccgccgacaatgtgcccgttggaccctaagtcagcatgggagatggtaactttgaagaccagcctaatcacgatggcgcaggtttaccggttctgtggcaatcctaacgaggatgcaagtgctcatatgcaggaattgctgaaaatctgtagcacggagtcactccagacactatcaggctccgactgttcctgttctccctcctcgggaaagcgaaacagtggttctacgccaactgtgcaattgtgaatatccggaataattgctcaacgacattcctctcaaaattcttcccgatgggtaagaccaacgctcttcgtggaagaatatccagctttcagcagccgaaggatgaaacaactcctgaagcttgggaaaggctgcaggaatatgtcaccgcccatcctcatcatgggatggacgagtggctcatcctgtagagttttttcaatggattaaccccctcatcttgggatcacctagacactgctattggaaagacattcttcttaaagacggtcagaggtaccaccgagctgattgagaagatggtctcaaatatgggttggagcgaggaacgactccgaatccgtcaatacggtatgcacaccgtcaagaggacggaaatgctggccactcagttggatcttcttattaagagactggacaacaatgagaaggacgccaagcagggtgctgttaaggccctggactcacatgacatgtgaggtccgtggcaatgccagtcacactgggatggatcatccgaaaacccgtaaggactcatgctcacgagagcaacaacgggtatcgtccataaggagatcaaggatggagcattgctccatggggaagatcaagtacggaccaaacccacaaggaggtcaaggtctaccccgaaagacggacagtttcagcaatttcatgatgaatttcctaaagatcaagaagaaatgaggatccgtcgataccttaggctggcacccaagaagccaggaacacaggtcggtcaacctgcgttcccagtttcgaagaagccattgaccgcaccaaaaacaaaggaggtatggcaggttaaagagaagacacctgttcctgtacctttgaaactgggctgtcacgccctaaaaatcgcctaaattaaaaatgcattgtttaaatgatttttagaaaatattttaaaagcctacaagctaaaacctaattatctaggaaaattttcaacataaaagtgagctagataaaattttattaaatactatgcttgctcttctattttctagaattttctgggaattatttgagcaagggaagtatttttttaataattgaaacaacatttcacaaattattttatttaaaaagttcaaaaacccctcctttaagttgttgggccgttttcggcccaacactccctctttcccgcgcggccgaaccggcccaagccggcccagccgacgccgcccgcccctcctcccctcagccgccgacaggtgggacccacctgtcgggtgtgtccctaacctccggccggcataggccgagcccgagccgcccgagccgccgccttgccgcctcaaatccgcacccaatccggccccgtttcttccggatttttgaggggttttgatcctctcgttctcctctatctttcccctcaagaatcggagcaaatcgttgggtattttatctgaatcaaactcgttttcgagtttatctccaaaaccgagtttttgatttctcggaccgatttcttgcgggaggagtccgatctcttcaatccaaggctataaataggaccacctcgtcgccctctttcgtttgccccctctctcgtggtctctagtgctccgtagcgccgccgccgcgcgtgacaagacgccgccgccgccggccggagctcagccgcgccgcgccgccgcttgcgtcatcgccgccgccttttctcgccgccattaggtgcataggagcaaggagtagctcggccgccctttccccttcgtcgccggccgccgtagctcgccgccgtcggtcaacccgagccgccgctcgttccccgtcgtcgccggaagtcgtccgacgtcgtttgtcgttgtggtgagtaccgttgggttcgtctcgtcgtcctctacgtgttcttgccctccaattccgcagccggccgctctatctccggcgaggtcgccatcgtggttcggccgccttgggtgatgtcagcatgacgtcatcggtttttctttttcccgattttctaatagattaaatcttcggaaaatcataactaaataaccgtagatccgttttaggtggttcaagttgttaaatttttctaaaatcaagatttacatgttaaaaatatccacatgtactgtttatgcttgtttttgtactgttttgttgatttttgtttaattgctttagtttctgacgttccggaggagagcgtttcctttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccaattaaataatggccgaagatgactttattttcctatgggttataatttgattagcatgaaccttatatattggattggttcagctaaatgctatatgtaagtttgcttagccatgcctagaaacatagctaattaaagggattaattataaactatgttatattaatgttttaattatggttacattaaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgtcagactgagaagtggcgagaagtccacgggggtcgctggggagtccatgccttgtttataaggggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtctcacactactcattaatggtaataatgtggtaattaatttgactcctggtttggaatggataattcctggtttggaggtttaatttgttcaactggggttggttgttcaaatgtggttgggcctatgcaacatgggtgtgttgtatggtgtttatttaatattgattaattattacaactgttttactattctcttaaatattcgttaaatgctgtttctgcaaatgagctatattatgccatcctttgttatcctgtgcacttgcatatttgctgtgtgacttgttgagtatgtcatatgctcattcttgcaatattcattcatcagaagaggagtatctcagtgaaggtgatgatctggaggattaggcttgttctggttaggatgcgtgtggagtggagtcgccatagctgttccgtagtttgttatagttttattttccgctgcgtagaatgttattctttgagaggaactatctacctctgtaataatttattatttgcgaatattaaatagttatttatttgtactctattatcaatttgttattgtgtgcctcagttgattcctggacgagggtttaacacacatgtaagcgttcggaattttggatagattttccgggcgtgacagtttcagcaatttcatgatgaatttcctaaagatcaagaagaaatgaggatccgttgataccttaggctggcacccaagaagccaggaacacaagtcggtcaacctgcgttcccagtttcgaagaagccattgaccgcaccaaaaacaaaggaggtatggcaggttaaagagaagacacctgttcctgtacctttgaaactgggcacctcataaagctaagacaccagaggtacggttttgatgccgatttttctccatttatggcccattctctgcagagggttagtgaaccaagtactagtagtttttattttattattacactatatgcattgcaagcataactagttcttttattctagtaatattgacggacgtaactgatcgataacgaccgtcaacaaaaccccccaagcttgaacctttgctcgtctcgagtaaaggacaaaaggaaacaaaacttgattgttgatcaggagttgctactatgctgtatattctcaaatgtacaagtgcaaggtagatatactctctcaaatcaaataattttgacacgtgtcttacccttacaactgattcccgcgagacattgctttaccttgtcttgtgcggttggaagatagaacagcaatcaagcactagtcacccattatttattcaaccttttattccggaagttttcaaatgatctttcaaaagaaatccaagttcctcaaatgaccctctcgatcactcagagtgtatataaatgaattcctcaccaaagtagcctagttgattcctactctaaggtttagtatgtggagcttggtaggtatcaaacatagcatacttgcatttattactaagtcaaaactttagactagagcagatgactagacatactcaagatcaagatcgtgcataaagtgtgtgtgctatatggtggaaatagaatgtggaaaaaaaaaggaaatacttctcctttgtgctttctttcttctcccaagatcattcatttctttttttggagggggcatggctactcatttttttatcatgctcaatattttgaggagcaagactttattttcctaaccatgcctttccctctttttatctctttttggaaaggatattatattggaaggagaaagcatataattggagagcttgattttgggtgatagcatgatggatatagatggaatgaatgaatgctaacttctagtgcagaagtttgcatgtgcatatatgtgggtgtatgatcttgatcatagagtatcaaaagtatctacacaagtctcaagattttgacaaagttcaatggaagtacaagcgcccaaaatatatatggtttatcaaatatgaaaatttttggctctggtaggaatttttatcaaatgaggaacttttaagtttatcattttggaaaataaaacatccggaatttaagtcaaacttagaacaggatcatagcaactcttatcactatatcatctcgcgacaacctagacttagttcggcaagtgcagcccacttacctcaggttcccggataatatgtggctactatttattcaatctttcagagcgtacttaaccgtgaacccatatataagagatataaaacagagaaactattcatcatctcaacaagagaactagttgtcttacctagcataataaactctaacctatatttttggtattttctattttgcaaatttttttatgtcatttttagtttataggatgcaatgtggaaatccaaatatgcaattggaaaggaattgagcccttcacttaggtccctggtagggattgaacccttggaagcgaaagtatgcttgaagatcagcctgctattgttgcatcaggttattgatgttgacgaactgagcatcagcattttgctgccattctcacccgcctgcatataaagggtgtccagcctcatcgtgagaaacccaagtcccgagaggaactcgagcgccaccagttggaagcaggaggcatcccacttgatccagaggaacgggtgtgcgcgttcccccagtgtacgtcgtgcggtgcttgccagcgattctcattggcactgtgccaggaagaaccaccggtgctgtgccgtggtgcctgggtccaaccgggtgcatctcccgttggctcccagtccgcctcgtacatctgcacaggtatcgatgaggatgactcctcatgctcttgccttggtctgttgcgtgtcttcctgtaagatgtacctgcacaagattcttctatggtctgtaggggaatggttagttcctgacagttgtacaaatgataccccgcattgggtaatgggatttcatttgtacaaccggggaaaaagtatatcaatgagccatcgtctccatgcttaagtatatgcccttgtactaagtatgtttcatcctcatagggacggacagtggatatatactcgatctgatcggtggtaataactccaaggccattcgctatacgggtgatcaaagaagtacactcaacaggggcagtatacttaatactttctaactgtcacgtcctgataaattcatcccgaaataaaaattattttctaaaaggaataatagaattaattaaaattcgaaaagaaattggcaaacactaaaatacgtataagaaaaattcaaatgtggcccggagattttttgttaaattctccttggtctaaaaggagccctcaaattttagtggaattctcagagcacaaataataattattaagaaataaacaaagttaaaatgattttataaaaagaaaaatcctaaaaagtcttctttttcccccttcccctcttgggccggctcggcccatctccctcccctccctctcctctccccgcggcccactcggcctctccccgcgcgcgcgccgctgacgggcgggcccgcccgccaccctcgctgacaggtggggcccgcctgtcatccctatcctcgcgccgctcccgccgcccgcccgtgccctagcgccgccgccgccgccgcggattccgccgcatcccgccgtccccgcgcgcaataaagtggggggaatcattccccgtgattccctctcccttttcccccacttttccctctctct

SEQ ID NO: 45370 - DNA, 6710 bp, Oryza sativa
attcctgcagcccattgtcgtcgatggaagaagttgtgtctctccccgacctactccaggccgagcaaagggcaatcaacctccggagggcgataccaagcagaagaccgtcatccgcttcaacccacaatcagaaggaagcttctcctgtgaatgatagcaatatgcagtcctatcacatcatcacagaactaatcaaggatgcagtcactagaacaatgccagctatatctctccagaatcaaaatgagcagccatatttgtggttttcagttcgctacctatcattgtgtaatcgaaagtttgcagcaatcatgtaatacataaatatattcatgtctataaacagtgagcttgctatgcttatggatgattcatgttgaagatacaatgtaccgatgttaagcaccttccctttttgtttaaggcagtgcctcgtattcttgtaatatgggagaaatgtgtaataaagacaagttctatgaggactctttcagaagatgctgatatgggattatgtgtataattgtttactgtcaaaggagacctagggtctcatttcagaggaactatgttctaacctcgagttaataaccaacctgttgatggaaaagaaaatcaattaaactgtgttgggttaaaaggccaatgagacagtagttggggataggagtttggatacgccttttacagatcaagataaggattgttggatgaaacccataagggtacccgccatgcctctacattgataagttcgcatatacctgcaaacagttaagaagacccaggagacatcaatatttgagagcatagtagtcgatggttggtaattagtctatcaagtatcagaaaagggtcaaaggtgatatggcagaagaacaatttggattctccccatctcgaggaagcactaaagatgatcatcggcaattaaaccctagtggcatagatacagatagcaagcaatgtatttccctgaaggtagtcagtgcagcttttgacgaaccacatcaaggtttcactgaaaggcagcaagccaaaggacctcatcgtccccagaagcgtccgcaatccacattaaagaataccacctgttagagataagccgaaagatgattgataaaagagattggcaaagatgttctccagcatgaaagaagtaggccgaaaggtgattgataaacagaaacatgctctgcatcgctcgaaggaagacccctgatagtaattgccccgcaacagtcaccttgtcattaagtaagcaagatgacctaggtaaaagtgtttctatgaaggcaaggagtgaaatcttcaactcagtatcagatgctacacggagtgaaaagtgcaagcaccggttaccaggtaatgccatgtcttgggagatgatccaatgggaaagaacacatcaaggttaaaggtgtaaaggaatacgttgaatgctaactgaggacaacctgaagataataatgggaagtaaactgaatgtaaagaaagtgaatccgagctgcttgttcgtgggagctattcccagttatgaaccaagtgatatgttcgaagatagtctacagaggtcagattaaaatcacctctaacaacgaagcttcagatttggcaggatcacgatcagacaataacaagtccagcagcaaagtcattcgggaagacgtcaaagcatgtcaagggggataaattggttctcttgggaagcataacttatagttaaagtggttgacccttgcatcgaatagcagaagtacctagcaccggagaccaggaaagctaatatgagatagttaatggcaagttgtcaatcatggtatccttagtaagcgggatatcatagtctaaagcatatggtggtaagctggaaggaaacgccaagcatggtattctcatgatgacaagcatggtatcctagtaatgacaagctagtgttgacgcatgagatgaagtggtaacttgtatgaggttgactccgaagatatgaatcatgagaagttctggaacggaagcatcattaaactaccgcaacctagtctgagtcagctaaaaggtgcaccctggttcaagtcaggagaagagaagattccatccgcaacaggagatcgagccaagcagtccagagtggagaagttttgctaggcaagttcgttatagaagacgcgacggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatacgtataagaaaaattcaaatgtggcccggagattttttgttaaattctccttggtctaaaaggagccctcaaattttagtggaattctcagagcacaaataataattattaagaaataaacaaagttaaaatgattttataaaaagaaaaatcctaaaaagtcttctttttcccccttcccctcttgggccggctcggcccatctccctcccctccctctcctctccccgcggcccactcggcctctccccgcgcgcgcgccgctgacgggcgggcccgcccgccaccctcgctgacaggtggggcccgcctgtcatccctatcctcgcgccgctcccgccgcccgcccgtgccctagcgccgccgccgccgccgcggattccgccgcatcccgccgtccccgcgcgcaataaagtggggggaatcattccccgtgattccctctcccttttcccccacttttccctctctctctccctcggattcgctcggaatctttcccctaaacctcgtcggcatcaatggcggccgcatctttcgcggccgtttccccctcgcccggccgctctctccccctcccgacgctatttaatcgttccccgtgcctccctcctccgtttccgccgctcgccgctcactctccccttcggaatcgagcccgcgccgtcgtcctctctctccgccgtcgccgccgagctccggttcgccgctgtcgtcgccccggacctcctctcgtctcggcgtctcctcctttggcttcgccgcgtcctcgtcgacctcgtccgctcctccgtttcgcccgccgaccgccggagcaccgccgtcctcgtcgacccgaaccgcgccgccgccttcctccacttcggtcgccgtttccgtcgccgccgtcgacccggggtgagccgaagaccgccgcttcacttccctcttctctcctctctctcgggcgccgctccgccgcgccggtggtcgccggcagtgaccatcggggcgcgggcgcgccgcctcccgtcggccgtgccggcgaggccgccttcgggcgcgccccgcggctgccaggtggggcccggccgtcagccgcccgcgcccgcgggtgcggctgacgcgtgggacccacggcgccagccgcgtgcacccggtccaccgtggaccgagaggctgccgcgtgggtcccactcccgtggacccggtccgcgcgccctctctcccggctgacgcaataattcgattttaaattaaaatttaaatgaagaaattcgcaaatatccatttaaagaacatataaacttcaaatgggcataacttggccatttgaactcggaattggaccgttcaagtctctaatttttccttaagaagtcaagaacccatttttgtgctttgtttctgctgttatgtggaatttattagcgtaaaagccttttcttttccgttggtcgtgtagacgctgcagctttggaagatccgctcttcgtggaagttgaagccggcgtttgggaaagtgagcaaggcaagtcacatcatccttgaacatattgaatcccagtttataaaattattttgatttaaattattgcattatcgctttatttaaattcccgcgttatcacggttttactaagccatgcctatttacctttgttatgaccgtattattgttgttattgttattattaccttgtccaccctagattaaacaaaaccccaactagtggatactctactcatggtaccactagtatgattttaggtagatgcttcgctgtttaattagacaatattaggtggttttataactttagacttggggaattctcatatcacttggacactttggaattgttggtttattgtggaattggattcacaccgccccctctattcaaaatccccaaaatggttttaggctgggctcggggtgcatggttttgatagtagcacctcggccatataaggaccggtcttcgggcctctgttgcaaagcactaccgtactttcacatgtctagtgggtaaggcttagtttgtggctcagtcaagttataaacaaaagtacacggattggaggtggatgaagtcgggggtcgatggacattctccagggcaaatgaaggctacacgagctgcggcccggtagtcgagatgtcatggtacagggttggtgccctgctgctgggggctcagtcctgcctgcctgtcccggaggttccggccgtaggtgggattgggtcggtactcttctctatggctaggatgggttggaaactatgtcgcgtcttccgcctgtataccgtggtggtatgtggcacgtggttgcacgtgaggaagatgtgtcttgtgggtaaagttgtacacctctgatcagagtataatctattcgaatagccgcgccctcggttatgggcaagccgagcaatgtacccaagttagcgttttaattcctaaaatttgcttaacaactaaaatatggaatggttggcctgggttggcttgggacgagctgggacccagggtcgggttgctagttcggtctgaatcatcgtaggccttgggttaaggcaggttcgtgtgggttcacggccttgattaataacactgtgtaactctaggatcgtctttataaaatggctttgggcaactaagtgacttttaaatgctgtttactgcaaaacttaacccctattattatccccttgtacccccttgcattaatcatgcatctgccggtgtgacttgctgagtactgtggttgtactcattcttgctcaatctttcccctcttcagtaagagaagctttggagaagaagtcttaggtggagtcctggcttataccccagttgagcgcctgtgaagatggagcagtaggcccgctagtccgctgctgtttatttttgattgtcaggccttaagtgcctttgtaataatgtaaatattatcgatataatacagatgtgtcttttatatcatgtttgtatggtgtaccccggcttttcctgggacggggattaatacactagcgttcgggaaaatgcaattttctcggtcgcgacactaaccattgcctaatcatacatttaacaggagcaattttaatttttctaaccatggcaaacatgataatcaattcatctccttgaatgggtcaaagatcacctctaggaaacaaagtgtaacaccctgaaaattcgaccgacaaaatcaaaactctaaaaatacggattttcaaaaactttttaaactaattacatcatgccgatcttattcgtctattttatctgaatttgatatcgaagattattaatcgtgagtaaagaatagttaattaggaataaaccttaaaaacaaattggtaaaataaatacaaaataaagattaggtgggatagaaataaataaaatattatcgcgaccatatttggatcaattaaatttaaatacgatggaataagaattaaccctaattaaaactcaaataaattacataaaaataaaatatgagtaatattaatctagggtgaattcattagttaagataacacaaatattgagtaaaatgcatatatgcaaaattaagaattgtggaatcaaatttatacggaaattacactaaaatcgggttaattagaaaacggcactgttcattgcacctaaagtgttcgacggggtcccctaacccagctcctcctttttccccctgtctctgtcgccaccgtcaccgcgcgttgccgcctcgcgccccgagccgccgcgcaccgtcgccatcgtcgctagccgccgcgcgccgtcgccctcgtcgcctgccgccgcgccaccgtcgccatcgccatctcatcgccgcggccgcgccgtcgccgtcgcgtcccgccccgcgctgcgcgtgcatcccatcgccgcctcgtgccgcgcgccacctttgccgcgccgtcgccgtcgccatcccgtcgccgcgtgcgcgttccatcgccgcctcgagccgtgccattgccgcgctgcgtgccgtctcgtcgcctcgcgccgcgagcccgccgcctcgcgccccgtgccgcgctgcttccccgagccccgtgccgccgctgctaccgcgccgcgccgcccgttccatcgcctcgcgccgtcgccgttcggccgtcgcgtcgccgctgccgctcctcgcgtcccgcgccctgccaccccgccgacaccatgaggccgccgcccctcttccctcttccctattatctctttccccttcccttatataatccccccctactcccactctttccctccatcctcacctcctctcctctacccaccccaccacgccgcctccacgccgccgcgtcgtcgcatagagctgccgc

SEQ ID NO: 45371 - DNA, 2604 bp, Oryza sativa
aatctttcccctcttcagtaagagaagctttggagaagaagtcttaggtggagtcctggcttataccccagttgagcgcctgtgaagatggagcagtaggcccgctagtccgctgctgtttatttttgattgtcaggccttaagtgcctttgtaataatgtaaatattatcgatataatacagatgtgtcttttatatcatgtttgtatggtgtaccccggcttttcctgggacggggattaatacactagcgttcgggaaaatgcaattttctcggtcgcgacaagctggtatcagagccatctcgactgtaggataagccaagaggataaaacctaaggacatattttataaataaaattatttgcgaaagttccttttttctccttcccctgtgctatttgcaaaacgtttactctttcttccttcttcaaatttcaactagtactagatggtcggctttgtggagaagaagatgttgtcaattgtctgccgaagctccggaagactgcaggatccgctagtaaagtgaaggaagcagtgaagccagctgtgaagcaggagcgaagatcttggagaacccgtcgcagaacctaagccaccctctagtgtttcgtttgtcgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacgttggtacctcaagctcccgagtgaacgaagcaccagacaccagttgtgtgacactggtccaacacctgattaaccagaaccgattgcttatagagatactgcagcagcatcagacgccaattctgaacctgagtcagatacaacctcaagtgcagttggaggcagtccaagcacccacaccacaagtcagcatgccgccagcatcccgaaggacccatggtgacgtgccacatgttgactcaaaagaagcaagtatcatttgttttatgtgtgatgagcaagggcactatgcaagggagtgtcctcagcagaaaagagaaacaccaatgcgaaccgaagatgaagtccgtaagatgatcattaccagcacagaatggcctccaccaggaatgacaaaacgtcagagaagaaataccttccgaggtgcaccacagttgacagagcatcttttagctaatggaggtagagtgtctgatagtgaagattcagatcaagtctcctcagatgatgaagacgagaagtctccccaaggtttcaaccaggataaaatggaacgtaaggcatgctctcgttgtggagaaatcggtcatgttgccagctcgtgtgccactacatgcattcattgtgaggaagaccatccacccgacaggtgtccaacgagcaggatcacttgtttcttttgtgaaggaactgatcatgtaccaaaagattgtcaattcagttttctgttgacgaagaagatggccaaccaacctgccagttccaacggagagaagcatcaaggccacacaaatcctcaccaagattacagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccagcacgtcagtccacgcaactccctgcaatcagaagcttgctcctcagcgaattgtcatccatgcatcccgaagcagtcctatagcccgcggtgcaacagctccaactccagctagtgcattaccacaaggtgtcaatgctcaatttcagccgcagccaccagttgacaagacagaggccagtatcggcattgtacctttggatgttccagcacagcagccaagaaatcaagtacaagatgaagaacccgagcgtaagaaagttattgtcggttacaactgtagtacctgttaaggaaacagacatgccaatcgccaagtggtcactggagcaaatgcagtacctgttaagcctagcgctagtcagaagcaaccataatactcttatatcagtgttcaaatacttttgttttatagttgttccccgtcaatcatgtaataacagagaaacatgagataatgaatgagtttgataagtttatgaaggatccatgttaagattgcaagagctgtgagttgtgtacattttgttgttgattagggggacctagggtctcatttccgtaagctcataatctattatgaatcaaataacctagcgattgatggcgaagaaaatcaagtgatcaaccaaagagacatttgtttggactaagagtttcagatatgtcttcttcggatcaaaggcatgcacccgttgtggagaaattggacacgttgctagcatgtgtctcacactctgcactcactaggaagaagaccatccaccaggggag

SEQ ID NO: 45372 - DNA, 3602 bp, Oryza sativa
aattaccttcgggaaggtaattgagatgcggcatgtggagacatgagcgccacattgccatgatgttgatgacatgatttgtgaaaggagaaataaaattaaaacaactgttttcgactggggcggacggaggatttgggtggtatctggaaaaggctagtaccgtccctagtcaattaaggaccgagccatgaagttaagcatgaaacgaccccccgtacaaccgtacttctcgaatgggtatagacctagcagattagatagccaagtggaggcagtatccctgcatagatggttcacccctgattgaggcaggtgcgctacgatgggacagccgttgaggtagggccgagaggcgtgccctatatcggtgttgccattggtaggactgccatgagtgtgtgagagagagaacttaacttgaaccataatttaatatgcgtgtgagacttctctttccccgggagcgccagaactcctctcactgctagaaacatggacgcctagagtgcatgaggatttaagttcatggagcgggtactgccaatgcgaggttatcgaaaagctttgccgtgacgtgtctcatgtgttgggacgaggctcatgtgttgggtagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggatgggatattgcatgatgaatttttatgctgatggagccacttcctaagaggcgggaatgtggacgtcctcagaaaaccataacgactcaatggcgggaagctatccttgggatcacaatggatggtggacagaaccgtcattatttaatatgaacactggtattaaaacttgaacagtctatgctaggtcttaggcttgtgaaaagaattacaaaacttgctttgtgcaaaaagaaccatagccatcctttgaattcctctgtcatgtgcatcattgctatgatggcttgctgagtacggttggtactcacccttgcaaatataaaattaatcagaagcgggagatgaagcctcggaggatccctatgcctactaccaggagggagatgaagacgatggcgctcagtaggtcttagtacggttgttgcctgtggcaatggcatgccgctgcctgaattccgctgccttatctatttctgcttttggatgtattccggaccgctcggtccgatgatttaagactatgcctgcgggcttatgatgtaataattcgtattagacactcgtgtatgtgcacttggtattttagctatgaattcgtgtgtaccagactacttgatccagggaaatggtactatttacacgattgattcctgttataaaaatgggggtctacacaaagtcatagcaatccatttgtgcataagtctaagtgtaggattatggatgtcatttgtcctaggacgtctgcaagttggagcaccagaaatgtcttcccaaaatctgtttttcttgaacccgggaattcctttctgaagatcggttttacagttatcgtgaaaaccaagaagtgtacttaatcctttccatgaaagcgtatactctttacggaaaaaagaaaggatatgccatcttctgattctttcaaagtgcacagaaattgtatattaagcaaatgagaacctggttcatctactactgcaaatctctgccaaattacagcattccaaatggcatgaaaatcactatccatacctgttttcctcagaagttccggatcgtacgcccgagtgtggctgaacttccggtccttcagcatatggtaggcttgtaattcctgatcaccgataaggttgaggttggtgtcggtcaagaggcttgtcggtatgtcggtgtcttccatcgatatgtcggtggtcgttcccgatgaagagccagatcccttcttgaacagacgggacaaccatcgcctcgttctgcacaaataagaatggactaactcggcgggggttaggatagcaagaagttctacccaccggttagcttcaacgaaacaacttgtgtatgcaactaaagtgtttgattttgagacaagcttgcaaaacttgaaatggattttgagagcaaagttggagaggaaatgaaaatgagttgaaatggggtggattcctctctctcgaccggttggcttatatagggcaccaacaacggtcgaaactgtcatgtgggtcccactagccgttggtctgccaaaagtggcggccgaccgttgcctggccggttcggccgaacccctagtgggcccaaccggccccacttttaaccgttgggttccaacggccagtgtggtcgtggcaaactaaattttgattgaaaattttgctctgaaaaattcattttgaatatttgcctcaaaattcaaacctaaatgcaaattttgagaaattcaaacatgctttgatgatgcagaaatcaaattggtgaaaataaatatgaggatacataccaatttacctattggcgagggcggcgtcatttcaagtccgacgtgcaagaccgtacctccggcgttcatttcatggatttttcacccgtctccggaggtgatggagcgggcgtcttctgtttcagccaccataccttatttgtccttggtatgggcggcggcttcttttgagccggtttctcttccttctaggccggtgtcttccaataacgggacctcatcctggaaggttgtatctccagagatttcttcatgaaagcgatgaggctgtccattttgggtggctccacttcgaccgtctgaatattctacggggctggcccgtactttaaccggaccatggagcattgtttcgtcctcggctggaactcgaacttctcctcctttccattgatgtggaaacggatgcttcttgttccgacatcaatgtttgcctctgcggtactcaggaatggacgcccaggatgagcggagtctccttaccggtgtccatgtccagcaccacgaatcgaccgggataaagcaatcccgtatctttaccggcacgtcttctgctatcccggctaggtagcggaccgacgagtcagccagctgaaggcgcatcggtgttggtgccaacaccgtaaagttgagtttgtcgaagacgtccttgggcatgacgcttacacttgccccaaggtcgcagagtgcctggtcgaatttttgtgtctagattgagcaagtgattgtgggacaccccgaatctttcttcttctccgggagtttgtggaggatcgcgttgctgcattcctctgtcagcttgaccacctcggtcgtcggtagtggtcacttgttgttgaggatgtctttgagataacgtgcatatgttggcacttgcatagcgtccaacaacggacgttgatgtgaatcttctagatcacctcaatgaaacgagcgaactgctcgtccactgacggcttcctcatcctctgggggaatggcagcaacctcgtgtcgcagtaatgctgcggcacggtcttttctggctgaatttcttcttcagccgctgcgtcagacggtgttt

SEQ ID NO: 45373 - DNA, 2299 bp, Oryza sativa
ggtctctgggcagtcattcccagaatgtcccgtgttgccacagacttagcacgtgatgtgcgagtccaaggccttgacggtgcattggggcttcttgtcgtgttcgtcaagtcgtttcattaggaggtcgagttttgcagcgagtatttccgtctccttggcagtgtgcattcctcgctgacgggattggagccgttcctcgctccaacccatgttagagactatcttctctatgaggtcgatggctcctctgaccatcttagagaagaaagctcctccagctgccgcatccaggtggttgcgggacgtgggagtgagtccattgtaaaacttttgcaggatcagccagtcgtacattccatgatgaggacagacggccacgtattcctgcaaacgttcccatgcttccggaatggactcatcccgcatctgctagaagcccgaaattcacccacgaagggcattaatcttgcccatcgggaagaactttgacaagaatgctgtcgaacatttttcccaagagtttatcacagcacgattggcatagaatcacttcttcgctttcccgaggagggaaaatgggaacagcctcagcctgacgatatcaggactgacgcccttcacagtgtacgtgctgcaaatctccagaaattgttgcaggtgtgcattagcatcctcgttcggcttgcgacagaatgggctagcctgcgccatcgtaatgaggctggacttcagatcaaagtccatgtctcccaaattgagctgcggcccagtggccacattcttagaggagggagcagcgaactcgcgaagagtcttgtcagccatggtcttgaaagttggtggcgctagtacgtttggcttctttgtcggaagagtcttctgcgggggaacaacccgcagttttatgcttcagaagaagacttatggattttcctggaagttttccggcaggtcaaaaacaattatacactaccctattttcacaacaaagggtgaaaacaacaaggttaacctgcaaaggatattgactatacagaggtaaatataagatattagttttaggaatctcttcttataaatcttccccagcaacggcgccagaaatgcttgttggtatttcctaacgacattactagaaatataattcccagcagtggcgccagaaatagtcaaggtatattatggttacagagattatccgcaagcgcacggatataccattgtagcatttcacctgagagttttccaagggtatcgtatttgtttatcccgtgggaagattataatagagagaactaaactaatatttatatgttacttgtactagtcgtgcctaagaaggggtaaagataattccagggtagaatgacacacaagctcaagctactcattcctatattaaatctctaagctaagtggaaagaatatagaaaagaatctattcctatacttctagtatacatagtgtacatacatcctaaatatatgattaactagctattaccccctttctgatgccctcctggtacttcgagaagccacccctgaccgccgagttccttacgacagcccgtcatgaccatacaaccagggctaaatacggaggagtaccctccccagggaattaacttaggattatatacacgcaaggaggaatacccgtagcgagctgtcaccatcagcggcccacctctcatccgcagcatataaccccaaataatgatacctagtaatctagacaccacgtctaaactaccagatactactctaatatcatcgtcatgacatagagtaattgcatatgcaaacattatacccgtaccaatgcatctcctagaaaagctagcagtataatcataatatctcggacatattgtaaagctggtattcatatattcggaaaatattacaatactagagtcgtatatagaggaatattctaaattaaatactagtcttgcaaaagaagaaaggaaagctactagaggccatacccgaactcttccaaagacttccagactccgactactattctattcctactccactagcttaagaacactaaactaaacttgagagagagtgagagcttcgatgcttggagtgtgtgaagaaatggagggagtgaatgccttaaataggctgccaatgacggttatggcagttggaattgtcaggattgccctctaaccgtcattggggagtgatccaagccgtccacttggatcgaacggccgtgagggaggttcggccgaaccctgggctaggccaaaccagcccattttcggctggcggg

SEQ ID NO: 45374 - DNA, 4079 bp, Oryza sativa
cctgttcatgataatgagatgattattatatatgccatggttcattagattagagtttctcctgtgcaacccatgattaggcagtgggtagagagcatagaggtctccgctcctataaaatgcacttctttgatcacttgtatagcaagagggcttggggttattacaaatgatcaaattgcttatatctcagtctctcgtgtttatataaatgaatcataactagtgcaaggtcatactttgaaacatggagcagatgtgaccttagtattcttccaacccggttgtagaaatgaaatcctgttacctaacccggggtatcatttgtataactgttatgcactaaccattcccctgcagacgatagaggaatcccgtgcaggtgcgacacataggagtaaccgcagaatggcagcagatgaacaggaggattcaacgtactcaccacccggtcatgcttatgagagtggctggaaatcagctagagatgcctccggctgggcccaagccctacgtcatagcactggaggatctgcctagccgagtgccggcagttcctagtggcagatgcctcatgaggtgcgctgggggcacaccaactcagcaggctcaagtggcgtgcctccaacctccagctggtggtgctcgagttcctctcgctgggacaacagtccctcgaaggacacgtgatccaggcgcaggagtagcagcaaagtgttgatgcacagttctcaaatatcaacaatatgatgcaacaacaacaagctgatctgcaagcctacttccgccatcaaggattcaatgcttactctggaccatgagcaaggagcaagcttggggggagaagtctctcccccgcaaaggtgacttgtatctgcatttatcttgcatatttcctttcttgcatgtttcaattcttgcatttgcatttataactcaaaaacataaaaatttgcaaaatagaaaataccaaaaatataggatagattttaccatgctaggtaagaaaacctagttctccacattgaaatgatgaatatttgctctgctttatatctctaatgtatctgtacatagttaagtactctctcaagttttaaataatgattagccaaccattatccgggaacctgagagatgtgagttgcacactgcgtgatttaagcctaagctgttgtgagatatgatatagtgaaatagagttgcttaaatcttgatccaagcttgatttaaattttggatgatttgtttttcaaaatgataaatttcaaagttcctcatttgatatatttattcctaccacagccaaatataatttgcacttgaaaaccttatataatatttggttacttgtagttccattgaactttgtcaaattttgtgacttgtgtagatatctttcatactttatgaacaagatcatacacccacatatgcacacatgctaagcttctacactggaagttagcattcatctcactcatatccatgtcatcatcgacaaataaagctctccattcatgcattcttctccaaagaaaaatcttttgcaaaaagaaaagaaaaagggagagaaaggtgtggctataaaaaaatgatgaataaagtcttgctctatcaaaatatggagcgtgatgaaaatatatagccataccctctccatgaaaaacaaaggataatttggaggagaagtataagcacaaaggagaagcattttctttatccaaattttattttccaccacacattccacacactttgcatgatcttgatctaagtatgatttgctatctgctttagtctagatttttgacttagtaatttatgagaatacaagtatgcctcatttgatccaaccaagctccacatattcaaccttagagtaggattcaaatagggcattatctttcgtgaggaataaaatatctatacactttgagtgatcaagagaatcatttgaggaacatagtttttatttgcaaaaatccttgaaaaccatccgggatgaaaactgagcaaggaaaaagaaaatggtgctctatgatctgttctatctctcaattgcctaaggtggtgagaagcgtgtgttccacaaatgttaggcataagggtaagccactatgcatatttacttaacatgagagagagtactcaaactgtgcacttctacattctagatatacaccatagtagcaactcctgatcaacaaccaagtctttgtttcctttcgtcctttactcgggacgagcaaaggtttaagcttggggggtttgttgacagtcgttatcaaccaatttcgaccgtcaatatttcccaattactgaagactagctatgcttgcaatgcataaattccaaataaaatgtctatttccactatgtactatgctactaacatatacgcaggagaagcacatataaatagaggagaatcgacagaaagcaaacgaacgatcactcgaaagctatcgagaagcaaacttgtgaaaagatgggccaataacacaaaatacgcacgagtaaacaagcccaataattcacatcactggattgatgaatcaacaagaagtccacctgcaaagttgtgggctgattgggcctagttcggctgaaccagtagctagcccaattagcctaattcttcaccagctggtagttatccatgtcccaagacggttatgaccagttaaactgaagaaaccatcgctggacacatgtcacaaggagatgaagctaaggagaatatgctccttggatgcttggagcatctccactctcccaaatgcaactcatggcctataaatagctcctcctctcattcattcccagcaaagatcaaagcttctctacaagtttagtgttagtatagtgctagtggagtagaattggaatagctctgctagtcctcggagccttcagaaggagttcggtaaagtctcttgtatcttttcctcttcttttgtaagacttctactttcaatagaataatcttctttatataattcaggtgctttattccaatcttagaatatgcgtaccgactttatagtattcatgaatagtataatctgtgtagctaaatcttctgggaattgcattggtgcgggtataatgtctgattattcggttgctcaacataaattgctaactgaatatttggttgctctatagatatagatgagggagagagagacagaggaagacatggagaaagagagagtggctgtcaagaaaatgagagctggcacctggtcaggctggtagtgtgcaacaagggtttgcaaaaccaccggtgaccatggttacagtggtaatagaaaaaccacggtaatctccttaaattcaaataaatttaaaaaataatttgaaattttgataaattttgcatggtttcgtatggtttgccacggttaccgcgcggtaaccgtgcttaccgtcggggcacggtaaccccgtccccggcggtttgggaaaccctgtgtgcaacagaatttggtatgatctccttgctattttacttttttaatattaacataaaaaccatcaattcttaacttcaatatttaatgagaaaaaaaccataaattttaacaaaaaaagttataaaggtttcaaaaaagaaaaataaaatgcaaacgaataacaccaattttcacaattctgacgtgtgtcgtcggtttaactccacgtattttcttcaggtatcaacacatactatattctcatagttaaagtggataaattaccacaaaattccatttattttttttagacttacctacttaaaagatatcaatatttccgttcatcacataaaatttccatccgtcgccttctgtgcaaacacaatcgcattgttcttccgaacgttcttccaacgctgcaaccatccagacaacatgtcaaaggcatcattcacatcccgcacatgtagggaaaattttacccagtgtgacgcactggcatttaggtaaggctttcgggttttttgtcagtcttttttccccttattttccttttttttcacccgctttttattcgttgccttttttagtccgtctttttttcgtttttccctt

SEQ ID NO: 45375 - DNA, 1578 bp, Oryza sativa
cagcatataaccccaaataatgatacccagtaatctaagcaccacgcctaaactaccaaatattactctaatatcaccatcgtgacatagagtatttgcatatgcaaacattatacccgtaccaatgcatctcctagataagctagcagtataatcataatatctcggacatagtgtaaagctggtatttatataatcggaaagtattacaattccatagtcgtatacagaagaatattctaaattaaatactagtcttacaaaagaacaaaggaaagtaactagagccatacccgaactcttccgaagacttccggactccgactactattctgttcttactccactagcttgagagcactaaactaaacttgagagagtatgagaagcttgcttgcttgaggtgtgttggaaatggagggagtgaaggccttttatagctgaacaatgatggttggaaatgtcggtaatatcctccaaccgccatagggaagccatccacaccgtctatccaaaacctggatccaatggtgcttcggttggttctgccgaacccagcccaaactcggtcagtggcctcctcttgctctccttcacccagacttatgaattttggtccaatttgatcgtgtcaattatggtttcatggcccatctttctataagtctatttctcggcatcgtccgattgattgatcgatggttttgatgccgattcttctccatttattgctcattctctgcaagaggttagtaaaccaagcaatagtggactttattttattataacttagacgtggtgtctagtttagatattacctttgtttgttgtgtatcccatggatttgtcagaggtaggcgacaggtggtgacagccctgaatcgcgtcctagtaatcttccacattcagatacatcatagagctatagccagaaccacgctggcagaccagcaggggtcggtgcctgaagcaatagattggaaattacttcaactcagtctagataactaaaacacttagaaagtcctctctagcctagcctagcttgcttaccattagttgttgtccttagatagtcttagatttatgtagattacacacgttccctgtgttcgatatcctttaggggtcacccgaagatgaagtactacagcggtattccgtgtgcttgcagatttatctatggtcttaaggaataccaacaagcatttctagcgtcgttgccggggaacggttgctaatttttccgagtctaggtcatcctcgtatctttttttatttcttcttcttttatccctttccttgatggagcaacccacaattcaaaacctttctgctcctcaggctgatctttgtgagccatctcgttcttcaaaaccaatcctttcataaggctacgaaatcagtcctggctttatagccatgattcaagagcaaaccttctctggtggtattagtgaaagcccatacctccatcttcgggactttgagctagtgtgttcatgcctatcgatcgtaggaatggcacatgaaactttgaagtgaaaattgtttcctttttctcttagagatgaagtg

SEQ ID NO: 45376 - DNA, 2285 bp, Oryza sativa
cgtaagccttgtccttctagcctacagaacattgttcttgtttatcatcaagaaacaactatgttcttgcatgatgcatctcttgaggaggaggatcttcaggccacagacaagcttgagacattgactctagaggatgagagaaaacattccacaaatgaacatgaaagtttttctttcaaaattccccaggattcattctcacataaggaattcctagagtcctgtctgattagtgacgtttctctgtgcgaggaccacaaccaccttacggtcctcatttctaacatgtttagaagtgtggttctggatgcttatatttatcataaatactacaaatcttgtatttgtttgtggcactaatcttgcagcatgatgtccctatggtcgagcttgagaccataatcaaagcactgccaggagatagtccagattactacggtaagtttcttttctaataaaagcaagaacctatgtttaggattgtatacatcttcgggtattcttggtcgctaagcatttcaggttgagattaagaatgagggtcagacgatgcctaagtacacggttagctacatcaactttacactttggcgatcctcggtatgggaacactctataggagactccgacatcacacacttggtttttgatgtcttgcgacacaaaagtccaagtgtggggggaaaggccgacgagcttgtgatgacgagttccatcaatcaaggccatcttggtttaaagttggtgttagtcccaccttactaaaaaaagagataaaaaaagataaaaagaggagaaaagagagacgaaaaaaaaagaaaaaaaagatgggagaagaggaagagagcaagagagctgacatgctgtgtaatgccctagaaaaaaaaagaatagcgtatagtatatattggaattccctacatttttttttggtgtttgcaattagaagaaaaacaatagttatacgctagttgggctagctttcggccagcccaaggcccagctgccccctccacacccccaagaccctaggaggtcccccccacctccccctagccgtcatttggtaccctggggcgcccacctccccctctggtcgacctcccccatgcctgccctactgcagacctgggaagaagaagaagggaaggagaagaaagggagagaaggaagcggagggaatcgaggtgaagaaggaaatgaggggtttgattgccgcttcccaaggaggcctaggtatcaaatacatgatctttcccactgtattggttttcttttagggtttagatcaagtgttggaagtgagtaagtttgggatccaccgatttattcctcagccaggtttttcttgctgatatgccccctgcgcagttctgttttggctgcttttccggccaacataatgggttttcctgtgaaagtctctatacaaaagttgtagataacgtgtagatctatcttctgaccagatggcatgattttatatcaagtggtttaggaggtatcaatttctgaagttggctgtctgaatgtcgatgcatttatctgtagtcgaggttcagagggattttaaaggatcttaatgatggaatcagagaatcttgtacttacagaagttgtagaatatgctgtatctacctcataaaaaaattgttagcttttatcttgtattttgttgtcagtgctcttttgaatgtttgttgcatagttttctgggcagatgcacttatctgttttgtgccatgttttaggccagctaaatggaagaattcaattttgttatctaaatgaaagttgtaactcttgttctgtagatgtcagaaatggtatatttttctatgttatgtgatgtagaattggaggtatcgaatcgttaatctatgctgcttttataggaagattatcggtgatttgctttatgttgtttggggtgggttcccagcatagaaagtgaatgtgtgattcttgaatgattatatgtgtgttgtttgaggctgagtcggtgtttattcaggtgataccacttcggaatgcaactagagttcatctcgtcatcggtaaaggcaagtaaatgtagcggtggtttgctacagctttaacctgttattttcctaccttcactttaaaattatatatcaataaccaataatcaagatagtattacaggtcgtagcaaggttttacctatctgaatcattgcttatcgttattgcactgtttatggttatactttatgctcttggttataataaccttatactggtctccatctgggctgcagg

SEQ ID NO: 45377 - DNA, 2340 bp, Oryza sativa
cgctatattgtttttaaaaaagagatgctgctgaaatttctttgttttggcacttttatagggttctttagtggcatcccagacttgtggagatttctagggtgttacaggctgtatctagctacacccagtctctctcttgagcttatgtgtcgccttggtttagctttcatccactcctagtggtgcacaacttctcgctcccgcagcatctacacttatacaagcaagaggagatgccctcttctttttctaggcggcgtttgctccagttcgcagttgcacatttgccaataaaaaagagatgcttcctacatctctacaatattgtgccaacggatcataccttcaaggcaaaaggttcttgcacccgacgtgtgtgcatgactaaaccgctcgcctgagttggcatggtcgaggtgccttcctccgctataatccgcaacgagatggaggagaaatctacaatcaaatgtgaccatgcaactgccccaaagattccaatatatccatcatgttggcggtaagtacactcaggtatgcgaaagataaaacaaggttcaccaagcatttactcaataatatcaccatgtgaatatggcttgatcatacatgattatgtttaccttgtctattttcatatactctggtttgggtatttccatagactttttaaattaagcatggtgcttaggttaaaattgtttgctttaatcaaattagacatggagttgagattgattaatgaaccatcagagttaatatgttcatcgacattggatatatatcttctgtggactaacccctacaggaaagttttcaaactgacaggtgagtcctcaagttcaattctcattggaggtaagtcagggcccgggaaacaaatcagtaaattgctaacatgcaaaggaggagcacaccatcttttgattatgttcatgcaattttacatcagccctgtatgagattttgcttaaacaaaaatttggtgaacaaaaaaaattaaaaaaaaatgttttcaagaacaaaagaagtgtctctcaaaaaaaaataaatggcaaacttttgggctcgacgcttcttaagttttgaatacaatttctctttagcgtggatgtgaacaactaatcttgaggctatgataaaatcttttcaattatttatagtctctcgggtatttactgtccactaaccgtttgtagggaataaaatgacaatcaacagcagtgtacaataagttcaaacacatatatcacgctccttggcctcataggaaagagatgcacatggaaccaaacagaacaaatgcaaaacttgttgcattcgattcggttctaagcttggtaagatatatttggtaagaatcccaaacatcttgtgtatcctcgcctcatatatccatcctgctacgatacccaccatatccattgtggccataaaataaaaaaaagataaaaaataaaaataaaataacataaaataaatttggctccttagtcttccaaccaagtgagtcatttttgcttcactcttgtctttgtttttcttttttgtgtccaacaaagagtcccatgtacaaagagaagtgtgggggtgatcttgcacatcaacgccgtaatcaaagcaagatcaccccagaagtgatgagccatgacaaaccacacaaggaaaattgacgcagtcagacccaataaggggtcaaccaaacctccagttcggctgaactacctctaacatgaatcgtcctctgttttttacagagcgcaagtttgcacattattcatttggacatccattctatcttgagtttagtttgattatcaattctaacatatcgaagataattaaactcaagctagggatggtacaattagagtttatggtctctctgaaaatgacatgcaagcctattattcttagctcattacttgttgcttgtggtgatatatccaatagggaccccatgccatctaggtaattgatgaatgagatatagtctaatgatagaaatcctgctcttcatgttgcacacttgggaattttataaaaaaaaacataacgatgctaaactcatcattgatattttttttattcccactagagccataggttgatcattcatgattggcttgctacatatgctgcttgttattacattgagcgttgtcaagttttgtgacccttgtgaaatgcttatcatacattcatggtcaagatcacgcacactccacatacacgcacttatgctaaatttctacactggaagttagcattcatcatttgtcattcatttcatccattatccacaaaataaatactccatgtcatttatgcctcttc

SEQ ID NO: 45378 - DNA, 1537 bp, Oryza sativa
ccatacgcatagaaaccatctagaagtcaaatccccgaaggaaatattcaaatccgacaaaacaactcgaaaccaaaacaaactggaacctgcctgtaataccctgaaaagaaacattttagtgtcggcttcgggatggtttataatatcatggtagcatttagttaaataaataatgtcttaggagtgggccaagccaacctgggccaaagcccatgaacccaatcactcctctcccatctaaaaccctagaggaggaggggccggattccctcttccccctcgcggcgcctcttccccctccactcctctcctgtgcgtactttcttctccctctcctctccatcaaaccttgctgtccgtagatctgcaccttcatagcttggatcaagaagcgaagtggaaaaacggaacgaggaggaggagaagagaagaatgatgggttagatcggagtttccccgccgtttcccacgggatatgaaaggaaaaccctatgtgaggtttaccccccctgttgtatcagttgttctagggtgattttagtggtttaattcgtggtaaacaaaggttagagaagggtttttgtttgttgtggctcggtttggtagttctcctccgttggcagatttgcattgtttcggtttttttgttgtttcgggggtctaaatgatgttttctacgaaagtgtataactaggaagttgtagaaaattcatagacctatcttctgaccagagggcgcaattttatctttagttgtttaggatatatgaatttttgagtatgactgttgtttttatgtcataatctggacattagtagattgaactgcaattgggggatccaaaaaattttcaaaaagcaatacaattgttcttttcttccaaccactgtcgagagaatcacgcctttcggcgtgacatagttgtccattcgacaacagctggagccatccgtggggacctccgaccgaaacactgagagtgagtgaaaccactgatgccaccgaagaagatcgtcagtgtcacgtcccaaaacgatcctaaaatatatcctttaaattatgcctagaataattaaatttctagtgaaagcctccaaaattaaaatgtgcaaagttaaaagtcaaacaaggcttagaggatttttgtatatttcctaaaagcctaaaatgtgtaatcaaattttagtggaattttcagagcacaaataataattattaagaaataaacaaagttaaaatgattttataaaaagaaaaaccctaaaatcccttcccctctcttgggtcaaatccggcccaactccctcccccatctctcctctccccgcggcccactcggcctccccctccctccccgcgcgagcgccgctgatgtgtgggcccgtccgccaccctcgctgacgggcgggacccacccatcatccccctcctcccgccgctccctccgcccctgcccgcgcctagcgccggctccgccgccaaatccgcagtgcctagccgcccccgcgtgaaattgaatgggggaaatattcc

SEQ ID NO: 45379 - DNA, 4854 bp, Oryza sativa
cggacctcctccgacctcggcatcactcccatcgccaccgacgccgtccaccgcctcgtcgagctcgccgaccgccggaacgccgccgtccccgtcgacccgagccacgccaccacctttctccgctccggctgcctcctccgttactgccgtctcctggggtgagccgaggaccgcttcctcttttcccccttcccttcccctctctcggccgccactccgtcgcgcctatggtcgccgtcggcaactatagtggcgccctcccaccggacgcgccgacgtggccgccttcgggcgcgctgtatggccgccgtgtggggcccggccgtcagctgcccgcgccctcaggtgcggctgacgcgttgggcccacggcactggccggtgtgagcccgggtgcacctggtccaccgtggaccgtgaggctgctgcgtgggccccacttccgtggacccgatccgcgcacacctcccctcggctgacgcaataaacccctttttaaattaaaatttaaatgaagaaattcgcaaatattcacttaaagagcatataaacttcaaatggccataacttggtcgtttgaactcggaattggaccgttcaagtctctaatcgttcaagtctcttggcgaaacgacctcttaaagtttcaccaaaaattggtgctatcttcgcggcacgacacacgataacggtcatagtcctctaaagttcgacctgggtgtgcgcgcatccatctggcaacacttataaccttgtagctgttgccgtttattaacatctcgtggtaaacgggccgaaaaggaaacttggtcgtcggaaaacccttcaccaccatgaatttctcatttttatctcgccaatccccagagggaggccgatcgcatatttttcggccgcaaacctgccaacaaggcataatggaacagtgcaaaaggagaaataccagcaaaatcaatcccacattccagtgaaaacatacgattggcgaaatactaacttttgattaataaaattaaggtcataatggccacaatacggcaacggctcccagccgaacatgtaaggcacctatatacatgagcaaactaccaaaaagcctaaaaaggcgaaggaggaaaaaaaacactagggtgaagggcctcacacctcagggtggtctcggtcttcatcgcttggctccgacggcctagggtccaccctggggttggtggcagcggcttccttatccttcgtcaatttttcaagttgttcgcgaagccgggtcttcgtgcaatccttgccgccatcctcccagaagtccttttggaaggccctcaaggccgccccggagcactgggaattctcgagccaagcccccttcaatagctcaggaaaatctttaatatggtcgcagccatgctcctgaagcaggctaagcacaaagcccgctgaaacgcgtgcgctgtagtctccgtaggcgccagccacttcaacaaccgagtcggtgttgacggtcgttatcgatcagtttcgaccgtcaatactaccaaaataggagagagctagtgatgcttacaatgcataaatgtgttagagtaataatattccactagtattaggtatactaacctttttgtagagaatgaaaataaagtggaggagaatcgacatcaacgcaaatgataaatcaatcggacgatgtcaggaaccagacttatgaataaatgggtcaagaactcagaactgacatgacaaactgggccaaaattcacaagtctacggagaagaacaacggaggaggccgccagctgaaattgggctagattggggtggccccaggttcggccaaaccaccctcgcctccgttggatctaggttttggctggacggttgagatgaagccccaatgacggttggaggctattaccgaccattccaaccatcacaaccgtcattacctgcctatataaggacttcacctcctcacttcacacacacacctcaagcaattagctctcttatttctctcaagtttagttttgtagtatctagctggtggaatagaaatagagtagaaatcggagtccgaaagccttcggaagagttcgggtatggctctagtagcttttctcttctcttttgtaagctttgtactattattagaatactcttctaaatacatttaaggtattgaaatactttccgagtatatgagtacctactttacatgaatatacggctagcttatctgggagatgctttcgtgcgggtataatgtttgcttatgcaattactctatgtcatgacgatgatattagagtagtatctggtagtttagacgtggtgtctagactacgggatatcattatttggggttatatattgcggatgagaggtgggccgctgatggtgacagctcagtacaggtattcgtccacgcctatatataatcctaagttaattccctggggagggtattcctccgtatttagccctggttgtatggtcatgacgggctgtcgtgaggaactcggcagccaggggtggcttctcaaagtaccaggatgttaacgaccaaatttggtaatctgagtatcgaagaagaagattagatcgatgcggaatcgaagacaaagatcgtttcggaaacagagcaagattcagctgaagtccaaatcggctacgatcaaagacagccgagttcgagtcggacaaggtagccgattaagccgaatttgacaatataacatgatacacgtcatcgggatgagttaatatgcttcatatggactgccagacatggattgagtcctgagaaggcaattgtatctattaattaggatattttacgtaatttccttggagataagtctgggcaaaagtctgccgcaaagacttatggtatcttagagtttgttagagataagagtcgtgtccgagaaggacatgttttgtaatctcgggtataaatagatctcgagccccatgtgtcacgcccggaatttctatccaaaattccaaacgcttacatgtgtgtgaaccctcgtctaggaatcagccgaggcacacaataacaaattgataatagagtacaattattactctaattaataagcgtataaaatgtcattacagaggtagatagttcctctcaatcaataaagatcttaagcagcggaaaataagataaacggcgcagacgactccactccacaggcagcttgaccagggctacacctaatcctccacaccatcagcatcattgtagaactcttcctctgatgaatgattgcaaggtgagtatatgacatactcagcaagccacgcagcaaatatgcaagtgcacaaggataccaaaggatggcatagtagggtttcatttgcaaaagcagcatttagcaaacatttgagaattttaataaaacagttaagtaataattaaacaatattaaaccaacgctatacaacataccctgttgcataggcccaaccattctgaacaaccatacccggctgtacagatcaatctccaaaccaggaatataccattccaaaccaggagctaatcaaattattaccaattatagcatcttttattacgatgagaggtgtgagactaatcacgaaagacattgttagacccgcccataaccgcgggcacggctattcgaatagttttattctgatcagaggtgtaccactgtacccacaagacacagccccacatcatgtcaccatgtgcctcaataccaccacggtacctcggaaaggagctgtgacaataccccttgcataacacactccaccgcagcgcaccattcctggatcataatcacccccttataaacaacgcatggactccccagcgacccctgtgggcttatctccgccacttctcagtctggtgccccgcaataaaccatgctatacaaaaggtaaagccgttgcccacgctggcttgtggttggcacggttaatgtttcacatccgaaactcgtgaaccggtccttaattgtcatgagcacgactgtcaaaaccatgtgctcacaacccaccattatcaagttttagttggcaagtaattaattaaccaatcacgattgaccatcgtgaactaacataaaatcatcattaaataataatgaattataagttatcccaataatgtgctaatgtttctaagcatggctaagcaatcacatctaatatctagctgaaccaatatatataaagctcaactagtcaagttatattaacccaaggtatcaaggaataaagtaatcaagaacaaaagggctataacaaacaataggttaattccacccaatgacattcgaaaataaatgcaatagttgaatagaaacaatagctttaaacgggatcaacatgctcaaaagggttgtttgggatctgtgtgacttgccttgctagccttggaactcttcaaattcttctcctgcgaaaacggactctccggaaacgtcggaatctaagcagaaaagagcaaaatcaccaaaacagcacataaacaagcatgaacagtacatgtggatatttttaacatgtagatctcaattttagaaaaatttagagacttgaaccaactaaatccaagctaagatgaattagttatgaatttttaaagattaaatcggattaaaacacttatatggattttaattgaattatgacgcaataatgaattatttttgaaaaggaaaaaggggtttattgcgtcagcggctagggtttgcggtggaccgggtgcacggcagcggttcacgggaacgaacggccgagatcgatccatccaaaacggacggccgagatcgctcgggtctacggcggctcacggcagacggccacgatgacg

SEQ ID NO: 45380 - DNA, 2854 bp, Oryza sativa
ccaaaagagaaaaggtagaggagatcccgaagattgtttcccctcaatcaatttcaccggatcgggaaagacgcggccgaatttagaaggagacaacggcggcgcggcgctagggtttcgggcggcggcggccggaggtagatgacgggtccgacaggtgggccccacctgtcagcgggcggacgcgcgcgcgcgagcggctgcggctgcgggctgggccgacttgggctggggggagagagagagggttttgggccgatggcccaaagccaaaagaagacttttaaaaacctttttcaatttaaattattcatgaaatgcaattccatttattaaaaatacttccttagctcaaataaatcccagaaaaatctaggaattatagaattaagcaaagtatttaataaaattttatctggccccattttatattggaatttattaattaaaattagctcttctcttctaggcttttaaaataaattctaataattccaattaaacaacaatttatacatttaggatttttagggtgtgacaccatgtaatacaacaacacacgttcaacaacaatctcggcgcatcgccactcttttactttcgttttgtttcgacgagttcttgctttcgggttgagctgcatcggtttcgatcttcaactaagaggtaaaacttgttatggcggcttgcgttctcgggattagtgcttacatctttatgatactctaatcttgttcatgtaagttgtcgagttatcatatatcttatataatctctgacaatatcgctatctaacctctagtcggctaatatctatcgctagggagcagccgattatgttacatatcgacgttggcttagattatataggatatctaccactctatgaagcttccaatagcttgattgtctagatattgtctttcttttcatacttatggctgcatcagttgtgtttgacctcataagtcgtgtttagaactatggtttctagcctgcttcttggttgttgattagagtagcatcggggtttcagctgatcttacctggtttagccttatatttcatgtgcttaattgatatgctagatctgccctttatgttgagatcttattgctttttagatatgttaagcttcttgtttgatatattttactcgctttaatgtcttaatatagagtggtatcggagtattagccgatacacgctatatctatctgatcggctatgctatgaacatatataatttcgttgttaatatatatttcgatctaagtgatttatactatctcggcatggcgaccgatctatcccaatcacttgatttatgtatatatcgacataaagattatatattgttaataattacagccgatcgaatagatttagtccttccttatttattcatgactgcggatcgatgcaaagatgcaaagatgacatcggctcaaagataaatgatacgtcatcggcggctggcagatcggctatcatttacggtttaactgcgttttctttgtctttatttcttgttgattgcagtatcaaatcaactggcacgcctgcgaacctaaaggcaagctttttggacctgcactggagttaagcagatctcccaggcctcgtgtttctacatcaacacgggagggcattggaaagagggtattagctagtatatcggttaactaggatgtatgtatactatgtatattagaagtataggaatagattatctttctcttttcttcccacctagcttagataatatattatgagattgagtattaatgcttgtgtgtcactctacccttgaattatcttaacccctacttagaatatgattatcacaagcaatgtataaattattagtctagttctctctacatgatcttcccacggaataaaataaatacgatacccttggaatactctcgggtgaaatgctacaatggtatatctgtgcacttatggatgaactctgtaaccataatataccagaactatttatgtgccattgctgggaattatatttgtagtaatatcgttaagaaataccaacaagcatttctggcgccgttgccggggaagattcataatagagattacttgaactaatattttatatttgcctctatataatcattttcctttgcaggctaaccttggttgttttcacttttgttgtggaaacagggtagtgcatgactggtttcaacctgccggaaaacttcaaagaaaatccagaagctttcttccggagcgtccgaccgcgagtcgttgctccgcagaaaactctaccgacagataaaccagccgtatcagtgccaccaatcttcaagactatggctagcaagactcaccgcgagttcactgctccctctgctgacaatgtggccattgggccgcggatcaacatgggagacgtggacttgaagtctagcctcatcacgatggcgcaggctagcccgttctgtggcaagcctaatgaggatgccaatgctcatctgcaacagttcctggagatttgtagcacgtacaccatcaagggcgtcagtcccgacgccgtcaggctaaggctgtttccgttctcccttctcgggagagcgaagcagtgattctatgccaaccgtgctgctgtcaacacctgggacaaatgctctacggcattcctttcgaaattcttccaatgagcaaaaccaacgcccttcgtggacgaatttcaagtttccagcaaacgagggacgagtctattccggaagcgtaggaacgtctgcaggagtatgcggccgcctgtcctcatcatgggatggacgaccgactgatcgtgcagaatttttataatggactcaccccg

SEQ ID NO: 45381 - DNA, 6428 bp, Oryza sativa
aacataaatgtcaaattagatggctttgcttccgcttttcaaaattagctgagctttaataaaatgatagaaatccagttagctcagttggcatctttagtccccgcaaatgaaactaggaggattccggggcaacccgactcctccattgaaaatgtcaaggcgatcacgacgaagggaggtaagtccactcgtgatccgccatatcctaaccctgcaggaacaactgggatatcaaaagaagcgccatctaatgattcggctgacaaggaagttcagccagaaaagatagtgtcgcaggagtactgtgacacacgattgctgcattccgtcaacagagtagaagaccgtcagtggacgagcaatttgctcattttgttgaagtaatccagaaaatccacatcaatgtgccattgttggacgctatgcaggtgccaacatacgcccgttatctaaaggatatactcaacaacaagagactgctcccaataacggaggtggtcaagctgacgaaacaatacagcaacatcatactccacaagctcccggagaagaaatattcggggtgtcccatgatcacctgctcgatcggggcacagcaattcgaccaggtcttgtgcgaccttggagccagcgttagcgtcatgccaaaggacgttttcgacaagctcaacttcatggtgttggcaccaacaccgatgcgcctacaactggctgactcgttagtccgttacccggcagggatagcggaggatgtgccagtcaagatacgggatttcttcatcccggttgatttcgtggtgctgaacatggagtcgggaaaggtgacgccgctcatcctggggcgtccgttccttagcatcgcgggagccaatattgacgtgggaacggggagtatccgattccatatcaatgggaaggagaagaagtttaagttccaaccgaggacggaacaatgctccatggtcagaataaagtacgggccgaacccgcagaatattgaagaggtcgaagtggagccacccaagacggacagcctagtgaaattcatgcagaatttcctggagaaggaaacaacgatgcctaggaaccgttactggaggctaccggtaaaaccaccaataccggctaagaagttagagcagctggctcagaagaagccgccatccccacctaagccaaagaaggtgtggagggagaagccaaagacgcccgctccatcacctccggagacgagtggaaaatccatgaactgaattggaaggaggtacagtcttgcacgtcggactttaaatgacgcgaccttcgccaacaggtaaattggtatgtatccgcatgtttgctttcaacaaatttgaatttttcatcatcacatatttgattttcaaaattgcatttaggacttttgaattttgaggaaattcttcaaatgaatttttcagagcaaaccaaaataaaattttccacgaaatgcactgtgccatgaccacactaaccgttggaatccaacagccgaaagtggggccggttgggcccaccaagggttcggttgaaccggccaggtaacggttccctgccacttttggcagggtaacggctagtgggtcccacatgtcatttttgaccgttgtgggtaccctataagagccagtcggccgagagagggaattccaccccatttcaatacattttcattccctctaaaagtttgctctcaaattcattcaagctttgatagtttccctcaaattcgaatacttagttacatatatacaagttgctttggtgaaactaaccggtaggtgaaatctttgtcattcctaacccccgccgagttagtccgtttttgctccattgtgcagaatgaggaggcgattgtctcgtctgttcaagggatccggctcttcatcaagtcatcatgacgagtctagtactcgttcatcagccgatatcatgatggaagaagccgaagcttcacgacaactcctgaacccgctgaccttgaccttgtcggtgatcgggagagacaagcctactacatgctggccgaccgggagtatgctcacacgcgagagtactcactggagttgctgaaaaagataggtatggatactgaatttcgttctatttggaaagctgttggttggcagaaatttgctgtggtatatgagcctggttctcatttgcttactttgcaatttctgtgcactttgaaagaaatggaagatggaatttccttttgctttttccatgaggagtttacacttacatggaaaggcctaagcacacttcttggttttcacgatacctgtaaaatcgatctccagaaaggaatttctgggttcgagaaaaataggttttgggaagatatttctggtgctccaatttgcaagaaacctaggacgaatgatatctataatcctacacttaggctcatgcacaaatggattgctatgactctatttcctagaggtgatctgagacccataaggggagatgaactaattatcatgtttgccatagttagaaaaatcaaaattgctcctgtaaaatgtatgatacggcaatggttagaaagtatcaagttcttttctcctgttgagtgcacttctctgattactcggatagcaaaagtgctaggggtcgttagcgaccaaattgcttttgtctcagccgctcgtccgcgtattgatgaagtttatctagtgcaagggcatatcttgaaacatggagtagatggatctttaatttactttttcccctgttgtacaaatgaaatcccattgccaaatgcggggtatcatttgtacaactgtcgtgaactaaccatacctctgcagaccatagaagaatctcgtgcaggtggaatatacagggagacgcgcaacatgacaagaaatgaacgagaaagttcatcatcctcaacactcgtgcagatgcatgaggcaggttgggcaccaactggggatgcacctggatagacctaagctccacgccacagcatcggagtctcaggctgggcaagtgctagtgaggaccgatggcgtgcgcctcatgacatacattggggggacaaccaaccctccagatcaagtggtgtgtctccatctccaagtgaatggcgctcaagttcctctcgttgggacttgggtgaaatcactaggagattggacacccttgatgtgcagacgacggagatccagtacaacctctcggaacacatagcacaaacacaagaatggcaacaatctgttgatgctcagttcgccaacatcaacaacatgatgcagcaatagcacgatgaccttcaagcatactttcgctttcaagagttcaatccttatcaaggaccctgagcgaaagcctagcttggggggagagacatctctccccgcactgaggtaacttgtatcacattgcatatttccctttccaattgtatatttccctttccaattgcatattttctttccaactacatcttataaaatttgaaaacaacataaaaatttgccaaatagaaaataccaaaaagaatggataggtttgcgtcatgttaggtaagacaagctagttatctttgttgaaatgatgaatagttgctctgctttatatctcttacatatgggttcttcgtaaatactctctcaaagattaaatataagtagccaacaattatccgggaacctaaggtaaatgagctgcacttgctgatctaagtctaagatgttgcgagatatgagatagtaaatatgagttgctacgatcctgatactagtttgacttgaattccggatgttttgtttttcaaaatgataaaactgaaagttcctcatttgataaaaattcctaccagagccaaaaatgtgctatcttgatgaaaccatttacattttggttatttgccattccactgaactttgtcaaactcttgtgacttgtgtagatacttctcatgctctatgatcaagatcatacacccacatatgtgcacgtgctaaactccaacactgggagctaagcaatgttccattccatttccatattaccaccaaaataaattctccatgctttcatgtgctttcttctcctaaaaagaaaaatccttttgaaaaaaagggaaaagaagaggatggaaaggcatggttaaaaaaaaggggttatgctccatcaaacatgagcatgatgttgaaaaaaaaatgtaatcatgccctctcctaatcaataaaagaaggatttttgggagaagaaagtaagcacaaaggagaagcattttctttatttttcttcatacaccatttccactatatatcacacactttgcacgatcttgatcttgagtatgttcagttatctgctttagtctaagtttttgacttagtaataaatgtgaatgcaagtatatcatgtttgatccctaccgaactccacatatcaaagccttagagaaggaatcaaaaaggcaataattggtgaggaattcatttttgatacacttggagagactgagtgaatcatttaacaaacttggttatctttttcaaaatcatttgaaaactttcggaataagagttggatgaatattgggtgaatggtgctctaattgttgttctgtctttcaactacccaaggcaaggagaagtagtgtcttgtgggaatcaggggtaaggataagccaccgtgccaaagattatttaatctgagagagagtacatgtaccttgcacctatatctttgagatatgcagcatagtagcaactcctgatcaacaaccaagtctttgtttcctttcgtcctttactcgggacgagcaatggttcaagcttggggggttttgttgacggtcgttatcgatcagtttcgaccgtcaatactaccaaaataggagagaactagtgatgcttacaatgcataaattttttagagtaataatattccactagtattaggtatactaacctttttgtagagaatgacaataacgtggaggagaatcgacatcaatgcaaacgataaatcaataggacgatatcgagaaccagacttatgaataaatgggccaagaactcagaactaacacgacaaactgggccaaaattcacaagtctgcaaagaagaacaacggaggagaccgcgagctgaaattgggctggattgggccggcccaggttcggccgaacctggtggttcggccgaaccaccctcgcctccgttggatctaagttttggctggacggttgagatgaagctccaatgacggttggagggtattgccaaccattccaaccgtcacaaccgtcattacctgcctatataaggacttcacctcctcacttcacatacacacctcaagcaattaactctcttatttctctcaagtttagtttagtagcatctagctggtagaatagaaatagagtagaaatcggagtctggaagccttcggagcagtttgggtatggctctagcagcttttctcttatcttttgtaagctttgtcctattattagaatactcttctaaatacatttatggtattgaaatactttccgagtatatgagtacctactttacattatgtttttgttatactgaatatatggctagcttatctgggagatgctttggtgcaggtataatgtttgcttgtgcaattactctatgtcatgacgatgatattagagtagtatttggtagtttagacgtggtgtctagactacgggatatcattatttggggttatatattgcggatgagaggtgggccgctgatggtgatagctcagtacgggtattcctccttgcctatatataatcctaggttaattccttggggagggtattcctccgtatttagccccagttgtatggtcatgacgggctgtcctaaggaactcggcaatcaggggtggcttctcgaagtaccaggagggcatcagaaagagggtattacctagtatatcggttaactaggatgtatgtatactatatatattagaagtgtaggaatagattatctttctcttttcttcccacctagcttagataatatattatgagattgaatagttaatgcttgtgtgtcactctaccctagaattatcttaacccctgcttagaatatgattatcacaagcaatgtataaattattagtccagttctctctacatgatcttcccacgggataaaataaatacgatacccttgtgtggatgcgaaaaagacaaactggcctgagagatctgttcatctccagtgcaggtccaaagtttgatgagatgcgggcgtgccagttagtttgatcctgcaactaacaagatatgtaaaccgtagattaaatagccgatcggctgacaaggcgatggagtagttccagccgatgccaataatagccgatgccgatactagccgatagcgataggatttaa

SEQ ID NO: 45382 - DNA, 9448 bp, Oryza sativa
acgccgacgtagatgacagattcaccagggcccgacggaacataggacttaccccttcgcaggagatcaaaagccgatgcagccccgcgtcaggtgccaagttccaccggaagacaagtaaaaacctcggtaaagagggtggcgatgcgccgagagtagttgtattgatcaatagattgatagattacatagaccccgggtgtacatatttatacccatgagttgatacaagtccttatcggacactaaacatactttcctaaagataaaaggaaactaacaaactattcctaattaatagataaactgtcataccgcatcctccttgaacttggactcttctaaataagcttccttcgattgatccgactccaccaagaacacgatagcatggcgacttgacgactcccatcggctgtttctagaactctaaaaccgatattgactttcagccgatgatgactttgggcttaccaaatttcgtcgttaacacatgccccccagtttagagtatgagtactcatgcttcaaaattatcttctgtctggtcttgataactccaaaactgatcttcatttgcgtcttgcaatcggctttcgtgagctgatactgtttgcattagatgagctagactgtcaaacccgtggcaaaagaatctatctctgattggtgctgacaatccttggaatgcaagatctgctagttgctcatcacttaggttcaaactataacattggctgcggacattatgaaatctcttaatatattccatagccgattctccctcttgctgctcaacggatattaaatctgcaagcttcaactcactgattccagcaaagaagtaatcatgaaattgcttctcaagatcggcccatccttggatagaatctgatggtagcgatgaaaaccatgtgaaagccgatccagtcaaagacaatggaaaaaatctaactttcaaagcttctttagctgatgcctccccacattgtgctaagaatcggctgatgtgttccattgtagatgtatcatcctgccctgaaaacttggagaaatctggaactttgtatcggtgcggcaatggcaccctatcaaaccactcaagatatggcagccgatacacagaagtatgttccttaggtttgattccaaactgctcctctattatctttgcaattctatcggccgaatcattgttatattgatattcttcatcatgcccatattgacaaagttcttctggccgatattgatatgcttgccccccgagctgattcttttgagtaactattttaggaactatcttcttgatcacatcttgtagtgtactcatcaaaactccagactgatcaaacaatgtgcgatgaactgcttcatcaactgtatcttgaagtatttcaactatcggcttggggaatcgagtcttctgaattggcccttctggtgtcatgatgaaacattgaagacaacgcatttgaaaatcagttaaaaactgctccatctgttgcctctgttcgtccgctaaattctccaccgtgaccatgatcttggcattgacttcttcttcagacatgtggatataaaatccgtggtcccaccaggcgtgccaaaaatgtgttgatgcgaaaaacacacactggcctgggacatctgcttagctccagtgcaggtccaaaggttgatgaggtgcgggcatgccagtcagtttgatcctgcaactgacaagatatgtaaaccgtagatcaaatagccgatcggttgacaagccgatggagtagttccagccgatgcaaataatagccgatgccgataccagccaatagcgatagggtttaagcaatcggctatatgtccaatatagataatgatagaaatgcaatcggctaatgatgatgtaataaaataacaatataatctagtataaaccaatcggctagcaatacaatatgatagaataagcattgatccgaaggttaaagcatacatcgactgaaggtccgatgtcataaaatccaaaagattagtttaaacagtgaaacctttgttgcaatcggctaaacccaacttgtatgtaatccttataagccgatgcaacgtccagataacttatcggctagcaccccgataaaacattagcatgaacctatcggcttagcaagacttatattatcaacaacaatctagtaggtcgaacctaaccgatacagcacgagattgtatatgataatctaatacttgatgagccgatagatctgtctaatgtgatggatataacaaatctatttagaacaacattgtaattatagagatatatcggctaaggtagaagatccgacctaaccgagacaattccaactaaaccgatgtgtctctaaacacaatgcaattagagatagaattgagatatcaggtaggcaaatcaatcaaccaaaccagagagatccaagaagtcgtagcgatgcagccgtgaacgacgccgacgtagatgacagattcaccagggcccaatggaatgtaggacttaccccttcgccggagatcgaaagccgatgcagccccgtgtcaggtgccaatttccgccggaagataagtaaaaacctcggtaaagagggtggcgatgcaccgagagtagttgtattgatcgatagattgatatattacatagaccccgggtgtacatatttatacccatgagttgatacaagtccttatcggacactaaacacactttcctaaagataaaaggaaactaacaaactattcctaattaatagataaactgccatgccgcatcctccttgaactcggactcttctagataagtttccttcgattgatccgactccaccaagaacacgatagcatggcgacttgacgactcccatcggctgtttctagaactctgaaaccgatattgactttcagccgatgatgactttgggcttaccaaatttcgtcgttaacaccttggaatactctcgggtgaaatgctacaatagtatatcagtgcgctcgtggatgaactctgcaaccataatataccagaaatatttctgcgcctttgctgggaattatatttctagtaatgtcgttatgaaataccaacagccggccgcttcctgcgtccactcggagaacgcgaacgctgttccgccatcacccagggcgccctccgcacgcgcgccaaggtcactaagcaccaaccaaagggtatagcaggcttgtttggtggattccgtcaccggcgcaaggacctcagcagcagcttcggatgaggcaagtcgagcctcaagagaccggatcttctcctcggccgcagcaagccgaagttcttgatcaacggacttcttgttcacccccttcaggttagcgtgaagagatttattctcccctatgagggatttgctctgcgctttcgccttcttcagggcgtccgccacgaccctacgttcgtcatctttatggcgaaggtcttcttcggccttccgaaggcagaatctataccagtcaagccgctccatagcagaccgcttcccgctcaagtgcgctgcgagaccctagatttagaaaattgaaaaccctgttagtacggctcgacggaagtgcaggacaggcgaaagtgagaaaagcccttacccgaaggaacaaactttccgcggcttaacaactctcgccaaactcgttgagttcgataaagagattgaggccgtcggacggcgcaatgatctggcaaaccccatcgacgaagggggcgatctccgatcgggtggtgaggtccgcagaaacaaagtgcggggcagtgagtgtcacatcagacacaatcatttcaaccgcttgggcttccccctgtcgcccccggagatgttcgccccaactgccggtgccgaagcacttccccctgtcggtgcttcggcgtcgctagcaggcgggggcgacagacgtttcccccatgggggaacgcgccactgggccggcgaagtgggcgtcccatcagtctcctcactatccaaaaaaccgcgagcaacctgcaccacccccttcttctccttcttcctagcgatcgctcctggtttcgctgcagagctagagatcgccagaagattgtttgcgccaacaacgtcttgcggacgcacaggcgaaacgtgggagcctgccccacacttcggccgagtcggactgggggtatagccgtgtgacccgtcatcctcgtcagacctggtgtaacatacccgaattctaggtcttaaaaatttcttgtcaaaatagttagaaactaacttttccaatgttgagagacaaaaattttcactttaacctaggtgaggtcaacttaacttgtacttagataaaatttgaggacaaactaaaaacttttcattttcagcctaggacaaaaatgcaaacaaaaatgtgtgcatgcatatgcatttagcattagtttgatttgagtcttttatgcgcgtttggattttggtttgcatatcatgttaggttcatgaacataaataaaaggataacttcactagacaaacccatggtcattattgtgaaataattataagtacatgaaagtgaagtcaaataataacaactcagttcaagtcaagtcctaatataagtctttacaaacatttagatgcatttatataatgagaacacttatataaataaacgtcttgcgaattattgaaaataattcgtgcaaggtaaaatcatggaaaaattcatgtagtctgtaatcaacacgtacaattcactgtaattttggtcaaattttaatacttaggatgatacctcaaataaatcagtcaaaccaattaaatgatagactaattataatccttaatcggctaaaacctactctcaccataatgtgcatgaaactgcatagaagtgtataggggaaacaatttattcaaatactaggttatttataatgaataaatatattttttcagaatttatatactctatttaaatctcctaaaaattcaaacaaagttctaacgagcccattttctccaattttctgagggcaaaccacataaaatttttgagagcaactacagaaaatggaaactaggtatcttcatctacgtccagaaaattccacatgaatttatcgtgcccacaaattaaactatagattaacaagagaggagagagatttaaatcctgaaaatcgtccaaaatcgataacacccaatctcctaccctcctctctcactccagacttgttcccttcgcccttgacccactttcagcctcacaagctcgctccacctgagtacatgatgccctatgttaggtactctaacgatttctccctcaaatttactggacaattgttcacgcatacaagtatcgatccacaggatcgttctgccgccgcctacgccaccacgtatccagttaatcaccttctaacatccacctatgttttttatatacagttaggacaacaccacacggctctccctctctcacatgacagcttggctacttggcccactgattgccgaagtagcgtgggttgggcctccgacgtcttgggccgatgcttggcgccgtttcctgtatcggcacgatcccctcctcgcctccagcatcttgttctgcttctccagcgccttgtccctcctcctggattccttccaccgtgccatcgtcttgttcatcagcggtttgatcggcagtcttcccgtccagttcatgatcgtcaggcttcctgtggttgtggcagtcttgagtcttcagaggaggcctgacaagcccccatgcttggaaatcggcttgcccccaagccggtgcatgagggaaccttgagtgaagatcttgcatatcctcccatgtggcgtcagtagctgctcccatgtggcgtcagtagctgcacttcctgtccaatgagttagtaactgaataatgggacagtttttggtgtgagatacgcgatagtgaagaaactgctggggaacttgaaatttggaaagagcagtaggaagttcagcttgcataggacaagaaaatccccgagcccccttcaattgagaaacatgaagcaccggatggatctgactagctgctggcagaagcaacttgtaagcaacagcgccaacccggtgcagtatctggtaagggccatagtagcgaaacgccaacttgtgattagccctgacagccactgaagactgaacatatggttgtagtttaagataaacccagtctccaacttggaattccctgaagcttctctttttgtcagccatgtgtttcatttgctgttgagctcggttcaaatgatgctgcaagagttgctgcataagcttcctctgttggaaccactgattcagatcaggaatggagcagtcattcagactaatgccaaaatgcccaggacagtacccatatagaacttcaaaaggagttttgttcaacgcagagtggtaggttgtattgtaccagaactctgctaagtaaagccaggatgaccacttggtgggagtagcatgaacaaagcaccccaaataaatttccagacattgtttaaccctctcggtctgacaatcagtttgtgggtgataggccgagctcatatgcaattttgtaccagatctcacaaagagttgctcctagaattggctagtaaaaatcttgtctcgatcagaaatgatgatttggggcagaccatgaagtttgtacacatgtttcataaattcaagtgctacactgctagcagtgaaagggtgagacaatgggaagaaatgagcatattttgaaaacttatcctctatcaccaatatgcagttctaatgatttgatttaggtagcccctcaataaaatccaaagaaatagtttgccacgctccagcagttacaggtaagggttcaagcaaacctggatacttggctcgatctggtttggcttgcaaacaaatttgacagttttgcaccctggactgtaccttctttttcattcctgtccaagcaaataaactcttaacccgctggtaagttgctggaaatcctgaatggcctcccattggtgagtcatgaagagcatcaatcaacttatcctgcaattctgttagatcccccacccaaatacgtcccttatatttaatgactccttgttggagagtaaagtgaggtcgagctgtagggcagatagcaagctcaatgagtagctggatggcatgagcatccttgttataactctggatgatttcctgcatccaagttggtacacattcagatacagaatttagctcagctgagtcttctttcctagaaagtgcatctgctgctgagttagtgactcccttcctatagcagatttgatactgtaagcccagcaatttagaatatgctttctgctgccaaggcgtgtgcagcctctgttcattcaagtgtttgagactatagtggtcagttaatataatgaattccacctctgaaaaagcggattccaatccccgatccggaatttcacggccaaatcaagagaatggaaggaaatctgagtggaattgtggttctgataccaggtgttaggtactctaacgatttctccctcaaattaactggacaattgttcacgcatacaagtatcaatccacaggatcgttccgccgccgcctacgccaccgcgtatccagttaatcgccttctaacatccacctatgtttctttatatacagttaggacaacactacacggctctccctctctcacatgacagcttggctacctggcccactgattgctgaagtagcgtgggttgggcctccgacgtcttgggccgatgcttggcgccgtctcctatagctttgttcggcatgatcccctccttgcctccagcatcttgttttgcttctccagcgccttgtccctcctcctggattccttccgccgtgccatcgtcttgttcatcagcggtttgatcggcagtcttcccttccagttcatgatcgtcaggcttcctgtcgttgtggcagtcttgagtcttcagaggaggcctcacaccctactgctccagccatccgagagggagaccgagagcgagagaaaacggagccgaccgtggtctggacagcaccgacgcgtgtcccagctcgcctactcctttcccagcatcgccgtctcccatcactctccactccactgccaaggaaccaaagctgagagctccatctcgccctcctcgccttcctctccatcgtcggccaccgggaaggacgcgttgccgttcgtcgtcgagctgcgcttgccgtcatatcctccatgttccttatttatctcatcataccgaaggttttaccttttgaccttaccctctctcgtgcagcggatcattgggaacgccatcgtgcccacgggagctgcagagcgcgcccggagcgccgccgccacgacctcgtcgctgtcccggcttctgtggagcgaatccggccgagctgtcgcgccaacatcttcccctcgaggtcctctccaaatgccctcaggaatccccaagatccgagcttcgaggagagagatcgagctattcttctccaactccggccgccgagctccatctttaattcctctttcaccggtgagccccaagtcgattccgtgaacacatagatttcctaggacctctttaacatgggagacatgcatgcatggcagttcttgtagtaagtcaagccgacgccgttcatccgagaaggagcgccgtcgccgagccgttccgaacgccgtcgtcggcgacaaagcttcgccaacctcgtacaatactactgtgagcaccctggagcttctagagttgcatgcatgcattttatccacctagatccggcctctaacgtgacatgcatcactaccccgagacccaccgccgctcgtgccgccgtcgccattgattccggtaaccacagatcaccataagacaatcattggattcgaaaagaacccctcttccttttctcttttggtttcatgccgagatcttccaccgttcgctgccggcaagctcgagaacgagctcagccatggctagctctgtttcagctcaaaccagggacctctgtggagaagaaacaaaactctaggtactacgttctaaaaactacctcacacatagaacagtcataggactgcggattgattgcctgaaaatccagggacctttttgcatattgatatctcactgacaggtggaccccatgagcttaaaatctgaaaatctaaggaaaatcctctagagctttatattttcaacagaaaaacatgcaaacttgtaaaattcatacaaagtgaaatatagctcattttgagatgattcaagtttctgtgaactcatagtaggatgaactttaatatggaaacataaaacttggcacttgcagtataaatttcacctctaaaatttatctaagaaaaaactatacataaagcatgcagggct

SEQ ID NO: 45383 - DNA, 15862 bp, Oryza sativa
  unsure (1)..(15862): unsure at all n locations
aaaattcatattacttcctttttgagtaaactcaagttctgtagaatcatcaagtctaggacttcaaagatataaaataaaaatatacacttacagtgcaataaaatcccctaaatatttataaaaggaataaacaacttagagcacccttcaacttgtaaaatttctagagaattcatctttagtctaaatgtaatgaaccaagtttctatagaaccagcaagtaatgaacattaattaggtaaaataaaatgtggaaccttctatactaaatatgtcactaaactttaaatagataacttaagtgctagtcacatggtatatattggctaagcaatacatatgtataaataggcaatccatatgtataaatgtatatataaatgcactctagctctaactaaccaaaataaaacttgatggaccagagaggtcatagttccatccctaaccaccaaaaacttagcacacttagctcatatatcaatttctaggttggtatgttaagtaactaacatagaacgctcccctagcttataaaatgtgtagtagcgtaatataatctctaaaattgtgaactaagattatattggttaataaaattagtcattttatacatctcaaacaatatgaaacatgtcctggacataaaactccgaaaccatgtacacatagaagctatatacctacaacacattataacttgtaaaacacataagaaattcataataactccaaaagttgtgaaaccaaatgttttagtcttagaaaacacatctctacatccctgatatgttaaacctaataagaatcagttcgcaaaaatatttcataacactactaagtgaataccaccctataccgagtaaacttctgaaattcataactcacaaataaaaagagataaaatagaaattctttcacctaaactcatcttataccagtacctacccactgtgcacaaatcatgcattttagagcattttggatttttacctatttccgtgcataaacggtgaagaagtgaattaggtgctaacatttcccaggaacaaggcaagttttctcctcccaatctttgatcacattgaatcccatgttttgaggaatgaaaatatttgtttgcaaagttgcatatgaatttagactataacggtatttgaaacttggttatggtagctatgacctaattgctgcatttacttccttgaataattgtgatcctcactgattgtaaccttagaaatggttagagtactttcaaagtgcttaaatgggtttatacatgcttacttaatagccatacgcttagccatgcctagtagttgctaaataacttcatgatcactttttaaatgagaatttggggaatattttcactgctggatagaggtgaatatctctgatatttgtgagctaaaatgtgtaaaaatgtgatgttagacctgggcggcaagtggtatgcatatggtgttagttgcataccgatagggggagtgctcgccctagtcaattaaggaccgaactttgtgtcaccatctaaagtataccgtgcaaccacatgtgctaggaatgggacggcattagcttattaaattgtttaatgtctaaccttgcattgggaggccgtagtagtatgaactagtcggaatgatggtttataggagctacctagtgcggttgtgcctaggcgtctaagcgtgtccaatataacggttaagtgcctcgtggaggaacggatgtgttcgctgccatggcgctagggatggcgagggccccccgacctagcggcacttgggttgctcctcgtgtggataaacacttgccgtgctcgtgcaaggttaggcattaggcaatgtaaaggcttcgttatgacctctagaccacattcaacgtgaagaatgtggtagagtcttgcaaactcaaaacaaactagagtgtttatatcatgtgggtaaagctgtacaaactctgcagagttctttaaaactaatcgattagccgtgctcacggtcatgagcgctttggtgatgtgtcatgagtatagtcttgtgttttaaaattgtgtttatgaaacttgggattgaaatggaagaattgtgttgagttgtgcgagtgatgatgattataagacttgttgctatggaagacaacaagagtatgcttatgatgatatgatgttaattatgatgaacttacaaatttgttttgttaattgaatcattaactcctttgcaaaagatttgtgaaccaagtcggtgtgcttgtggttgggtagtcaagcttctgctgttctctgttatctatctatatttggccggtcggcatatgtaactataaagtagttgtaaatttgaatcgctttcatcttatttgtatttgctatgcataacaatgcttaagatgaaaatgtgaatctagtgcacatcttgggaactagattcacatgaatatgagttaaggatatttgatatatcatagatctttagccattttgtcaagtcacctgaatatgtaacacatctggtcgctgccttcgtgtggtttgacgggcacatctcaggctgaagttgactggcaggctaaaggcccggcaatgtctctagtatccttctctcgaggcgtcggatgtttcattatgtttgtttgatgacttgaattattcacttcatacctcaaatataatgagaggtccggagagcctacgacacctggcctccctatcgtcatcatcatcatcctcatcagcatcggtttcggccgcgtcctacgcagcacgacgagttcgcacctggccgctcttcgcgacggctcgcttgtgcttcctcgacatcccaacgtcgtcgtcgccagccttggaagggatcgatcggttggccaattcgccgccatgaacccggttcacctgaccgtcagcctggcgctgaagcaggcgggcgaattcggcagtagtacgaactaaaaaaaacaacgaattaggccgaagcgcatctccgtaaaggaaatagatgtcaaaaagcgaaagcaaaactcacgttcggtcccggcggggagaacaaggcgaggaagcccaagcaccacctcgcccttgttgatggaaaccccccagtcgcaagcaaggggggaaatccgaagaaggcaaaactcctcgcaaaggtcgtgggtacttaatcgccgcagaaccttgcgaaggaggatgagccgggactcgagggtgccatcgatctccacgttcggcttcacgacaatggagacggcaagacgccaaaaacggagccagttcgccttgtcatcctcggcggggtaaggattgttgatgtagaaccacttctgcatccagttccactcccacttcaccatagacgcaggcaccggccaggcgtccgaacgctccggccgaagcatgaagttgacgcagccgaaaactgtcttcctcggcccggctggcatgttcacgtctttggttgtggcgcacgccgtaaacaagatggcgaacaattcggtggtaggatcgaaaccacacgttcggcacatccatgcgaagacggccaacttcgggaatgctgacgggctaagctcaggaagcctgacctcatatatcgccagcacagacatctagaaattgtcgcatgggaggcgaagtccagcaacaaggaaggcagcaaaaatgactgttcgcctgtcgcctggcgaagggacggtggcttcgcccgcacagttcacttggccctctgcaagagcaccggagaggacgaactcagccaagtcaggctccttgacaagggacttgccaaggtagcacgaccacccttcgccagggttttcgccggttgacccggctgtcacgccctgataaattcatcccgaaataaaaatcattctctaaaaggaataatagaattaattaaaattcgaaaagaaattggcaaaccttaaaatgcgtacaagaaaaattcgaatgtggcctagagaatttttgttaaattccccttgctctaaaaggagccctcaaattttactataaattttagaacaccagaaataattattaagcaacaacaacctttagcaaagtttattaaaaaaaaacttaaaaataatcctccttcttcctttgggccaagtcttgcccaaagcctccctctctctccctcggcccgcggccgaagtccttctatgctccctctctttttccttccctctctccctcgggccgcccctcctatccctccttccctctcggcccagccgctcggcccaagccgagctgcagccctcccacgcgctcacatgtgctgactgcgccagaccacgtgggtcccaccctcggtcatcgtcctcctcccgcacggcctcctctctctctcccgtgaaccctagctcctttcctcccttaaatccatacgaatcaattcccttcatttcaaattgaggctttgttcgctagctgtgggaattaatccccgggtaaagcctcccacgtggggtttgggttgtccccacaccccacacccaatccctccctggctccctgcgaatcccccacctctcatccctctcacgttagactgttcggacagaggtgggattagaagggatcactaccattcactacacttcaaattcagaaaatgagtaaaacatgttggaaaattcggataaaataaaaaaaatggaagaaaggtcacgaacgtcaaaatattttagaaatgataaggaaaaaattgatcatgaaaacaaaacaaaaattaaacgtggaaaataattctaaaaatcccaaaaaaataaaattgtagaattaccacagatgcactctaaaaatagtccagaatttttaaacaaccgtaattttggatagattaaattctacaagcagtaaaacatccaaataatcacaagttttccatagatatgctaggaaccaacttaacattgatactacaaaaatctctctttgttttcaaagaatctaactttcaaaatcagtctagaactgaccactcttaacattgtactcgcatacaatttctattgaaggggcactgcactattgcaacaatcaaaattcagtgaaaacagctttgtacaaatcagatctctctcactgagctaactgaaagaataaaagttccaattgccattgtgcaaagcaagacaaaaattggttcttggaacttaataaatctctgtccaatcaaaatcaataatatatctctgtctgatcaaacaagtgataattctgtagaaaaaattggttcctgcaaccataatagctacatgaattaagaagcagttaaggaaaaattgtccttcacccatcgcatttcacgattaaggagtctctaagaactatcttgcaaaacaatccttccaatgggcacagctagcaaatgggccatggaaccctgtaattacacatccaaaaagaaacaagtgttagacactagacaatggtgattgctaatatgtaaactaattaagcaacaggtaaaatgaacttgaaaacaatccttccaatgggcacagctagcaaatgggccatggaaccctgtaattacacatccaaaaagaaacaagtgttagacactagacaatggtgattgctaatatgtaaactaattaagcaacaggtaaaatgaacttgaatcaaatcagataaatatgcagaagatggttacttatactcaagtcagcaaatccataacattgtacctacaatctctctctccaacttcaaattacttctgttactctagtaaatatgcaggggcaagattaaatgcttcatatcaggcaaatgtaagtacaactgtatttagttttttctcaaataccttggataatatcaactccttcagctttacttttgccaaccccacacgcctgtgcctcgcctgaaatttaattcagcacaacagattatatttttgtcattcaatagccatttatatagctttgtatgatatgacctctagtaaaatatctgaacacccagtttcctgaaactagttgtgaacatagtagcagttcagaatagataaatatgctaaattgattgctaagagtaaaataggtattcgaacaaaagatggacagctacatttctcaagttttaacaagggcattttgctaaacaaaaagccatggaaaaaaataccaaaactagaatgtatactacagtgtccacctgaccacctgatagcatgactttaaaattttttgcatcttcttgctcattcaattggcatatagtattggtcgttcaatctgaagctcaaatgaccttggccaaaagcaaagtgatgcattctagacagcaacaacagagtgcactagtttttatttttcaggtgtgctcccactgcatctacaataattcctggagaatcaacaaaccaggtttctccctcacaaaaaaagaaaagaaagaagagagcccatgttcagaaatataggatctgccaattgaaatatatatttccttgattacagagcaactgataggcaagatttgcacacacacatagagagatgtgcatggaattttctgtggtttcaggttctactactacaaaccacatcacccctccttctaagcagaacatgactgatacttcaatccatacagccactcaattcatcaactagcaacaaattcatccactagataagtcacaaaatcttttctgagtgggaaaagaggagatcaagaatcagacctgcttcttagtgtccgggctgttgccctcgacctcgccctctcccgcaactggtgaatccgaagcgaggaaggagagatggcgagcgccggcaactgggcgggatggagagcgggaaggagagcggcggcggctgaaacgggatggagaccgtcggcggctgaggacgggatggacaccggcggcggctgaagcgggatggagaccagcggcaaccgacggcgggatggagagcggcggcggctggagatatgctgctctcggatctccaccctagagccgcctcttggacctcgcgccgcctccaaaccctagcgcagcgaggagtcgaggaggccgagcgctgcggctggcttggaaaagaaaaatcgtctccgaggcgatttttctctccccgtggaattggtgtggattgggtggagaattgctccgaccccagcccaggcgaacgcatacatgggccacggaagaaaattcgacccggccgggatggcacacggggattttggcccattccccccccccctcaaacccagccgaaaagaacaaggcctgaggggggaattaatcccctttccctcctctctctttcccccttaattctaccttgattcgtgcttttaatcgctcggaacggctgcgcctttcccggccaccttccatggccgccggccgccattcccgcctccgttccgccctctcctgtggccggctccctccctgcgcctataaaatggaaccccctttgtgcgttctctcgtttttgcctcttcccgagctccccgtggccacaccgcctctccccgccaccgtcctctctctcccgtgccacgggccacctccagccgcctctcccttctcgcccatgcaccggcaggccaagccgtctcctccctcggcgtcgcagctgcctcccctccaccggcgtcgcctccgtttcgcgcggagaccatcggaggcgcgtttccgccactgtaccgcctccagtctccctgatcgctgcgccagagcgccggccgacgtcgccgtctcctccttcggtaccgcggcatcgacctccaccccggccgctcctcggtttcgttcggaagtcgccggatcaccgccgtcgcgccaacctttgcatccaccttgccggcgcaactccggctacctctgtttgtctcctttgcaaagcatcggctagctacaccaccaccacctttggcatcgcagtggcatggtcgccctcggtctcacctcccctcctcccgaaccctgccggtcttcatcgtcgtcatcgttcgtccttgttgacgtctcctctggtcggccgttcctcctcaccggcttgtcatctcgcggcgctgcctctatcgtcggcatcgcaacggcatgttccacgccgtccttgcctccgtgcagctgctgccggctgccctcgtcgcctcctcgccggccccggtcgtcgtggcgttcgtccctctgtcaagccaatcacgttcgccgcccgtatttcgtcaagtgtgctgctgccccgtcgtcatcttcgtcctcggctccatgtcgtcaagccctgagtcggccgcatctcgccttcgtccaaggatcgcaaccgaagtgtcatctgttcgtctccgttgcgcccgttcgtcaccgtcgttcccacgcctcatcgcgtggtggtaaggatccccctctcgctgccccgtcctcatccttttggtgtcgccctgtgcctgttgtgcggttgtcgaccccggtacccgtgtaccggtgtcggtagtcgttcgtgtgtgcgtgtggtgaccatgttagtgtgcccgctcggtagccgcgtggtttccacgtgtgctgcctgcatggtgtctagtggagtccgtttgtcagccactcacctcggttgacacatggggtccgcttccgtcgacccgtggaccgtctctgtgtacccagtccaccgtggtcctttaggttgacatatggggtcctcatgtcaacagcgcagccttcctatcttttccaggctagcgcttccacatgttttatagttacaaaaccttattataataatcagtaaatctccatataacagcattaaacttcggatgaccatatcttggtcatacgaattccgaatcgacccattcaagtctcctaatgtttgttataacctaaagaaccctatgcaatctttttatgtactgttattgcttctttataggcttgtagctttgattgtgtgctttgcgtagctttcgtcattctggaggttcccgaagcgtggtccgctatcgtcgccgaaggttcggaaggtcgttctctcttagcaaggcaagtcacatcacccttgagcatattgaatcccagtttataaaattattttattttaaattattgcattaccgctttatttaaattcccgcgttatcactgtttttatttagcacttcctattaatccttgttatagccttatcattgctattgtttattatcaccttgttcaccctaggaaaataaaaccccaactagtgggtaatccattcatggttccactagtatgaatttaggtagatgcttcgctgattaattaggcaacactaggtggttttataactttagactttgggagttctcatatcatttggacattatggaatggttggcttgtgatggaattgaacacacacctcccccttctctacaaaactcccaaaatggttttaggctgggcttaaggtgcatggttttgttagagaaccttggccaccataagtgtcacatcctgattttcgtttcaggatttataaattatttaataaattattaatagaatttatattaagtgttctttaatttacaagtgaagttaaatgtgggaaataaaatttcttaaatttaaagcatggatggatttaatttttgttaaattctccatggttaattatactctctgaaattttctcggatttttcagagctcaattcttaaataatacaaagaacagttcagtaattatttgatcattaatgatctaattataattgttaagagcttttcttgtttaaaaatccttaaattataaattgttgtttaaaaaggaattattcgaaatgatcttaaaagcttagaagagaagatctaattttaatttgttaaatctcaacataaaattgggctagataaaattttgttaaatactttgcttaattctttaattcctagatttttctgggatttatttgagctaaggaagtatttttaataaatggaattgcatttcatgaataatttaaattgaaaaaggttttaaaaagtcttcttttggctttgggccgaaagccggcccaaaaccctctctctctctttccctcggcccagccggcccagtccgccaagccgccgctctcctctctctctcagccgctgacaggtggaccccacctgtcaggttcgtcttcctcgagccgccgccgcccgcaaaccctagccgagagccgccgccgtctccttccaaattcgaccgcgtctttccttctccagtgaaatcttttgaggggaaataatcttctcgatctcctcttccttttctcttatagaaactccggtcaatttcctttggaaataggcggattcgagattgcttcggattcgttttcccccgatctttccttctcgtcgccggcagccgtgggccttcgccgccgcctccttgcccctttaaaaggatccccgagctctcctctacccgccgccaccctcgccttcgtctctagtcgtctgtagcgccctagcgccgtgccgcctcgcgccgccgtcgtcgccaccgctccagccgtgcgccgccgtcgctccagtcgtcgccgtcgttcgggaagaccgccgtcgtggtcgccaagtcgccgccgtcctcgtccgccccttcgccgccgccgaagaccgccggagctccgtcgccgccgccaacccgatctccgccgccgcttcttcctcgccgccggcgccgtccgttgcccttccgccgttgttttggtcaccggtgagttcgctgcgtcgccctctacccgttggtgccctccgttcgcatcgtcgagccgtcgttcgccggcgagcatgcgcgcccgagccgccgagtcgccgccggtgctgacgtcatcgctgacgtcatcgggatcgtccgccgtgagccggtcgtggaccgtttgatctcggccgtccgttttggatagggttgatctcggccgttcgtttccgtgaaccgctgccgtgcacccggtccaccgcaaaccctagccgctgacgcaataatccttcttttccttttcaaaaataattcattattgcgtcataattcaattaaaatcaatataagtgttttaatccgatttaatctttaaaaattcataactaattcatttgaactcagtttaatgtggttcaagttgcaaaagttgtgtaaaataaagatctacatattaaaattgtccataaattgaattaaatttattgaattctttttaaatgggctttaaatagatttaatcttgtaaaattcataataaattcatttgaagtcagaatgaggccgttcaagtctcacaattcatctaaaattatgatctacatgtttgtttactttttatgtactgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcaaatgtcactgggtggtgtgaacctattcctttgttatggcctgtttgcattgattactttattccttgataccttgggtgattataacttgactagttgagctatatatatattggttcagctagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcacgagctactattgtgaaacattaaccgtgccaaccacaagccagcgtgggcaacggctttaccttttgtatagcatgattcattgcggagcactagactgagaagtggcggagataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcacaataattatggatgttataactggtaataatttgtttagctcctggtttggaatggtatattcctggtttggagattagatctgtacaaccgggtatggttgttcagaatggttgggcctgtgcagcatgggtgtgctgttcagtgttgattaaaatttctgattaattactccactattttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaattaacctcagttgaagaaaaaggattcagaagaagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattccgggacgaggattttatgcacaaataagttcggaaattactagtgaatttccgggcgtgacaataaggaccggttttcgggcctctgttgcaaagcactaccgtacttccacatgtctagtgggtaaggcgtacttcgtggctcagtctggtcatgggcaaaagtacacggatagagatggacgaagttggggctcgatggacatctctagggaaaatgaaggctacacgagctgcggcccggtagtcaagatgtcatggcacagggctggtgtcctgctgctaggggctcaaccttggttacctgtcccgggattccagccatagtcagggttgggtcggtactcttgtttatggctaggatgggttgggaactatgtcacgtcttccatccatatgccgtggtggtatgtggcacgtgattacacgtgaggaagacgtgtcttgtgggtaaagatgtacacctctgatcagagtataatctattcgaatagccgcgccctcggttatgggcaagcctagcaatgtacccaagttagtggtttaattcttaaaacttgcttaacaaccaaaatgtggaatggttgcttgggttggcttgggacgagctgggacctaggtcgggttgctagttcggtctgaatcatcgtaggccttgggttaaggcaggttcgtgtgggttcgcggccttgattaataatattatgtagccctaggatcgtgcttgtaaaataactttgagcgactaagtgtcttttaaatgctgtttactgcaaaatctaacccctattattatccccttgtacccccttgcattaatcatgcatctcccggtgtggcttgctgagtactgtcgttgtactcattcttgctctatcttccccccctcagtaagagaagctttggagaagaagtcctaggtggagtcctggcttataccccagttgagctcctgtgaagatggagccgtaggcccgctagtccgctgttgtttattttttattgtcagacctgaagtgcctttgtaataatgcaaatattatcgatataataaagatgtgcctttgtatcatgtttatgtggtgtaccccggcttatcgtgggacggggattaatacactagtgttcgagaaaaggtaatttttccgggcgtgacaccggcctaggcgagcttgcaaggagccaccgaacccgcggcaaaagcagaagtctaaagacgagaggggggggggaaagagtcaagagagcaagcgcaggagcgcagagatggtgaaaagctaagagcacaggtagagaaggaaagcgcggcggtagtaaaaagtgaagagcgggggggaaggtggtaacccgcggcagggttatatagactcgccaagcgacagttcgactatagaccaatcaaaacccgccacgtgtccaagggtagacgaaacagtaaattcccatcgggcagaggccgaacagtaaaaggccgaatgcaagattgaaaaggcccacggggcccattactattcataatagtataaaaaataatccaaccttttcgccactcgttggagaacataggtaggaaattttcctcaagatttttttgtcaacgcgaaagcaagttatttattttgcaggtacgcagcatgggtttcgacaggaacatcggctgaaagggggcacgtcgtggtacaccatttgacttgcgcggtctcggtcgaggctccctactcacccttgcccgtgaggggcttgttggaggtataccacgaagggccttcggtcggacctgccgaaatcaagaacttaggcaacaagctcagatcagaggaaagcggcgaaggtctagaaggaaaccatatgggcgaaggtcacaagatgaaagccgtggctcgggatatgccaacttcgccaagcaaagaccttgtcagagggccgcacgggtgaagatgatgaggtgaaagccttggcacaagggcatgggttttgccaaagtaccgaacctcgctgtcaggaggcccagcgggccgctacgccttctagggatttcggcaaatagatgggccaagccatttaagcccaataggggccatacatgtaaaagacattgagtgcccccaataacgtccctatcataagggtaaccatgtaaattcccccgtaaaatctaaaccctaaaggggggagcctgtaataggattataaatagccccctaaggccatgtaatagggggatccaaaaaattttcaaaaagcaatacaattgttcttgacttccaaccactgtcgagagaattacatgttatccgaatagcttgttaaagccatttgcttgttatccaaataaccactcaagcatatagaagaatatgtagaataccatattccaaattcaagagtctattgcaaatacctcatgatgcgtttgacagcttgacgatgtgaagcacgtggagaagcttgaaaacaagcacacaaacatacaacaaattgtatgtccggtcttgaagcagtgagatagagtaatgatccaatcatactcctatactccttttgatccacaacttcaccatcttcatccggatccaacacaggagtagatccaatgggtgtagacataggcttgcaatcctccatcttgaaacgccgtagaagatccttggtgtacttcgtttgatgcacaaatgtgccttgctttgtttgcttgatttgaagccccaaaaagtaagtcaattcgcccatcatgctcttctcaaattccatgcgcatagtctcagcaaactccacaaccaaagggtgagatgaacaaccaaagatgatatcatccacataaatctgaacaaaaagttgatcatcaccatgcttaagaacaaagagtgttttatccacttttcccattataaaacctttggcaagcaaaaagttttccaatctatcatgccatgcccttggagattgttttaaaccatacannnnnnnnnnnnnnnnnnnnnnnnnnnnnnnnnnnnnnnnnnnnnnnnnnnnnnnnnnnnnnnn

SEQ ID NO: 45384 - DNA, 1928 bp, Oryza sativa
attcctgcagcccgaaaagaaaagaaaagaagagaaaatagttaagtagggtatctccggtttgaacgcggcgcgcggccaaatgcggaatcatacaattctttactccttccttaaatccgttggtttcgtttccgttgtttatgcctcggaagccgcatgcatctccttaaatcttcttcttggccggcatccgccatccctagaaaacaactcacgaagaacgtggccatgcccatgccagctttgattgatgagtagtggagtacactggactggactggactgaaggagtagttgttgattgataccgatttgtctactccaccacatgatcagcacgagctagacaggcaggcacaattagctgggaatgcgactcgatcctcgtttcacgcagtccatcaaggagaaaaataaaagcactatcttgcttttggctattttccttccttccagcaatatataccttgaagcatatgtagagaacatgtcccatgtgaacaggtatgttacactcttctctgtaagggcattaccttatgttatagttaaaggttgactctatttttcctttgctcttgctttctatctctgtaaatttaatgtaaatatcttgagcacgtgtaaagcaagctcttgtattagagctaacactttttctcttttttctatataagtttatatttgacttatagcctaccacttcactatctttgctctaaaagaaaataaactaatgtctactccatctgtcccaaaaaaaaatcaacctacgtggacatattcttttttgggacggagggattactacttccaccccccactaaaccaaaaaaaaaagataaattaggaggagatatgatactccatccattccaaattgatatacatatagtttttttaggttattcctaaatgatctacatatttgtgttcatttattgagtctattcgttatttgtgtattggagtaaatggacattgatgcatgcatccatgcacacaagcatttataacccacatgtaatatcttgatttgttattggctagaaaatattgggaatggtgcatgcattgagtttgttgctagaataaatatagtatgaaagagttattagcttttttggttttggtgtacctataaaatatgtagatcaatttggaatggagggagtacctcttaatgagaatgtgactcatcctaatacaaccaaccaacaaatttggacggtattttttgaacggatggagtagttagaaaaaaaataaagtaaagatttttgctcttctttttcccctcatgtcaggtgaggtgtacagtagtcggcgtctcataagcagaggcgggcaggagcagtgtgtgtgagtgcgaccatcacttatctcttctctaatggtgtagcggcacggcccggcacggcacggctactgtagcggcacggcccggcacggcccgcggcacggcacggcccgtttcgccggcggcccgtcaggccgaaagcgccacgtgggcgggcggcggtcgaatgggaaggcgccacgtggcacactaacggctatttgaccgttcaaatttgaaaataaccgttgggaggctaaaaaattcataaaaatttcgaaaaaattccaaaaaatctcaaatttcgccccgaacggcccgtgggccgcaggcgtgccgtgccggcacggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcctgtttggacacctatataccagagtcgtggggcttgccttcactcacaaaacccccccccccccttggaccttggtttgttacctt

SEQ ID NO: 45385 - DNA, 1952 bp, Oryza sativa
  unsure (1)..(1952): unsure at all n locations
cgattcgtgcccctcattcctgggacgaatcagatttgctcattgcttacactctgcactaatatattaggggaaacatttgcgtgcgccggaacactagctagtttatttcaagattcattctttcattcgcattcgcatctggattctagacggactggatgtgttcctgttacttcaaaagatatattttacatttttcagactacaactgctccaaccctttgccaaacttctcctatcgctctagcagtagcagatctccgctactccgatccgtccttcccctcgaattgaagcactaatccctcttgcacacgccctagtactagtattactgcctgcctagctctgctcacctctgcttctctttccaactcgcgaatgctagcctccatcttcatgcctgtctctttactaacattatgcctccttttacttgtttcaggttatcgcaatcaacaagcagttccctggccccgtcatgaacctcaccaccaactacaatgtggtcgtcaatgtgctcaacagcttggatgagccattactcatcacttggtcagactcaatttcctcccccattccattatattgttcaacgctcccatgctgacattcactcgcaatataatgtgctgtcaatgtgttgactgacccatgtcttatttcaatcagggatgggatccagcaaagaaagaattgctggcaggatggtgttcttggcacaacctgccccatacctccaggttggaactggacctacaatttccaagtcaaggaccagattgggagcttcttttacttcccaccccttagcctgcagcgtgctgctggtggtttcggaggtattactgtcaacaaccgcgccgtcatttctgtcccattcgacacaccagatggagatatcaccttgttcattggggactggtacaagaagagccacacggtagagagagaaaaaaaaaacctaagcctattttccaggactcatcacatcaatggtcatggtgctgattgtgtttgtcttgtataggacctgaggaagatgctcgatgatggaaaagagctcgggatgcctgatggagttctgatgaatggcaaggggccgtataggtacaatgattccctcgtccctgctggcattgaacatgagactatcaaagttgaaccaggtgattagtcctcccacactttcagcatgataagctaaactagtccttgtacatgttgccaaaaaaactgctcctataagtctatctctctgctgctgctaccagtatttttgaatgtaacattgaattgtacaatgtgttctcactgctatgttggatgaatgaaagtgatagttcatcatcacttccatgacagggccaactaaaatttctttgaacaatgattgcctttgtttattctcatgatttggtaactgactgctcaaactccgcaacaggaaaaacataccgtttccgtgtccacaatgtgggtatatcgacgagcttgaacttcaggattcagaaccacaatttggcccttgttgaaactgagggatcatacacaatgaagcagaatttcacaaatcttgacatccatgtgggacagtcctactcatttttgatcaccatggatcagaatgcaagcagtgactactacattgtggccagtgctaggtttgttaatgaatcactgtggaccaaagttaccggtgttgcaatcttgcagtattcaaattcaaagggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45386 - DNA, 5247 bp, Oryza sativa
  unsure (1)..(5247): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaattgttttaattcaactttaccttttatacgtgtcctcaagccagatatacatgatggtaatgctagactgctagctgtaacttattgataagaaaatattcaacaatcatcaaaagatttcggagtgttccagttgagtttgatgtcgtgatacaaaatttaccttgttatgatgtggctaccatttatcaaattgccgagatagcaaaggtctggcaaaatgtcaaagaaatcaaccagacctagtcctcgaagacagaaaaattttaagggaaacattataaagtaattggcgtcaaaccgaacagtatacagtttaaaatcaatggaactatggaagcattcaactcgacaactatacggtttgattctgacgacaaaaacgagcatctccattcttgcttaattctgacgtaaaaccagatccaagactagaagcaccaaaacatatcttcgtaaattacttatgtactgagcaaacaaggcaaaatactccagtctatggatttaagcacaacggatgaatcattctacactataacaaagcaaaagaaatgggaaaaacaatcgtagctccaaaacgcaaatctgtacacactgcctacactgagctcattaatctcacagcaaattacccaccaaagaatgaaaagaacccagctttcttcttgggcctctcctgctcctctaccataactgctgtcattgcatctctttccaccaaccgccaagtcgcctgctccagagcaagaccagctggtgtgggtgggtcgttcagaaccaacggcacacctctatttgtactccggatcacctccgcgtcctctggcacaacacctagcaaaggcaagccaagcatttcttgaacatcaagtgctgacatcatatcctctcccttcaccaggtctgggcgtactcggttgacaataatcttaatgtctttgatgccgtcacactccaatagccctgcaacacggtcagcatcacggagagccgtaatgtcaggggtagtaacaagcacggcctcttctgcaggggcaatagcagtgacaaaccctgcatcaacacctacaaagaaaaatctgatttaagcaatctggcataacatatgtggatgcatatataactggttataatctaacattattatcaggcaactgcagataatatttgtggcactggaattgatcaaatcagtggtgacaattgcagtgctctaacttattatctgtgaacatgggatagtgaatacagcactatagagatagaaaaggagaaggttccttcttttttaagaaagagaggatgacattcccatttcattaaggaaatgtaatagacgtttaaccagtgattacaaagccaaaaggaacctattaccatttcaccggtgccatgtcctaagcaaaggataaagctaagtcttgcaacattttcacttaacagaccagcactaaaaggtgaaggttcataattatatattgacatgacagaattatgctgcagttagttatggatggtcaatcactcaatcagtggggttgaaatttacagctcacaaccaaattaaacaaactgatgcctggcctaaacaacacctatatgtggcaggtaagaaaacaaaatcttaagttacaatgatcaaaggataacttgatatggctctaaaatctaaaatagaaaataggtaatatgcataaatggattgactttgagaatataagttgcatcacggttatgcactggcatcataaaaagtttgacttgcatcatggctcttaaagttacaattctgggcaatagatagggatgggcaagcgagaacaagataaacatcacaattattaattgcgttaaagcaaatcgagtggcatataacatccatcatcataagttgatggaaatggtggtggggcggactgacctgcagggcagtcgatgaggatgaaagcgggtgggttggcggcgcggcgaagcgcgtcagcgacccaggtgagggtcttggagccgaaggcgaggggcagcttggagcggggcttggagaggcagagcagctgcaggtcatggagcgcgcggtggcggacgagggcctggtcgaggcggcagtccccagcgagcacgtcggcggcggtgaggtggacgcggttctcgaggccgaggaggaggtccagattgcgcaggcccgcgtcggcgtcgacggcgacggcggagagggagaggcgtgcgagggaggcggcgagattggccgtggtggtggtcttacccacgccgcccttgccggaggtgaccaccaccacgcgcggggtgggaccggacagctcaggcgcggtgcggccgccgtggcgcgcgggggaggaggccggcggggggcaccgggaaggtaggaggaggcgcggggcgaacgccattggagttagggttagggttggggttctcttctcttcaagcggagatcctcaggaaggaaggaaggtgggtagtggaggtggtagcggtgtccgctttggctgctactctacttgcctagtactagcatcgtttaggcctagaaatgagaaacttcccaacattttaagcccatgaattgtttgctccctaccaaaataaacccacttataatatattctaaaataaaccaacttagaataacatgatatcctattctagatttatttaatttgaaaaatgttaccattgaattttgcatatatacgagtagaagaaaataaatcatcatacattgtactccctctgtcctattttaaatgttttttttttaccattcgaaggagggaatcaggaaaatgggtgaaagccccctacaatggcatcgcatgtcagtggtagtgactactccaccacaactgtttagtatagatatataattttgttaaaaattttgtaaaagaacaaatcctagcaaaataaatggtaattacatacatacgtgcaaaaatcatatatttgcaaaagtcatatattaaaagaaggattgatataaattgtttggttaaaaaaacagatagcttagtataggaaaataccaatgttatacactatttttctaacatgtcatgttctgagtggttgatctttctgcggcgactccttatcctgaactactactccgttaaaaaaaaacaaattcctagctacgaatcaaggttcattggtaggattggtctcttttttttttttgaaaacggagggggtaaatgcttaaataccagagaatcgttacatggatagcattttatcctagaaactaaattaaacataaaatgctactgtagctaaaagaaaaggtgaggccagggaaacacttccaaatgtgtctgtcaatctggtactttcttttgcagaatagtatttatacagaaactgaaaacaacagataggcaggcagacagacacaatgcagaggtggctgctacggtgatggacctcacccaatattcgttgggttccccactttcacaacagatcactccagatcaccaacccattcataacttctccatatttatatgcaaatgcaaccaacccccaccaccagtgaatcatcaggtaccttatcgcagccaaacgattgtattgatggtaaacgctaacccaagctcattgacacaggtacatagcggtatggcatgggtaaagagtactatttgacgcaagtacagcaaaccgtttctgggtccttcatactgcataagcaatcacacgcatccatctatctgtatctcaagttcatgtcaagctcgggcccgtacatgccgccaggtacatgaccagccattgctgggtgcatctgcttggatctggctgtaagctccatctggagaaacctttcaaaggcatctgggtgattgcctctcagttctggacctgatggacctaaaatcgaaaaacgaaagaacagaaatcaaacatgtggtccaaattggtatacaggtaaattcagggtaaaaaccaaacctatttggttgacaaacaatggtaatgtagtcctaacaatgaacgaatcgagaaaatgttccccttaaaaagtgatttcaaggaaataatagaaagcccgttccatatagagaataaaacaattggtatagacaagaataacgaaaaaaaagtacttggcatgttaagctcaaggaaagcagaagcacacaattataccacaattcatattcccaaaccttagtgccatataattcagattagagattttgtctatgtgaattagtgaattctgtagttttcagtcatggatgtcacatttgggacacatatattatcttgtcacctgtagcaggcctgcttctgcaatctcacctttgtaaactgtgacaacataaatttgcaaatacacacaacatataatatcagcttgcagaggctttctaacctgccatcatcaatccaaattctccatagttgggctggcgagggtgcatatggaagttatttacattgctcatctcaggcctataaccaggcatgtgatgcacaggctgagatggcggaacacctctttgcaggccttctggtggaaaatttccaggtgtggagatgtgctgcatcataagatgatgagcagctgggtctacatgaggagcccgaggagcatgaagagattgttgcataggattcatgttcgatgaaaaggaacggtgaggatcatgctgtatcgcttgtgtcatgtcaaacggggtttgctgattcctattaccaatgtgatccatcataggacgaggagccagtgcaggtggtctaccttgtagaagatgataaagattttgagattcagcctgataacgccgttcatgagaatgggatcccagcgcatcaggaccaagtacttgaacatgttctgaatcaccaggcactagactttgaagcctataattaagatcatcaactgccttttctggtagtagcccct

SEQ ID NO: 45387 - DNA, 2798 bp, Oryza sativa
gcaggtatgaagagtgaacagatcagacatacagaaaatctacggttattaccatttgctaacaatgcaagaccacaaaagtcattccttcttaaagacagaaatcagtgtttctaacaagtaaaaaaaaagaagctcaagaaccatctgcattttacacaacaaagttgacagaattgcaaactgcaaactgcaaagcttagttaacgtcagaatttgtttgcattgacaagattatgttggatcatgtaagtcataaggatagaccattttttattggtttaataattcttaaattaaataaatatctaatgcttgtatgtacagaaatcagagtgccatacaaaagggacatctgcacagataggaaattaagagtgagcatacgcaaacaaatttgttgtcatacctcaacatatggtggcaaatcagttccaccttttgacaatgcactgccaaagaattgttccaagattgagattgaatggtccttcctaacagaaccaatatttttagactttccttcgttttcaatagaatacttatccattgcatcaccttcccagtctccacttcctttcagaatgctcgatgcaaattcagctgaatatgtaacacctccagatggaagtgtgtgttgtttacctacactagcaatgttatcaggaatgcccttctctttatttttgcttgctgtgatctctgatgctgactggttaccctctacaaggccaccaaattgtgctgtagccaatatgttaccctcactagttgcatcaataacctacaaagtacaaagtcaattaaggagcaatctagcattgctgcataatagatttgttatatccctttgctaagcaaatgacacactagcatcagtagaacattgtgccttccatcctgatagcaaatcaatctagtaatgtcaaaatcagaatttatcaatctagtaaagcttccgttagatagagcataatgatctgaagatacaacatataacatcatcttaaaaaggtggtagcaactgtatgttatgaaattgttcgtttagctactcaaataatgtcatgatctgcacctttggttcaagagagatgttggacgattgtggctgaagctttttctccacaaaggcatttgaaaaaccaggcggcacaagtggtctggcagtggaagctgatagaactgaagaggttttagtggtatcttcttgataagctgaggaaattgcagatccatctggcttctcacttttagctgtggttgctgtcctttcggagggagtctgtaacagtgaaatgatatcatgaccggagttttctttctcaatctcaggaccattcttcttttcttgaagggctttatgttgctctttcctcatcatttcaaacgatgctgcacagaagggtaatatgagacactgaaaatgaatccagctaaaaaattagatgccatatgttgcatgaagagggactaaccccttcgtttcctttcttcctctgctctatcctcatttgaaaattcagaagacccaaatgtttcatcgttcattgcgtcaatatctttccgtggaaaaggcgcagcctggtaacagcgttaaatttcatcatcagaaactaatgtgcaaaaggttgatgatcctgatccacacaggagaggaaggaaagaaacatgtgtagaaccttgggacgaggtggttggtagcgttcagatgtcctgtttggctgatacgtattcccacgatccttggatgccacttgccctccatatccaggtggtctagggagaacgccacttcccagcaggccatcatgctcttgattctgccaattgcgcctgtattggttcccattacgcctatctgcattgagagcgttattaaaaccacagatgtagaaagtgaagaagtcagcatgcctactgctatgcccgtggatacacggggaaatgtactatgcatctaactaataaacaatatggcggtgcagttaacatacatttaacagtgtactaatattctgaatggcaagtttagaagtaaaaaaacaaattaccattttggggagaacatagttaccatggtcatgctgaataacgtttcactaaccttgtttgcacaggctactgaagctaacccacaaaagaggaagtaagagaacatatagaacagtgccgaaaatggtaaaaattcacgtaccctgcattgatgagtcacggtcaggcaaatctccgtcgcggtcacttgaaccagaggagcgtgtttcccaccttccccctgagctcccgccatgagaagaataagaatagggacctgagccgtcggacctccccaggggtgtagtgtagtagcctttgttcctgtcaagcacgccagcggacatctcctgcagatcactgctcgacgacaaaaaatagagatatgaggagaggaaggcgacgtatagaaaggtggcgcgcaagcgatacacgacaaggctacaacctgagaagtgaggcatcaaagccctggggcagcttcttgcagcggtcggtctctccaacggagatcataaagtccctggagtaactgatcctcatgttgcgcctgtgagagatggacacatgagcatggcgacgaacaggatctatagatgctagtagcttattaaagtagcaataagagaaaggcatatagagagagatatactgacttgggcggctctggctctgggggctcggagctcatcttcaacagcaacagcaggtgcaggtgcaggagcaggaagagtggagaggtgtagaggtaaatgtaacaagta

SEQ ID NO: 45388 - DNA, 3482 bp, Oryza sativa
taaccctacatacacatacaagccccgaatcgcgcggcggtggctcctctccttccccctgccagaaatcgcagcagcaacgaaatcagaacgaggcgcaggaagaagaaaaactcaccgaagcagaggggatgggggggcaaatctgaggtgaaccaggagcggatggatgagcagtcgaaaccctaggcgcgcggtgtggaggatcggcgggggcgggggcctgaatcagaggcgaggcgaggcgagggagcggtgggttcgcggcggcgggattccgggcgatctgctgctcctccgactccgatgagcgaaaaaattgagaagagcggaggaaggaaggaagggtgggaggaagctaagcacgccccacgccgatgcaacgaaggatggaagaagcagacagctgagagaaaaaaaaaagtcggtaataagaagaagaagaaaaagaaaattgtactgtactagtgggctcggcggatttctctctcttctgggctattgggcctgggcttgtatgtagagacggacggcccatggaagttaggcggaaaggggtgtggggcccagtgtcagcgtcagcgggggaactcgtggacaggagaagaacccgcgatgtgatgtctttcttctcactccacgcaccattttcttcttcttcttcttcgtcttcgtcaccgccagccaaccacctgacaaagcaagcaatcgagctgagcaccccaacccaaccctaggcagaggctgaggctgagcgagatcgcgggcatgagctccgcgccgcagcagttgctcgattcgtcgtctccggggccggggccggggccggaggtggaggacgacgggggaaggagggtgaggaagccctacaccatcaccaagtcgcgggagagctggaccgaccccgagcacgacaagttcctcgaggcgctgcagctgtaagcatccatgcgccttcttctaactcttaactgctgccctgcctccatcttctgctacttctccatccaatttcatatgccgttttgcctgctgtatcctactactgttctagttcgattgttattactggacatctaaatctaattctaattcctcaatttcacttcgggacaacaaaatactagtattagtatatacttcttctttgaatcctaacgctcacctggatttaattgctcactcatgtgaatgctaaaaatgcctctacttcatctttactgcccatctaacttgctttatcttcactggaccacttcgaattcagtatgatctctttactccgaactacagtaccaagtagcaactctctttcaaattagttagatgcagctctccatcatcaactatcaactgctaacaacaaagggatcatttccccccctatgatctttgaattcttatcttgtggcaaacattacgagtggggttttaccacaactgaaaaatggttccttcctacttattctttgcattctttacttgcttttactataacaggtttgatcgtgattggaaaaagattgaagcatatgttggctctaagactgtaatacaggtatagtttatagctatctcaacttccttctttttttttgttttcttctttagttggttgcctttgttactgaatatttcagagttttacaatttttaaatctaccgggtaccaacttcaacttaaatccaatttcaagctagcagttttcttttttcagtaccatcccgccatgcttcttctgtgatgctacaaatatgtgattgtcatctattggaagcttcttcgattatccacaaagcaaaatgtggcacttttctgttttcattagttgcgtgctgttgcttcagatgcttaaaaattaaacacatattaatgtaatgacatggctttgtttgatttagcaatcggtttgttggtagttaaatttcctagtcatacaatctttcattttgctgcaagatgtttgtttggcaatcttgttttggtgtaggatctgcattcgattgtccgtttaacaagatataactcactcactctcaacttattactccaataagtaaatgaacatgtttgtttttgcttaatagtaaatcggtaatgcatctgacataccgtgcatgatctaaaatacagttatcttaacagatcagaagccatgcacagaagtactttttgaaggttcaaaagaatggaacaggcgagcatttgccccctcctaggccaaaacggaaggcagcacatccatacccacataaagcctcaaaaagaggcaagtttttcatcctcacctgactagcattttcttctttacctcttatttttgggtcaaaggcggagatcttattataaaccttggagttcttgcagcccctcaagttgtcctaccacaacaagcttctcatctaatggagcaaggctgtcttatacctatggacatatctcctgttgctagaaactttaatgcaaatgatgtattttcttcctgggatagtgctcttgcccaaagtttcagtccaaggcatacacatggtatataattctgccatcattgtatttcccattttcaaatgttaattttctacagaatactaggttataacaaatccaacatattcaggtgcagcaaataattgttctagtagcgtagagagccaatctggaacttgtccaacttctgaggcaattgagcaagagatcatgcttccaacgctgcgtggtaagctgcctgtttcactgcatgcatttcccctccagagtttctacacagaattctaaatggtccaacataaggggtttatatattgtgtaagtgtgttggggtagacttggccttccttgaggatgcaaattctgagtattttagaaaatatttatagatgggggtggaaacctgtttgagattcaactttgagcttctctggtcatctgtttccgctccgaaatggaaggtttggatctatcttttgtcgtgagggataacataagattttaggccacctttgcaagatgcataagactacctttgtataaagggagattactgcctccagcctctgctcctaccaagagcattggaatacctatatatctgcaactaacgagcttgagactttgagtcaccttgtgctgatttcccctgaaaatgagcctttttttagaatttcaattactctgagtctcattagatccttaagttcttgatgtcaattgttctgtttggagattctcccttttctgcccttctacatctgtttaccttcattttgtccttcaaattctcaagtcttgacataatactcctggcatttgactggtgaatgctgttatgaccttactaccaaagtgaaaaaatggatccttgccgttttagcttcctatacttcctttgttggtggtgttaatattaaatcaatttatttgtactctacatgccccttttcttcattcatattctgacttctttctttaccttgcgtcaaaa

SEQ ID NO: 45389 - DNA, 1451 bp, Oryza sativa
attcttcaagacaaaacaaggatgcaacttgcaatatatcctgatgagtgaaagatggtgaaatggatgtcacctgtcaataaaggcacatcacattcaaatggactgttcattgttgatggccttttccaaaaactagaaaagaaaaatctgccagtgaagaagaaaagtcacagcgttgcggtacaccttaattgcaaactggttgatgcaaaccataacagtgaacaaagcctatcatgtgcaatagcaatacaattatccagtgacattttccttgtgttttccccagaaatgtgtttccacaggaagaaccttgatggagtgactagagaggaaagaaagagccaaaaataaaagagaactactctgtatattagatcagagatgtgcacaaaagaaagacgtgcggttatgaacagttgaatcacaaggttgggggcttgcactcttgagcactcccaattttgtcattgccatacaaattgtacaagcatgccatggagcatgaattctcccaggcaagaaataattacccaattactactactagtgctaacatatcacaagcagctttggtttgatcaatttacccaaagctgaaaatattcaagatcaatgaacaccaaacatttgtagtacaagtgtaccaggcagaggcagctagcatcgccacgctgacaccgagacgagctccgaccgctgccaccacagcgccagcgccgcctgccgcttctccacatggaacccatggctggccgtgcgcctcagcaggcattccgcctgcgcctccgccgcattgctcacctgcagcgccgcaaaccccgcggacgccaacatggactgcaacggcggaggcagcttgtcgccgccgccgaccgcgaggcgctccacccgtggccgcaggacgaactgctccaccttggacaccacgtccggcgacgcgcccgccgcgtccagagactccagcagcgccgcgcaagactgcaggaggttgagggcgccgcgctcgcacccgtggtcgacgcacaccacaacggcggggcggagctccttcacgacacggaggtgcgcgggcgccggcgagaaggccccggagccggccgtgagatggacggccaccgcttcgtcgggcgcggccgagagtcccaagggcggggacgcgctgctgagggggtcgaacacgagggcggtgaactcgaacgggatgccgagctcggcggcgaagcgcgtgaggctctcgttggtgaggtggagctcgagtgggtggctggaccccggcgacaccaatgcggtcaccttgaggttcggcggcggcccagcagcgcggcgccagtggtgcgcgagctcctgcatgagaggcggccaatgggcaccgaagccgacgtcgaagtcgaggaggtggaggcggcgcgcggagccgagcgcgtcgaggaaggcctgcgtggatg

SEQ ID NO: 45390 - DNA, 5098 bp, Oryza sativa
tgagaaatgccaaagtcttgagttaacgatcgacgctagctatcgcatcgatcgatctatcctgagatatgatcatatacctccattcatatgtagggacccgttaattatttggagtatattagtattaactaggagtaggactaggacattcgtggtggttgggaagggagttaagttagtttggcatctgttattaaaaaaaaagttagtttgtcatccaataattattaacaactgttaagcaagcatgccttgtacagagttgtatgcatttaagctatatatatctttcttgactattgatcttttgatcgttatgtgaatttcaaagttaggccttgcttagttagggaaagtttttgggtttggttctcacatcagatatacggactcacatttacagtattaaacgaagtctaattacaaaacaaattacagattccgctagaaaactgtgagacgaatttattaagcctaataaatccattattagcaaatgtttactgtagcactacattgtcaaatcatggcacaattagacttaaaagattcgtctcgcaatttacacgtaatctgtgtaattggtctttttttctacatttaacactccatacatgtgtcaaacattcaatgtgacagcgtgaaaattgtgttttgggaactaagcagggccttagctactactactacaattgttacagtacatgtagagcagtatacgggaaaaggagagaaaatgaaatattgtaaaacggtgctgcagatggatgcatggtctctcgagctacgtacagcccataaatcaagatcaaacgggccactttgtgtagttgtgaacaaagctcattttcttggcccattactacatattgggctctttaggtgatttgagaattgaggcccatgaatatattgtttagcattgggattaggttgcagtaagttcactttgacttcttaactagggaccaaatctgattcgtatccctgaaccacaataccgaatatctcgaccccccaactattaaaaccacaatttaactccctcggtggttttggaggacagtttcactaatgtgggccctacgcggcaatattgacttggtcttcgttacatgtggcgttgacgtggcattataattaaaaatatgtgggagacccatatgtcattgaacaaaagtatgtgtgggactcactgacatgtggagcccacataatcatgctctttctttttccttcttcctcttcccccctctccctctctctcttcttccctgcggcaagccgcaagtgtgggacgggggcccggagctcgtggcggagtggccccgccgccttgccgtcgcccgcgacgtggccgccgcgctccattacctccactccgtcgtcaagccgccggtcgtgcacggcgacgtcaagcccaacaacgtcttgctcgacacgtcgagctcatctagggcggaagcggcagcagctagggaatcgggctgctgccactcccacatctccaccgctcgagggccgccgcgccacgccctcgtctccgccgctcgccgccgtctccgctgcccgccgccgtctcgaagtcgcgagctcgcaaaggggatccgatcctcgcccgcccgctgtcccaccgccgctggctcccggctcctgcccgccgctggcagcgccgccccagcagcgcgtcctgcatgcagcgacccgttgggcatgaggtcatacaccagcatcatcacatgcgaattgggtttgtagtaggaatggttatcctctcgtgtgtgatgctctaaccaatttgtgaaaatgcggtttgaatctactatctatcaatataaaactctagctttacgcaaagaaacatatatatagctatccttattatatcctgcatataactgcatgcatattctgtggtgactcgctaagtatgtaagtactcatccttacttataattaagtagtacaggagaagggatcgaattgtcgaacgtgagctaggtcctcacggccctagtcaactgcctgtgggcatgttgtttggacccactatatatatgttcttctacagttggttatctgatagatagattatgacctatttagcactattaattgaaggtaattaatcattttagtcttatttccgcgcaccctatgttatgatattgctttatatgtgcgtaccaactactgatataggaaaacacatgaggtttctggtttctaaaattgggggctgacaacataaaacgatactcactccgctttatactctaagattttctagcatgatctacattcatatagatatattaatgaaacatataaatgaatatgtacaatgctagaaagtcgtataatataaaacggaggaagtatatatgctagaaaaattaaaaaacattgaaaataacacaacaaacatgcacatgatgcatgtctttattttaattatcaggccgggattaccagcttgagtatgtttacatatgcaccgatcgagtattatatgtagttacttacgtacatacatgaaaacaatatatattttatttagccgttgttgttcgatcgatgagaatgatgattaataagtaatgacaggggggtgcatgcaggccttggaggcggcctttgccatgtggttgtggtcgagggcggcgttgcacatgttggcgaaggcgcgtgtgtgcttcatcccatactgccccagcgggccacagtgagcctcgaacgtgcgcaccatggacttgaggcaatcccagtcgtcaaccagcggctgccccgccggacgccggatgtgcaggagcttcttcttggaggagtcgcccaagaggatgtctccgatgaggtcgacgctgctgtcgacgcgtgatcgcctctccatttctcggagaaggcgctcccatgcctccaccgatttctcctcgtagtacttacgccacaggtagacgagtcccgcatcccgttggttcacgccgccgacgcggccttcgtcatcgatgacggcactagctgttgaggtgccggggccggggggcaagtagtagaggctgacgggttgggaggagaggcttaggtcgccgtaccgactgacgtgtgacaggttggtgcgcttcgcgacgatgtcgtacagctggccgagcgtctcgggatcgccggggcggcgcgcgtcggcgtcctccatccaggccacgctgaagaggtcgccgaggcaggtgttgtactccggcgtgtcgcagtaggtggcccagctgttctccgtcgcgttcgacgccgtcatcgcgtacacgccgatgttggacggaagaagctggccctcgaacatgctacccgactcgcacgcctccacgtacaccaccaggttcttgtacgcgccggccgcgttcttattcttcagtgcttgagaaagatcgttcgcgtgcaggttcccccccgatggcatgcctgtacgtagtgtcgtatccaattcaatttaattaatcgtatgcattatattattctttgtttatatatatacaaggattccattggttactaaaaattacgtacagacgtatccggggctgccatgatctgagtaatagacgaagatatggtcgttggggccgctgctgatgaccttgccgctgccggcgccggtgagagccgacttcttgcccagcaacacggccaggaagttgttcttattcacgtcattcccattgtaatcctgcaagtgatcacgcatgcatccatgggcataattaaccattatacatatatagtggacgagcggcagcgctcgcggaggtgacggagggcgtggacgagcgcggacaagctgacgttgtttctatcaggaaccaactcattacgctcacctctaaatcaaacacctctgggttcatctcatttcatcccatcccatccttgtaatgaaatactccctctgtttcaaaatatttgataccattgactttatagcacatgtttgaccattcgtcttattaaaaaaatttgtgaaatatgtaaaattatatgtgtacatgaaagtatatttaacaatgaatcaaataatatgaaaagaataaataattacttaaattttttgaataagacgaatggtcaaccacattcaaacattttaaaacggagaaagtactatctaatggacacgtacctttgggactccagcgtagacgttcggaccgttgggtttgttgatgatgacacccttgtgaggattctcggggttataggcgatgtcgtcgtacatcataaccacgatgttctggtccttgagtcctcccttcttcattatctggtacgcgtggcacacgtctgcctggtgacggtagttttcgtaccccttcgaccccgcgatgagcaacgcccacttcgtccccccattctccgtcggcagccggaggaactcctgccacagcccgccgttgccgaggcccagcccaacttgcagatgcatcagcatcagcatcagcaggaggacacccatggccatggatcttcttcctagctaattcgttcgtgctagcgtagtgtattgatcgatggaatgtactgggctagctattgagttccgatttccccagcaaagtacgtacccctatatatagcactagcaagtagcttagttaccatgcgtgcgtacgtacccctattattactgatacaaaatacgtacatacgcctccaattggaagagggtaagtgaggcaagcaaggttagcccaattctactacctaattaagcttagtttacgcgttactactgctactatactattaaacaactcttttttggacccttaataatgatcatgcgttgtttcttttacttagatttcaaaataaaaggtcaattgttcgttaagtagttttcataaccgatggatcgtacaaggttaggataatacatgttcgctttcatagcctaaaaattctcatattaatctgagaaaaagaaaaaacagagtctatataggaatgaaatttaaaaataactgaaattcgaaataaaaaataaggaatatataaagagaaaactagagtctataccgatatacaatagaactaaggaagggctgcagga

SEQ ID NO: 45391 - DNA, 5344 bp, Oryza sativa
cttacatcgaattggatactggtgacttaccaaacgaatgacgaaaacatctttaatttttacaatagtagagaagagatagagatagagataaagaaaaaaataactaaaaaccgatttaagcacagatgatataccataatcccagtagaaacataagtagagaagagatagagatagacatatactactatataattcacgttgcaaataaaaaaaagtacgtccatggctgctggacagctcgatcggtcggcacgtaccaaaaattgtaaaactcaaactcgtccagtcctacataagtacatgatgtgacttcaccggcataaacaaattcgctacgggcatgtttagttgatgaaataaaattttttgagtgtcacatcggacgtttgaccagatgtcggtagggttttcggacacgaataaaaaaactaatttcataacttacctggaaaccgtgagacgaatcttttgagcctaattaagctgttattagcacatgcatgtgggttattgtagcacttatggctaatcatggactaattaggctcaaaagattagtctcgcgatttacatgcaaattgtgcgattagtttatctttttttatctatatttaatgctccatacatgtgtccaaagatttaatgtgatgtttttgcgaaaatgttttgggaactaaaccgagccacatggtatttgtccattaccacaccatacttgtatgatacaaatgaaccaaacggtacgttatgcgatataaatattagaaaaccaactaaaaacttaatcaaacacgaatgacgtactaaaattccggcaaaaacatctttaattttcataatatagttaaagaaataaggaatattgtaagaaaaatatagagtccatatagaaatacaatttaaaaataactaaaattaggaattaaaaaaataaatattgaaagataagtttagagtccatatggaaatataatttagaaataatagaaatcagaaattaaaataagggatattggaagaagagtatagagtttatataggaatttagaattaattaaaatatggcaaaaaataaaattaaaagtagagtttagagtccatatataaatataatttataaataactgaaattcggaattaaaaataagaaatattgtaagaagaatatagggtccatatataaatacaatttgaaaataactgaaattaggaattaaaaaaataaatattaaaagataagcttagagtccatatagaaatgcaatttaaaaataatagaaatcagaaattaaaataagggatattagaagaagagtatagagtctttataggaatttagaattaattaaaattaggaataaaaataataaaattaaaagtagagtttagagtccatatagaaatacaattggaaataataaaaattcagttttctttaaaaataatattagaagaagagtctagagttcatatagaaatataatttattaatagtaaaaattcggaattaaaaaataagtctagagttcatatagaagaataatttaaaaataactaaaattttggatttaaaataagaaatataggaataaaatttataaataatagaaattcatagttaaaaaataaagtatgttggaagatgagtctggaatccatataaaaatataatttagaaataactaaaaattgatattaaaaatagttaataactattatgtgcatacaacacgatatgaatattgcacattgatagtttgatcaagctagtacaaaatttaaattatgttattatttttaagatatcttaataataaaatgagaatatgtatatatatgctactatatgagagaaaatataaaggatatgctagccgcacaatttacgtgggtaagcatgaaccatgattgttactgatataaaatatgactcctccaagagggtaagtcaggcaagcaaggttagtccaattctactacctaattaagcttagcttacgcattactactactactactattaaacaactattttttggacccttaatgatcctgcgttgtttcttctatttagatttaaaaataaaaggtcaattgttcgttaagtagttttcattaccgatggatcgtagaaggttaggataatatatagtaataaaatccacatgtgtcctaatcagctgtagaggacttatgtaccgagtatttagttacttgttatacatacatgaaagacatcgagcgaaagcaacggtccgatctgtattttacttagccgttgttttactatatatatgtacgtacatattatcatatttgatgagaatgaaaccttcagtgacactaattattgccatcgtagtagtagcagctagccatcggattagacgagaaagaatcgaaccattatattatattcttaaaaaccgaacaaaggaacagtaaaacggagcacgtgtagaggcatgcaccatgcatgaaagcaagacatgcatgatgacagcaaatcgaacaacaatataataatcaatgcgccagcaccgcgagactaaacagcctaaaaacgcatgcccaacacgcaaagagatgaatcagcactaacaacacaccgcgtaactaacaactaacatccatatcgatccctacataatcactcattccaaacaaggaacagagaacggaattttctcttctctagcttcatgttacataagtaagaaagacaggcacataaaaggaaaagcaacaagacacatagagaaagaaggaagggcacgtactgaaatagaaaaggaatcggatgattaaaaaggaagaggacagttagaattaaccggcaacgacccgtacgtccacagctaccggcacgtacgcaagcgcaagaagaagcaaggctaatctacgagattaaccggacgatcaatacctgccagtgacgaacgcatgcacgaggagatcaagtttagcgtaaacatgcaacgtgtcagggaacgaaatagcctgaaaaaattctccaaactgagattaacgcaacggttaggagaattatcaatatagatgattgtctcatcccagctatcttcaacttgacagacaatagcaagtcgtctctttttgagaaatataaattttattaagcatgaacagattttaggggataaaccccgttacatatctaaagatgaaaattgtaaacaactagccatccttgtgaaaagaagggttaactgaactacagaagcaaccatcttgatgtaaccaaacagtagaaaaagaagcagatcgatagggagctgcgggctgcggcactgccgcgacaaccgctaccttgggcctcaaataacgtgcactccacttgacaagccgttaatcccaatcggctgcctccatagaaacgacacaaaacagaggtttgttgctgagccgtggattttggttgtgagcatcactggactcagcaaaggattcccacggagttcgtcattgaatctaaggagctctaacatcaaacctgccaaccgaggttgcataggtagttcgagctcaacccgaatgacaaaccctgcatggtttcttctgttagggaacaaaggagagggcaaattcaaagaccaatcaaccttcaacattgaagtatttgaatggctgcacaataacttatgtcttgctgagaggacaaagacggtcgaggaagaggtggcctgcaacttgaaattacaagatcatggtgttaacaatagaatttggcatcagactcgaataaggaggaaggagatcgagatggatttggtgttgaaacaagttaaactcgggatcggactgtgcatcggctaaagatcgagactggagattgatctgattgatggccaatacagccaatacggcataacttggacttggcatgggcccagattggaataaccgtcattgccaattagagataaagctcaataaaggcaattgtatctattaattaggttagttatgttggttttgttagttttggtaagagaacgccatcgatggtcttgttcatatctaagtttttagaaagtttaagtcgtgtccataatggacttagtttgtatccggggtataaatataaaccccacagcactgtaatacgggagacaatccaatacaatttcacacttttttacttttcctcttttttacgttccgacagaacttgagtaacatccttaaattttaatctaaaatttgactgcatcattcttgctcttaaattttaatctcaatttagcaaataaaaaatctcttaaaaatttcttgtttaattcttaattttggttcaagtattgtacccttagaattccttcggactatactatgccatcctattcaaatattcctttatcctaaactttagaaattttatgaaatccttccaaagaccaaaacctagaaccctcttttatattatctcaatattagtgaaacccttttatactaccaaaaccttccaaaaattaagaggaaattctattctctttaggcatttttgtcaaaatttgaaaatgtactattcattgcacacaacgtgctcgacaaatcgcctagcccactctgacccaaattgttcttcaagtcttcattttgaactaaccaacatcaaataaaaaaaaagggaggtagtatgatttatgtccccattggttgcctgcaaagccaaagctaaaaccaaaatttaaaatttaaaacttaatttgaggttacttttaagatgttttaaacatagtttctttctagcatgacttttaagcttctaaaacacacatatataaaaattttacatataaattatttgttaatcgctaataaaacacaccaagcacggtatcacactgcatttctcgtcctcgctttcgatgaaaaaaaaaccatattcgttgtttacagtgaacgggcgagaaacaggtgaagctgcggctaggaaagcgaggtgggactgaactgctacagcgccgtgatgtactgtagcgctgctgctctgctatgcctgttgcgctgctgctttgcatgcttgggccaaaggcccaagtcctgctgctgggctgctttgctctttttcctctaattattgcggagcgtcacatgaggcccttaattagacatcactatcattctcagttcaattaacaccagttcttctacatatactctttttagtcatcaataaatcgatatgcaagcttcagtttttctgcatataatctttttgaagttagtacaatcgcaactattgaaatacaacaaataagattgtactaacctcgatatttaaaattaaagcaacttacttgcccacagttatcaa

SEQ ID NO: 45392 - DNA, 4684 bp, Oryza sativa
attcctgcagccccttgttcatactcctcattccttgactgatgtatccattcctcctgtcagaaaggaaaaaaaaaacaatcataacatcatacttagaccatgtgttaattttcctttttccatgggcttgtcaactcgaagcttaattcctactgttaaatcctagtcaaatcaacaaaaaaaaaacataagcccagcgagagaacaatagaaaccttgaaagggtgtctagtctcaccgctcaccaatttggtaggaaatattgctaaagttctgagaataagttgtcctaaatcctaacaacaacatcttatcgcatcaaaattgctggcataaagactctatttagcaagtttgggctttctttcaaaaatctgggtattaaatctacctggattctggaacaaaaacttactggcataatacagaaaatgcttacactgatcgcataggaatgggtttaagaaggcaaaatttgctacaggacacccaaaaaacgtataattagctatgggacaccgcaaaaacgcgtatttgctatagaacatcgcaaaaaactggacattagctcctggacacccgtgtcattattttattatttttagaggaataggagagagaaacagctgtgtaagtacggttctacccttcgaattatttttctttattcttccttattcttctctttctcattctttctctctctgctatttcttcaagtgagcccgaggcagagggagagcgctggcgacagcgtgggctggtgcagtgcctcggttggggcggcgctgcacggtcatgcgggaggtggtggcagagctagaggccagggcggcgctggggcggcgctgcgcaggcaagggcagccgggctcggcagcgcaacaacgccaagagcgcggctgctccaggccgacttcaggaggctggatcggatggcaccggcgccggcgcggcgaggctcaagccgtcgctgcgggcgctcttctcatgcgggatcttcagcgcctgcacgcatctagcactcagcccgacggtgacgcccaacaacaatgtcgcatgccatcaagctggttgtggaggcggcgtcgtcgctggttgtggaggcggcggcggaggtgacggcggatgcagcagcgggcggcggcggctgcttcgatgatggttgacgagcccgacgactgcagtgacggaggcagcggcgagcagcgctgggaagcgggcggtggtgatagtttcaatgatgatcagcgagctggcgacagcggcttcgatggtgacggttggcgagcggcgctgggaagcggctgccagcaatggggattagatagagctaagggaaattttgtctttttgaaatttctctctcctctttttgataagaaatgataaaatattgtctcgggtgtcctatagcaaattacacaaattttgtggtgtctatcagcagcgacgcaaatttgcagtgtctcccagccaattacacaatttttggatgtcctagggcaaattttgccttttcatttatattaggtcaatgctcctctgatccctctccttcaggttgtgccttgtacatagttgtatgcctttaagcaatatctttcttgacgattgatcttttgattgtttctgcaaactatttggttgtgaatttcaatgttagctactactactacagttggtaaagtacatgtagaacagtatccagaaaaaagagagaaaatgaatatgtaaacgatgctgcaaatggatgcatggtctctcgagctacgtacagcctagaaatcaagatcaaatgggcccctttgtagctgtgaacaaagctcatttttatggcccattactacatattcggctctgtggtctgagaattgaggcccatgaatgtattgtttagcattgggattagatttgatcgctcatatgaaatctggcccgttataaatgtcgatatgctaaactatgtacttttgactctcaaaaccttgcaaacttctaatatgcattattgggatctgtgctctggtcagtttcccaacttcaataacgttgatgaactccgatgtgggtaagggaagaggaagttcccctgactggcctgggagatcggggaggtggcggcctgacggtgggtagcgttgacatcgctagagctatgggattagctagacggtgggtaaggttggcggcaagggcaaaaaataaaaaaaatgatggtcgagttaggaagcgacaggaagtgacagtgtattcgacgacaataaccaccggagataggtaactaagatgtactccctccgtcaaaaaaaaaatcaattcctagatttctgtgtctaacgtttctccgtccgtcttattttaaaaaaatataaaaaaattaaaaagataagtcatgtataaagtattattcatgttttatcatctatcaataatgaaaatgctagtcataaaaaaattcatataagacggacggtcaaacgttggacacggaaaccaaagaattaagtctttttgggacagaggggtaggtgcaacaaaatttaaagtccgtgttggcaatattggtggatgaagaaaccaccggagaagggggtgggtgggggagaggatgattgtgaaggaggttgtcatgcctccacaatgtcgggatgacaccattagatcagatttttggaaaggctcgcctgaattttcacctgtgtgtgtttcaattcctcacctgaattttcattacggaatctgtgctctaatttaatttgttacacatgaattcttatgaacgaacaagctaggataactgctccaaaatcgatacgaaaactaagaaacaattaaagggaagacgtactcacgtgcatatatagctgatagcttgatcactatgcaggatatatgtagactatatatattcgctctagccgttgatctgatcagcatctgatcgctgtgctggaaactgcatcgatcggtaggacgtctggatatacatatatctgcatgcagttaatacggggggaatccatcgatggatgcttccaagaaactaacttttgccggccggaatggtcgaccaaagtccaattatatgtcatcatggcatatatatgcacgccagcagatatagaataatggtcaatatataacccggtcactgcaaaatggattaatcaaagtagcacaattaacttcatttgtggtcactatcaagctagaaagaacaatgagtatatacacattcgatcggccattatatattattatattcgacggtgaccagctagccgtctgatttcagctgattgatatgatcagctgagagaccatcttgcttatcatattcttaccgaccttttcaactactaacatcgatcttccttttcttctttttagggagaaagtaacaaagcggaattaagaaaccgtgcgcgctctcaaattaaaccagcggcagctcgtagtacctaggatcatgcttggccacgaacttataattactgtgttaagtagtggcccctacagctacttgtagcttgtttcgcaaggcccttcatgcatttacttagtagtactactgattatcatatcaagggtgtctctgtcaaggatgatctgagcttgaatcgatctatgtaatcagcagtcatgcatgatgtttctgtgttggtggacgccacggttttctccctcagctcatcgtttcaaaccgaaaaaaaagaatggaatcttgatcaagattcttaagacctaattaccactacagccgcgacctcgattttgttttcttccggcctgatccaacaggcatcgcaagttaagtacgtggttttcatccccatcaattcaattctacccaaatcaagtcttatgttaacggcatgcgttggtcgtctaattcatgctgaccactaattaagttactggctagtagcttagctactgacaacattctttcttaaaaagggagatctatatacattcatatatatgtacatgtgtgtgtcgctttattaaagtggatcgatgaaccgacgaagaaattaggtaccacaaattaaaggtagcagtactgccgccattgtgccaaaaaccagctaattaaccatcggttttcactaatcaagcacaatcatgctactaattacccttttcaacctataaatttatcacggtcagatcaatttttctaattactttaaagataatataatagtagtaatcaaccctataaatacacaaggggtgcaacgaccatgcatgtatagcaaaaacacatttccaacattcggtcttcactactagctagtagtgtttttttcctacatatataaacaataattattcattgacaggcatcaagctagctagctagccaactgtctgcaagaagaagaagaagaagaaggtgcaggataaatcgatgaagaaggcgtcgtcgctgtctgagctggggttcgacgccgatggcccgtcattcttccggcacctgacgctgaccgatggcgacgacggcacgctgccccggcggcggctgatcaagatctcggtgatcggcgcgggcaacgtgggcatggccatcgcgcagacgatcctgacgcaggacctcgccgacgagatcgtgctgatcgacgcggtggcggacaaggtgcggggcgagatgctggacctgcagcacgcggcgg

SEQ ID NO: 45393 - DNA, 2437 bp, Oryza sativa
gggagccggggacagctcggtggcgctgtggtcgagcatcagcgtgggggggatgccggtgctggcgcacctgcagaagaaccaccggtcggcggcgacggcgaagaagttcgacgaggcggcgctggaggggatccggcgggcggtggtggggagcgcgtacgaggtgatcaagctcaaggggtacacgtcgtgggccatcggctactccgtcgccagcatcgcctggtcgctgctccgtgaccagcgccgcatccacccggtctccgtcctcgccaagggccttgtccgtggcgtccccgccgaccgcgagctcttcctcagcctgcccgctcgcctcggccgcgccggcgtgcttggcgtcgccgccgagctggtgctcaccgacgaggaggagaggaggcttcgcatctccgccgaaaccctctggggatactgccacgccctcggcctctaaattcattaattactacgccaacccgtttatatatgcccatatatatatgattaataatcgtcgtgctaatgcctatcgatcgatattatgcatcatcgtatatgtcggtcgatcgaagcttaatttcatggccgcccgggttgtaataagctactattctcattgtgtgattaattagctctatttctctgattgagctaattatgtgtaactgtatacacattgtgttcaaacaataatggaatgaataaaattgattgagacaaatatatgtacaatatatatatagtactgctcaacgtaacgtgtcttgtttactattgtcatcagtattcaatttgtcagacaattaactataagttttatcatcaatcatcatagaaatatgtgcttgtggcttctgacctagcttgtcgaatgaagtttaaaacaaagtgcatgcaagctagctgcgcagcggatatggagggcactactactacgtactcaatcgtatcgatcactactacctccgttctaaaatatagtaacattttttttttattttacgtaaaagttaaagactgtaccttgtaatcatcattatattaatgatggtcaagtgtgagaggtaaatagccgaaacacagtggagaacagaaaagagtggtacagattgcacgtcaatatattaaaagaaaagaatatttgatcatccgtcttatttgaaatttctttaaaaaatataaaaacataagtcatacataaggtattattcatgttttatcatctcataacaataaagatactaattataaaaaaattaaataagatagacaattaaagttaaacacgaaaactcatggttgtgcttaaaatgatacggaggtaatgcatgcatatagtacataccatgatgagtacagtatatatatatatggtattatctccgtcctaaaatataataattttttgtttatccagattaatagctaaaaatacttatattttaaaacggatggagtacttaattagtacacgaagaattacatgatgaagctgtaggcaggtcacatcactcgtgtatatacgtatctatgtgcaaccatgagcactcacagtactgactcacgctcgcacgttttgtacgtatacctacctactacagtagctctctgcaaacttaattttattacaccaattaacaccactagtaacagaatatgccataggtgccggtttgcaagtgtctataggttccggatttccatccggcaccaattagtcagcaccaatagcaaaacccggcacctatgcaaaaatagaaccggcacctataagttcacacgagccaaaaaaaaaaaaagaggaaagagccggctcgaatcgcgccgagctcaccaactgcgtcaccacgccccgccccacatcgattgctcccggcaaattcatccacaaattcacaaaaaatcatccacaaccacacaaccatactccatgttcatcaccgccctactcgatccccttcatcaccgcctctcggatccgagatcaactccaacagcaaactactatatttatcaagaactagtaaaatactacaaagattaatgaactcatgcgggaactcaagaacactcaagaaccttcgtccttctcccttgggttgcctccggccttcttccccttgagatctgccgctatggcacggccgccgccgctgtggtgcgccgcagctgcctcctccaggcagccgccggccgcgggagctcgccgcctccccaccgcctccccttccgcaggatctagtggaggggagggcgcagccgccgccgccgctgtcccaggcagctgcccgccgcgggagctcgccgtctcccctcccgccagatctggcggaggggagggcacagccgccgccgccgctgccttaggcagcgcgccggccgagggagctcgccgcctcccctcccaccggatctggctgaggggagggcgcgg

SEQ ID NO: 45394 - DNA, 14900 bp, Oryza sativa
aattaccatttcaacgtcccgtgtatagtgagaaatcaatttaattaaggcgatcgtgtataccatgacatgattaattaaccgtgcctagcttacagcagttagtacttttactgtaagatatcgagagtgcccaattgatccattcattcgtgacggtgttgctgggaatgacgagagaggaggcgttagggttagaggtaggcgtacaacacacgaatcttaaaacgatgtaatggtctgaaatttgtaagattttatgaaatgttttacagtcaaatgccattaaggcagtctcgaaagaaaaagaacgaagacagaaagaaagccaaatggtcttgtctccgctttaaaaaaaaatggtcttgtctctgccataacatgaaagtgagtcaaacaattaatatactgtatatatatagtctctgtcaatcgctaatataacttcacaggaaatgtttacaattaaattacgcccatatcttcactactagatatggggattatattgttgaaactaaactacggcccgtgacctttcttcagctgccggcctaatatctccaaacctgaaccggatacggacaccaaacaagatcaagttctcatattacatcacaagtcccgccacataatgacagaccactaaacccgtgattaattgatatcgaaggcgaaacataacttaaattacacaattcacctcaaactcggcattcgcattaacaattgcaatacacgtcaataatttgtatatacttataaaagatatggatacaaatctgaatttcgtgggcaaattctaaaacattaatttacaagaaaatactagctgacatcaattgatagaaattagggagcaaaatcatgcaaatttatatcattccatttatgttataaaactaacactgagatcgactttggtagcaaaacatggaagaacaccataagagatccaaacatcgagacacgatattaaatttgttaacatggctagccaaaacgtacattcccagagcacttgttacagacgcttctccttgatcatatcacagtgtatcagatgtctatgaccctcaactggcgggtgtgacgggacgacggtgatgccaccttggctgcgaggagtagagtagtgttgatggcgaggtaagttttacattggagtagttaagaggcggaggcatgtgcatgcgtggtggatatgacggtgtaagagaatcatagtgagagaagataaagaagtgtactgaagtacggttgcgagaaggatgtaggttgatgtcacgccccgaactagtcccgaccggaactagcccgtgacgctccaaattaacctgttaatcgataccagtctgacggagcatgaggctcctcaccgggagaccgcgcaggcccccctttgccggttcggccgggggccctgggtgagattctaagctcttggtctgagtgtggaaggttcgcgagagtggaaacacacaagacacgggcgatgtatacaggttcgggccgctgagaagcgtaataccctactcctgtgttttggtggatctgtgtatgaagaagctacaaagtgcgagccagcccccgatcgttcccggatcgtttttttcctcccttctctaagtgggcaaggtcctccttttatatctcaaggggataccacatgcaccatctctccctctcacttctcttctcttcgttaatggacggagatttgtatggctgccgtccgaatgaccttctgatgggacggcccatacctacctccacttccgccggaagcaggcgcaacgtgggaacatggctgtctgctgacgacatgaccattgtcagaccggtcacaaatcggtcactcttgtccaccacgtgtcatttaacaatctgcatgttcgcccttctccatacaatatcttgcctgtaatggttaggatgaagcctggcgtatatctgaccggaaccaacgtgccatctccaggaggtaacacgccggctccggctagggacgagtgcttggaggctctcgtcctgacgggatggggcgaggcgtacgtcagaccgcctgtcgccacctaatccacgatttgaccggtctgtgactgatcacagaccggatgaacgagcgcgctgcactgcgttacatgcggcgtgacgcgctcgtccaaaccgcaataaatgcggttaggtgagcgccgctgcgctcacctaacccatacacgcggcgcaaaatccacaaggggtcagggcaccccagccctcgaggccgaaaccggagcggatcgacccctcggggagacaaagagaagggcgggcgtatcaccctcgggcccgaccccctcctcccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgctttgatcggcgagcgtaattaacgcgcgcacgagatgttccatctcgactgccacagccgcatatccacctcatgcaccgaaaacgggcgaatgggattagtggaagcgtgggcgcgagaaacgagggggcaagatagtgggtgcgagaaacgaggagccgggcacagcgttggcaagggtataaagtcgccgaggaagagatttgcttccttcctctcgccattattccccttgtcttcgccgcttgcgccctaactccttgtttcctgtaccctaccttcgccacacgcgctcgctcttaaacatctcttcctccggcgtcatggcacggggctccgctttgcttgatggtagcgtgctgccgccttcccgcatcgtgagcgagaggcaggccgggctgccgcgccgcttcatgccggaatctgccaccggccgggagatagttacgctgggcgagggacgcccggcgccatgctacccggggcggtccgtcttcttcctcacttttgcaatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagtcggtgtcgccgccgtcggtggttggtggctgctacttccagccgcgggggccggtgttgaaccgctacattccctgcgtcctccgcaagaagtgggatgactggaagagcgactggttctacacacccctcgccgacgaagcgcgcctccgacttccgagccagcccccggcgcaggcctccagctggcgggcgccggtagatctgggagatggctatgacgccgtcctcgaccgcctggcgggcctgcgatcccaggggctcacaggggccatggtgttcggcgactaccttcgtcgccggattgcgccgctccagcggcgcgctcggggcgcctgggagtacaccgggtccgaagactacatgaggacccaccagggggtcagatgggactgggctcctgaggacttcaagatagtggtccaacgggtgctgaatctcagctctgtggaggcatccctcattcctcaaggagtcctccccctctgcagcgatccagaccgcgcctccatcctgaccatcatgcaggcggtcggggcgtcggaggagcgggctcctcgaggccacgatggcgcgggcgggagccgcaggggggaacaatctaccccgggagggggtcgtgcttctgggccccgcaacgggggcccggggagcggccgccctgccgacgcccgggggaagaggaagcaggaaggaacccctcccccatctcctccccgagggggcggggtggcacgtgccagcagcaggcgcccggagggggccacgccgacgtcgcagcccgagggggagcggaagaagaaacggccccacaagatggggggcacagaaccatcccggggaaaccttatttcccctccaaggtggtcgtttaaccgaccccctcgcaggttcgtcccacgcccatcgtggccgtattcattccctcaacgcgagttttcactcatccatcttgtttgtcttctggtctttcttctgtttcagcgagatcccgtcgcgtccctcccgccattccaagtccggccagtctgaggccgaggacccggcgaccacagaggctcggaggcgggaatctgaccggcgagaagccgcggatcgcctacgggaagccgaggaggccgcccaggtggccgtccgagctcgccaagctgaagaagccgctcgggaggaggccagacttcgccaggccgaggcgacggcatcctccgaggcgacccgtgaaactgaccagcaagaggccgcggatcgccttcgagaagccgaggaagctgctcaggtggccgtccgagctcgccaaactgaagaagccgctcgggaggaggccagacttcgccaagccgaggcgacgacgacttccgaaacagctcgcgacgaggctgcgggcgcatcgcttgggcccactccctcgtgcgacgctcgggacaaaccaggtccgggggacatccccgagtccggcacgtccatcggcgggccaagccgcgcggcatcctcttcgaggcggctcttccccacgccttccgttgctccactgagcgcagaaccccttctgcaggccttggcagtcgcaaacaccatggtgttggacgggttaagtgcccaaatggaggccttgcaagcagagcgggtggagctcgacgccgcatgggcacgtgtcgaagaggggcgtcgctcggtggaggccatggtggaggtgggccgcaaggcacaccgccggcacgtctcagagctcgaagcccgtcggaaggtgctgggggagatcgccaaggaggtggaggaggagcggggggctgccctcatcgccaccaccgtgatgaacgaggcgcaggacaccctccgccttcaatacgggagctgggagacggagctagggaagaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgccgttgccatccgggaggcaacgctgactgcgcacgaggccgcctgcgccgaagaggagtccgcgctccgcctccgcgaggacgcgctcaccgagcgggagcgagctctcgaggaggccgaggccgcggcgcaacggctggcggacagcctgtccctccgcgaggcagtgcgggaggagcaggcgcgccgtaatctggaagatgcccgcgccgagagggccgcgctgaaccagcgggccgctgagctcgaggcgcgggagaaggagctggacgcgagggcgcgcagtggcggggcggccgcgggtgaaagcgacttaaccgcccgcctcgcagctgccgaacacaccatcgccgatctgcagggcgcgctagactcgtctgccggggaggtcgaggccctccgcttggcaggcgaggtagggcccggcatgcttcgggacgccgtctcccgtctagaccgcgccggccggcaggcgggcctctggggcgggcggactgcgaagtacgccgccaaccagaggggcctcgcccagcgcctctcggagatagccgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccgggaccgaggatggcgcgcgcgcgcaggtccgggacgccgccgaccatatcgtccacagcttcgagggttcggcccctcggctcgcgttcgccctcaactccgacgaggaggacgatgacggcggagtggacgacagtggcgacgaggctggcgacccgggcgcatcggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtatatgagacgaggatggtctgtgccgcggtccttttgtgtcttggcttgaacaagggctcgtgcccaggtcctagtcctcaaatggctcgggtcggggctagtgcctggggagatccacatgtcgagactggccaggccgggagcgtgatgaccgagggttatgggtgacccgattgtgggtttttgccgattcccccccggagttcaccacgccccggggcacggctcggttctgggccccgtttggcgattttagccgacccgagcccccgagggcaggattgaacacgagtaacctatttcaagtcaagatccttcaaaaggaaacaacagcacagatacagccttttaggaaatcgaaaatacttttattgaaatacagatataagagaaataagaatatgcatatgtggtagcccccggccaaccctgcacgcccgaggggggtgcggggttggcccgagcccgaaacctgacacccgatccccctttaggggtagaagcgacgaaggtgttcgatgttccacgggttaggcagctctgtgccgtcgcccgtggccagccgaacggagcccggctgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctttgctggtagcgcgtggctcggagggacgcgcgccgccttcgctcttccaagtagtcgaggtcatctctgcgaatctgatcttgatcagcctcgcagtacatggtggcccgaggggacctcagggtgagctcggatgggagaaccgcttccacgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcattggcgcgctccacttggccgttgcttctggggtgggcaggtgaggcgaagcagagcttgatgcccatgtcttcgcagtagtcgccgaaaagttcactagtgaattgggtgccgttatccgtaataatacggttaggcactccaaaccgggctgtaatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccgcattcgccttcatgaatatcggcaaaaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctaggagcgctcccctcgggtcccgaggcctggactccgacgggcatcgggggcctgtcaggcacgtccgtctcccctaaggggtcgggtcgcgccgacggctgggcaagcctttcttcaaaggtgcccggtggggtctgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcatagcaccggtactccttgcagacctggttaacgaccagctgggagtcgcctaacaccaggaggcggcggatccccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccctgaagagacagggagccgtcgaactgcatcacccagtgggcggtgtgaggcggctgcgaggggcccgagctggcctcggggactgagacgggctcgggagctggggtccactctgccacaaaatcggcgagggcctggctcttgatagtgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccatatccctggggcgctctttgtccaagcggcctcgcggggtgcactcgtcttctgtgccgacgacctcggggtcggaggacgacaggggcggccttcccacagtggcctcggggccgtcctgggggtcgggggctcctggcgttgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagtgggcagagggcctgctccggtcgtcgggggccttgggccaccgttcggctcgggggcctctcctcccggctctctcccgggccaagccagcacagggtgggggtgcgcggaatgaggattgtcctcatcgcgctccaccaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctggggggcgcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttccgctagatccaagagtaaggtctcttggttgcgcgtctttacaaccaagtcatcgacataagcctcaacattacgtcctatttggctacccaaagaaattcgagtagtacgttgaaaagtaggacctgtattctttaacccgaagggcattgtcgtataacaataagttcctatgggggtaatgaatgcagttttttcctcatcctccctagccatgcgaatctgatggtaacccaagtatgcatctagaaaacacaaaaggtcgcaccccgctgtggagtcgataatctgatctatacgaggcagggggtaagggtccttaggacatgccttgttaaggtcggtgtagtcgatgcacatccgaagcttgtcgttcgccttgggaacgaccatcgggttcgccagccactccggatggatgacctcgcggatgaatccggcctccagaagtcgcgccacctcctcgcggatgaaggcttgacgttccggggcctggcgccgcactttctgccggaccggccttgcgcccggccgcacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcgtcgcatgtgactatccactgcctcggggcggcgggggcaggggtgccaagcctctcgtcgcctccctcgggcttggacgcggcggcgaggtggtccgcgcgctgctccatacaagcaagcgcgactttgaggtcgccatggacagagatggggccaccggggcccggcatcttcatctggaggtaggcgtagtggaccgccgccatgaacttcaccaacgcgggcctccccaagaccgcgttgtagggcagactgaggtccgccacgtcaaagttcacccgctccgtgcggaagttggcggatccaccaaaggtgaccgggaggtcgatatgacctagcggccaagtgtgccccggcgtcacaccgataatcggctgggacggccggagcaccatccccggggccttgatggcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgtgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcgacgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcgtgaagggaagtgttgtggacgatgcaccacttgccggttgggcgctccctgctgggagcgccggcctccttctttttgtcgcccgcaggcctcccctttcgggtggcccgcgaagcgccctcgacggcgaggacatgaccctcgtcgtcggaatgggctgacctcttcttcctcctcctgtcatgccgccctgtctgagcagcaaatccgggggcggccgaagctgccacaccggaaccggaggggttccaggtccatgcctcttccttacgagccactcggtccgcgagctaaaaaagctccgtggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcaacatcccttcgctggactgcatgtaagtccacttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgccggccattacgccagcgctcgatactgatgcgggcatccggccccccacgcagatcttcctgggtcggaggcgctgacgaaggagtggcggctgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacaaggaggcgacgctccccatctcgccgtccttccccatcacccgtggatgtcgaagtcgcggatccttcgaccctctcgagcgcctcctcccgcctaggactttggcgtggagggggcggtggagtacgatctcgacggcgtgggttcggctccccatcgtcaccgctaacactcggagagaggttgtgcgcctttgcttgttcggccattgggctgaacaggaaaagcttggcgcacacgaaagaatgcgagagcttagaaaaacacacgcaaagccccctacctggcgcgccagatgacggagcgtgaggctcctcaccgggagaccgcgcaggcccccctttgccggttcggccgggggccctgggtgagattctaagctcctggtctgagtgtggaaggttcgcgagagtggaaacacacaagacacgggcgatgtatacaggttcgggccgctgagaagcgtaataccctactcctatgttttggtggatctgtgtatgaagaagctacaaagtgcgagccagcccccgatcgttcccggatcgtttttttcctcccttctctaagtgggcaaggtcctccttttatatctcaaggggataccacatgcaccatctctccctctcacttctcttctcttcgttaatggacggagatttgtatggctgccgtccgaatgaccttctgatgggacggcccatacctacctccacttccgccggaagcaggcgcaacgtgggaacatggctgtctgctgacgacatgaccattgtcagaccggtcacaaatcggtcactcttgtccaccacgtgtcagtttaacaatctgcatgttcgcccttctccatacaatatcttgcctgtaatggttaggatgaagcctggcgtatatctgaccggaaccaacgtgccatctccaggaggtaacacgccggctccggctagggacgagtgcttggaggctctcgtcctgacgggatggggcgaggcgtacgtcagaccgcctgtcgccacctaatccacgatttgaccggtctgtgactgatcacagaccggatgaacgagcgcgctgcactgcgttacatgcggcgtgacgcgctcgtccaaaccgcaataaatgcggttaggtgagcgccgctgcgctcacctaacccatacacgcggcgcaaaatccacaaggggtcggggcaccccagccctcggggccgaaacgggagcggtccgacccctcggggagacaaagagaagggcggccgtatcaccctcgggcccgaccccctcctcccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgctttgatcggcgagcgtaattaacgcgcgcacgagatgttccatctcgactgccacagcgcgcacgagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactgggggggattatttatatagagcaagggtgagtacgggagtactcagcaagccaggggaaataagtgtttaatgcaggcttcaaggaaaggctgttgtttttgtaattgattttatttgaactctttttctaaaacaactagatgagtgcttctcaaacgacacggatgagacagtgcgtctcatccggtcggagtatgtgcaatgtatcagtctttaggattgcaacaaggttggcacccggccaacagcttttcaaacggccacccgggccaacaacttttcaaacggccacccgggccaacaacttttcaaacggccacccgggcctagctgatcccatcagctacagatttt

SEQ ID NO: 45395 - DNA, 14635 bp, Oryza sativa
tgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccccgattagcaatttactcagccaggggcgtcccattccacccatgtggtcgtacttgtcttatgttcggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaacctaagttttacccaagttgttactcagattttaaatttgaaggcgaccgtcgatactcgcacagagtgcgcgagtatcgaggcgcagctgggtggttacaaggggacatggtatagcaattaacaaaggaaggatcaaatgcgacaaattaggtaggtccgccaatctgccttgcagacgggacaaacagattaagtgcgatcctatcaatgcataatattttgcaagcaacataattaaatttcaaatataggctcaagatgttcaaaggtggcttgccttgctcgagatctggagcttgatcctcgaaatcctcgcactgcgggtcttcgggctctgaaactacacgggaaacgggacaactcaacaaacggcaaaaataaagccctattaacgacctctaagcgtgccataagatcgatctcgagatttggggaattttggaagttgaacggagtcaaacggatttacggttgggaagatattgaatttctaagattattgaattttttatctaaaggaaaaggatttaattaaatcctttttggaaaagaaaaagaaaagaagggagggagggaatatagacttttctcggacggctagggcgcggcccaagagaaatggagcggtccggccgagctaaatgggccggccggcccaaggcggcccaaactcgcgcgcgcgcgggagggaggagagagagagccggtggaccgggctcaccacgcgcggtcccgggtgggacccgcttgtcagcggctcggctcaccgtgcggagggagcacgcgacgcacgcgcgcgggcggggaagggacgcggtgcatgcgcgcggtccgcggtggacgcaggtgcggcgggcccacgcgcagcctcacggctcgcggtggatcgcgcgcacgcggagggaccgaccggggtcggcccgacccggtctggctgagctggcgccgacgtggcgcctacgtggctgccacgcgggccggcgggaggtagacgacgacccggccgcgaatggacggcgggcggcggcggcgagcggcggagcgaaccacggcgatacgggcaacagcgagcacaccggacggttgcacgtgacaaggggaggcgagccaacggctcggattcgccggaggttgctcgacggcggcggattgcggcggcggcaaccggcggcgggagaagagggaaacggcgacgaggtcacgagaggtcgattcccggcggtgagagcatctacgcggcttcgggaactcgacggtagcgtcggattgggcggaactacgccgagcgaggccggcgacgagcgggtgctacggagctcgggcggcgacggcggcgagcacacggcgagcgacggcaacggtcggggcggcgccggctaactacggggagtctactcaagctactaccgaaagctagggggaggagatggagcgaggaggaagaactgagagggacactaccgtgcgggacggggcgcagtgacgagaggccgacggcgcgggagtgatctctccggcctcgggccgaggaagaggaagaagagggcgcgcccggagtccccttccgcgtccacgaacgcaccggctcacccggcgcttggcaatggacggcggaggcgaggcagagcacgggagcggcggcaacggtgaggaggcgaatgggagaggaaaggaagggagggggaagacgggtttaaatgggcggcaatgtcggtttgagagaggggaaccgacatgggcggtcaagccggcgagctggcgctccggctagcgtcccaagcggcgacaggaggtgacgccggcgagaggggaaaaaggggagaaaaagaggaaaaggagggagagaaagggggctcgcccctttgccgattcgggaaaaggaggagggagcggggtgactcggcagggggagaggggctctctgcctccgccccttggaggctagcgcgcggagtggctggggccgggcgatgacgacggcgatgacggtgggatggtttggagcggcgcgacgacacgggtgacaggcgtgggctggcgcggcaggggggtgacggcggcggcgaccaggcggtcggccactcggcacgcgcgcgcgggaagcaacgggcggcgcgactgggcagcgggaccgggcgacgcggacggcgcagacaacgcggctcgggcgggaaaccacgcgggcgcgcgcgcgagcaacggcgcgcggggccggctttgcgagcggggagcttgcgcgagaggagggggcgctcggcgcggctctcgcacgcgcgagcagcgagcgggggggaggggaaacgcgccggggtggggagggagcgagagagagagagagagaaagagagagagagagagagcgggagagcgcccgggggggagagggagagatgggccggggaagaggggaagatgggccgagcgagattcggcccatcgacctcgggggaggcaaaatagacttttgcggaggaatttgatttggaaggatttggattcggaattgaactcgacgatagatcggggattgagatcttgagatggcacggacactagacaacaatcaaagaaacaaatttcgcaattagggtttttaagagataattttcccgctaggcgccacgacggaacgggcgctacagaccaacccccctaacaagaatctcgaccccgagattcagcacctaagggagcaggtccgggaactcggcgcggagaagatcttctcgttcccaggttgcctcatcttcagaatgattgctccattggactttgtagaacttgatggtcttccttcgagtctgacgttctgcctcttcaagaaccttgatcggtctttccttgtaggtcagattcttttccagctcgatattacccaggggaacttgctcttctggaactcgaagacatttctttagctgggatacgtggaacacgttgtgcacatctgcgagaccttcaggtagctcaagctgataagccacttcgccacgtctggcggttatgaggtaggggccgatgtagcggggtgctaacttgccggacatcccaaaccttctcataccacggaggggtgatacccgcaggtacacatgatctcccttttcgaactcaaggtcacgcctccgattgtcagtgtaattcttatgacggttctgtgctgtcttcaaacgttctcgtatcagcttaacttgttcttctgctgacttgagtatgtcaggaccgaataccagtgcttcgcccacctcattccagcacaagggggtgcggcactttcttccgaacattgcctcattcggcgacatctgaatgctggcctgataactgttgttgtatgagaactcagcatacggcaaacaacgatcccaagtgccttcgaaatccaaggcacacgcacgcagcatgtcttctaggatttggtttaccctttccgtctgaccatcggtctgtggatggtaggccgtactaaaatttagatcagttccgagggcttcatgcaactgcttccagaaccttgaggtgaactgagtgcctcggtctgacacaattttcttgggacagccaaatctacatacgacatgggtcatgtagagttctgctagtttctttccatcataggtggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggtgacggagcgtggggctcctcaccgggagaccgcgcaggcccccctttgccggttcggccggggaccctaggtgagactccaagctcccaatctgtatgtggaaggttcgcgagacaggaagcacagaagacgccggcgatgtatacaggttcgggccgcttagaagcgtaataccctactcctgtgttttggttgattcgtgtgtgaaggagctacaaagtatgagcctgcctctcccttgttctgggttcctaatctggaaaagtccagtcccaaaaaaaaaacctccctctctctcagtgggcaaggtcctccttttatatcttaaggggataccacatgcaccatccccccctctctgtggggacttaccctaccttttcataaatggacggagatttgcatggttgccgttcgagtcaccttctgatgggacggcccgcacctacctccactttcgccgggagcaggcgcgacgcggaatcatggctgtctgctgacgacatgaccagtgtcagactggtcacaaatcggtcattcttgtccaccacgcgtcagcttagcaatctgcacgttggcccttcttcacacaacattttgcctgtaatggttaggatgaagcctggcatatatctgaccaggactaacgtgccatctctgggaggtaacacgctagctccagctggggacgagtgcctagaagccctcgtcctgacgggatggggcgaggcgtgcgtcagatcacctgtcgccacctaactcgcgatctgaccggtctgtgactggtcacagaccggataaatgagtgcactgcaccgcgttacatgcggcgtgacacgctcagccaaaccgcaataaatgtggttaggtgagccccactgtgcccacctaacccatacacgcggagcgaaaacccacgaggggtcggggcgcctcggccctcggggccgaggcgggtgcggctcgaccccctcggggggactaagaggagggcgaacacatcaccctcgggcccaacgtcccctgagggtgccaggccacgtgggcgattgtgtctgcctcaaacctctagtcatgatactcccgatcccatgtcaccgacagtaggggttgcagcagaccggctggcctctgatgctctgccttgactctttggcaaatgtcacacaaggctacgtattctgtgacatctcgcttcattccaacccaccaaaagtatgccttgatatcttggtacatcttcgtacttcctggatgaatggagtaagcggactcatgagcttcctttaggatgagatctcttaactccttcttggccggtacacagatgcgtggaccgcaccaaactgtgccttgatcgtctatggagaagttggtgtctttcttctcctgtattctttttattaattcttttatcccttcgtcgtctttctgagcctcccggatttgcgactctagggtaggctgtactgtcaagctagcagggacacctgactgtaccacggtcagtcttaacttctccaattctctgcacaggtgatcttggtcaggccgtatttgagctatattgcaataggccttgcgacttagcgcgtcagcgaccacgttggcttaaccaggatgatagtggattccaagatcgtaatccttgattagttccaaccatcttctctgcctcatatttaactcggtctgtgtgaagatatatttaagacttttgtgatcggtgtatacttcacatctgttcccgattaaataatgcctccagatcttaagagcatgaaccacggttgccaactcgagatcatgggtgggataattgacttcatgaggcctaagctgcctggatgcatatgccacaacctttcgttcttgcattaggacacatcctaagccttgtcttgatgcgtcacagaagatctcaaaatcttttcggatatctggcaaggtgagaactggtgcagtggtcaaccttttcttcatttcttgaaagctgtcttcacaggctgtagaccagtgaaatttcttttccttctttaacagctcggtcataggtctggctagcttagagaatccttcaatgaatcttcgataatatcccgctaagccaaggaagctgcggatctctgacacattcttgggcgggttccaagcaagtacagcttcaaccttgctgggatctacttcgacaccgttagaggagatcacgtgtccaagaaatgctactcggtccaaccagaattcccatttcgagaatttagcgaatagttgatgatctctgagcttttccattatcagcctcaggtgttcagcatgttcttcctcgttcttggagtatatcaggatgtcatcgatgaacaccacgacaaactggtctaggtattccatgaaaattttgttcattaagttcatgaagaatgctggagcattggtgagtccgaaggacataactgtgaactcatatagaccataacgcgttgagaaagcggtcttcgggatatcttcagatctgattttcagttggtggtaacctgacctcaagtcaatttttgagaaaactcttgctcctttaagttgatcgaataaatcgtcaatccgtggcaacgggtacttgttctttatagttacttcattcagggctctatagtcgattaccattctctccgagccatcctttttcttaaccagaagcactggggctccccaaggggatgagctaggtcgcacataacctttactttccagttcttcgatttgtcttttaacttctgctaactcattagctgccattcggtatggcctttttgcaattggtgcagtccctggtgccagttctatggcgaactcaatctctcggtctggtggcatactcgttaattcttctggaaatacgtcgggatattcacagactatgggtaccgactccaaggaggtgacttgtagactggttaggatagaccgacttgcggtaggggtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagtcaacttcctcaattttaaggttaacttccgggcatatttgagttgcccttatattccttccaggggaatgtactatcattggtacacgtaaattttgggttttccaaccgtttcttttcacaaaagcttgtgatatgaaagaatgggaagctcctgaatcaaatagaactattgcgggtacggagttgacagagaacatacccatcacaacgtctggagcatcctgagcggtttcagcttgaatgtgattcacacgtcctcgaccaaagtggttggaagcacgagaaccttgtccacttgcctgagagctaggacgagactgagctgccgctggagtaggagttttggcgatgctgccattagcatgccctaagttggtgttggtaggattctgagggcactgtctagcatagtgacccatctggttgcaccggaaacactgaactactgacggtccctgtggtgagttgaaagaggtaacactgtttggcgcagtgttgccactaggggcacactgctgtggcggaggtgtcggacggttcatctgagggcgaggggcgtagcctggctggcggttagcctgagtgaccgactggtggtattgcatgggttgaccgtagcgagggcgaggtgtgcctcgggaagaatttccctgatggttagacttgcgtttcttgtattcttcggtagcctcttttctggcatcctcaagcagaagtgccttgttgatcatatgttgaaaagtggggaagtcatgagcaagcaactggagtctcattccaactgcgattcgtttcaagaatttcctgatcttcttcttatctgtgtctacttcctcaggggcgtaccgagccaacttgttgaactgacttaggtactcattgacactgctgttgccttgcttaagtctgttgaattcttctttcttcatgtcaatagtgctttcaggcacatgagctgcacggaaagccgtagcaaactcatcccaagcaatgttagtgggttcaggatgtgcattgcagtaattctcccaccaatctgcagcaggtcctcttagctggtgagaggcgtagagcgtcttctcaacaggagtacactgcactaagttgagttttctatcaacatctttcaaccaatcgtcagcctcgacgggctcgacggtctgagagaactctggcggacgtgacctcagaaaatctgtcagcttggatctattgttgcccacgtgagggtggccatttccatgcgcattatgctgaaaactggctatggctgtggttagtccttgcaagatttgtgtctgaactgccattatgtgttgcatgttgttttccacatgaggtggggaagggaggcgttcttctccagaattgtgactggcagtgcggtgagagcggtgagactgttccatctctgcatcacgggaaactgcgcgatgcgagcggctgccgcggcggggttgctcaacttctgcgttacgggaagcagtacgatgcgaacggttgctgcggcgagactgctcattagccgactcatgattttcttctggctcaactctaccatcttcaaaaccaaagcgggctggtgcacgggctgcacggcgggggcggctagccatctaaactcccagaagagggcgggataagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcgtgtcgcgaccgagaaaattgccttttcccgaacgctagtgtattaatccccgtcccaggaaaagctggggtacaccatacaaacatgatataaaagacacatctttattatatcgataatatttacattattacaaaggcacttaaggcctgacaatcaaaaataaacagcagcggactagcgggcctacggctccatcttcacaagcgctcaactggggtataagccaggactccacctaagacttcttctccaaagcttctcttactgaagggggaaaagattgagcaagaatgagtacaaccacagtactcagcaagccacaccggagatgcataattaatgcaagggagtacaaggggataataatataggggttaagttttgcagtaaacagcatttaaaagtcacttagttgcccaaagccattttataaagacgatcctagagctacacagtattattaatcaaggtcgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgtcctagagatgtccatcgacccccgacttcgtccatctccatccgtgtacttttgtttacaaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaaaccacctaatgttgtccaatttaatcagcgaagcatctacctaaattcatactagtggaaccatgaatagagtacccactagttggggttttgttttcctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacgcgaagcacacaagcaaagctacaagcctataaagaagcaataacaacacataaaaagaaagcacagggttctttaggttatatcaaacattaagagacttgaacgggtcgattcggagctcgcatgaccaagatatgatcatccgaagtttaatgctgttatatggagatttgcggattattataattaagctttgcaactataaaacaggtgtaagcgctagcctggaaaagacaggaaggctgcgccgttgacatgcggaccccacatgtcaacctaaaggaccgcggtagaccgggtacacagagacggtccacgggtcgacggaagcggaccgcgtgtgtcaaccgaggcgagtggccaacaaacggagtccactagacaccacacgggctgcacacgtggaaaccacgcggctaccgagcgggcacactaacacggtcaccacacgcacaagcgaacgactaccgacaccggtacacgggtaccggggtcgacaaccgcacaacgagcacgggcgacaacgaaaggacgaggacggggcagcaagaggggagaccttaccaccacgcgacgaggcgtgggaacgacaacgacgaacaggcgcggcggagacagacggcgagggaacgacttcggcggcgatccttggacgacggcgagacgcggccggcacgaggcttgacgacgcggaggcgaggacgaagacgatgacgggggctgcagcgaccttgacgaaacaccgaggacggacgagaacagctcgacggagggacgaacgccccgacgaccgggaacgacgagaggacgacgacgacgacgaccggggccggcgaggagacgatgagggcagccgacgacggcgtggaccacgccgctgcgatgccgacgacggaggcggcgccgcgagacgacgagccgggtgaccgatgggacgtcgacgacgagaacgatcggagacgacgatgatggaccgcggaggggtttggatggaggggaagcgaggccaagggcgaccttgccgctgcgatgccggaggtggtggtgccgcggctgaccggtaaacaagcgaggaggaacgggcggccggaggactccggcgaggcgggtagaggggttggtggcgacacggcggcttccgggcgaaaccgaggggtggacgaggtggagggctacgtcaccgtgccgagggaggggacggcagcgccggctgacgcatgggcatggcgaaaggggcagccggaggagatgccgccgaggaggaaggagaagccggcgcgggcgacggtgttccggcgaaattcgggcgaggaggaggagatgccggggatgagggcggcgtcgcggagtcgagggaggtggtggcgacgtcgaccggcgctcaggcagggagatagaggcggctggaggcggccgacgcggatgaaagggaagggcgacggcgggaacgcagctccgggggtctccgcgggaaacggagggcaagccggggaaggggaggcagctgcgatgctggaggaggcgacggcgcgaccggacgacgctccggcgaggagggagagacggctggaggcggccggcggcacgggagagagaggaggacggcggggagagggctagggaccacgggagatcgcaggagggggctaaaacgatagaacggagcgagggggttgcattttatagcggagggaagcgagccgagcacgggagagggcggaacggcgacgggaatggcggccggcggcaaaggaaggcggccggacttggcgcgtccgttcccggcgattgggggcgccattcaagggggaattaagggggaaagagagaggagggaaaggggattaattccccctaatcaatttgggaatcccatgcttgaatcgcgcggatttgagggaggaatggcgctagggttcacgggagagggagagaggacggccgggcgggaggaggacgatgacccgcctgacgcgcgggccccacgcggccggacgcgcggtcagcgcacgcgcggcgcgcgtgtgcacggccggctcggctcggcctggcttgggcgcggcttgggccgggcggccggcccaggaggagaggagggggaggcggcctgggagaaagagggaggaggagggagtgggccgggaggggaagaggggcccaagaggaggagggagagaaggagagggaggagagggagacttcggccacgggccgaggggagagagggaggactttgggccagattatttttaggttttttttctttttaataaactctaataattgtttttgttgcttaataattatttccggtgctctgaaaattccacaaaaatttgagggctctttttagaccaaggagaatttaacaaaaattctccgtgccacatttgaatttttcttgtacgtattttaatgtttgccaatttcttttcgaattttaattaattctattattccttttagggaatgatttttatttcgggatgaatttatcaggacgtgacacggcggaacaaaagggcctatcacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaagggctaactgggtgtgggtagggagagtacactggtgagtacggcgcacgcgagctgggggagcgcgggccactaggagtgcgggcagagccgcgggagctgtgggaggacaggtggctggcgtggcagaggcggcctgagtcccaagagatagtgtcaactgaggtgacaccctccacggccaaacgggcctccaaagcggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaaggcgtggaagctgccggaaggcggaacctccgagacggtggctgtagtcgtgggccaggcgacgaagcgcagtccaggagaggtcctggtacgcgatctggagagtgggcctggccacagtgaagtggtgggggcgaaggccagctccgtgtatacctccacgggggtaaaggtacacagagagcgagcgacggcaacggtcggggcggcgccggctaactacggggagtctactcaagctactaccgaaagctagggggaggagatggagcgaggaggaagaacggagagggacactaccgtgcgggacggggcgcagtgacgagaggccgacggcgctggagtgatctctccggcctcgggccgaggaagaggaagaagagggcgcgcccggagtccccttccgcgtccacgaacgcaccggctctcccgacgcttggcgatggacggtagaggcgaggcagagcacgggagcggcggcaacggtgaggaggcgaatgggagaggaaaggaagggagggggaagacgggtttaaatgggcggcaatgtcggtttgagagaggggaaccgacatgggcggtcaagccggcgagctggcgctccggctagcgtcccaagcggcgacaggaggtgacgccggcgagaggggaaaaaggggagaaaaagaggaaaaggagggagagaaaggggg

SEQ ID NO: 45396 - DNA, 6254 bp, Oryza sativa
actttatcttcccaacccatatcttttgttttttttttgcggggaacccatatcttttgtttttgtagcgcccgttccgtcgtggcgcctagcgggaaaactatctcttaaaaaccctatttgcgaaatctgtttctttgcttgatgtctagtgtccgtgccatctcagatctcaaatccccgatctatcgttgagttcaatcccgaatcacaatccttcccgaaagtccctccgcaaaagtctatttcgcctcccccgggttggatgggccgaatctctctcggcccatcttcccctccctccccggctctctctctctctctccctccctcccgggctcactctccgctctgcccgcgcgccgtgcgcgcgtgcgcggcgccgagccgagccctccgactcggcccccgcgcgccgttgttcgcgtgcgcgcgcccgcgtagtcgccgcccgtgccgcgcctgcgccctctgcgtcacccggccccgctgccctgccgcgcctgccgccgcgcagccgctcggccccgcgagccagcacgcgtgcccgagccgcgccgctcaaatcgcccccgccgtcatcgccgtcgtcatcgcccggcccctgccactccacgcgctagcctccaagggacagaggcagagctcctcctccctctgccgcgtcgcccccgctcccctcctccttttcccaaagaggcaagggacaagccccctttctctccccccttttctccctttttccctctcgccggcgtcacctcctgtcgccgttttggccgctagccggagcgccagctcgttggcttgaccgtccaatgtcggttcctctctcccaaaccgacattgccgcccctataaacccaagctcctcctcctccaaatctccctcgttttcgtctctcgccgccactgtcgccctgttcgccatcgccgttcgtcgttgcgcgtgtcggaggagccggcacgagcaaggacgcggaaggggacttcggccgcgccctcttcctcctcttcctcggcccgaggccaaaacgatcacgtttcgcgctgtcggctctcgtcactgcgcccgcccgcacggtagtgcctccctccgttcttcctcctcgctccttctcctccccttagactcgggtagtagcacgagtagcctccccgtagctagccggcgccgccccgactgctgccatcgctcgtcgtgtgctcgccgctgtcgccgcccgagctcggaagcgccgctcgtcgccggcctcgctcggcacagctccgcccaatccaacgctagcatcggattcccgtagccgcgtagatgctctcgccgccgggaatcggcccctcgtgacctcgtcgccgtttcccccttcttccgccgccggttgccgccgccgcaattcgccgccgtcaagctccctccggcgaatccgagccgttggctcttctcccctcgtctcgtgcaaccacccggtgtgctcgctttcgcctgtatcgccgtggttcgctccgccgctcgccgctgtcgtccgccgtccgttccggccggcgtcgtcgtctacctcccgccggcccgcgtggcagccacgtaggcgccacgtcggcgccagctcggccaagaccgggtcgagccgaccccggtcagccgctccctccggccccgctcgcaggcgcggtccaccgcgagccgtgaggctgcgcgtgggcccgccgcatccgcgtcctccgcgaaccgcgcgcgtgcaccgcgtcccttccccaaaccctagcgcacgccgcatactccctccgcacggtgagccgagccgctgacaagcgggtcccacccgggaccacgcgaggtgagcccggtccaccgtctccctctctcctcccttcctgcgcgcgctctcggccgccttttgggccggccggcccattaagctcggccgagccgccccttttctctcgggccgcgccctagccgcccgagggaagtctaatttccctccctcttttcttttcttttcttttctttttccaaaaggatttaattaaatccttttcctttagaccaaaaattcaataatcttagaaattcaatatcttcccaaccgtaagtccgtttgactccgttcaacttccaaaattcctcaaatctcgagatctatctaatggcacgcttagaggtcattaatagggctttatttttgccatttgttgagttgtcccgttttgcgtatagtttcggagcccgaagacccgcagtgcgaggatttcgtggatcaagctctagatctcgagcaaggcaagccacctttgaacatcttgagcctatatttgaatttaattatgtttcttgaaaaatattatgcattgataggatcgcacttaatctgtttgtcccgtctgcaaggcagattggcggacctacctaatttgttgcatttgatccttcctttgttaatttttatatcatgtccccttgtaaccatctagttacgcctcgatattcgtgcaccctgtgcgagtatcgacggtcgccttcaaacttaaaatctgaaaaacttcttgggtaaaacttgggttttacaaaaggcttggaaaacacgacacctgggtcggtgcttgcgaactaaatgaatttccaaaaccacggaccggggaacataccgggtgtacggtttcccgctctcgcacttaaggaccgtttccttggaatttcatccgaacataagacaagtatgaccacatgggtggaatgggacacccctggctaagtaactaacttatcaggggagccttgatgccgagagacatgtggattcgccggggtggtatcggggaggacccctgggcatcctggcacagtatggtctgggacctaacctgttgttggtctgggacccctctcgtcggcatatggtaaacctgtgtcggctttagaaatgccttgtcatgaaagcttggaggtctaccgacgtggctgatccccacaggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgccttgtgaaattgctgttgtgaaaaggggatcgttgtttggaaaatctgcagctgatgggatcagctaggcccgggtggccgtttgaaagttgttggccgggtgccaatcttgatcaattttaaagactgatacattgcacatactccgaccggacgagacgcactgtctcatccgtgtcgtttgagaagcactcacttagttgttttcagaaaagagttcaaataaaatcaattgcaaaaacaacagccctttctttgaagcctgcattaaacacttatttcccatggcttgctgagtactcccgtactcacccttgctctatataaataatcccccctcccccagttgctgaagaagatgaagtggatcccgctgacgaggagttcttccaggagcaagccggctacgatgagttttagggtttcggcctagttcccaggtcgcgcctgtattgtttggtccaagtcttggcttccgcttcccttttgtaatgcagttgtgagctcgggatctgtccgcagcccgacttgattgtactcctactctataataaagagacctttgttgctgtgataatctgtcttcctgtgataccagcactgtttcctgggactggtatcgattaacaggttaatttggagcgtcacgggctagttccggtcgggactagttcggggcgtgacagttttcctcgtgcacgcttttcaaactactaaacggtacgttttttgcaaaaaaaaaagttctagatgaaagttgctttaaaaaaaatcatattgatccatttttcaaaagaaaaaaaaagccaatatttaattgatcatgtgttaaaagatcactccgtttgtgtgcaggagggatgggttcccatcctgcaccgtcgaacacagccttagtgctgggtctcggctactcgtatgaaactaagtggaagggaatggagaagaagttggatggtttgattcatatccatgtataagttgatattaagatatttccaacgtaatgttttttcagtattggattttaaataattgaaatcatatatataaaagttgtgcatgtaaaataatttttattccctaataaaccgttttggattaatatgggcaaccaaaccgttgttgtgcatcgtcttgcatagagaaaaaggcgtttcccgggctgaaaagcgtatatcacgaagacgtattcatcttccgtagagaagagaaccccaccacgtttgacattccatcgctttccccaccccatggatggagtaccacaccagatccgatcagatcagatcagcagatcaccaagtctccttcacactcccactccagcggcagctgagcagagagctccaccgccgccggccaccatgagttctcaccaccgctacgcccacctcctcgacgaccccttcttccccttcccaccgccgtcctcctcctcctgccccttcctctccccacccgccgcttcctccacctgcccattcttcgccctcgactcccccttcgctgctgaccctttccatctccaccccttcctccccacgccgcccactagctccctcctcgaccccttcctcctccacaccctcaccgaccgcgtctcccaactcgagctcgccctcgccgcccgcgccccacaccccaggcccaccagcaggaagtgcacctatgtcaccgagtccaccggccgcaaggtcaagtggaccaccgaggacaagcctcgcgccggcgagagggtgctcaagtgggaggctgagctcgactccccctacgacgatggattcgaccgcaagtggaagtgggaggccaaggccaagaccgcctccgctgctgccaccaagctcaagtgggccacccacctcaagggcaagggttgcctcgagccatggtcacactcctacacctgggaggaggacttctctgccaccgacgacgacgacgacgaggagatcgaggaccaactccatcacaaggccctgcaggatcacagcaagctcaaaaccaaggccaaggacgacaagaagaaaaagaagaaggacaacaacaccgtggtggtcaacaaggagcagaagaaatgccccttctccgtcaagatcgaggagatcccacctgaggaggacaacaccgctggatgcgtcgccattagaaaggtgaccactttctcaaaccccatcttttacattacatgtagtcaccatttcgctcgctgaagatcacacttttatgtgattatttccagaaaaaaagattgtatctgtcataatagaggggtttggtttttacagagatactactagtgtctgcaaattagatgtgcatcggtgctcttgctgtgggcataatatggaaatatttgttagttagagaacaaccaaccgattgattcctcttgtttcaaatgtacatttatgctgacaatcctgcattttcctcccctcattcgatcaaaggcttttgcattgggcaatggcaaggcaaagaagaaggaactgtccccacaggatgcggcattgctgatccagttgaactacagggctcacctggcacaccgttcacaggtgcttcgctgcctgcgtgatctggctgtggctaaggccaagctcaaggagatcaggtccctcttctataacatctcttacaggcatcgcatggcacatgaccatgaagagcgccaaaggttcactgagaaaatcatcgtgctgctgctcactgtagatgcgcttgaggtgagcgtcggccttctatttgtttgccgtcactgtttctgttgcattatcaatctgcaacctctatggttggtccaagggcgattaatcctttagggatctctgcataggtttccaatgctgctttatcacctcaagttactgattagtcctaatattaggggaatcaaagcatgacctaaatattgcagctgctgtgcatctctttcttatacatatggttgtgaaacactagttgaatattaaccaaattaatatgcatttccctttaacgcacaaggagatgaagggtgagcatttatacctagtaggtaataaaatgtctgcacatctcatcagattcagatgtatagctaattaaatctacttgtttcttctttatatgttgctcattttcagttcttgcacatagca

SEQ ID NO: 45397 - DNA, 786 bp, Oryza sativa
taataaatgataattatataaattttttaaataagacgaatgatcaaatattaggcaaacagtcaacggtgtcgtacattaaaatatagaagtagtagtagggaaactattttcatccttcgaggggatatcctctcgttgtttgcatgtcacccaaatggttatgaaaaaaatttaaaagatgtattaacatgtgatatatcactccacaaacatgcaagtttaaattcaacttctacacctcgcaacgaaaaaaacaaattggactgtgaatattaactagttatagtttaatttgtttttttcgttgcgaggtgtaaaagttgaatctgaacgtgtatttttgtggagtgatatatcacatgttaatatatgttttttttcataactatttaggtgacatgtaaacaatgagaagatgttcgctcgggacgaaaatccactcccgtagtagtaactgagagagatcaactgctactccagcgaactcttctcctccatttctatctccgcctccgcctcagcctcagcctcataggataggagtactctacatgctgcctatgatcaatattgccctcatgtcctcctcctcttgccatccccacaaccccaccaccctgccgctgccggagccggacagcagcaagtcgccggagcccacctccgtgctctacaaccgcagcagcccgagcacctccctcggctcctgctcctccaaaccaccggaggaccctcctccccccatcgccgccgacgacgactgcgactgggacgccgtcgtcg

SEQ ID NO: 45398 - DNA, 1504 bp, Oryza sativa
tgctacgtcagttgttaggactagtctttgcatttgttggccatgtggtccataacctgctaaatgtccagtcagatctactcagaattgcaattgattttggtagagtagagactaacatgcatcccatagtgcaaaagaaaccagacctagaattttcaatgtgaaaggtggttccttctccatatattaagtgtattcattcagataaatgttagaagaaggttttcttgtcactgcaaatctgcatcaaattctttagggagtcatcactcaacactagaaacattccatatcacaatagattttgtccttttgtactcagctgcataaatgaaggactatttgcagtttatcttcgagcggcttgtattgcagcttcaatttgcgagacgactgttgcaagattttcgatatacttgtggtcactcagctttgatttgtccattttggctctccctctctgatctttcattttcaggatagcactatgtatggctacacgattgagacgacatgccatccttttcctgccctgggactagtagtaatcttttcaacacaaagcaacaggcaaatctcctctgcctcccattggtttgtatgtattgtaggctcacagccaagcagttccttgtcccattgtctttcctcgtgtacaccttgtacacatgtataattatttcttatgggtgtgttattatatgtcttgtgtttaggccttaatcatttggtgtcacatggactttgcctctcatcacatgtagaccacacttttttttttaatttcacttgtcccctccacactctatcaggtagtaatacatctcatctccattagatgaactttcattttatcttttggcccctcatggaactagtgttagttgagcttgaaccacataatacagttgaaatgcatgcacttgtgtcttgtctcttcttgtacagtggtgaccacaagttagctatatatgttctgataaatcccaacatgttctccaatgtgaaaagtctgcaagagtttatatccccaactgcaattgatcaatgaatatatagctcaattagagaggaggggggaaagaaacatgacataccgtatttttgtttgaacctttgctgaaagatggagatatgatctgataaggactaatgcctgccatttcttgattgaagattatgacctccaaagtagctattaggaccacacaggacactttcatgggatgccaaaatttgtggactcaaagtaaagttgtaatcagctaaacatctataagcattgctcaagtgtgaatgatcagtttaggaccatactgacatggtgagctgaatatccaggttagaaactgtttctaaaataaaagagaagcatcttcattgcttctgaactctggtgccttgcatgtgaattaacctcaggataaaaggggccttgggatggatatatggctgctttactttacagatttctcttgctgcccaggaaaggtattttgca

SEQ ID NO: 45399 - DNA, 1362 bp, Oryza sativa
gttttgattgaaaccatacttaataagtttgtcaacacgagtatcaactgtcagatagtagtgaggaatggtttgcttggagtgcagcaggcggtttgcagtaacctgacgaaataatatcagaaactgttaatagaagtagagcaccaacagcaacaaaaaccttgaaagaaattaagtggcaatgatattaccttccttatttgcgtattaggaagatccacatagcctagtccaggagctgctgctgtttccttcttggcacccttggccacagaagcttcattaagcataaatatcattagattaccgaacccacttactctactctttataggtaaaactatcaccattcattacttatcatgctttaatctggctcttatatataagcatcttaattctgaaggccaccatcaagatgatgttttttcagcatgaataaaaatacagaacaattgcatacccaagtaatcctcaatatctgccttcaaaattcgcccatcggggccagtaccttttatgcttgacagtggtacctgtttaggaaacaaggtttcaaaattaaaaactgcgttctttggaaaccgtaggatagctaaaatattagaagcttacattgttgtcttctgccaatttccttgcaattggactggagaatgtgcgatcctctgaaagaaaagattcttctgtctttgtagcctttggctcaggagccttgggctgctctttctccttttttggctctgtgggctcagattggggcttcgattcggctggagctgcagattcagcagatgatggagccttataatccttaaatttgccgatgtcttcctcttcttccacggttacggcaataatctggttaacaaataatgtgtaaatattgaaggcaactcaagttcatatcagcacagaacatgggctaaatggagggaaaaagtgtcttttctaaatcaagaatatgtacctcaccaactttaatttctttggcaccatctccatggataattttagcaaggtagccttcctccatgcattccatctccactgtcgctttatcctaatcaccataaatgtgattgatggttaagctgctgttgctccttaattaaataaagtagggaaattaaatcaagtcttggtgtgcacattaagaaagtaacttacagtctctacttcacaaagaacttcacaggtgagactttatctccttctttcttcacccaccttgcaatgtttccctacaggcaatttaataagtttgacatgataaaggcaactcaagagatacatgacactgctcatcctttaattttctctttgccatgatgccatgattttatttatttattcaat

SEQ ID NO: 45400 - DNA, 1121 bp, Oryza sativa
tggtataaccacattgccatacataatacggcagacaaggaccttgctggtctccaggcaggcaaccacaggctcctaaagtctcattgacaactgagtgatcaaaaccctctacatctttaaggctgctacggctcctccataagtcctgcagtactttaattcacgaaaatgaaaactgacagtttttttccgcaaaagaaaacgatgttgaagaaacataacagaaaggtgagcatgtgaaaatctgaccggaagtgacattgcacatagctttagtattcctttacaaggcatgatgaatgcatcctcagataacatcgagtcaagtagggtcctcacactcctagtgttaaaacatcagggatatatatttttaagtcttaccttaaaaatacaattgaaatcaatataaaaatacataaaaggtgatttcaaataaaaaaaatgtttgcattttttacttgtcctccctgggtttgatgaatcttaaaacaatatggatgtgtggtgcttgataaatgcaacagaaacaaggaaaccaggtgtatcactaccagacaagtccagtctgcgcaaacactactagtaactcttattccagcttttgcttgaaagattaacctggttgtgcaaattgttcccaaggtttatacttcatatgcaactataaccaaagagatggtactccaaataatttcacaccaaacatgggttaagtaatactagtgagttgtttggtttgaggaatcaaaccatcaaccatgagttgattcatgatgacatcatcccattcctgatttttctagtaagcatgtgtctttgagggataaggtggcgacgtactgatctaaactctattccattccttaacaaacaagttgtacaggatcaagtggtcaattgcatgttctattgtgaatctgtgatggattgtgaatctgtgatggacatactgcaggctacggagtaccatacaatatcgaaaattattggcttcactgttaggaaatctttgaaaagcagcatgcactagcagagtgtagaaatctctaacatcaatcagcaatggcttcatcttatcaaactgggggtagttttccccttgtacagaaatatgc

SEQ ID NO: 45401 - DNA, 906 bp, Oryza sativa
ttttttaagcccaacgggtaaaattcaattcctgtatttttggccggagactaaatttcagcatttttttgtcaaaaggttaatcacctaattttagcaagaagaataatgtcaatgtgtttttgggcccaagcctaatgctcgtgtaattttgagccgaagaaaaaaagtttcattcggtttttttgaaggatataactcacgaaattatatgctaaagggataaaaataataaaactgtgttgaaggcatgcatacgcatttggcataaggttaatacccataaatttttaggtcaaaagctaaaaaccattgaaatctaaacatcagggaacgaaagaaagaatgatacggtatatacaacatttgcccttatcagccacacggcattgttatttcagaccatccttgttttcaaataaatgaacaaatgctctaaaggggtaaaagaaagtagcaaagtaatcactttacaccaagtcatttctttcctttggcatctcaaatcaactggcagtgatctatctgtacaacggcatccgcatacttctttcatgtaaaaaaagaaaagaaaagaaaagggacgccgctcctttgtttcctctctagacatcatagatattaaatacaaaatgacatgaaaaacaaaacatggccatatgattgatttacacgatggacgcacctcatcttttacccttttgttcaggtatcagagctctacctcgtgaagatcctcgcccaggccattgttgaattgaagtgatgagttactactggaacggctgtgggattgtttctgtccaggaatcaacggagactgcatcatggtccgttgtccatctggtgatctcgaaacagcattgccgctcaactgctctgaatatgctccactccatgatgctg

SEQ ID NO: 45402 - DNA, 1572 bp, Oryza sativa
agaattggttctggctaggtggcattggtggcatccctgaactaggcccagaaggattcaaaggccttgcttctgaaaatccattagcagtataacttacactgcctgggccattcgaactctgatctggaataccgttctggaacaaggcctttgttggaggtgggggaaggggaggctcctcagcaggtatgtcagcaccttcttccacccaccgcttcagcttctcgtcatagtagaacttgttttgttcccccagcttcgcctttagggcacaaaagaattagttgtgttacacaaatcaaaaactactgtgacatgcagttcgaaaccgggatcggatgaatttaatgttttagcaagcacctgatgatgagatcttgaaacaagtcccattgtcttctgcagcaaccatccaaaacgtgaactacctgaacctgatgtgctttgtgcattatctaatcctgcaccctgtgagagttccaatttcagaaaagagaaatgaaacacatcaagaaaacattccagtctaagaagcacctggttgggggttctgccaaagtctggttcagagacacttctgttatgtgtgacttttctgtcagggccagtatttcctgacatttcactcatagattgctctgaaacagaagacatcaaagaagacatagccatcactggctgattattcacaaaatttgtagctgcaggagccgaataggaatctctttcggttaaggagccctgtggcactggtgacaacgctgaaggttgtgtacccatcatgcgggacaaagatttatcaagtgatgtgaaaagttttccaacaagctttgcaggggctagatttgtaccataaccaccctgaataacaatgagttgatcatcagtcaacatggaagaaacagtctgctctagtaaatacgagaatcagcaagcaacagctacaataaattcaaacctgctggtaggtgcgtatccgctcctctagggatgaaaacaactgcttccatgcctctaattcaggtgcacggccagatgctttcagcaccttcaagcatgcttgacaatacctaaagagagtagtttaaagtcaatgtgtgtaactaagaaaccaggggaaaaactggaatagtaactcagcaaattaccttaatgaatcagaaaccttcccaacctccacaagcatgtatgcatatatcagcttatatggttgaaatggcaagaggatgtactgagaattaccaagaacttttgcatattcatacacctctgttcgctgtttgttacattgtgaggacatttgtttagaaacagcaaatgacaaaagcaaaaaaaaaaacagtaataatatgaattaaggccgaggacaatcatcatctaatcatgccattttctgagtaagaagtggtccaaatagagggactgtaaagcttttgactaaagtaagtcatgcaaaaaataacactagaatttgacacatctaaaaacatatgtgatacgcatgctcctctgcaaaaatgcgaaaccatctacattagatacataatgattcatatctgagatattgtt

SEQ ID NO: 45403 - DNA, 2878 bp, Oryza sativa
cagttataatagccaaattctcttgccaatcatccagcatgctcttagaattcacagcctatccaacaaaaatgctaagttaggttcaaccctaatgatccacacacgataaaagatgagaactaaaatgtatgaaaatcatggaatgggaagtcaagaacaatcaaatgatatacatcacatgacatataaacacgaaatgagtatagaactataggtcataaacaacatagaattattatagagtctaaatagaagcatttggatcctataacaaaagaaatagacaacatgtcccctattgcttcgaatcgaataatcattcaggtaggagtaataaatttagggattccgtctaaatgtttgatcaatagatccttctactgtcatgagcaatcaagaatgtggtaatgaagttatgtattacctccaccggccgttggggtatatgcaaattaccataattgccatcaacagggttctcagcattgaaaacatctgcaggctgtcccgcaataagaaggcacaatgtcctcaaaggtgatccagatacaaaatggtggtaagccattttcttcacagtatccacataaaactacatcaccagtcaagaaaacattaaacaaactgtccagggaaaaaagaaaaatatgtgtatcatgcagccgaaaaatgaatgcaaacttatatcaatagtagcagaccttatcaccaagttgtaaagcaaggattaatgcgggtccccaaagctgaccttcctgagcatactgaagagcctctttccttctaccagaaactaggagattttgaacctccttagcagtagcctgcaataaaatggttgccacacccaggattactatttttttcccctgaagctggtgttcttagagaaataagaattacctggatctggttttctgacggaatgtttttcatgcaatggacaatggctccatactctcccttatgagcaccactactcttacaagatgagaaaagttttgtcactgccatctctggaccatctataccctgttaccaagaattcaaaataaattcaatattcctttcaaaagaatagaaataaattcaataaaagatagccagcagttatatgataaagctgattgaaaaataaagtgaactcaaggaagaataggtcttttcatttcataggtccagtttaacatgcatacattacttcagtgttgctggttacatgcttaaaatcctgtatggacaggccatttttccatgtgagaaattaatgacaacttgacaaggagatgtttttaactgtggtcatgaattatagaaatatagtacagcaagacaaaaagcaaatacctcctgcgatggatcagacccaaaaggtgaacggagctttccatagtgttggcacaatattttaagcagtgaaatgagcaacttctgatcatctcctccctggaactccctgatagaggaatcatagcctccggtgatctcatcaagccacttgttcacatcctttgctgcagcacttccaccaacaagggggccaggaataggttgacgacacaatgcatggaagtaactaagtgcgctaccactagggatacttggatgatcaactctatcagaaacaatctctgacacattaagaattgacactgtgccacatggatttcccttaaattgcagcaataaagtttttcagtcacgatgacattgcaaagaagagaagtacaaataaaaattctaatcgtacctgattcccactatcaaagtttgtggacattgaaatggtctctcgcacaactacaagcttccccccaaatccgaatgtaaccaaagcatgtggtgggcgtccagctgatgacctctgctcatgggaggaataaccaaattgttgaggtaaagcattggaactgatgaattgctgctgcgcaaaatttacagagcttccagtgctcaaatagttatttggcaaattcatgcatccatcagaatcagcacgtgtttgcatctggggcatgtttgctgttggaacagagtcttgtggcttagcagcaccattgaagctgctgtaatggcttggtaactgttggtatgccacatggttagcttgactatctgtagaaggtccaaattcctggtggccagtctggcccgtagaataatcatatcccttatatcccaactggtgacctgaataaggctcaaaccccttataattctggttgcctgtagaaggtttaaatccctggtgagcagcctgttggactgtggaagattcagagccattgtacccactatgatggctggtaaaagtactttgatgacctacagatggttcaaaacccttgtaaacactctgatgactagtggaagatccgaatcccttgtaactcgcctggtgatcctcactactagtgtactgacttgtagaatgcgcatatgtgttgatatcagcatgataatacttagaagattccaatgactcgacatttgcctgctgagcagtttgattctcagtgtgctggttggaaccataaaaactatccgacaagctgttatcacccaacgagccatgttgctgttgtccctgatggctatagtcacctgtgtaagaatcactggtttgagctacattatggcctgttcctgcatatccagctgaggctgctgcagtagtttctgcctgcacaccaccttgctgatacgactccagtgagagccactgctgagtattggtgtcaaagtaccatcctgggtattcagcgtagaacaccatgttggacgggtactctacggctcctgtattgctctcattcggggtccagcttgtagccatggtgcttccctcctctgcgatggtctccaaccccgcctg

SEQ ID NO: 45404 - DNA, 3812 bp, Oryza sativa
attacctccaaaaaatgcatcgtcgcccatgaattctccaaaaggatcatccccaccgacaccgctgttggtggcgaaggcgctccactgcacctgcttgacggcggtatggacgtcctttgcggagcccggcgaggcggcctctgggtttggtggcagtgtggcggcgggggccttaacctccagctgaggaggaggaggggcctcgggttccgcattaggaggagggggcgccggggcggtgtgaggctgaggtggaggaggaggcgcggcctggtccggctccggtcgagaaggcggcggcgtgaggtcggaggcgaggcgacggttggtatcggcgtcatcgtcgtcgacgagcttgtcgaagaaatcggcgtcggcgtcgtccgaatcggaagcggaggccatcgttagggtttggggcagatgggagggaggggggcgggcggagaggtggatgaggttagggctagggtttggtatagtttaggagagggatctgatcgatcgattcgatctcgaattcgtcgtctactagagactagacttgaatgaatgcgatgcggagaagagaagagaagagcggaggaggaggaagacgacgacgacgacgcgtgctcctcctctcctagctactcaccccgccccagtattattattccatacgccctactactagtgcttgttgtatttcctcttttctttttcatcaacagccgacatggatatattttccagactccactaaaatatactaccaccttttatttttcttttatcctttaaaaaataccacgagtagtaactttttttttgttttcaaagtagtatgaaaagtgcgtatgatttagattatggaaaattgtctctattgtcaacgatggagatggcaaaggcctgagtgagcgtcgtatcatcaccattaaacttaataattgctgcgattcgattttgtttggacgatcacataccactccagctccagtggtggaaggtggcactttgacacccacctacattgtgatgatgcatcatgcacagtagagacaaattaattcgtcatcaacagtcctaatctcatccagatttggtctaactccttttttttctttcctcatgtaggggtactgtagtgtactctatcttcttccgcactcaaaagtatgtgctgacgtttgctacaaacaaatactaccttttgtactagacacagatacacctagagaaagaaaaaaaaaagagctactgctactattttgcaattacatctaatacgtacatacttacaagaattacaagagaaaaagaaaaggtgggttgttaattaggataaaagagccttctcaacatcgccaccttccaaatgaataatactatgaccttccttgctcttcgcccacaagacgatgtagagcccacagaacatgagcaccatccctgccaagctgtatcacgcatgttatgtaatgtacccacaggattatcattattgatacctttcagatccacgttattatgtatacataaacgaatcagcatatctatatgtatcataatgacagttgtattactattgttgttgttacagtcaaatgtaccatatatgtatttttttttcttttgccaaagcccagaaggtagcatgtgattccagtgaatatgcatatatagttgttcttaatttactatttcttttgggatcatgttaggtttatataatagactaaacacacgaggttaagtatgaaagtgcagtcgaatctctacattttctttttataaagaccataaaaacaaagaagataaaggaatcaattgaagagataattaaaggtaccttccgaggcagagcaactgggagaagagaagagcagagaggagggcagaacagacggtctgcacagggccaaagatagagacgagcagaggtcctcttttcccgatgcaccatgtctgaaacaccacgcatccgcccaccacccctcctccctttgcattttcaatttcatcatcatatgcgtccgtcagtcagtacacatcaccactaattgctcctactaatgtaaatggagcagcagaagatcgaggaaaaggtatgtaccatcaggacgatcgttgagatgatggtttcatcgattctcggcgagcccatgtcgatcttgccgtccacgatgaactgcaggatcgcggtgaagacggcgcccatcatcgatgttacgctgcacatcgtcaatggcgcagggaagctcaccaacgtcgctgcctgaataataccatgagtatatattgttgcaagtttcagtaatccatgagcagctagctaacaatgaaactacatgcatgtatgtagagtgagtgaattagtagtaattgatgattacctggagcaccgtgtagatagagagaacaactactgccaggaaaaggtagaagcaaccaaggatccagtcatagtaactagttgttgtgagttgtggagaagacgaaacgggactctgcaagaagctcatggccatagctcccaccaagcacaccaacgttcccagtatcttggctcttgtgtacttgcatcccttgtcaaacttctccaaccttaagtatatgtaataattcaggtaaatgtatatatcttaggtaggtcatcaattgcagcttcatctataagcagctactactatacctgaaacaagccgcaatgatgaagatgagtccagggctcaagtttggcatggctgatgcgatagctggtgttgtcttctttattcccagaagcatcagttcttgaaacaccgttgttctgaaggttattcattggatacaaaggctaaagcattaaaaaaaattataccatgcatgtgtatggcaaataatctcccaaatagattattcctaagtatatgtgtttttgccattcaaaagatgtgtgtgtatttaatacgtggtccttggggaggtatcacaagcctagtactaactgagacatcatcaggtcgtctatctgaagaactaatgtatgctgctgcgtgcactcaacaacttgcccctgctaaatgactggtagaatcagtatatgcatggttattagaattgcaaatgcacttgccattttgaggcttttagtacgttaaggatcgagaaaggtaacggttttcagtgcagatcaatcactttgtgccacatatttatagctggctaaacttgagccaattagcacgagcttctcggactgttttgctaatactagtatttagaaatatggttgaaataaaaaatcatcagcagttaatgtataaatcttaccctccaagagctatgaacacgaattgcgccatgagagtgcgagaaatcttggaaggccatttcttcctgacacagacaaaccaaacattgcattacttacattcaggcaggcaggcggacagaaatgcatctcatcaacttcaatatatatgtggagaaactactagctaatgagtagttaatcaagagagaattgaattaaaataagtaatggtggccggagtacctctcgaggacgacggcgaagggaaggaagaagagggaggaggcgacggcgccgaggacgatgagggacagcgggttggctccaaggctgaggacatggtccacgaacaccacgtatccggcgaggatgcactgcaccaccagcaacccacccacgatcaccccctcctccactttcgatgaccatcctccgccgctcgcaccttgcaccattgcacccaatctcttcttcttcttcttcttcttcttcttggaagaaatatatacgctcgtactacaggatcaat

SEQ ID NO: 45405 - DNA, 1915 bp, Oryza sativa
aatcatgaatcacctctcaaatttcacagttccattcaacaaatctccctgtgaaagcagacagaacagacccagaaaatgagagatcaaatgtgtcagcaaactggactttatttatgttgcacctgtccaggatattcagtacacaaacagttccagaggagcatctaacatcatctgatggtacacgacacatattatttaccatacaaactactgtttgttagcctgtgcaaacagctatacataatcacacgcatatacatatatgcatacacggccaaaaatacatgcaaccaaagtaccaaactctcaaagggggttaaaaacaaaaggcatgcatatgccgtgatacaacataccccactatgtggcaggttcatagatgagttaaaataaaaggaaaggcaaaaaaaaaaaatcacaggcacataaactacctggccatctagatgatgagcaaaactagcctaatggttagagcattactaactgctatatgtacaacgtgacagtacaacatgtcgctaacacaatgtggtatttcggattcactcaaaatcgccactgggtgctgatagcagggtttgcttgttacccccaatggatgctgattgtggtggtgttctttcatttggtcgttaccctgcaaaggggttcatagcttggtgaaatgatgatgcatgtattcaggtatggaaccatactgtgaaaaataatgactgtttacatgaatgggagatgaagggtgtgagttgatcccagatcccctaaattctcatgcttcacttggtccatgccatatccatgtgatgcgagtaccttcctctgcaacaacaataagggatttccattgctcagattccacgcatgagtatagaatcagaatatcaggcagcgcaaatatttatggaacatagtcagaaactcagaacactagcaaacatggtgttgtttaggtcatgtaacaacatatataactgtaaaaagcgcaatcaataggtcaaggttgcaaaaagaacacaaaaggggatgccagagactgcatcgatatacctattttgaaacaaatgacggtatacaggccgaattggattcgagctatgagaaaaataatcaggtaatgctatgagaactagagtaatgttccattgtgctgccaagtactagcaagttgaaataacaaacagatgcacagaagataaaataaaacgaagaaaaagaagcaaggtacttacatgtgcttcaaagtttgggtttgtcaggtttattgacaaatttttcatcagtaacagcacctggatatcaaatcaaaacaaaacagttttcattatcatttcaagtgatacaatgcaattatgtactggcataacaaacattgaagtgtacgtgttcactgaacaaactgatttaaaccttaaaaatgcatgaaacagggaaaacaacccatgcagacctgacatgcaaatcatgaaagtgtatgaactgcacaaactaagagaaaagggcaatgaacaaaataaatatttcttttatggcctcagaaggtgcatagtagagacattatgccaaacataggagatccattcttactatgtcaagattatctaagccacatgtagtaactggtatccaccactaataattaacaaaatgaaacacattaacagtcgagtttcagttatgctgcatagtaaattcctattttaccttctctaaaaaaagtcttcgatgtacttaattattatagcatcatctttctgtcttatctgacatctcacacaagagtttttcaagttgctgatggaatggcagtaatagtacaagttcgcgtgacaatttctattagaattgaagccaaagcttcatttaagatgcaaatgaaatcaagaatagcttccatgcaagcactaaa

SEQ ID NO: 45406 - DNA, 747 bp, Oryza sativa
ttagaaccgcataaccttgaaattctgaagctcttttccagactgcctgtcatgggaaaaatctgatcctccaattttttttgcatactctggatgaaggttggaacttgatacagctgcaacaggaagtcgctataataggcaatacatgtagaggaagaaaataccattttcattacaaatgtttcactaagaccaaaatattctgtgttgaagcactagaaaactggcgagtgatgcccaaatatttgtatgacgaaaggaagttcctttttctttctgaacaacaaaagtttattgagacatcagaaaggaataaagagagaacacatactatcttcctttacaagagaggagcaagtgctggatgagaagtgacgaacaacagtcccacgctcgcatccgaggatagcatgcgctcttcgcaactgtgtgagtagattgtgcaggcaactatgagcatatgcaaaccatatatgtataataacagaatgaatgttcatagacgaaatgcaagcatatataatcctgttgtgtttgacataaatgataaaaaccagaggcccatgaagatagagcaagccagacatgcgctttggtgtaattccacaatgacctagatcgatttgtacatgatagcagttgagtaagatgaatagaatgggtttaaaagtagcggcgtgattaccgagagaggatttgtgcaactctgaaaaaaaaaaggggacattttgaacagttgaaaca

SEQ ID NO: 45407 - DNA, 1324 bp, Oryza sativa
gaatggatgcttatgtctttaatgatttcagagctgggactgggttgctatccatgatggccgcccgagctttggcagctgttgggggtgaaactagaggaggaagtgtttcagcatgtgaatcttacctcccaatgggaaaattgatgcgaagggtactgagagccaatgggatggaaaacagggtcaaagtctttcacaagcgttcggatgagctcaaagtcagagatgacctggattcaccagctgatatattggtatgctcttgttttaggccagcactattgaccataagatgctgctcatatatatagcaaatttggcaggggaaaatgatcattttccaatctaaagagtagcacttgatcatttgctaccccttgtctctcagacatgttgcctcaggacccatggtcagagtctacacattgtgtgggaaatgattgattttgccaccccaaatgttcagtcccccattatattctgaattaaaattgctaatctcatctatacttgattatccaaccaaaagtttcccaaaagaaaaccattctactgatctcacttattgtcaatgtgatagactatctgtatcaggcaaactgctgtagatgtattgattgttttgtttttttttcttgaatacgcaagagagttgcgtatcatttcactaagaagaagagaaaaacaggagaattgggaggggagcccctcccctcaccaagaccccacagccaagacctttacaaacaggggattgttttgttattttgactactgccattcagaggcacggccaactcaatattgcttactttcccttctatttgtgttttaggatataagagggtttaacacttttcttgctattgtgtattatgtgtaactaatactcgtgctaacaaagacatgttctgcaggtaagtgaaattcttgattctgagctgttgggcgagggtctgatacctactttacagcaagcatatgacatgttattggcaaaaaatccaaagatagttccttatcgagccactacatatgggcaggtcagttcccagtgccttctaatatgcgtttgtcccaattttaacaatgtgagataaatttatactgaatttgttgatttccttgatgtcctagctagttgaaagtacattcttgtggaagctacatgatttgcacaacaatgaagcaaatgctgcagacggtgtatggcttactcctggtgagatggagaggattgtgtctgtgaagccacaacaacatgcaatgcaatgtgatgcactagaagatgagatacgattggtatggactttagttttgc

SEQ ID NO: 45408 - DNA, 752 bp, Oryza sativa
gattattgaattttttatctaaaggaaaaggatttaattaaatcctttttggaaaagaaaaagagaagagaagggagggagggaatatagacttttctcggacggctagggggcgcggcccaagaagaaatggagcggtctccggccgagctaaatgggccggccggcccaaggcggcccaaactcgcgcgcgcgcgggagggaggagagagagagagagccggcggacctgactcaccacgcgcggtcccgggagggacccgcttgtcagcggcttggctcaccgtgcggagggagcacgccacgcacgcgcgcgggcagggaacggactccgtgcatgcgcgcggtccgggacggacgcacgtgcggcgggcccacacgcagactgacggctcgcggtggatcgcgcgcacacggagggaccgaccggggtcggacccaccctgtctggctgagctggcacctacgtggcacctacgtggctgccacgccggccggagggaggtaaacaaccacccggccgcgaatggacggcgggcggcggcagcgagcggccgaaccaaccacagccatacgggcaacagcgagcacaccggacggttgcacctgacaaggggaagccagccaaccgctctgattcgacggaggttgatcgacggcggctgattgcggcggcagcaaccggcggcgggagaagaaggaaacagcaactaagtcacgagaggtttattcccggcagagagagcatctac

SEQ ID NO: 45409 - DNA, 8793 bp, Oryza sativa
atcatatgcaaggggagggagaggcaaaagcttggaataatcgatcatagggcgacaccatgagtagtatatttatccccttctcttcgctttcctttagctccaagcttttgtaccaaggctgtttggcacttactctccaggcgtatctgctccacatcatgatcatccctgatgtcacaactcaggccatcagaacatggtgccatgattctttcctatctagcttggagaacatggtcaatgtgtggatcatttcgtaatcctgtaattatccaagagctgaattaacccacaaattaagtacaacagcctgaactctgaagataggaagaaagaaagaacatgctattgctatcagatataggtttgattcagatggaagaagtggcaacgtagaaagagtagttgcatgggattaaagggtaaggaggattatattccagctatatgtacagagcaaaaggcccatcgaataaattcttcttgtacgatttggcctgaggaaagggatcgatgtgatcgaaagttaactcaatgcaggagcttgccggctccatcctagctaacaactgacagaaacaatagccaggacaggtccatcacctagtcatttcccccccttaattcaggtcaactctttaactgtacatgtatactcccctatgcctgaacagaacagctaaataatcctcgcaaattttgttctgtgagataatatcgacaagtgaaattcagagttcacatgattcagaattcagagtttcagatgtgttactgtgctagtccaacaacaggtaaggtctcttcatggacagatcaactttttttttcccttcttcttctttggagttcacaaggcaacaacctgcagaagcaaaagcaaaggtgacgtggacttaaaaacgagggcttgtctccggtagcatgcaaaagcggccatggattcccgggaaggcgagctcgagctaactgagctgagttgcatggggaaagctacctagttggtgtttgcatcatgcatgcatgatatcgcgtactaggcgtttggtacgtgtatatagtaaatccgtatcattcagagcttcttcttcggatcaaatcatcagggagacatcagctttgctctcctttctgtcaaaacaaaggcaacagcgagacgtgggtaaagatcgagagagaagaagctaagcttagccatggcttttgctacactggatgaagtggctagcaatggagccctcgagccctaaagatacgggcgatcttgggcgagccatggagcaaagtgggctagcaatctctgggtcgcatataaatgggaagaaaagtttgcacagggtgagagagaccaagctaaccaatggagctttttgtgtggaagcaaagaacaaattaaaggatccctaagacctagctaagccaaaccaaccttttgatttctctcttttctttcttcctctcatgcacagccaggggaaaagagtgttcagaaagtggatagatgctctatctagctcatacacagagaaaaggaattgctcctgctgctgcataaagatgattggccccccaattgccactcttttttttttgtatctagcaggatgaacagttctgctggattgcagtacaaatgtgcaattgctgtggtttatgccatgatcagacattctaaatgctgcaagaattcatcatgtgtgcatgcattggctgggccctttctgcattggaggatcatgagagttcatctgatcattagcatcttttccttccatccaaaggaattaccaccagctagtagtgtccatgttgatgttcgtctgatccgtgacgtgtgaggcatggcaggcacaagaagcagccattaattattgttcatccatcaatctcgcttcttgcagagcttaattgggccgtttgccgtcgctggaccaggctaggtatagcagcaagctgtctgaatttttttccccatgtctctgaatctatacgtccgtagttagctagggctagacggtgttagccatgtggactctcaccaaacttctgtactactgcttgcaaagagatctggtaggatcgagttgaaacatgaacattgttttgaaactgtgtggcgcaagtactatttgcaacagttcagaaaagttcagacatgcagtgtcaactgttaagctcctaaactccaagtacaatacactacgtacatggctcggcttagctcgaccaaggtcgttaatgttagactacaatgttttctgtattctcgattctttatatacccactcccgatactgattctataagtcggtttaagttaggtacaattggttccgtgccttgggtaatcgaatctattgcgttgcgtctatttcgccttcagttaatactaactttctttgtgtcagagtccatgctgttttagaagctgtgtgagactgtgattatcttgggcaagtgagatagctcatgcacagtgattcccacaagctggatcaagatcagggctaacggttctgaagaatttggcattttttgcagtggatgagcagcacgtgacccgctcatctctacctcgcgcgcgcgcgccaacgccaacaactcgatgcacgtacttcatgggaccattgcctcctctctctcgtcttccccactctaaggattccccatgaagagccctacaactcttagcctgcaccatccatccatgagacaagttttttctttctctctctctctctctctctcctcccttttttccttgtgattttcatttcacagttatcatgagagcaagaacattaacggcacagaggggagagagagagatgggtggggaacagtagtgaacactatggctagggcagaaaaggagggtagtacactgctttttcatgtgctatcctccatgtgttgacaatgattttctatcttggaacaagggtactactggtgtgtgagtgtgtgtatgactattaagcttattactgtctcggctatgttcatattcatgtatagaagtgaacttatttcgagacggagagagtaacgcggtgttgttactagtccatgtgaggagaaagaaaacaaaaggaggcaccacttgtagctatcagctgcttctatggccaaggaaaagaaggtgatgactgaagagagggcaagcaggactaccatgcacatttgctttagaatctgtcatgtctcatatttttcctattccctcagcagtgtatcaaccatgagtgtaatcatttgcaaagagttttcatcccatccttccattgagagaccactagagcaaataaaaaggtgacaagcagatactgttcttttgtcctctcacactgaccactttgtcccaggccccactttcagtcaccaagatagctgcaggtgcttgcatccatcaccacgcaatcgtcacatttccttgttttctttcgcttcagattcattggctcgcggctaacttctcatccaggaataccaaggattccaagttcccaactgttctatatctcaccacagctttagaggtaaaaaaaataaattgattgaaataacttaaacaaattttttctgacccttgaaaagttagatatctcgtaggctaaactccctctgtcacaataaaaatgaatctagtactggatgtgacatattctagtgtaatgaatctggacataggttatgtgtcacatctaatactagatttgtttttttatggaataaagagagtatctcctaattaacaataaaaaaaactacgcctcttggatcatgaaaactcaggtatagatactgcgtggtgaaattttaatcctagttacttctggaattagttttggtacttctctttaaagagagatatttcccaagcgacgaggagctatatgcctctcaaatagggaagaaaaccttttgtcctaggtagtccaacatataggattaattaacatggaatgcaatgtcctaatcacatggaatttatagggacaattcaatttcctcaagaatattgaaacaaacccatgttttatgggcaggccttaggacacctttcgaatttgtagaagttctaatcattcgaagttcctattcaaaataatcctagctcatcttatagtggcacacaacaaacgactagagaagtatgaattaaatgagtggcagctgcagtttaaaccttgttcggggagcttctgtcagctatattctaaatctccaactcttccagatagtctagattctcataagctagcagactatcgagctactcttgcataatagtcaaccacgtgtaaatatttccaagagtaaaaaacaattgcgaaaaagagaaaaactgagtgggatcaaccattatgaactgagaattactctatcagtaacactttttaggcatagagtatccagggtatacaaaaccatgcggttatcgtggttatcatgtacggtaactttctcaatttttaaaaaccatagtataactcgtggtaaccgtgataaccatagggaaccatagtttggtgaacgctgagtgtatcctctcctatccattcatattcgactggccggtcaagagatcaacctagaggcagctagctagagttggtgtacacattgtacagtggtagacttggcatgccctaattatgggcacacacacattgtggttggtgccttctcacaagttttgcatgttacgatcaatctaatctctgcagccggccgcaagcagtggtccattgggatcgggagcgagccgtgatcggtgagtgttaaatgaactgagacgcgaatttgttccgaaagagactgaggagttaattgtgagatcaagatgcagccggtctctggtgccaagagatcatccagagcatatttttagttattaatcataaccgaggatatatttgcccaaagcaaagatttgtcttacgatagctatagctagctagggagtacgagatgctccttgcccactttcacgttcataagagagatcaggatcctggttattggtggtggtggtagattgtttaagttgcaactaattttgaaatttacaacttaatttcaaaacagacatactgcttattggattattgccacggatgatctacttagataaatctagtagcttagaacatgtggtatgaacaatataatgtggtagaaaagttatttttttaaaaaaaatgtatttttagatgagttgagcggatattccatggcaaagatccgacaaactagttgaaaagaatggaactaagaaaagaaattcagtctcacgctacatcggtcacacgtcttgagcttattaaccgcataaaagaagccctccaagcacactatatgcgcccgtgaaaaaataagttgaaatgaacaaacaacgtaggagcaggaaattatgcgaccagcacacaactatagtaatctaccaaggtccaaataattccgtttaaaaaatatagtaataaaaaatatagtaatctaggatgtgatcgattaaaccaatcataatactatatcctgattcatagtagtagcaataggataggtctaatttcattctaattaaattactatattttggaatggagtaacaattttagacattagcacgtacaaacgtgtggcagtaattacttttaattgtctaggggtaaaaagtttgcaaggtgaaagcagaaccagttgtcaatgccaaagcaagaatttataattgtctaagaattaattaattaattgtaatttccgcccataatcttgtctaaagagtatccctcacactgaactcaaatagtcctatataaaactagcaatgtgtaaattatagcataaaattcccagtgttcgaagaggcacttaccaggatgcacatgcattcaacgacaaatagagatattgattaacaaccttaatttaatttataagcgtcgagaacgaataatatactatatatgaaaatgcatgcaatcatttctgtttggcagaatcttctcattgacacagtagcataaagctagaagcggattagaatgacagcccaggttgctttctttgtggagcacgcaagaatctcaaatggactaacagatacaccgccgtaaaatgatgcaatgggaacatatactagtactggtgtaagcaaccggcaactgtcgaagacataaaaaatcaatatagttcagcatattgtatttgacaaatgagctttaaaattgcatatatatatatatagctggcaaataggtattatatattctagatatatgggccattaatttttggatgaattacagcataaacgcaaaggagaactactactactaatcagattactctgatcatgtgttttttagacatactacacatgaatcgaacatatatatgtatatatatacactactaaccagattagtctaataacgtacaggagacttaatgtgagccgaaatgaagtctacaccttacactctccgtccaaaaaaataaaaaatctgactatgaatctagacgagcaccactagtagtaagttttacggtttcaaaaaaaactagtagtaagtttttatttttactagtgtttcagtgaatgagcttaactacttgtgtatctttgccacataaatacatgtacaatgtgctttgcgaagtgatgatatatattcagtatgacaagctataaataaccattcagtactagctaacaatacagaatcaaacacattactattaaatatcatgtcaccaccactgattgcaaaaagaaaacataaatgaagatgattaataggcagtagaagaaaagtttacatatattacctaaacatgtcatatatatttaccatgtgatatttctaaaattttgcaaagctttgttatggattcctacatatacttcaggaaaaaccaataacatcacatgtacaaaaacaaacaagctggaagcccattaaaaatttatacaagttatattatgtgatttatttgaccacaaacaatagaataaccgggtagtattttaccacctcaactatatatattgttttttgaaagtagacattaattatcggcattgtgagatgaagcatgaaattgaatattatttcttgttaaaaacagaagagcagtacattccttgctaaagtagtgtaaaaaaagtcatgcctgaataggttaattccctgtgcaacaatagttaccaaacccaggcaatgtacgctagcaacctaggatgatggacaaaaggccaaacaaatatatattcgctgcctgatgtgatgggatcaacgagacaatgttcatatgtcagagatcgatcggatgaagaacacgagaatgtgcgagtcatcatctcaccccccttgcaattgtaaaactcggaaacaataaaaaacccatcacgaaatcaagcaagggatcggcgcatggctcgatcggtcacggctcccgaccagatagatgatcatttgctcctttcgtttgtctcctctctcactcactcactttgtctctctctcccatgagcatacgatgactgaatctctctctctctctctctctctctcatctacaactagctagtagtaatataatcacaggcataaacaaacgcaaacaccccaattaacttaagacgatgcgatatctaggatccacgagctaccaattaaagccaactaggtttctagggctcagcttttcaagagagcaaaggtgcatgctatagtaaagcgaaggtgtcaaccttatggaagctagtagtactcacatctcacatatacttcatggtgttagtactcacatactacatggagtacaacatggagtagtaaaagcaaagaaaccttattagccttattctacatggagtatagtacaccaataccaagaattactagtatcaattcaatcaagcagcaggaatgatggaagaagatgaacagtgcacggtggaaatcatcaagctaagcttaagctaaagagagagggtgctttcccccaagctcctaactgttgggaagcttccaatcattcttgctaggaaacgagtgtattaattgctcatatcaaatggctcccaagaagagaagcaaacaagagtctaaagggttcgcctgcctaatttaagctaagctaggctctagaagaagacacatcaatttatgcaacgagatatcaaagggagatcagaagctaagaattctcaagagatcgagatcgaccaaagcaattgacagttgcagcgagtgagagattgtagtggcgttacagcatggcggcgacgttggccggacggccggccggcgaccggagtgggcgccggtcacggccgcgggtggccgtggaagaatggcgtgccggcggggaacgcgccgtagggcccgggcgtcgggtacgggtccatcaccacagccgatgacacgatgatgttgccgccgccgccggagcctgcctcgccggccgcggcggtgctcggcgaggacccgtcgccggtgaggcggaagtggtactcgctggcgccgccgccgccggcgaccgccagggcttcggggccgacgtcgtgcaggatgcccttgaacacgtggccgccgatgctgacggccgtctggtacgcgacctccgcctcggcctggtcgaccggccccagccgcacgcaccggaacaccgcctccgagctcacctcccgcgggaacctctccgccaccgtcaccatctgctgatctcctgcacacccagcagatcgatcaacgcggttagatacagcgcgcgcgccat

SEQ ID NO: 45410 - DNA, 2422 bp, Oryza sativa
caccgcccccgccgccgctcgaccgcatcccgcgcgacgaggacgaggacgacgcccccgccaacgacggcgccgggggcgcgtcatcggcgaagcggatgatgttggaggcgtagaacggctgctgctcctgctgctgccatagctggaagctcccgcccctcgtggcgtacaggaacgaggcggcgtcggcggggtgcaccggcgggacgggcggcgccgggttgtctcggctgtggcttcctccgcctagagggaaccccgccatgcgcccaaatccataggcggccgtacgtacccccggctagggaagaagaagaagaagaagaagaagaagaagaagacgacgaccacgaagcagcagcagcagatcaagaaccgatcaagaaaccgaaacctctctctcgatcgtgtagaccactagctagtagctagcacgcgcggccaggaggagttaatccgcggcggccggatcagctcagctcagctcgctgcgctgccgcgagttaagacggtgaggcgacagagaggccctgccacgccgccatggagcctgcgctcacctaagcttccatttattgcctttgcctcctctctctctctctctcgctctcgcttcgtatcgcaccgagaggaaaagagatgtgtgtgtgtgcgcgtgagttggagaggtagccagccaccaacacgcgcacacggcaacgcggctgctgctgctgctgcgagagagagaaagagagtcgaggggaaaaggcagggtacagttgccggctgcctcacccctctctctctctctctctctcgttctgaatacagttagctggttggaatgtactgtactgtactgtactgcactgctactagctgcatgcagcatgcgaccccggggtggagttaattgcccgcgccgtatgcatgcagcgagagagcatatgttggcgtgctccagaattcagttattccatgcctcccttccaacgccatagtcagtgcgtagtaatattcaaagccagccaagctagccacgcccatacgtatacgcgtcttcgatcgcagaaaagatcctggaaaggaagaagaagatttgtttagttgacagtgtgtctggttcagtctcaacatgtcaattcatctcgaatcgttgtcaccgacaccgccggatcgttcgtgtgcgacgacgcggcacggagcggcgcgcgccggcctgagtagcagtcaaacaccggagaacacgggagcttgctcttttctttactccacggtcatccgcgcgcggctccccccatctccccctgtttcgcgcgggttttctgatgtttcccccacccaaaacgctcgatttcaccgtcatccaccgtgcaaaacacccacttattgtactcggtcatcacatcacgtctcggttaatcgtgcgaattaaaggagatatatatagtgagataccaagccaatgcaggagtggggatatattacgcgtgacgtagctgaaatccatgtcgtgttggggtcgattggattaattagcaggaaacagtggtgtgatggatcgattgacagtgcagtggcgatcgagtggtccagtccaaaccccggtttgcaggggagaaggaatagaccgggaggtatcgtatctatcgtatatatgcacgtttcagtgggacaaatcaaccggattatttagcatatatagatactgttaagacaggttctgtgctctgtgtgtgtgtctgtctgtctgtggatcgttgacaaggcagttttctgctgctttttattttctttaacggaaagggggggcccaattaaagggtctctcagctgtgtttcgatcatctgcctttaattaagcagctgattgattgcatgcccccgtgacagggagataattaagggcaactagctagcagtgtactgtactggacgtgcgagtgacagcagttggtgagtggtgaccgcaaactacacgccggagtggcactctgtcattttcccatgggggcacatacgctgggtacacactacaggaccatcctcgttggggctactctacggtgaaaaaaccaccgtgagacattggagtgaaatattatatagatatataatcatagaattcttaccacgcagtaatatatatcataagtcaaaatgtagttttattactgatcgttatttttaaatcggtgccactaatttttatcaacatcgatttgttacgctccataaaatctaaatttaagtatatgttaggattattttcacgctagttggttgcttgtttattaaacaaatgggttatctttatgtctcactgtttggttgaatgcctagaaagatagattcaagtcatcatttggggttatgacctatcaccaatggtgatcttcagtatacaaaacaataaaaccttccaccggtgcaccat

SEQ ID NO: 45411 - DNA, 17208 bp, Oryza sativa
gaattcctgcagccccatttagaaacaacttaacatatgataagtacaatgcttgtctcttcacatctagcgcaacatttatatcatcatcgcttaattattttttctctcaccactttcccgcttttctctttcatccaagccaatcagccaaacccattcacactaatttctttttcagtcgacggaaccgtcgatatatatgaaggcgctaagccaacgataggagcattggaccaatgacgtatctctctcatagtactctctctccgccagctaggtataaaatccaatgtaagcttactgctccctccttcttaaattgatcatgatataatggaattcaaaatttttcaaattgatcatcatataaccacatggacacagatttcatcagaatacaactaatgcaacattggagaaagtgtgcatgctaaggtgtaattggcatggtgtttttaattgatgcatgccttgtgggagaatgtgtgcatggtgtctcgattgatacaatttaaattatccttggtcttggtgcataaatatatatgatgatcaatttgggaagggggagtattagacggtgatttattgttattgtacttgcccttatgaaaggtctttttggtagagctccaactccaaatttagctcaaggagttggatctacagtggatatagttgtggatctgcctaaacccagcaccacctctctagttcattttgtgatagagctgcacccagtttcgctcccatttttggtgaaactgaaactgtttggctgagctccagctctaaaagaggtggagttggtgctggagctgtgctaaacaggcccggagcttcatcatgtatcccttcgcacacttttcatggggtatttatttattatttaatttttcaaatctaatactaatatcaacttctatttttatatcggtagtaagatatgtttttctgcttaacataatgtttttttcctatagctagatttgttagtacgttcactcacttgtataatgatatcaactcaataagctaattatgaataaaaccactttggctttttcatagtgagccatcttgctaagtcattcgatttacgaatgcatttctaacttaatcccattaaatcgataatatgaatttgattatattacacgtatatcaaatataagagttatttatccatgcaatagtataagagggaaaaatctttattttgggacgaatacagtagttgaaaatctacaatcaaaccaatcatgaaaagcaaccgaaagaacctcatcaactaatcaaccacttgacactcacgattagcaactgaaaatatctcatatagtactaatcaattagttgtcagggctaatttagtttcttgtagtttgacatttgacaaccgcagtttgagaacacttggcagctaaccttgtgagatctagcacacatgcaggatggtcgaatttcaccctcattccccaccaaagctgcggttgtttctgtagagatccgagattggcccggatgttggcatgcagcagcaggatggagggagatgggaggagattcaagcccccctgccattttagcaaaatgcttggagtagcagtagcgtataaagaggggggccactgagccattcactgcgcgtgccgatcctgaccggttttctgaacactgtgctggaccccggatcactgtagcaccgatcgcccatgggatcgtttaatggggatcccgatcgagaacaggatcggcacgacgtacactgcgcacacactcatcgaaacgacaagcgttgatcgtttgatcgatggtggcattgaaggtttcgccggcctgagcatgcacgtagtacgttacgtccgtcgtcagagaggggaactccattatttatttcctactctatcgtctccgatctgaaccagaaccagaccaaacttcattctcgagtcagagaccggagtaggcgaaggccggtgcagtgcatgcagagcccccagactgctcagggcttttacacccatactactccatacacacacacaaaaaaaatgttaccacaatgaagttccggtttgttcggtgaattgtggcaaggcagcgtgttactagtaccgtgttaccgtaacgggaggcaagcactgtggagagcgtcatgtacgtagtgggagggacgtggtggtgcaaggcaacaagagtgtgtgggttttttttttttacagagagaagagagagttgttcttttccaggaccagcaagggcaaaggcaaaggcatgcagcggcagtgcattgaaggagggggaggagggggaagagatcgacgcagaaaaagttgggaacaggatccgaagggcgccgctgcagtgcctgcctgccgagaaagtccgggccccaataatgaagcgaagcctgcctgccgctgcctctgcctgctgctgctgctgtgtgtgctcctcgagccgtgcgcccgctgctgcgcctgcccctgtactccacgtacccgcgcgagccgagttgacccgcttcccttgcctcccccgctgtgccacgtccccccggtctcttcctgtctgtgggccctcctctccctcgccccccacgtcccgtcgtccgcggccatgccgggatgcgcgcgccccgcggacacggagacgcagcgcgcgccgtcgccctcgtcgcggctgatctcctctcggcctctcggcctctcggcttcgctcgctctcacgggcccaacatacgtgcgtcgtcgcgcgcacagtgcgtacgtacgtgcggcgtgcgcggccgcggctgcagtgcagcaacaccaccaccagcagccgtcgggacgtgtgcccggatttacggtgaaagcaacggacgccgccgtcccgcgcgacgtccaccacgacacgccaccgcgacgcggacacgtactactactcctcctgcaactgtaacgacgacgactgctgctgctgcgtgccgctgtttttcacgtgccgtacgtgcggcgccgcgcgcgggaaaaagcgatgcgatgccgatgcgagacgctttgcattgcacgtgaacagtggttttagcgtaggtgcactgcgcgtatagtgtagagagggaattgattttttggccctagcagcgtgtgtcctttttataaagcggaaacagtactaatgctgctagtagtacatgggtagggttccataacaataacatggccatgtctccacggaggaggaggggatctctctgcatcaaacaacaacgttgtcgccacacacaattccattcccattccattccattcatcggaaagctgggaaggaaaaagctaccagctgctcgaacaacgaactgagattgggaggacgtacgtgcacacgtacgcctgcatgccatgtacaagaaatatactacttctcgtaccgttatttttgcttgtacaagaaataacactgtttgttggttacgtgcgtctctctactttaatttgttagcccttttccgtatgcactttcttgtttccactgaagtggtatgaatgatcattagttattcgagtgttcctcttgctgtgtgtgcatatagctagcatagttcacgagtactctccgagaatatagtgcatgcatactatatatacttttgtctataatgtaatattaggttgtttttaatcatattcaatacaatcaatcttgttttgaagaaaagaaatctctctatttatgtgctacaagagaggtagaaaataagagggggcgaaaacattaaccaaattaactggagaattaagaagagataaacatatacttgcactagacgattttgatatttgtgaaaacataagctaattagagctgaatatcaacataattttgaagttttaaaaacaaagcggggagaaaatccgctagttggtcgagaaaccaattagacgaagtatctgtggtatatagcttgccacgtttaccgtgctcatgcgtggatcagattaattagtactcgtctgttgcgaaacccttgttagctgagctgggccggggccggcctgggagacacaatccatccctgacatgacgcttcatgcatgacagaaactttacaagacaacacatatcctgcacaaggaacacgcagatgcaggcaacaaactctacttggtccacagcagttgcgtcaatcggcagagagatttctcttgctctcatccattataactcagtcatcaggctaattaacctagagctccgcgttttggccatttaggtggtgtttaagataaattaagatgaatataaaatcaaggcatgtaaaactaaaaaccattaattaagatttaattattataaacttaaaaataaatttatttaatatagtactgcatagaattttttttataaaaaatgctgcttgctagcttaaaaacgcgctaacgaaatcgagataaaatctactactatatcttaactactcacttcgtctcaaaaatataagaatataaaatcagataatttctaatattacgaatatggaaatataccattcgtagttttttatattttgaaatggaggtattatattttatgatgaaggtagtagctacagtagaaaagaacgagtgcattaacgaatcgatcgtggccactccagcagccggccgtatcctgcctacttccgagaaagcaagtcaagccacagagacagcagaaacaaatcaagatcgagacgagacagatagtagtatttgcacaccatcaacaaggcctgtttattagttggtgaaatgaaaatttataggtgtcacgtcaaacgtttgactgaatgtctgaaggagttttcgcacacgaataaaaaaaaactaatttcataactcgtctggaaaccgcgagacgaatcttttgaacctaattaagcaatcattagtatatgtgggttactgtagtacttatggctaatcatggactaattagattcaaaagattcgtctcgcgatttacatgtaaactgtataattagtttttctttttatctatatttaatacttcatacatatatctaaagattcgatgtgatgttttttaaaaagttttttaaactaaacagggccaaaaaaaatcaattacggctagttgctataagagctactactagtacacagtagtactacgattgacagagacgcgacggaggaatcgatatctccaatcgttgacaccgaaagtatagcacgtaaaaagcgatcgagagagatgatcatattatcggttgatcgagtgagtcggccggccggtttagtctcatatcttaattattataacttgcgatgtgggtcccaattcggtgatcacgacgggaacctgtcgcacacatttgccgtgacgtcgtctcgatcgatcgatctctcgctgcctgcctcctattattgttgtttgggtatagtatagcatcttaattatcctagctacaaaaggtttagtgtgctctttttcaagcctttttggactaattaagtactgagaaccggtacatgtgcagtgtatcactgtattgttgctgacgagcaccacgttcgctgtgggggctagaaattcccacattaatcggagaaaaagaaaataagagtccaagtagaaatataatttaaaaatagctgaaattcggaattacaaataagcaatattgaaagaagagttcgtataagaatccaatacgcgattaattaaaattcagaataaaaataaaataaaatcagaaattggaaaaagaagagtccatataggaataaaatctagaaataactggaattcggaattaaaaataaggaatattaaatgaagagtccatataagaatccaatacgagattaactaaaattcggaataaaaataaaataaaatctgaaattggataaataaaaaagatagttcgagtaggatgaaacaactataaaattgaaaataaaaaaacattaaaaaaataattcatataagacataatacgatattaactaaaattctaaataaaaattaaaataaattccaaaaatagaaaaagaaaaataatagttcaactaggaatacagtttataaataacttaaattcgacataaaaagtaaaaactattgaaataagagaccatctagaacatatgacgagattaactaaaatttgtaataacaaaataataaattctgtaaatataaaaataattataagagttcaagtagaaatataatttataaataaaaatatcggaatgaaaaatatggacttctaaaaaaactccatctagaacacaaatgatgacaaataacaataaagaggagaagcaacaggtttataaagaagtagaatggtggcggttgataggacatctaaaaactaataacaaaacctcaaatagaatcccaatgacgattaaaaggagagacgacggatgggccgttaagcagcccagtcatggcggttggcgggacttatagaaactaaaatatgaaccaaaataataaatatgttcgatttttaaaatcctaatgacaataaagagaagaggtagtggacagaccgaagagaagtatggtgacagggtttgacataacttctaaaaattataaaaagatgacaaatgacaacaaatataggataatcaacatgtatgtaaaggattaaagtggtggcggttgatggaatatctaaaaactataaacaaaaccccaaatagaatcccaatgatgattaaaaggagggacgatggacgtgtcattaagcagcatggttacgacggttggcgggatttctaaaaagtaaaaataaaaacaaaccccaatgataatcatgtttgaattttaaaatctcggagacaataaagagggggcagcgggtgagctgtacatgagtacagtggtaaagtccctgacagtttggtggaacttctagaaagtaaaaaaaaacctaaatggtaattacgtttgatttttaaatcccaatgaaaataaagagaagaggtagtggattgaccgtagagtagtatggtggctgcatttgacgagacttctaaaaattataaaaacaaaacccaaacgagacaataaactctaaaaactataaggtctaatttttagaggttttagggagaacaaatagaagtagtggtagatcgaggaagcaaataaatgaggggtgacaaaatatttaggagtagcaactgacataactttaaaaaaatataaaattagaaacacagggatgataaggtttggtttttcaaagtacaacgagatatctattaacaaaattctaagtaaaactatattaaaaaatagataattttatatcggtgctagccgcataattgcgcgggccacccagccagttttaattatcctagctacaaaaggtttagtgtgctctttttcaagcctttttggactaattaagtactgagaaccggtacatgtgcagtgtatcactgtattgttgctgacgagctctatctttaacacgcttgcgtatgtgtagtagcatgcagtcgatcgatatagtagtaccagtataggagtaggagtagtatatatgatgatataaataagaaagcttatcacctgttccgttggttaagtgaaaaatgattagatctttgtgggcttttgcaacagtcagtaagtgcaaaatgatataaacgagtgctaaactgctaatgggccgtagtatgtcggatgtgaaaaagcccacgggctaataacattcagtgataggtccaaaattgcagtataaacactacacgagctcttatgctcttttccatatccgtgcgtggctttttgagtactactagctccttcgcgccgaaaccacactgctgccgccgactccgtgcggcgtggggtaaaggttgccatggtgccggtgcctgtgcggcgggggtgcctgtgttcggctggcgctcgccgccaggtccgccgctgccgtaggcccaattgccggaaggcggagaggggggggggggggggtagggagagcgccgacgttggctccaatgcacgcggcgcccatgccgtaggggacggatggcggcgctctcgtgccgtggggagaagaagaggggataaatgcggttgtttttcggaaaaacccttgtgttttttatgtttatagagcaacctctagaagcagaattttcccttctcagtgttgtatttctgagaaagatgaggggttttccgtataagacgcaacgggtgtcagtcggtgggaggacgtgcaccgctattccgttcaaacacaatgagtttttttttcataaacaccaccatgcgtcatttactcgagaaacaaaatgatcagggtgtgcatggcgcacatgcaaggcgagaccgacacaaccagtgtgggaaaccagacaaaaaaaaatcatgtcacccaatcgaggaggttccgcacctgcaaactacatggcacaactaccaaggagcaaaaaagaaagacaaaaatggagccctatggggctttactatcttattattctatgtactcatccttaaggcctttgttcgatatagctgaattacaatattttttcgcaacaggcaaaacgggaacaacaattaacgcacggttaattgagtattactcacgccgtcccaatatatagcaacctatgactggataggacacatcctattacaaggatatattccatctagtcatatagtgctatatatttggatgaatgaagtaactattacaaaatttaaaatagatttatttgattttttaaaagaaatttctgtaatattttttttaaaaaatctattctaaaatataaggcacaattaccactaacacaaataccaaaaaataattttatcatcttcatatttggatcatataatgcatgcacccaatgatattagaaatcttgaggaagaaggactaaaaaacgaatttagatgaggaggtgctagttgcatgcttaccctatattatgaaacataaaaaaaaaggtaattgcacaacgaatgaagtatctttagtagatcgagaagcatggttatggaaaacaaggtaatagcccaaccaggaagttgatttaaactcaaccttactaccaacaactcctttgaagaaaaatgatttcaaaggagaaaatggtgtgttcagagaactaagatttatatcctagttgagttgtgtgtgaggatgtaaccgtagaagcccgtttcccattgtatttttttagctcaaggattaattacctccttgtaattgtttaacgtttatttcgcttgtaatattcaattgtcactttgtaattttaatttaacagaatcgaacattttcaagtaaatggtttattttctctaaaaattcttgtaacttaaacgggacagacgattaataaacatcttagctgaacaattacataacaaattaatactccttcaattttaaaataattatcagttttaactttgagttgttaagaatttgaccaataatattttaaaatattattagataatagagttgtatacaatcggatttaataaaccgaatgtgctttaatataacaccatacatttcaacatattcaatttgacgttggtgggaaaaagtaacggtcaaagttcatctagcccgtttaaaaccggaaataagggtgtgtttagttcacgctaaaattaaaagtttgtttaaaattagaacgatatgacggaaaagttggaagtttgtgtgtagaaaagttttaatgtgataaaaaagttagaagtttgaagaaatattttgaaaataaactcggcctaggtattcggaatagaggagtgacaacaacgctagcccaggcatctttcgaacaatgaaagtcaagagaaataccgaaaaacatatcttgcaatcaaacaaaactttgcaggcctagaacattaattaaaactcacttgatttctccctcccgactccaccattaatcaattgcttactacactaatcaagtataaattaacacaaacaaaatgctagctataccaacaatttgtatgtcttaatcgcatgcaataatatgtttgcttatgcattattggagaaaccatctttgcttggttggctaaaaaccacaatatttccggtttgaatagaaaccgggactatagatgatttttttctcggtttaaaactctatcggccctaaatgatctttagtcccagttggtgttacctcgatcaatcaatcagatcacctcaacctcgtcaatttccagttcctcctgtccagcggctcgctgctgccggcggtgacgtcgtcctggtcggtcgtcatcgtgatctcgtcgctgctgccggccaccgtcgccgccacggggacgatctccttggtgcgcctctcgccgccgctgaacctgagcatgtcgaccacctcggccatcgccgggcggctctcggcgctgctctgcgtgcacagcatggccgtctccaccacggcgcggagctgcgcggcgtcgaagcgcccggcgagccttgggtcggcgaggcgctcccacctgcggcgctccaccagcggcgccgcccactgcacgatctcgcgcttgacgccgccggggagcttctccagcgggcggcgcgcgctgacgagctccagcaggaggacgccgaagctgtagacgtcgcagctctcggagaccttcccccacatggcgtactccggcgccaggtacccgagcgtccccttcacccgcgtcgtcaggtgcgacacgccgtccgggatcagcttcgcgaacccgaagtcggccaccttgggcacgaactccgcgtcgagcagcacgttgctcgccttgatgtcgcggtggatgatgtgcgggctcgcctcatggtgcaagtacctgcaatgccaatggatagtaggttaatcaatcaacctcggtgatgctcgatcatggcgcgccggccgtggacgactcacgagaggccttcggcggcgccgacggcgatggcgacgcggcggggccactcgagggggacgtggtggtgggaggagggggtgccgcggtgagggtgcaggtgggtgaggaggctgtggttgggcatgtagtcatagacgatgaggcgctcgtcgccgccggcgtagaagccgcggaggctcagcaggttcctgtggcggacgcggccgaggatctccacctccacggcgaactccatctccgccttggccgtcatcgccttcagccgcttcaccgcaatctgaacaagatagaactatcgatcaattcgcctcaatccatgaacacacacctcggccgtcacacacctagtgcgagtcgttaaaaaaagaaaagaacaccgcggccatcaacctgcccgcgtcggcggcgatgatccaacccacctcgacgcctttggaggtgcgtccccagtagacggtgccgaagccgccctcgccgagcttgttgctctcgctgaagttgccggtcgcttgcaggagctccttgagcgtgtacgtttcccatgggtaatccacgctcgtccggttcttggacgccctcgccggattcgtcctaccatcccaaattaattaacaagtcacaccaaatgatcacctcagccgatcgatcggtgctatcaagaactctctctccgatggcaaacaacacatcacaccgaatgatcacctcaaccgatcgatgctatcaaagtatcaagaactaattctgatggcttctacatgcatggtactgcagtaatacgtacctccgacgactactggtggcagccggctccggatcagagtcgccgccggtgacgcagcagaagcaccggttgatcatttcttcacagcaatcgatggatcctgcgggccaagctgacagtatgcggatgaagaataatctgaaataagtacgatggaagaagataaattcgatcgatcgatcaggatgtggatttggaagacgaaccaaaggtgaaggaagcttgagaagaaatgctacctttgattgcttgtttgagttcttgtctgcttcgctcgcgtacaaaattgtcctcctcgtgcttggctcactttggagatttcactccctccctgctgtgcaaatgtgatgtggtatctagaagggccattttattaaggacaaattaaaaaaaccaacggcagctgtgcacggaatggaatttaatttcatacaaatgtatattctatacacagattgaagactgaagatttcaaaggatacgtatacggtcagtctctgacttgaaaagatatataaaggttatacggaatacactgtagctatggaagaactaatagacaggaggtggtccatgacaatggattcagagagattttgaactagacaagacaactgcagatcacaaattcttatgcgtcttttcaaaaaagaatgatagataaagtaaagggaccaattcagcattccaataggaagacagattcagtatattgtttggatttcttctgtgttcatctctaaaaggcaaagagatgtatccctttcctattgaaaagtatgaagacgatttctgcatagtagggtataccagttttaaacttttacctcaccaagagcaaaatcagtaaatcacagtgctagccactagtccaacatagaaccaaacctgtcacaaaactacaaaaggtatttccagaggcaccctacaagttccaattgacatttcttatatgttcatagagattatttagaaaattacctaattttcctcagaaagtagctatttttgaggactccaggcaccagcctttacaacataaggtgaggtaatcacattcttgctcatcagcatactagacttacattgcacaaccgtagcgaccaggtcagagatagacttaagctttttttttattatttttttggaacagggcagcagccctgcagtatgagaggatcaattcaaactgcattcttatattttgttgttctatcaaatggcttaattcgattgtccaacaaaagatcttgagaaagtcggccgattattttttttttctgagctcgtcaactcatgaagtgaaatgatgaaatgcaggctcacccagtaaacaaagggaagaacattacctaatcagcttatgacgtgtgccgcttccatttgttaatagcacaaagatgtgacatccaatggtcaattagcctcatggaaggcttgtgataattacagtcgtacagacaagcaacaaattgcttcaagttgacgatgttgttcccctcacctgcagagaaagaaacagaggttcaggttttcttatggtgcaacctgcatttatatgcatatgcacttgtgaagtcagtcagcttgcccgtcataatctaatgcaggccagagagaacaacacaacaaaaagagacaaaatgtgcataattacctccttatccttaatcaggaagatagtactgttttttttagataagtcaccccgggggggggggggggggggagattccccacctgaatttaccattataaaggagagctacaaagtttgttacacattagtcagaatttgaaggggagccgaaaagataagcttccaagaattgattacagagcgatgctcaaatttgaggcgttctagccaaagaccactctcctccatacattcgcgaaggaccgactgcagagacggggacatgttcctgaaaacaacatcatgccgatgattccacaagcaccagaaacatagaagatagaacaccttgtaatgaaattggggcagattcccatcaggtttcagattggccatatcactgacatgttgaattcgagggcttaaacctattgcctcccagaaaccttgagcgaatgggcaatttagtactgtttttgggttaccttttctgttaattgtccaaaaataagaatgatgcaaaccgtcaggccaacgaactggtaaagatcaaagctaggtttaaggtatcattatcaatcaagcatgaggaatcgaatcatgaccagtgtgctcaccatctccatctcgtgatcagttgatccggcgatctcgccgccactacctcctcctggactcctcgccccaatttcgacggcggtgatccccgtagtgtcacgtgttgccgatagttaaattcagattctgcattttacatacttgccgcttcgtgtgcaaatacgatcaccgaacagtagaatactccctctttttcacgttatttgacgttttaactttagtcaaaatcaaactattttaagtttgactaagtttatatatcaaatatagtaatatttataatactaaattagtttcatcaaatcaataattaaatatctttttataataaatttgtcttggttgaaaatattactccctccatctacttttgatagtcatattttcaaatctgtaaaatttattttcgataggcatatttcaatctaacaaattatcattttaacgactttctcggatttaatgcatgactctattcttccacgtaagattggctacatgagaatcgagaaatgtaaatattaatgaatcgcatgtttacaaggaatgactagtagcatgtttaaatggatgataagtaaaattacttatccttgatctgtgtgccaagatgaaatatgactatcgaaagtaggtggagaaagtactacaccctctgtcccataatataagggattttaagtttttacttataatatttgaccacttgtcttattcaaaaaatttgtgcaaatataaaaaacgaaaagttgtgcttaaagtattttggataataaagtaagtcacaaagaaaataaataataattctaaatttttttgaataagacgaatggttaaacagtgcaagtaaaaacttaaaatccctatattataggacggagggagtacttaacttggttaaacttaaactttgaccaaagttataacgtcaacggagggagcagtacattgcttcgtgtcgtcagatatcatctaatcccatcccatccatcccgtgatagaatttcattgatccacagttccacacttacacatatggcaatgtcagttgccaacaatactcctgacaatttcgatggcaacacccaccctaaacacacaatcaacaggtttctccttataatatcgatggtcaaacaaaacagcacatcatcaattgaacgaaagaactactgtaagcctaaaacacacgttcgtgagaacatctagctttttttttaaaaaaaaaagacagggagaagggcaatcaatagctccagctctagctactatactttgatcgagcgaagcatgtttcgcagggagaaggggcacttctgatcaggctgggtgatatccgtcagctttacatcacatctacttggccaagttgcatccacggatgtaagggtgatcatactttatataccttgtccaatatggtctgtacttggtcatacttggtcattgccaactccagccatggcttcatgttaccgttgtaatcaacaacggctgcattatctatctctgagcggtcaatgcttgggttgtatcctaatccgaggacatgccacgacttgtcaaggggatgcgtcaacttgaagaaggtcaagaggccgtgtggaagtgtcccaagcttccaaagaacccggtcttcgttctgttagaagaaaaaaaaaaaaagcaacattgatgttagagtaaatcgttttgcatgacatctctaaatcaatgagatccaatcatggaagtagtaatctcaccatgttttgccacctgtggtagatcccagtgatatctttcttcttccactcgttcagatcaaagatgttcattccatatgcccagccacatgcatttggatcgaagttccgagcgatatgtggatttgaaaagttaagatacttgtcaaaacgatgaaaactctccccacaggtctccactgcaccggtgaccttcccattaagatcaacatcccataatcccgtcaaatctttctgcacgactatgtcatcatcaaggaaaaatatcttatccaactttggatagacctgtgggagataaaatctcaagtggttcagcatggagaggtacttggggttacgatactttaggtttgaagaacccgcagagagagtggtggggcggtcagctttgaaataatactctttcatggctgcagactcaagttgccgtaaaacaggacagtatgatgagttcaaccacttaaattcatctacgttctcaacatggatggtggccttcccaggagggttcagcaaaaaccacatgttcatggctccaaagttcaacttatcagtcacaagatggaaaacatgcttctcaggctcctgaaaagattatgccatagatagctgttagaacaattatcacactttgcacttgattaaaaaggaagacgaaactaccttagcattcatgatggttgagttcacaacagatgctgccaagacattgtctgagaaaagtgcataatggtagagctctggattttccaagttctcgctcctcgggaacttccttttctccaacgggaggagatagtaatctattgttaagcgcatcgacaaacaatgaatgctgtttggaattgtcttcgcagccaactggctaagaaatgtactctgcttcttcaagctcctgacttgttcatctgctgactgaagcatagctctaagtctctgagtaaccgccttgcaatcatacacatcttctctagccttggatagaagttgacccattactctgactttctcaggtgcactgcaaagtacattatttgtcatgatagagaacaagatgagatataaaaatatgacgtgaaaataggcacaaacctatgatgaaggtcagaatcagcagtagcctctccaacagcccgctggctttccttgatcctggtttgcagctcttgataaagatcattcttgttctttgatttagcaagcacagaataaacacgtgccataataatctggtctctcatcaatctaactgtcaaatctgagttctcattctcattctcctttctccaaatgctgtatttcccaaggacagcagaatctttgatcgatcaatagcagcattctccagcttaacacgtgcttcatcatctttccttacaaatccattgccctcttttcacgccttttctcccttagtttctttagtgaccaaacagtatcaagggatgaatgatgtcataatgcat

SEQ ID NO: 45412 - DNA, 15045 bp, Oryza sativa
caatcagttgcaaggacaaatcagagaggatgacgttgcgaaattagtagcatagcaaagatgagcacgttgttatgtacccttgtacatttccatgaaaccaaaaaagaaagataagaaattatattactaagtcgcgagacaattctgacctccttggacaaaatagatttcaggttgttcgttggcagctgtttttgccattctgtttcctgcaagaaagctttaatgtgagatggatcctcaaaatttaggctaagcaattaactagctcccagaatggaaaaatacctgagtaccttccatatccatgggatctgcaggtaaacaaactacaacatcacttatctatttcaaatcagtataacagtattcaaatactacaaaacattgacaatgttcctacagttctaataaatgtagttttcttgtttataggcttttggcactacaattacatccacaattcacttgtgcaccctagattcttaatagctagggctttccccacaatgtcacacatctaacctagcaaaggcacaagtgacactacaatagataggaaaatggtttccaaaatcacttgaatcacaacttcaactgtctgctgtaaactcatgattcctccaaagtgcgatggattaattttttgtttccaaaacagagcatcatgatccaattatctacgttttctatccaaaatcataaccaagcctactaatacaactcatcaattgaatttaacaatagtacctaaaccactgacatctactcggattccattccgagtaatatccctcagaccaacgctgggaaactaaccaaacctgaacacatcactccccagtccccacccccaccttaaaaaaaaaaaaacaatctagatgctacattcgcgacggaggatgcgattaacaaccgacagcgccgcgcatcaggaggggggagggggatgcaaaccggaacctgagccgacgtggcccccattgcacgcgacgaagaagatcgacggcgcgagaacgaagaggaacacgacgaccaccagcggcgccaccacgccgcgcctccctcctccgccgccgccggccgtggagtacgggagccgcttcgagttcgccatctccagcgaagggtaggatccgcgggggtccacctcgccggagagtgcacgtacgtcgcgcgcggcgcgcttccctctccgcctcctccgccgagagtggggtggggggagtggcgtggtgaggggaagcctggaaaggaaggggaaagcacccgaagatgtgaggcaaccgatggtgggctatttgggcctttttgaaaaccatctaggcttctgccttgtctacggccccgtttagatgggccaaattaaggcccacctatgtgtatgggctagtatgaaacaaaggttaaaaaaaaaagaggtggtctaaaagtgaaaatattggttaagggttcgtggtgaaactagggtaaaaataattagtccaatgttaaatgaactctactttaattaacttatttggccctatttagcacaactccggatttaagatttccttttttttagttatgtatttttagctccacaaatgcatgaatcgaaatctaaggttacatcaaaaatatctagattagtcattttgttcttagtttagactaaatataatatttgaaaccaatacaatttaacatacatacttcaaatccaacgtaaaattgggagctagagttctgccaaataaatcctttattttgtcaaccagttcataaaatctttggtaaccttagagtttaggaatttaatagtataggacctccattttgaaatatatgacgccttgaccttttaatttttggatataatgtttcacaatttgtcttatttagaatactatgcaagtacttcttttgtttcatattataagacattttgggtttcgaatagatttatgcatggatccatatatgtgcatcatatacgtgtctaaattcatatagatgttagttaatctagatgtggggtcgagaggccaaaacgtcttatagcatgaaacaaaggaggtaacatttattttgtatttgatatgttttatcattaaaggtactttacaattattgcaataaatctttaaataaaatgaattgctcaacatcatgtctaaaaattaatagcattattacatatttaaaaatatagggagtaatggatcggacgagatgagtacatgtagtgagtggttctccgattagttttagggctggttttcattacttttattgcctggatctcttttaatgattttcaggcaatcaaaaaaatctaccccaaattacaaaaatcaaactttgaattcaaaaaacgctttaaatctaaaggagtaccaagcagatccatctcggccactcaatatgttggtccatatcaagccagttaagtttcaactagagagatagcataggttactttcagaaaaaacaaaaggggaaaaaacagagagcataagagtcgttttatagcagtagaaagaagcaagagttacacgcatcaaggtggtgtttggatcagggactttagtcctatatttagacactaatttagagtataaaatatagactacttacaaaactaattcaataaatgaaagctaattcgcgagacaaattttttaaacctaattaattgataattagagaatgtttactgtagcatcacataagctaatcatggattaattaggctcaatatattcgtctcgtgaattagtccaaaattattgatgagtttttattaatagtctacgtttaatatttataattagtgtccaaacatccaatgtgatagggacttaaaaacagggcccaagcacaccatagaaaaaagacgccccacatcacggttgcagacaaagttgcagattccagcaatgacgcaattaaaaccgaaaattatctctcaaccatccattcgatccatcaactcatgcggtgatcgatcgatcagctggagagaaagttccagtgacaggttcatcaaaattaagccggcaggcaagcctgaaagctaccgttaacgcattttatttttttcagaacaactgacaccggccgtgtatttactccacttaatagaagcacctctgatcaggctgggtgatcttctccgtcagctttttacatcatatctactccgccaagttgcatccacggatgtaagggtgatcatactttatataccttgtccaatatggtctgtacttggtcattgctaactccagccatggcttcatgttaccgttgtaatgaacaacagcagcattatctatctctgagcgatcaatgcttgggttgtatcctaatccaaggacatgccacgacttgtcaaggggatgcgtcaacttgtagaaggttaagaggccaggtggaagcgtcccaagcttccaaagaacccggtcttcattctgttagaagaaaaatagcaagaataatgttagactaaatcatgttgcattacagtttcttctctaaatcaatgtgatccaataatgaaagtagtagtctcaccatgctttgccacttgtggtagatcccagtgatatctttcttcttccactccttcagatcaaagatgttcattccataagcccagccacatgcatttggatcaaagttccgagcaatatgtggattggaaaagttaaggtacttgtcaaaacgatggaaactctccccacaggtctccactgcaccattgaccttcccattaagatcaacgtcccataatcctgtcaaatctttctgcacgactatgtcatcatcaaggaaaagtatcttatccaactttggatagacctgtgggagataaaatctcaagtggttcagcatggagaggtacttggggttacgatactttaggtttgaagaacccgcagagagagtggtggggcggtcagccttgaaataatactctttcatggctgcagactcaagttgtcgtaaaacaggacagtacgatgagttcaaccacttaaattcatctacgttctcaacatggatggtggccttcccaggtgggttcagcaaaaaccacatgttcatggctccaaagttcaacttatcagtcacaagatggaaaacatgcttctcaggctcctgaaaaggttatgccatacatagttgtcagaacacttatcacttatcacagtttgcatttgattaaagaggaagacagaaactaccttagcattcattatggttgagttcacaacaacagatgctgccaagacattgtctgagaaaagtgcatagtggtagagctctggattttccaagttctcgctcctcgggaacttccttttctccaacgggaggagatagtaatctattgttaagcgcatcgacaaacaatgaatgctgtttggaattgtcttcgcagccaactggctaagaaatgtactctgcttcttcaagctcctgacttgttcatctgctgactgaagcatagctctaagtctctgagtaaccgccttgcaatcatacacatcttctctagccttggatagaagttgacccattactctgactttctcaggtgcactgcaaagtacattatttgtcacgatggagaacaagataagatatcagatatgaagtgaaaatagataagatatcagatcacagatataacacctatgatgaaggtcagaatcagcagtagcctctccaacagccctctggctttccttgatcctggtttgcagctcttgataaagatcattcttgttctttgatttagcaagcacagaataaacacgtgccatgataatctggtctctcatcaatctaactgttgaatctgagttctcattctcattctcttttctccaaatgctgtatttcccaaggacagcagaatctacagcctttgatcgttcaatagcagcattctccagcttaacacgtgcttcatcatctttccttaccaaatccattgccctcttttcacgccttttctcccttagtttctttagcgaccaaaacatatcaagggaagtattaggtcataagaaatggatatcgatagaaacaaacaacaatgtatcaatgtacatacaagaagaccagcatgcttacccttcgagcattttttgcaggtgcatcgacttgatgttcagctgcacagaaaagaagtatattttcttgagtacctaatcggattgtgtgaaatgtgcttttcaaaaaaagtcatggttatttttataccagtatcatccttgggtgttttatctgtcagtgataactcatgttctgcagaactgttttcagatttaaccttgtcatcaacatccaaactagcattgctcaggtcattgactagatcatcagttttccaagagggagatgcacgttttctgaaaaaatcaacactcaaagtgcctgcttcttgttgactagaagctaaagcatcgatcatctggagaccaaaaggtatgcataagactaaaagcacagaaaaatcgaggatacttctgaacaagatgacagtttcctatgcaaataacagtagatggtaattgaaaaatcaaaatgttcgcaacagaattacagagcagatagaggacacagcatgcaaatctacttggaacaatagagagtagcatggtatttagagaaagggcaatcagttgcaaggacaaatcagagatcatgacatttcgaaattagtagcatagcaaagatgagcatgttgttatgtacccttgtacatttccatgaaaccaaaaaataaagataagaaattatattactaagtcgcaagacaattctgacctccttggacaaaatagatttcaggttgtttgttgccagttgtttttgccaatctgtttcctgcaagcaagctttaaagtgagatggatcctcaaaatttaggctagtaaaccaattgactagctcccagaaaagataaatacctgattaccttccctatccttgggatctgcaggtaaacagaatacaacatcacttacatatttcaaatcagtatagcagtattcaaatactacaaaacattgacaatgttcctacagttcttataaatgcagttttcttgtttatgggcttttggcactagaattacacccacaattcacttgtgcgccctagcttcttaatagctggggctttccgcacaatgtcacacatctaacattctaacctcgcaatggcacaagtgacactacaagagaggggaaaatgatttccaaaatcacttgaagcacaacttcaattgtctgctgtaaactcatgatttctccaaagtgagattgattatttgcgtttccaaaacaaagcatcatgatccaattatctatatacagagttctcatccaaaatcataccataccctgtaaatacaactcatcaattgcatttaacaacagtaccactaaaatctactcggattccattccggcaatatccatgagaccaacgctgggaaatttaccaaacctgaagacatcactcccagtccccaccccaccaaaaaaataataataaaatctagatgctacatcaggggggggggagagggggggtgcaaaccggaacctgaggcgacgtggacgtggcccccattgcgcgcgacgaagaagatcgacggcgcgagcacgaagaggaacacgaggaccaccagcggcgccaccacgccggagccggaggcgccgccgcgcctcccccctcctcctcctcctcccccgccgccgccggccgtggagtacgggagccgcttcgagttcgccatccgccggatccggccgccgcggcggcgagggcgacgttgccttctccgagacgagagtggggtaggaggggagtggcgtggtgagaggggaggaggggaagcctggaacgggaaggaggggaaagcagccgaagcagtcggtgctgggctatttgggcctgcattgtctacggcctcgtttggaataggccgcgaatttcggcccatttgtgggcgaggtaggccgtcacgccgccgtcgcactcgccgaagccgcctgcgtcgcagccgtgacacattcacacacgccgccggtgctgtcgccgtgcgaacccatggcgactttgcgtgaactgatcggagttcagcgactgtgtggcactaccacagtgtacaggagtagcatatttttagtgtgtgacactatgaatactcttaattgctgtcaatatatcggctttttttctccttcttttccttttcaattttcggcaacaaacaatggcgcgtgtggatgatgggtcgggctcgacaggaccaaggggaagagacagagaacaaaatggagatgatggacgaggaagagagaagagggaggatgatacgtgggttccacttttgttttgtttctttcttttttgccacgtaaacgctagtcagcatgaatgtattaggtcaacttgtcacgtcagcaaaaccgatcatccatatagcccaaatacataatttaaaccggttttgcatgttgaggatgagatttcttgtattgcggtatagggatgtgatttaaactcgatagaaagtgacttattctgggtgggctgcaattttgaggcctatctggaccgtgatgagcatacctttcgtttggatcatgcatccgcgtagttgatcaaatcataaacttttggttaaaaagaagttaggagtttaatgataatcagctgtatgtgataagcatcaaacttgaggactccatatagtgttataatccactttggattttaggttctaattttcgagttagtttttagagttgttcttagttatttgttattgcccgggttcttttttagtgattcctaagaggacaagtaaaaattcacctaaaatgattcttaagcatgaaactaatttaaattcaaaaacactttataaagaagtaccaagcatatctatctcggtcaatcgatatttttggtgtataacaaagctagttaaatgtgaaaccacagagccaccataggttactttcagaaaaaagatggaaaaaaacagagagcataagagtcattttatagcagtactagaaagaggcaagaccgcaagagttacacgcatcatcaagcacaccatagaaatcatacaccacatcacggttgcagacaaagttgcagattccagcaatgacgcaattaaaaccgaaagttatctctcaaaccatttcattcaggccctatttagatggaacttaaacttttaattccatatcacatcggatgtttggacactaattataaatattaaatgtagactattaataaaacccatccataatcttggactaattcacgagacgaatctattgagcataattaatccatgattagcctatgtgatgctacagtaaacattctctaattatagattaattaggtttaaaaaatttgtctcataaattagctttcatttattgaattagttttgtaagtagtctatatttaatactttaaattagtgtctaaataaaaagactaaagttaagtttctgatacaaacaccacctcaatccatcaactcatgcggtgatcgatcgatcagcttcatcaaaattaagccggcacgcaagcctgaaagctaccgttgacgtatttgcttcagagcacacgtattttttacccatgccagattaccaaccttgcaacgacttcttcagttcagttctcctcatgtacgtctcctgcagagtctggcaagattcgagagctatcttgacatgttctgaattctgatcgcgacatgaacaccatggttcgttcggttttttcaggaaaaagaatcgcatgactcgccaagcgcataattaaacaatcgtgtttcataattaatccacacttattagctgctagtactaatttgctatacaaatccagtcatgtcctcatcgacgtagactgtagaatgtacaaatgaaacgagatctgtctttgtgtgtcgacttcatctaataattgccatttttgcagtaacatctactgcatcatcgatcgtttccatttgcttgccatctactagtgttcttctatttacaagctcaccacactcattccctaaagctaatcaaatatgtgctaattgcagagctgagctgagctgagctaaatgccactacgaataattaaagaatttaacgcaaagcacgcagcgtcatttggcgacattgcatgcgtgtaggtgtaccatggcaaccaaacgaattcgctaatctacgaatcgcggcggcgccgccgtcactgctgcggctggccgtcggcggcggcgacgtcgtgctggtgcggccaggggatgaggctgtatggcgggaagcagcagtcgcactgccccgggcaccgccgcggccactcgccggccgcgggcatctgctccgccgccgcctcctcggccgccgcggcggcgacggcgtcgtcttcctcgggcggcgctccggcgtcgcggagcgggccccagcactcgacgcggttgaagcgtgggaggttggagtggaagtagacccacaccgtggcctcctccagctccgggtgccggctgaacaggttgccgtcgccgtggacgaacgccttcagaacctggccgaacacgcgccgagtcaacggtcaaccaaagcaagcgattaggctcgaattaatcaatttcaggaagctgttcaaaaatttcgatttttattctcacatctgaacttccaagtcgtgtttggcacgtgtcaagtgggcatgcaactttgaacacagttgattaatttcactagtatataatattcttaaaaagttgataaaatagattaacatataatatattgcaccacaaacatataagtttaaatttgacatttgacttatacaagttataataaaagtaacaaatttaacagtgaacatagtaaactaattagagtttgattggttatatttattacaacttataaaagtcgaatttaaacttacatattatatgtgaatctatattatcaaatattttaattttttttataacgatttaattgatatgtaacagatggatggatgccaatctgagagattaaaattgtttcccctacttgttggagatcagtttttggtgccactaataacagtgtctaaaatcagatctagaaagtcaagggatttgcctgctttagcagacaagaattattggatcccatcaattatctcagggacattgacacagagtacgtcttgattgcaaaaatgaaaagagcaaaggggaaaaaaaaaaggaaaaaagcttgtggtctccaagtctgaaagaagaagagagcatcagtaaagcgagcgacgaggaaaggggccacgtacgtaccacggggagctccttgcggaagatgtagtagcggaggccggcgatgaggtcgaggaggacgtggccgccggagatgtggcagtggacgtgcagcgacatgtggccctgcaccttcttccactccgccaccacctcgtcccgctgcagcttgttgtaccacccctgcagctgcgcccggttgatggtgtgcgacaccgccagcgtcagcctcgccgtcacgtcgctgtgcgtcagcgtgtacgtccgcggcagcttccccgggtgctggtgcttctcctcgtccacccccaggaacagcaccttcagcttcgacgcctcgaagatcgccggcccgaacagcctcgccctctgcaccaccacatccacatacatatttaatttacatttcattcggattcttcttctccaaccattgattcaccggagaagaaagaggatggtgcatgtacgtaccggcacgacgtagcggcagcggcggcggcggcgagagttgtggcagcgggaggcgaggacgacgagggagtcggcggcgtgccaccgctgctgctgggtgatgggaggaagcagggacatggtcgaagtagcagcagccatgtctgctccctcggatctcttagtcctagctagccagcagtagttaactttaagcctaacaaccaaaacgactcttgacagctttaattataagctgggatctctatggaggccggagatgctggaggcgcggctaattaatccctctcggcgaaagcacgagccttgcacgcctcaacaaagacaccggccggccgatcgatcgatcaaaattttggctcggtttggtagcttcgcggattggcttctcagtcagttcagctcgctgcaggttggtgattataagagagagcgggttaagtgagaagaagagtgttgtattagtgttggtgtgcacgcgtggtgcggtggggggtggagtgaggggtcgggaaacgtcgcggttgtgtgcgcgcgcggggaagctcgcgtcgtcgccgcgccctcctctcgtgtcgtctcgcggcggtggtggtggtggtggaaaaacgcccaggaaaacgggggaaattgtggcgttcgcgcgtgggtggaaacgggaggaatggaacgcttggccgtgctgcacgtggcgtctctgctacaggagcgtggtttgatgcaaatttgacattcggttacggccttgttagttccaaatattttttcttcaaactttcaactttttcatcatatcaaaactttcctacgtatataaacttttaactttttttgtcacgtcgtttcaattttaaccaaacttccaatttcgatgtgaactaaacacatatatacgtatacgtaccacacacctacttatctgtaactattttcctcttgaaacgggctaaatattgatcgtaatttgcagagtttctaccgaaagacatacagcaggatacttaatattggcccgaattaatctagtggagacttggacttcatttggttttgaccatgcaatatatggggactgcgtctgcttaattgggattgtaattttgcgttacgtacgttgcaccgcgcagtgtactcaacatttcaagtaactcgttgacaaagcaaatgatggagatatttttttttccgggggatctgagtggatcaaacttcagagtgatcgttccaaacacgattccaacttcttttttttatagaactagattccaagtgtaattacatggtagaactagattccaagtgtaattacatggtgtaaggctactgcacggcgctgttgcttgcgagctaggcgcatccgtgctttctgaaatgcatgtatatatgcgcgagtgatcatatttttgactgaatcctccgcgatgcgtgcgagctgatcagctcgtgcaaggcagctgacacactcacataagcgatcgatgctagttatggaatctagcttaatttttctcggtctaactgaagaaggagcattcgtcacgtttggcaaatacggccatgcgacatatagttggaagacgaaaatgggagacttggctcgtggttatcatgttctagcctcacccgttcccacagcccacgtgaccaaacaggatgaacgagagcgccaaagcttcatcgatccgtttctttgcttctgttttcgatatgtatgccatgtttgtgaaggttaacgctatgagaaacagctagctggtaacgagcttttaagaatctacataagctagacaaaatcgtatatcgatgggtcagcttaagaacccccatatgaaatgatcatatataccttcaatctggggacccaatcttattaaaaaggaaaattgaaaatcttgaggcccaacgtgaatcacatatactgcagttataactgtttcaaaacgccacaatgtctcaaaaaatctgtaaaaattctgctccgatacgccaggcgggctagctgccggcggaaggctgcagaaagtgcagattcgtcagaggcggagacgttcatgcaactccgagcgagaatttgcagcccggccgtaaataatctagaggtgaattccgtccggtaaataatccacggttacgaattacccctaaactattatggacgatcgaattaccccctaaactcgaatatcagatattttacacccttaactatacaaaccgggtaaataacccccggctcaatccggggtggtttcagtactacgtggcagtccgatcagcattttttttttaaaaaacagtgtgggccccacctgtaagactctccgctctctctttcacctctaacgtctcaatctctctctactctctcaatccccatcccctctcttcctcctcctccctcacctgctgcagcgagcggcggcagccggccggcgcacggcgacgcgccatctctctcctctctacccttgctgtggtggtggccggctggcaaggcgcgagtcccccattaccatcgagctcgggtgaccgtacgacgcgccccacctttgcttccaccggacatcgtgcttgtcccccatctctgcctcatgctcccgcggaggctcgccaacgtcgccgatgggggtggtggacaagcacggcagccaccttcggtgatggtttgtgcaccgatgtctgcgcgtcgatccgtctccgccgtcggccaccgtctcctcctccagccatagacgcagagagagagagcaagcagggaggcaggggccagggggatgggatttgagagggattggtggaggaaagagatgacatatgggtcctaagattttttttatttttattttgctgactggatgtcacgttggcggccacgtatgcagacacaagtcaaaaaccatccaaaacagtgctcagggggggttattcgtccggtatacatagtttagggggaacgatgtctggttttcgagtttagggggataattcgatcgaccgctatagtttaaaagggtaattcgtattttttttcctttttaatacatagagatgatttcttgggttgagatgcattttagtagtaatccggaggtgaattccggtgaattttgagtattttatttactactactacttccagttccaggatgcagtcgtcgtcaggaaactggagaggacaccgggccaaatttagctaggcgacgtggatgcaccggcgtgtgggcttcatttccgtgatgcttagaaggcacggtttgccctctctcgcgatcgcctgcctggcccgcacgctgcccgcggccgccggccgggggcatgtcgcgatccgatccacgtttcgcgtgcggtatacgtgctcgatcaggttcagctcccacggccacgggcgcgcgattgattgattcaccggccgcgtggccgcttccggttaacatgcgcgctcaacgcggtcacggtcacggcgcgtgtgttgtgttgtgttgtgttgttgcggatttgagatttgcatgcagttgcaagcctcgctcgctcgtattacggatgtcgtatgtggtgtgtatgcctaccccgattccacggtgggtgagctgcaaagtacccgtagttttcagtgaaaaaactcacatttatgcatgcattatatcgctgccacctcctttatccaatacgatcgagtaacagtcagggttcaggttctttttttataaaaaaaaatctgtaactgattgaaaaccgtaaaatttttaggttttgacgtagaacgaaggcagattccgagtaaaattttggaatgttttcaaggattcaaatttttaacaacaaattaatttgaccgaaatttgacgaaaaccatcatatcgtcgtgattaggattaggcactagatcaaaaggtgcaccctgtatcacaaattgtaaaggatgattttattcctgagtaatggaatgccctgtttttcccgaaaaaaaaaagttgcaccctggtgattaggattaggattatgttgaccgtgcatgctcaggcttcaacactcacgagctcgcttgggtacccgtgagtatatatggttgtcaaaatatatcatacgactttatggttgtaattaaggagtctgattctacgatatagtaggtagaatcaatgatgttatcatttttatgtatacgattttatgattacgatcctacttagacaaatctgggctgcaggaat

SEQ ID NO: 45413 - DNA, 17486 bp, Oryza sativa
  unsure (1)..(17486): unsure at all n locations
agaactaacttatttttgggtatgtttagttcacgctaaaattggaagtttgattgaaattggaacgatgtgatggaaaagttaaaaatttatgtatgtagaaaagttttgatgtgatagaaaagttaaaagtttgaagaaaaagttgggaactaaaccaggccatatggatgtaaacatattcagaacacaaatgccactaggctcaaaagtccacagtgctatagtgtcacaccacagtatgtacagtgattgtctgattgataggtttagggatcttttttttttctaaaaacgtttagggatcaaatgttgccaaagcgaccaaagtatcacaatagacaaacttgtcacaatcggtacaatgttgcacgatagactatgatgtcttaggcctgatttttttaattagctgaataattttataataattatttgagaatacaaacaaatgcaccaaaactattagaaagcagaaaaaataaataaattcaaatatagagagttttttcaatacttatactgtttagaagctcaaaaatatgtccctctattctttcattccttaaaaaagaatatcgatccttaaaattaaggtcgcatacataatttgataaataaatattgtatcacgtttcaatttgtacttcgtatcattaattattggtatggaaactgtccaacaaatggtgatttcttcatcaatagatctagggcgaaacccagtaatcaggtatgtgggtcatcggtcgttgggtgaggtgatccaaacttggaagcatttagtagaaattaattaaaatatccacaagccatgcatgataattgtatgaaaaaattccatgtgtacctctaaaagttcacctaattccttctacgttgctgaattttgttcatttccttgcatactcttgaatcttgaattttagtttgtatccattctatgtccttttagttgactgtcagttggacgttaaattctcgtgtaaaagtccatttttaccctttactatcaagaaacataataaattaatggagtatattgtttgagtgtagaaatttgttcagtgtgactattatatttatgagtttgttatgcaccatattatttgtgacataattacttttagatatgatataaaaaatttaatatttatttattagttattaaaagttggtttatgtagtatatttgttttgatagtaatataacatatttgttgtataagacaaatatatttatatgcacataagcaacttttaataactaataaataagtaattgattttttatttcaatatctcaaagtaatttatcgcaaataatatagtgcataactaactcataaatataatagtctcatctaacaattctacactccaacgatgtactctattaatctatatttttttcatagcaaagagtaaaacggaattattcataagaaattaacggtcaactagcggaaagggcatagaagagaaccaaactaaaattcagatatatgtaaaggacgtagaaaggattaggcgaactttcaagatacgtacataatgaattttcaggggtacatagtgataaatttgcaacaccttgcgttttcgttctcacaacgcagaaagttcagacctaatgttatagtcatcagggctatcatcctatttaaactactatatctccagccaaaccacggatatggtactaaggctccgttcaaacagtacatgattaattgaatattatctattataaatttgataaactgatttatttattaatctttagaaaaaggttctatatagaaatcttttcacaaaatatatcacttagcattttgacaaagtgttatcaaaaataaaaaaaagttatcgtttaaagttacggaaaagaactcagcctaaaagctagctacagcatgccagcagctgttggctgctgcctttgctgccgtaacgtaagctctaagcaccaccgctgcttgctcgccatggaccaagcaaggcccaatgccgaccactacgctagctagcctgctttgctaggcccacaagcaaagaaaccagcccactacctttttctcttatctcttttttttttcatcaatcaattattccgggacgttacatcggtatcatggcctcatgggaactattctccttaaatccttgagtattctaaaacttgagaaatattcaaccgtgtttgtttggatgcaccacaaaaggaatggtttttttagatccacaaaagaaatggtacaggactttggaagaattatagatagagattttctttcacaaggttatctctctcatgtcagaaatctacttagaaacctactgtattaatttattttgcgaaaaaaatattaggaccaaaaaagcacgggttacatcggaaaaattatgttactaagtttttttaaatagaaagttcaattttactctcccgaattatttcattggagtacttcactcctaagcaattttttgggttattttacaccccaaactatttaaaacggttcaactgaccccctatctgtatttctattttttccctctctatatatgtcgtattttatactaaatctaaaaggatcgacagatgcattataacttatctctcaatattttttgaattttttttatcattgtttacataggttggaaacactagaacatatttaaacatcgaggttttaagtttaaagaaagtagttatgaaaatattttagaactttaataatagtgccatctctgccttaagaagtttagcttaaaatacagcttgtataaaagagaaataaagaagagaaatactattaagtggtaaagtgaagcatcattaatagtttatgaggcaaaaaaaagttcatgaattcagtgctaagctatgcctcatttggatttttttcaaaacatagtgcatatgcggacgctcatatagtcatataaattaacggaattgctaaaaaacttgcgacagttttaaggaaaactgtcaatttttcagtcgtcggatttactccgagattcgtgcgtgcgagatgaaagaaaatagcaaaaagcagtacgctatactgggagtcgatcatttcccctccaattaactagagtagcatccctaccactgagccagctgaactattgatgttgaaagcagagttacatgatactcacatatgtgtaaccacatagcagatccctattttttggataatcttattatatttctattttctttgtgggcttgctagcaatgatgctggtgttggatacaaatgctaaaattttttttgaatgttttggtacctagtttttatcgaacgtcctatatgtattgtcatcgtgctttaatatacttacataacacttaccctctagttacagagtagttacatagcagttacaccctagttacagagtagttacattatgtaaaattaggaactacatttttttttcatgagcatgcatactagaagcatgcgtactagcttgtactagtgtggaaccgttttcctgtaacggttgatgacagaccctgtggttaaaaaatttgaaagttttgaacctctgtcgacaactcactagccagtccctaaattaatgagcgcataccttacctttataagtactttcaaagtagttattgatgtttctgtaaatgcaagtatttatggcaagtataagatttgaacatggctgggcaggtccatcacaagaattttttaaaaaacagcgttcatctggatttcggaagaatggaattcacaaactgctagatgaaatccgaggtactagtaatttggagttgtactagctacttcagggtgtgtcagggtgtgtttagttcacgttaaaattaaaattttggttgaaattggaacgacgtgacgcaaaagttagaagtttatatgtgtaggaaaattttgatgtgatggaaaagttggaagtttgaaaaaaaaagtttggaactaaactcggcctcagcactattggagttgtgagtactgagttgtttgtaaaatataacatttattctttgtgaaatcccatattttccaccacaaaatcgatcagaattcagagcagacgatcgaagcagcctcaagcatccacggcgcaccgggggtactcgagaagcggcacgtcgccgccgccgccgccgccggccaccgcggcctccgtgctcagcccgacgacgacgttgcaccgcacgtacaggtcgcgccacccgctcctgaacggcccgctcctgtacttgaccctgcccatgacgacgagccggagctgcacccgccgcgccgcgcagtccgccgccagcgcgcgcgccgcgtcgggcgacaccggcacggccgcaccgccgagcagcggcgacatcgccacgtccgcgccgcggtcctgcgccacgggcgggagcggcgccggcggcatgaccggctccccgcggtacgacgcgtaggcgacgaggccgtcgtagagcagcgacgccctgtcgctggggttgtggagcaccagcgtgaactgcacgctcgcggcgagcgcgtgcgcggaggaggaggcgttggcgagggcgaggcggtacacggcggcgcgcggcacggacgcctgcggcatcacggggcggtagacgaggtacagcacgagcgcggcggcggcggcggcggcgagcgcggccacggcgagggccgccgtggcgaggtggcggaagcggcgagcccggtggtgggcctcgcagaaccgcgccttcctggagacgtccatcgacacgacgatgccagctatgtcccgacctcgtctcggcgtcctcctcctttccacctcgcgtattattccgcgtcgtcacgtcacgcacgcgaggcggcgccgcggaggaggaagccatgtggatggatggatcgcgaattcgggagcagtttggaaaagcggccgcgcgcgcgagctcggacaaaacggggtggtggctcgcgcgcgcggcggtagaaagaagaagccaataggcgctgcggctgctgtgacgctggctgcggcgttgcgggcggagtactgagctggaaacctgggaaagagaagctggcagggacgtttgcatgcattgaaacgtaagcatgtgtgacgaaacgtggtgagtactttgggaagaacagacgatggatgatgggatctgctgaagtaatggaggcttcactggaataccactggatgcaattactggtctatttttttcacacatttgaaatattaaacgtagactaataataaaacaaattataaattctacctgtaaactgcgagatgaatttattaagcataattaatacgtcattagcaaatgtttactgtaccatcacattatcaaatcatggcgcaattaagctcaaaagattcgtctcgcaatttacatgcaaactgtgcaattggtttttttcgtccacatttaatgctccatgcatgtgtccaaatatttgatgtgatatttttggcaaaaaaattttggttcttaagagcaggtacaatagcaggctataagccagctgcaaatatattttaaggagttaaataaggagagagaagtgcagcgggctatagatttgtagccagctgtagcacggactccaagacgcagtgtgtgtatgacatgtaggaccaggtattaatagtgtagtatgtaactattgtatgaatgagctattagattgactatagatgaattggagttagtagttagctgtactattgaacttgctctaacacaccctgcgttagttacctccgttcccaacttctctccctcgtttttcgcgcacacgcttttcaaacttctaaaccgtacgttttttgcaaaaaaaaaatatatacgaaagttgtttaaaaaatcatattaatccatttttggaaaaaaaaagcaaatatttaattaatcacccgctaatcgctgctctgttttccgtgccagggagtgagggttcctgaacgaagcagaacagtccattaggcggaaaacgagagagatgagttggaaaacctagggtaagaacacagccttaaaaagcaaactctcatgtcgtgtgccccccgcctaggcgagacgacagtttaccacatctctactacttaaaaaataagaggtgcttccatcgtccgtcaaaaaaatagagtgaaaaaaccggacgaaaaaaatctgtccgatccaaaacaaaacggacgaaaataaaccggatgaaaaaagaaaagaaaaatcaaatctgtcatataaaaaaagggcgcaataaaggaaaagaaaaacgaatccgattccacggtaaaaaaaaagggagaaaagaaattaaaaaaggaatctatccgattctaaaaaacgggcgcaaaaaaacaggcgaaaaaaaaatcaggtgaaaaaaaagatcggccaaaaaaaacgaatcagatttcgttggcgcggtaagaaaagagcaaaaaaaaaacaaatctgtccgattctaaaaaaaaggaattatatgtgacgcggtaaaaaaaatcgaatcctattatatttgacacgatactatatatctctatcttctctatctctactacttaaaaaattaaaaacgtttccgttgtccgtaataacaaaaaagaagggcgaaaaaaacattaaaaaaaagtttgattcaatttacttccgtcatgcgtaaaaatcgtatcttatcttaatctcaatctttccgaggggaaaaaaagaaagaaattaaagaagggataaactagattgatgttcccaaaattaaaagaggataaacgatattgaaactcccctaactcgaaaagaaggaataaaatagatttaaatttcccgacaaaattctccaaattcgaagaaccctaatttcgggtaagaaccataagagtcaaaatccaaatcaattaagctaaaggttcgggttacttatcggacttgaaacccatgagcacaccggagctttccaggaagcggcaccgccgcaccttcacctcctcgcagtcgtgtcgggttccctgcgcgctgtcctggagcaccccgccaccatcctttgccgaagacgggaagcgtcggcttggcgttgcccctaccgccgacgaggtccaggccgctcggtgctcgtcgccgtttgcacgcctacctagccagaccgcggacgtcgtggcacggctttgcgtcgccctcgggtgcgcccccagccggcgaagcaagagccgctcggcggtcgtcgccgtacgcacgcaccagcttgccggaccgccgtcgttccgctggctcgtcgtcgaagagaaatgggatcaggagagagcgatttgggagctagggttttgcccctctctcccggtcggtgcttcatccgaggcagggacgattggagccgtccattagatcggacggctcagattcgcctagcgtcaggccgtcgccgccgttgattacgctgcgcctaatgggccgcggaagtgcatcggaccgtccccgcatatgtgggccacgctcagctgctcagcttgcgggccgtcgaattgatgactcaactcgccgaagatgggcaagcccaagtttgggctagcttgggaagacctatgccgaaagcaaatttgatcaaacaatgtggctcacatttttcaaattaaagtctgtcggataaactcctaggtaggctcgaaaaataaatctaaaactaaatcctaaatcctatgctaattgatcaaattagactcggttctacttatttgttaatataccaaattagacttgatttttacagatttgaggttttcaaggtgtcacactatcaaacgatgtttttccgttgcaacgcacgggcactattgctagtcataaaaagattaaaaaaaaggaagccggcagcatttgtagaagtttgaaaaaaaatattttaatagatgatttggaatcacctgtacatttcgacaatgctactgaagtagtggcgttaatgccaatgggctgtagtccacgggaaatgaagcaagcttggcccacaaaagatttggactagtcaaattattgggcctattgttgccatcccaaagggaaggaaattcaacactcaacgtcatcctttctgccgggtgttccagacttccagtgaaatttaactgcccacggtaaaatttggaactggccaattaccaaatatcataggaaaattttgaactttttaccagtagctagccggaatacttgtaaattcaactttaaaatatgtagtactaaatttacaacttctcgaccagcaggcgtccataacgatttggtacgacgtgcattaaccgagccaaaatgaggagcaataccaattttcatcctgttaaaacgtacacatttcacaaaagaacacatcttcggaagcatcacaagctttactgaaagtatgaaactacaccaacgatgttcagtgtaagaaactgtacaaaagaactttgtctttggatatccttgacaccttacatccacacacgtccagcttacacgttaactgttggctagatacaatttagaaaacataaatacgtgtgctacatgataaacgcagcttatctagatctgaagcaaaatatgatccctactgacaaactctacaatgtacgaggtccatggcctaacctagcacacgaagttagcctgtatatatatgcaacaccaccatacactgctgactgtaggtcagggcaatcatactttcactcttcaaacaaaatctgacactgaccaccaggataaccgtggcacagcaatctcctgaagtttggacagccctagctcccttggacaccatgatcttgccgaacaaactgacccttaacccgcggtcgctgctcggctagtagcttcctgctctggtatcgcacctgcacagcaatgtaaaaatgtaaaccacagtttctactattcagcaatacaacaaattggattggaataaaatggcaagattagttgcttgtgacctaccttcttctcaaagcacctgtctttcctcttaagccggaacttgttcagtgcagcctctcgttggctcaggtggcgtaaaccatcaggattttcaggaacaacatttgatgattcagtaggggcaatcatgtggttggaagagctgtcacagacactgccactgagcgtttttctggcgctgtccagcacagtgctgctcccactttcaccggtggttggagaaacatgccgcggctcatctgtaggaatttcaatgcggagatgtttccgattagcacttagatgactccgagcagtttgttcctctacattttcaacctgcttagtatccgtatcttttggaccattctgctgcagagaaattgcttgtgtggttgcgtcttgccaggtagatgttttgctattccaaatgggaggagctgattgtggatagaaaagggatgccacaggtgcaccgttccagaatggctgcccatcaaatgttagtcctccaacaggaacaggaaatggtacaactctaatgggaggttggtttgtttccctcttgtcttgagagggagttttggaatctccatttttgttttcaagatctatatgtgttgccgaggtgctgcatgcctgagcatcaccagcattaatggtagatgatgctgtcctgcagttgtacctatgaacaagaaatgatcggaagtgtgagatctcatatgttggctcttggtaaaactgtgtaaaggagcaagttaaccagtaagttagattatctaaatgcacaaaaagagagatcatacaaaaatttctgctacttccatattatttcatgttttattctatgcttgcaagaccatactgtagcaaatcaaagtaaaatatgtctacgcatgatggtaggtaaataaatgatgaaatatcaaagacgatattttttttctgttataccagtaggaaaaatacatcaacgcgaacataacaaccatgcacaaattaggaatgacagaataaacgttacagtaagaaacacttacaaggaaaatggagatgaagttgagtggttcagtgttcttcgttcatttttctcctggctctctaatctactgtagtcagatcttctgagagaaagttctaactggtgtgctggaatggaaaagcacttgtcatcatttccacgggaatttgctctcgcaacatccatctccatatgtgtgttattcttctgctgattgtcaataatatgaaccagctccatatccctggaagctttctcacaattaatatcatttgaacatgtcatcctcctcagtgatgcatcctcttccctccgtggaatcaagttgccatcattagatgctgcaaaacgaggaggaggtaatatcaggaaaaaaaatgcattcaaaagataattgatgatatgaccactttcagtgtagaagaatgatatggaaataacagagaaaagaatgaaggatgttttattaccatgaattttagtccctccatttttctcggtgttcttgtggtcaggcttggagaaatgccttcccattggctgcttatattccagtaaattgttggtttgcctactgtcagcctccagttctgaccttgtacatgaactctgcaagaggggatccaaaattcagtccacgaacaacagcgaacagatctgaactcagcataataacgacagtccctactgctaaggatataaagactatgcagtatgatgtcttgaagacaataacatgctacagattcagttcaagtgtgtaacatcaaatatccagtacttgaaacaaacaagtattccgtaataggctttatcaaactgttcgtgnnnnnnnnnnnnnnnnnnnnnnagcagccaaaaaaacttaccttactgttgtcatatgtactccattttgcaatacccaagaggaccgaactgtgacatttcgctgacaagaaaatactattctcactcaaaacacagttccattacccacctgacttgaaaaattgataaattagttcaccaacattgatgcagatctgaagggctaaatacatcttttgcatgaagtaataccatttttatcgtgtgggtaatgaaactgcttttggccaaaacatcaggtgatggaagtgttacagttcggtcatagctgggcaatgcaaaatgatacagcacaaatcccatacgtggctaatgattgaaattttgtacgcaagactatctttgggcacacatgagcaggaagaagaaagaacaggtagacaacgtcatgttaactgattctaaaacttacttgagcatcactttcttgttcactgcattccatgttcttgtggacaacattttcagtcacatgttcagctttcgtcactccggtcttctgctcatgcctttctgtaagattatcttcttgttgagtatgctgcacatcaagaacaccgctggactgtaaaacagagtaattgaagtttgttgattagttttgtgaaaaatgcagaatccaaattttaatatataaaaacgagaaagcaaatgtagtcatgctaaaacgttgcaaatatgtgatcttaccagttgttttctccaaacatgctgccataagttccttaattcattcttccgtattggcttaacaaggaaatctgcagcaccctttagcatgcatttgaaaaccatgctaacggaatcatttgaagacatcactgagaccaatagaaaaatgaagcatcagatggagtaatgggattagaaagatatgagaaaggcatggcatagagtcaagttggatacatacttatgacggggatattcttgcatgcgtcatgttccatgatcgtggagagcagcaggaacccagacatcaagggaagttcaacttcagttaaaacaaggtctatattgaaagatttttcctttagtatgtcccacgctttcacaccatcagaggctgcggcaactgcaagaccaaatatgttgcataagatcgacgaaaaacacaatagtataatttaaccaagatcccagagaatacgcgaacaaaccaagagatcaaaaaagaaggaacgtgcctaaataactgtactttaaaataaatttgctttttttttgttttaaaagaggaaactgcatttttcagctctaactctgtcccaaaaaaggatcaaatatacaggtaaacattttgcttcaggaaaaaaacaaatatacatgtgtagttatttcaatttaacacaagatacgaaatggatcgttaaaatacagctatatttttttcgaaaaaaaaatgatattcggtaatgcctcaacttaggtattcctgacgaataggctgcactacaccaaatttcgtctactgaagcagctctggcaaaataaagaaaaagagacagatagcaaggaattacaactacagaccaaaatcagcatattgattaacatatcttctgaaaaaaaaaacagatcacaaatcgtcacatcccaaatctccccacttgaggtctaatccagtaaaatcagctgccacgtagtaacagttttacagcgcagaaacatccgcaactttgcaacttcactagtgagattagccactcgtgacaacaattcgagcaaaaaacaatgaacaaaagcagtcaaccaatttaaccggatcaaaaacaaactgtgcggcacagacgctcacctcgatacccgcacttgcggagcagcgcgcagatgatgtggcgcgtggagtcgtcgccctcagcgagcagcacccgcaccggcatcctcggcagcatccgcgtctccctgctcgaccccgccgccaccgccgccgcatcctccccttcctccccgtccccgtcctccaagtccaccaccttcctctcctccactccaccccccattcccccgccgctagctccgcccctcgcccctcctcgccggagtcgcccgcggcggtaactaccctttcaccgcgcaaggcgcaaccacctctcctcctcctctctctctctcctcgagctcgccactaggaaaatggattggttcgtgggttcgcgaaaaccaaatgccagtgtgggcgacacgacaaagccgaagcggggggaggaggcgtgtgtatatacccccacaccaccacacaggcaactccccgtcaccgacacgtgggccagtcaaccagagggacccacccgccagtgggcgagcgaggcgaggcggtggcgggtgggggtgggagcacgtgagcgagctccgcgcacgaaatatctgtactacactcgaccggtgggcggggccgccacgtcacgcgcgcgggctgggccccacgttgacgtggcgtgcgcggcgtcagtggttgggatatttccgtttcccccgcgagatcgcgacgaggagccgagggctctcgaggccgatattttctctcgcgggagggacacgtggtaggcccggaggaaaaggggaccaatcttgcggccgcgcgggacgacacgtggcgggtggcgaggctaggggattgtgggggagatcgtgtggctggggatgggcgcgtgggcctccgctttgtttaatcgtgcggctggggatgggcggggtgggcccgggtgtagcggtgcgagtttttttttttttttggggggtgggctagtggttggcgtttcgtgcggtccacgataatatctgggcgggtggggactcgtggtggaggataattagcgtggattaagtatggtttaagggcggtggaatggaatgggtttagtgtgggttggaaatatctaattgactcatttgacaacctttgacaccgtgagcgagcccgtgacggatgtgaagatatttgtcaggaggattctggaagcgttaggtttcctccttataattaatcatacaagttgcaaagcaaaaaatattcgctaaattttatgattccttatcacccacatattaatagtactaatatagtgttgtggtaattggcaaaattacgtagcttgtcatattaagttgtcggtactcagtagtaatattgtgaatgcatgctttttattttttttagggaaaattgtgaatacaaactaaagagtggttgtttgttgagatgggcagacggggtgcaaaaaagaatggacgaggttgattcgaccaagtgttggcctacatcaaccatccgtgtgtctgtgtcctccatggctccatgcaccatcaacacccacacacacccacacacacgcaaaaaagaggtagtacactagtagtactactccatataggagtagcacactagtagcactagtgaaaacaacttttcgaacaagccgaacaatatacactcgcccgaagaatatccaaattccgccaacacacatcctgcgccacgaggtccgattcgatccacgtcgaataatgccgcagctgtactccacttacacattgttaagctacaattaccacaaacagtacagtaatactacatatagtagtagtacgtaacattggctctgtccgctagatatttccaggctccaaccgacgaagagacgaggagtcttatcggttgtccatattttctaataaattattttgatttattataaaaaaataatatataattaaaagttttatatatttgttcataacgacgtaaaaggtaacgttaaaaaaattacattgaaaatattttaaaatcaagtttgaaaattaaaattttagcttttattttgatttattagagcaagtttaatagtatagccagctactagctccaattcatttatagccaatctaatagctcattcatataatacttacatactgccctattaatacatggtcccacctatcatatacacactgcgtcttggagtctatattacagctggctataaatctgcagcccactacccttcactcttcttatttatcttcttaaaatatatttgcagctggcttataagctgctatttacctgctcttaggataaccgatggagctagagacaagtggcggcgaccgcatgccgtggataatccacgggccattggccgtttcgttgcaatgatgctgcctcgttgccgagaggaggagacagatagaccggctcgcgtcgcggctgttttgtgtggtggtagtcgtcggtggtggggtcggcgggtctcgctcgcttccgaaacaacccacttggcgtggccgggcgtggccggccgccccatgtttctgagcctccaaggtaggactcgatcgatcgatctcacgggaaccaaactgaccggatgacatggcacgccatctcgctaaatatcttgacggactaacaacgctcgccgttggatgcatggtagtagcaaactagttagctgctaccagccatcttttattctttttggttgttatcggcataattttttttaatgtctagtaatatcaaaaataggctaaatgcattgttgcaaaaaaagtattactgatatttgtaacaaattaaatgcattcgtatatttgtcaattttatcttaaaaatggtatggtccaaaatgacatcaactgaacaggttgttggccaaaatttaaattttaagttttaattttgtaattgatttttaagttttttttgttacaggttattttttataatgatttttcaaattaatatattatttataaattgtttttcgaatctctaataagtattacggcttattttttttgaaaggacagtattacggcttattaacaaagcgaaatgacttgccacaaagttgcaagcaacaatatcgcaatattcgtggggcactagctacagtacagtagttataaatggacagatggggggtcgagttcacgtggcgcggcatggcgcggcataaacctgtctacgaatttgatgaccttcttgttgttgctgctagagaagtcatgcatctaggatagtactggatgcagagatattttgaaactgtgtgcgcctctgcttttcgtcgctggggtcgccgattcgggcggtggatcgatgactggttgacggttgggtgctgtagctataacttgggagggcaaaatggtggattaattggatggctagtttttctccttgtggatgggggctggaccgctggaacgctggatggatggaccaaacatatggccaagcacgcgcgcgtgcgacacgctcgacgacggccgcacgatccgctagtggccgcggtccgcgatggtggcgcacggaccgcccgtgcaaatcgccgggaaatatcttcgcgagcagagagatattttcgccttgatctcgattacgcaccccgatcttttttatggtcgatctccaggctgtctctcagtctctcgcgtgttaatttggagtgagtacgtgtaaagccatttttttccgcgctatggccaggctcgcagcggacgtccacatccacagcctcgatcgcgattcgcgcagcatgggttgtgtttggttggttttgcaagggtggcatgtgccgtgctagaatcggacattccgcaatgagaccgacgagagggagatcgctcgatcgatcgatcagtgaaaggtgctttagctagcatagcaagcgatagctaagcaggcacagtggttgcccgaccggttcggcgagatactactgtacaagtggatgatcgatcgagcagctcgcgggcgagacgaagctcgcgggcgagacgaacgacaagtgaagcggccgtggccactagctgtagcttttactagctcgttctcttcgtgatctctttgggtggatcgattgaaacgtggggacggaggaaggtccccatcgttttctctaatatagcattgctaaattttgtttttttagacttaattttagtttttttatcgagatttattttttaataatggtatacaagtcgctaggtacgtatatataaaaatctacctacaaaattattattattattactaatacgttgaatgacgtatgtgatgaggacggagaatgctgtgttgttggaggaagtgtggtgtggttgctccacgcgtgcaccgggcgttctcctttctccggtgatacgtatacacccaactaggaggcaaaaatatctttgctaggtctgcgtggctgcagttgacaagtcctagattttttcgaaatatcttctcgatcggtctacagttctgtgggtggggacagcttcctagatatccggcagagcactactactattatcctacctgatgcaaccatctggctgctggccacatatactcgggtgtacatgcgtgtggttatggatcgatataatcatttcaggatcactcatcagttaaggttagtggtgtgttgccgcgggctattagaatttagaacttagaacttataaacacttcaatgaatgactgtcacagttcgatgatgtgactatatatggccgtgttcctccctcattaagatgtagattataccttagattttgtcaccatgttttttaactgctaaacaacgtgcttggtacgaaaaactttctatacaaaagttatat

SEQ ID NO: 45414 - DNA, 6908 bp, Oryza sativa
tcatacattttcgtgttactttagacttaggacgattgaaaatatgcacactaaaatctcagcagttctttttggctaacctagcgcaagctcctctcttgtagaaactgttgtatcattcaaatgcaatgtgcatgttatttctagtttgttggaattattaaagcatttaaaactctgaatagtagcatagataaggctaacaatttaatgtttcagatacatatcttttgtgcttatatcaaccagtgtttgggaatgataatctgacagcagcaaaaataaatcgtactatttaggatcgaatttttagcactggaactatattacttccgctacaaattaactcaatgctactgaatgaaaaatacaaacaggaaggacggacttcatggctttccagtttgcaggcacgcctccttctgctcttcttgaggtcaagagcaggaggcattcttaaggaatactatcctacagtacgtgtatgatgtggttattgcttcctcaaatatttaaataatacatggttactaagcaataccgaaaaattcctgtgcagagaactgaacgggttgacaagccacttgtggatgagataataagagctgtatcctcagatcacaaagtatatttatcatagacttaaccgttgatatatgcagtatagcctgcaattctttttccttgacagacaaattcagtcatatgatcctggcgcagcaaccgttattgagagcatattcagtttcaatctttccattcctctcaactttttatttgattcttttggtggaaaaatcttaattgttcaggtattttctgatataaaaaaatggtgtggattcataccggtacctaatttagttactgcaacatgcggatagctaatactaccttcatgtgctttttttggggaaacaagggaatgaaagatccacttacaaaatccaagtcatttgtttccatgcttagggagcattgcagcaaggtccatattagagagctagatgcaggtgaatctctctctctctcctgtgcgcaagttctcattcatgaacgtcttcaggggttaggggttactgatgttagtttttttcttctcatactgaaatgtgtcaggtcatgctccacatgatgaagttcctgatgaagtgaactccttgctgtgcgaatggatcaaagagactggcgcttagccagcaatggagttccatcctacttagatgtctggtaaccttatccattaactgacttctcgattatactaacttgatcgttggaagcatttttttctaagaacttgatcccaatgtgcccgttgacacttctgtactttttttgcttcatgtcttaggtggcaaaaaggagatgaatattgaacactgtacagaattgtatgtgtagattacttatttactcttaatcttcatatcattttctggaatttcaaaatgaaatgcaatatatgttgaatgaaaggaaaaacagcatcgagcaggtttgatagcaagtcggcacaagaagatgagatgcaattcgcactcctgatgaactttctggtggttcttaaagctgtttttgtttatggacctagctcaaaatcaaccttgaaccctacattacaagagttgtctaaatctaatcatacaaacttttgaccccatcgtgcaagtaatgtctaatcgtgccacatttgtactctcttgtagtcttgttttatatggctcgacatagatagaagtacaaaatgaactaatatttcatgccaattgggtgcattctttcatctgttccaaattgtttttcaagccagtggctaacaccctactaaactattctccagcaaaatgaattaatataactttccatcgaaggaatttctttagatgtattcttgatggtgaggccatggaatcctgagtgcctcgcttgggttaaatttttgggtgtagtaggggttcaataaacgctgaactggagtgcatgcattctggtgtatgttcttcagttttttttttgagggtagtcatgtcaaattttctggctaaaaatgatgtgtggtttgagatattgccgagttcctttgagcttctttcttttcccaatttgtataccataacaaactccatagttttcactgtactgcctgtttggactcgtaatgtgctgtggaattgtaggaacagtttaaaactcgtgggctactagctaatatgttcgggtattttacttttattttccctcttatagtatagcgaatgcaaccgaatctttttttcaaaaatgtatttcacttttctttgaatcaaatcaatccatctcttttccttgtgatcagatttcttgtgctattgaagcctctaaatgcacacacaacacaccgtgtcaaacttaaacgaaatcctgtttagctacacatacaaaaacatcctccttagcaatagcatggtttaatctcatcatcctgagtatgcattacatcagtgctgcgtacaagttcgattcaacgcaagctgccaatcaccagagcctttggaaaggccatgaaacggccctgtcagtttgattaatcgattaatatgatattttaaataactttcatatagattttgaaataacaatttaaaaatcgtgcacgcggaacatgaggaagatgtgttaatacaggctgccgaactaagcctaatatgtaaattataccttagattttgttaccacattttttttaactactaaacaatgtgctttgtacggaaactttctatataaaagttataaaatataaaataatttttaagtatataataattaaaacttgatatttttactagttaataattaaaactcaagtaatcatgcgttaatggttttatcgttttacgtgtgtacaccacttatatatgaaagctcatttttaataattaatattgagtgaattacaactatataataatagaaaatatgtgccgctctagctgattttcttatgtgatcaatcaaattcagataccatatgatgtcttgaaaaagatattacgaactctcacctgtacgctatctcccgaacaaacataaattctgtgtaaaatgggtgttttgaaagttgaaactatttgaagccagcatcactattcactccatgttctctcttcctactctccatgagcaagtttaatagtatagccaactgctagctccaaatcatctatagccaatttaatagctaatttatacaatagttgcttactatagaattaatgcatgatcccacctatcatacacacattatgtaatagttgcttactatacaattaatgcatgatcccacctatcatacacacattatgtaatagttgcttactatacaattaatgcatgatcccacctatcatacacacattatgtcttggaggttgtgctgcaactggctacagatatatagctcgctgttcttctctcttatcttttatctctttaaaatatatttataggtgactgatagtctgctattgtacttgctctaattgggtagttgggttgaagtgcgaggccgcaaagaattcaagacatggtccagagcccatatgaatggcccgagagaacaagtagccctcctaactataaggctccactttggggccaagcccatgttttgttgggccaaagcctacgccagtacacgatcatcttcatcgttcggtccccgtctcccagttcgagcccacgccatcacggcctcgccgatgctcccgtcgccaccggcgccgccgccgatctcgccggcgcggctgcacaagctcgtgacctcccagtcggacccgctcctcgcgctcgagctagtcaccgtcaccgcgccgaccaccgcgccccacccgtcgacgctccacgcgctcgcgctccgcctctcccgccgccgcgaacacctcccccacgcgctcgcgctcctgcgccgcctcccgtcgccgccctccccgcggatcctcctcccgctgctcctctccgcgctccgcctccgccggcagcctcacctcttcctctccaccttcaactccctcttcgtctccggccccagcccgttgccgctccaccccgagcttctcctccgcctcctctccgttctctcttccaccgcttcctacttcccgtgcgcgctgcacctcctccgcgacgtctccacccgccttcccctccccgagccgctcgtcctcgcctcgcacaacctgctcatcgaagccgccgcccgctccggccacctcgccgtgtcaatctccctcttccatcgcctccgctccctccatgtgtctcccaacgccgagacataccgcatcctgacccagtcactatgccgcaggggccaggtccgcactgcagccaacctgctcgacgaaatgctccacaggggcatccctgctgacccactggcatacaccaccgtgctgaacgcgctctgccgtaagaagcagcttcgagaggcttaccgcttgctgtgcctcatgcgaggccgtgaggtctcacctgacattgtacattacaacacggtcatcgtcggaatgtgccgtgagggacggccactggatgcctgcaaggtgttcagagatatgagggagagtgggtgcgcgccaaatgcggtggcatatactgcggtggtcaataggttgtgtgtgagtggattatatgacaaggcagaggcataccttgatgatatgttgggcaaagggttactaccacatttctctgtgttccattcagtgattaagggatgctgtgcagttgggaaggtcaatgaggctgcagggatgatgactcgaatgcttgatcttggaatggttccacatgctgagacctggagttcagtgatcaggagtgtttgtagtgatgaggataatgtcgaggtggttttgttgcaagtgatgaaaggaataaagcacctctcaaacataaattcaaggagtacttggacatgatatcatgtggcatggatgcaaggaacacctattttatggtgtgttgtaacaatcagttttgaaagaaaacagtagatgatgtgcaaaatgtggaccgcaaccatttttctcatcgtatgcagctaatttgatatttgagtttatttgtttatatgcaggttaggagatattgtttgacttcaactaaggtacactatcctgtttcaagaaaaaaaaaagctattgcccttaattaagcatgtagcgctattgatattgagttctagcactgttttggtagtacattttgtatgtagattctgaatttctgatgcttgttagttaaaaccatactctgttctagtagtaattttcaaatacatttactctgaatcgagtagatcatttactttttcttatgcctcttcaattgtgctttcctgtagctgcaacggcagcacccagattctgcattcgcagatcttataatctgccaaagcccaaagctttgatgccaggattcgtggttttgtagaaatgtgcagtaaaaaccgaagtcgtggttttttcggctgccgaatcaaagcgtaagctgtggattggttgtagtgcgggatggtactttctggttctgctgattcagaaaagtgaaacatatggtttgccttaaaatagacgctagtaaatggaaagaacaactgcctttcagtcccaacttcttgaggagacctgcacctttacttatgtggtatgtgtcagatcatgaaggttttaattggaagggatgagatcgaggtgtgttttatcaagttatgctgtggaaatgggtattagaatctggtgttaacattcatatacaagtaacatcgtgcgaaattatactgtaatctgtattatgtagtgcaagaatcgcaagtaatcacactggcagttggctttaacattagcctttttatcctttgcaggttactcagacacgatgctggaactgctactttttgctttggaagatcttaagatggttttgaagtctcaggagtctgatcttctcataggcttgggaaatgctgaagatgttgttctcaagcttgtaaatgaggtcactatgcaaggtttatgttgagaattgagcttaagagtttatgcaaaccttcactgctagccatctaacatatccagatctcctgattgcatgcattgatggagcataacaggtacaagcgggcctcattttcacagaagaggaagttgagtacagagtgcgcaatgttctggccagtgttgaatcatctctctctaatgcatcatacctatcgggaaaccctcctgagatagtggtttggagtgcctcattgtatgactacaaggtaattttttatctcaggttatcattccctattgctatcctctagcaacctaattatgtttggcatgctaaaatcattccaccagaatccgagggaattgtcaacatcacacaaccaatttttgaaggaaaaattaccgatgaacacacctcttgctgccccgtctttacctgctctgaacatagagatagagacaggtgtatttcagttctctttttttttttggttagtgattatatccttgatcatttttggtgtgtgcattgtgatacttgtgggctactagctaatatgttcaggtattttacttttcttttttccttcttgtagtatagcgaaggcaaccgaatatattttttttttcaaaaatgtatttcacttttctttgaatcaaatcaatccatctcttttccttgtgatcagatttcttgtgctattgatgcctctaaacgcacacacaacacagtgtcaaacttaaacgaaatcctctttagctacacatacaaaaacatcctccttagcaatagcatggtttaatctcatcatcctgagtatgcattacatcagtgctgcgtacaagttcgattcaacgcaagct

SEQ ID NO: 45415 - DNA, 5238 bp, Oryza sativa
tccgctccctccatgtgtctcccaacgccgagacataccgcatcctgacccagtcactctgccgcaggggccaggtccacactgcggccaccctgctcgacgaaatgctccacaggggcatccctgctgacccactggcatacaccaccgtgctgaatgcgctctgccgtaagaagcagcttcgagaggcttaccgcttgctgtgcctcatgcgaggccgtggggtctcacctgacattgtacattacaacacggtcatcgtcggagtgtgtcgtgagggacggccactggatgcctgcaaggtgttcggagatatgagggagagtgggtgcgcgccaaatgcggtgacatatactgcggtggtgaatgggttgtgtgtgaatggattatatgacaaggcagaggcataccttgatgatatgttgggcaaagggttactaccacatttctctgtgttacattcagtgattaagggatgctgtgcagttgggaaggttaatgaggctgcagggatgatgactcgaatgcttgatcttgggatggttccacatgctgagacctggagttcagtgatcaggagtgtttgtagtgatgaggataatgtcgaggtggttttgttgcaagtgatgaaaggaataaagcaccgctcaaacataaattcaaggagtacctggacatgatatcatgtggcatggatgcaaggaacacctattttctggtgtgttgtaacaatcagttttgaaaggaaacagtagatgatgtgcaaaatgtggaccgcaaccatttttctcatcgtatgcagctaatttgatatttgagtttatttgtttatatgcaggttaggagatattgtctgacttcaactaaggtatgctatcctattgcaagaaaaaaaaagttatcgcccttaattaatgtgattcatatgattgttttggtagtacattttgaaggttgattctgaatttctgatgcttgttagttaaagaccatactttgttctactctgaatccagttgatcatttatactttttcttatgcctcttcaattgtgtgcattcgcagatcttataatctgccaaagcccaaagattttggttcaccttggttcatgttttctggattttgttagaccccagttctgtgtactttgtggaaactataatgttttggcagcaggagctgactcagctgagtgaaggatcagcaattcagcatggagatcatctcacggcaaatatgggaagctcactggacgttggctgaattccaactgctgttgtcaaggtgcatctgatcttctcacgacaagcatacactatacatatcgttgcaggtgcagacaaaggttttacgactatttgatttcctgatacaacgcggcaaagctgctgggatctggatggttcactcgcacggcttgctacatttttgtgcacccactgacctcgtcgtacttgccgtgcccggtggtatcctctccctgtgactgcataggtagtgcggtactgcctcagagagttttgtgtgctgaagtagagaaatttttgtaattctattttcactgggtgatgtacctttcaagaattcaaaattaccagcgattaccggtaacagtggccatgctatgtactatgagtctatcttgtatagacttagaacaagccccccttcattcaggagataaaaaaatgatggattcttgagattttagatttaaaaaatgattatgtacacgtattggaaatgcaaacgtgtaatcgtattgtactgattatgtaatgccatacggtgtccattgacatttgcttattcactctggactactcgtttcgtgctgaatcatttgcgcctaattgattaggccatgtctaaattttgatacaaattcctgctaatttcagaagagaaaaaaaaagtggtcatgaatagggtttaccaaaccgaagtggtcatgaatagggtttaccaaaccgttttcagtgggttactatcctcgctcgatttgacggttatcacagtaactaccgtggtttaaaactgaaatatttaccgcacgtgatagccgggcgataaccgtgcggtttgtatgcgtttcctcctgcggctctgtttcgttgcgggggagccccaccggcccacggcgcgggatcaccgccgccacagaaacctccatagagatctccgagcagccgtcctccgccacaactttcgccatggtggcgccctagccccgcgcttcttatcccgccccacctatggctgctgctgctgccgctgccgccgccacactcctcccatggctctcctcgcgctccgcctcggccaccaccaccaccacctcggcctctccgccccgcgcgacccccgcctcctcctccgccggaggctcgtggtcgccagctccggtgccgtgaaggcccccgcggccgcggcggtcgtgtggttcaagcatgacctccgcgtcgacgaccacccgggcctcgccgccgcggtggctgccgagccgcgccggcccgtcctgccgctctacgtcttcgaccgccgcatcctcgacggtacgctgctactactgcgcttgctagccccttgcagcaaatgtctcactgagccactggttttggaatgcccgggggctgtgggaagtgtgtgcgatgtgttcgacacaatgtcttacggatcgcgcggtggtttgatcggacgcttgcactttggtgtttactgtgtactgtctctcgcgtgcccggtaacctggctacgttttttttttttgctacgtttgtgcaaaatctagtgactttgatgccaggattcgtggttttgtagaaatgtgcagtaaaccgaagtcgtaggttttttggctgccgaatcaaagtgtaagctgtggattggttgtagtgcgggatgatactttctggttctgctaattcagaaattccctagcataaaagtgaaacatatggtttgccttaaaatagacgctagtaaatggagagaacaactgcttttcagtcccaacttcttgaggagacctgcacctccactatctggtatgtgccagatcatgaaggttttgattggaatggacgagatcaagggtgtgttttatcaagtcatgctgtggaaatgggtatcagaatctgatgttaacattcatatacaagtaacagcgtgcaaagttatactgtaatctgtattatgcagtgcaagaatcccaagtaatcacactgacagttggcattgacattagcctttttatcctttgcaggttactcagacacgatgctggaactgctactttttgctttggaagatcttaagatggttttgaagtctcaggagtctgatcttctcataggcttgggaaatgctgaagatgttgttctcaagcttgtaaatgaggtcactatgcaaggtttatgttgagaattgagcttaagagtttatgcaaaccttcactgctagccatctaacatatccagatctcctgattgcatgcattgatggagcataacaggtacaagcgggcctcattttcacagaagaggaagttgagtacagagtgcgcaatgttctggccagtgttgaatcatctctctctaatgcatcattcctatcgggaaaccctcctgagatagtggtttggagtgcctcattgtatgactacaaggtaattttgtatctcaggttatcattccctattgctatcctctagcaacctaattatgtttggcatgctaaaatcattccaccagaatccgagggaattgtcaacatcacacaaccaatttttgaaggaaaaattaccgatgaacacacctcttgctgccccgtctttacctgctctgaacatagagatagagacaggtgtatttcagttctcttttttttttggttagtgattatatccttgatcatttttggtgtgtgcattatgataccatgacaatttcctgttcaggttctctccccacactggaagaactaaaagggtttcttaaagagagtagaacgtcagagaataattgggttcctctcaagggcacatcagccagatctattcttaaaaagactctcagccagataaatgtcaaaaccggtgttgcatcaagtggcagcgatggaggagaggataccactgcatattatgctatgtcagggaggaagatccaaaattcaatgttcacatcagaaagctcaacagaagttagaggtggaacggaaatcactttggatgctttagctgcatacctgaaatacctagaaggaacagggaaggctagttggcaagagtacgtcgcaccacttctttttaaaatctaattacattcagcactattggtatgtttgtaactttgtatttgaaaatgttgcctagctcataaggtaaatgcagtctatgatgtcatatcagtcatcaatgatttttctgataacaggctttgtttaaatttcatatccaggttgcatgataaagtacggttaactgaaactagagatggtgcctcgttttgcactttgtttggtcctgcacttcagcttggagttatatccaagaggagagtttaccatgaaactattcagtatgagagagaccggaatgctggatttatatcaccatttggatactcaacacctacagtgacagcagcagtagatgctatctgttcaatggaggtacttttgtaactgtcctgttctcaaaaccattcgtccataccttttcctcctcttttcggtgatcttgttttcctctaacaatgtctttctgaacatgaaagtggtattggctcttggccttgaaatcccaagtatgcattgaaggaaattaccctgtcagaatctggagatggaaaggtcatcttatacaggtactattagttaacttcaagatccacactctctatctctactgcatcagaaaccataacttatctatgtaacaggaatcatgtcaaatgcaagtagtcctagaattggatataattacaatcagcaatgttagtcgttaaaatgaattgtgatggcttggtcaaccactaaaaaggaccaatgtattatcctctgaactattcatctttgcacttggatccttccaccttctggttgccgatacagacccctagataggtaagcataaaacattttcttctatcccatattagtatctctgaaactaactaggatttcagctgaaccatttaaaagttccatccagcagggcagcagctcttctt

SEQ ID NO: 45416 - DNA, 3650 bp, Oryza sativa
agtacctcttgcccattattacattttgttattctttatttggtggccatctcaaaaatgcttaagcagagttcccatcagtgaggccataaacaaattaaagctctgattaggattacccaaccaacccaccttatctaagcacaagctttctttcaccagggccttgtctttgagtctcaccaaacctgacagtgacacaagcaattaatcctggcctctgaaatatgtcaagttgcagatgacaccaattccttttgacaagttactccttatcatcccttcttccttcctgccccctaatgataggctaaggtcctatgctcagtagattatgtattatggattaccacaccacgcttcccgaacccctaatgaacggtactatatgttttacaaaaactttcttcatcaacagttttaagaaaaccttttcaaatcgacttatcaaccaatatttacttcattcatttgcatcctcaaataatatgatcataaactcaatttcagtttatcatccatcttatgctaagaacgcccttcaagagatcgtttacacaagaggagtgaaagaacatgtagttagtgattgcagtgagtagcaatctaagaccctagcttcgaatcttcgtaggagcaaatatcatattggattgtttgaggggctaaattttcaatttaaataactgtgtatattcggttggattagaggccgaataaaaattaaccatctctaaaaaaaatatttacaaaagaggtaaaaagcaagctactaattacttgttgctatcaaatggccaccactaggagtagtactagtgtactactagccctgttgcttgctctctctgcaatcctcctcggatttgttaatgattctgttcttttttttcatttcgcccttgtcatgccgtctgatcacgtgctgtgatggatgttaacaagctattgctcctgggccaccagctcgattttggctctgctatctgctgcattctcgctgtctccttcgtgacgcactcgatccccctctcgccggctagatttcttgggcagttgctacgctaccgcctcgctcgccgacgtgtgtgccgggcaaatcgaaaggcaaggatcccggcgagcgcactcccggatcggatggtgagatctctctggggcctttttgcagggcacacttggcatctgcttcttctgatgcggatgtttctcatgatattgcggtagctagatatgcaattgatagtgcagcgataaggggtgtatagtttcaacatcaaggtcctatatttaattccaacgcgctcacaatttcttctttaaaaaaatgtttggagggacatctcttcaaatctagtttttttgacgcatacatttctcagggtaaatatcggtacctcttctactctatcttccataaactagctacttgcctgtaaattctaacaggtcaggcatatataatgtatgtttggcagagctccaacttttaaatttagcttcgggagaccagctccactttcattttgtgaaagtgctccaactagctctactcccattttaggtagagttgaaactgttttactgtgagctggagctgtgccgaacagacccataaccagagagaaaaagttgttacttttcatgtacggacgcttaagcaccttgagatagtagagaatgactttgttttcaagaagtagaggtataaacatttctaacgtttaaaatttacaattcaccaccaacgccaacaaaatggatggaatcacttgaaagctcacgagttacggagagtactggaccgatccacctataaagcgcagttcctcggcttcattaacacgatcatttagaaaccttgctacccgctttgccgatacaccctggaaagtagaaacattcttttcacctcgtcatatacacaaggagaaactcatgtgagcaactcaagctgacaacgtgaaaacacaacaatgatggtccactagtggtgctactggccaaggtatattaaaaaaagggtccgcgctctcatcctactaacagtataggaaatatggaaggagaaaaaacatagagtgttttaacgcaaggggctcttggcaatagctaataggttgccaaaatcaaggagactaacatcctcatctttttgctaaggcttatacttatcaactaaaatttaaaatttaaatcttaaatttgaagttgattttgggtttttttatcgaaatttatttttcagcctttgctttttagatagttaagaacacgtatataaaggttttattcacaacttattttttatttgcaaatatgccgtttggcttattcaccgaataagcgaaacgattggactgtataacctaggacctagcatgagcaaaacgacttcggagctttttttttttgaaaggtttcggagcttattctttagctttgttctactttttttatagttctctttcacacgtatacaactcttctttttctcttattatatttaaaagtaaatttcataaaacttgaagtagtttaatcaatctatcacaaaactacaaatttttaataacatgtatcacaaaactacagatttaacatcataatttttttatataaaattacagatttaaggtatgatataaaaaaactacagatttaacgtcacttttatcacaaaaactacaacttctataacaccaatagtgctaagatataaactctaaactaaatctatagttttgtgatatgatgttttaaatctatagtttgtgataagtttggtgctaaatctgtagttttgtgatacatatctttaaatatgtagttctacgacagtttgatcaaagtatatgtagttttgtaaaatttactctatatttaattaatgaaattgtcacgatctagtacggttcgttcatttgtttttatttctagcatactacttcccaatccaaccggccactgttcatgattatctatatttacagatgtattgctaggcacgattttttttaatcaagtaaatttctagtgaatatcaccttaagtttaattttaaactcctaaaagtgtatatatccgtggatggaggaagtagatgccttctccttgaacaaattggaagtggtcgtattactgcattcaaagacatgtgttgaatgttctaaaaaaagacatgtgttgaaatgtcatagggcaattgttggatgagttagaatatatttatttagctcgagtctgatttgctgaacataataaattaataattaatagacttctaagagtgactttaaaaaataaggacagttgctccaaactagccctagttaagtcagaagggaagatggataagatgcaggtaaatgttcatttttggtatatccttttggcttgttctgcagaagatacaagcaagtacatgtcacagtattagttggaaatcaacaggctggctgttggatttgcagattaacttaaaagagactgtcacttgcgaagttggtatgactgcaattgccgctcttcgaccctctaaacggatgatgaggcaaatgaatgatcccgcgaatatatcctctaacataaagaaaaaaaaaacagataaaggccataaacaaactctgaaagaaaagtgttacaacatt

SEQ ID NO: 45417 - DNA, 4208 bp, Oryza sativa
aatctgctacagcctatagaataataaaatttttatgagctacactacacagattcagattcctttaatttcaaaaacttaagttcataacatatttataacttaacaacattcaatgtacaaccatacaatatacatgtaaagatatctaattttctacagatactctaaatacaacattcaatatctaagaaaatcaagcaagctgcaaattaataaattgcacatgctaaattgttaggaacttaggattacaaaagtgaagctacaatatataaagggttagcgtgaaatcgaaccccatggatttgaataagcgcacgccgttggtggaagatgaagcttctggagttcttggagcagaaggagctcctgccttagtcgaagcagaaggtgctcctgcaagatggctttttgcctagtggtggtcctttttataggtggttgcggcggccgactgcaggcctttgcaccggagttggaggaaccagatctgcccacatgaacaatggcagatccagcaacaggcacaacggcaggtgtggctgcagctgcagcgcttatagcatgcgatggctggtccaactccgcattggcgtcccttattgtggatcgccgaacgtgagttagtgactcaacgagacaacgatgtagccatggaagaggaatttagtggagggggagggggatatggtactgtagttaggcgtctagggaggggtactgagttgggagtaggacagctagatgtgctcaccttgcatcgtcgtcggagcttagcagtggtgaaggcgaagccatggtggactcgagcggctggtcgtcgtgtggactcgtcgttttcccctttcttgccaccgaagccttcacctacatccaccatcagcaaaacaaataagcctacatgacggatcagatattgacagagggtggaggaggaggccgacgtccggtggccggtgccgagtccacggcgtcctcggacctgggaggctgcgagtgaagggaacgggacggcgcggcgtggcgctgggacctggccacggggctcgggagctgggagctgggccacctgggaccgggcggctcggcgctggtgcggtcaccgacacggcgggcgcggcggcccggcgctggcgcggtcgccggcacggcgggcgcggcggccctgcgcgtgcgggtgcgagatcgggagtcggcgccgcttagccgctgtggccgacggacggtggcgtggcgcgtggcggcgtggggattgggacgagcggggcggacggtggcgtgtggactggggaatggggacgaaggggataaggattggaatggttagggttacacaactgctttatatactctatgctttgggcctggtttttatgggccatatgggccaaatgcacaggatattactacacacatacttttatatcgggcctccacggagggcggggacgggggacggtgaactaaacccgcccccgccagacccgacggagactactttctctccatttgattccccatggagacacaattgataccatcaccatcacataatgggagaattctccacgggggaccggggaccgggtacccattgccatctctagtcgggtccttcgcttcttcccgtggacgccaatcgtcaacccggtaagttggtactaccttcccttcttcttctttgctagtgttgctgttgtcttgtttatgacagcgcggcgcggcgtgctttgtatggtatcgtgaaggggatgtttgtttaatgcataacattgctataatttagattagttgtggcgtggtgacgcaagtagcttaaagatagtgccacaaataataaaaaaaatactatgatatcacttcagatgaaaataaactttatagaagagttattgatatcattgagatctacaactttgtagtgtattaccttttcatttcaaatcatttggagtatcaaataagcattagtatttcttaaataaaacaattaaaaccagtgaaaagaatttggatacaaataaaataaattacatttagatctctctggaagggctttttttttaaaggacgtgagacctctaaatttgtaaattttcaaaacaaaaatttattttttaaatatttcaacaaaatctctatctctatctctactacttaaaaaataagatgtgcttccatcgtccgtaaaaaaaaaccagacgaaaaaatccatccgatccaaaacaaaacgggctaaaaaaaccggacaaaaaacgggcaaaaaagaaaagaaaaaccaaatctgtcccatcaaaaaagggcaaaaaaaagaaaggaaaaacgaatccgattccgtggtaaaaaaaagggagaaaagaaataaaaaaggaatctgtccgattccttaaaaaaggggcgcaaaaaaaaccaggtgaaaaaaagaccggccaaaaaaaacgaatccgcgtggatgcggtaaaaaaaagagaaaaaaaaaacaaatctaaaaaaaaagaattatatgtggtgcagtaaaaaaatcgaatcctattatatttgacatggtactatatctctattttctctatctctactacttaaaaaaattaaaaacgtttccgttgtccgtaataacgaaagaagggcgaaaaaaacattaaaacagaaaaaagaaagttcgattcaatttacttccattgtccgtaaaaatcttatcttatcttaatctcaatctttccaaggggacgagcagcaccctccatccccgcccgcgcgatgaaacaccagccaaagaaaaaaaacaaaattaagcagagggataaactagattgaagttcccaaaattaaaagaggataaacgatattgaaactcccctaactcgaaaagagggaataaaatatattgaaatttcccgacaaaattctctaaattcgaagaaccctaatttcgggtaagaaccataagagtcaaatccaaatcaattaagccaagggtccgggttacttaccggacttgaagcccctgagctcattggagctttccgggaagtggcactgccgcaccttcacctcctcgcagtcgtgtcgggttccctgcatgcgcgctgtcctggagcacccctccaccgtcctttgccgaagacgggaagcgtcggcttggcgtcgcccctaccgccgatgaggtcaggccgctcggcgcttgtcgccgtttgcacgcccaccttgccggaccgctgacgtcatggcatggctttgcgcgccctcgtgtgcgccccccagccggcgaagcaggagccactcagcggtcatcgctgcacgcgcgcaccagcttgccggaccactgtcgttccgctctctcgtcgccggagagaaatgggatcaggagagagggatttgggagctagggttttgcccctctcctcggtcggcgcttcatccggcgcggggacgattggagccgtccatcagatcagacggctcagattcgcccagtgtcgggccgtcgtcgccgttgattacgctgcgcctaatgggccacggaagtgcatcggaccgtccccgcatatgtgggccgcgctcagctgctcagcttgcgggccatcgaatggactcaactcgccgaagatgggccagcccaagtttgggctggcttgggaagacctgggccgaaagcaaatttgatcaaacaatgtggctcacatttttcaaattaaagtccgtcggataaactcttaagtaggcttgaaaaataaatctaaaactaaatcctaaatcctatgctaattgatcaaattagactcggttctacctatttgttaatatatcaaattatacttgatttttacaaatttgaggtttttagggtgacactatcaaacggcgtttttcccgttgcaacgcacgggcactattgctagtaatataaaaataaaaaaatcgagcgaaaccggtccataatagggacaacagattttgtgcccatggcccatggggtgaatggtagagggcttcgttgctttaccaaccctagggccgagcttttttcttttcttttttttttgactaaacatctgaattgtcattgcataaaagggagaaaaatagttttgttacaatggatttagagtttgtagacaggaagagaaaatgtgtttccaatcatctattacggatctattctgcaccgctagtgtttgtccccaaaaacctgggctgcaggaatt

SEQ ID NO: 45418 - DNA, 4653 bp, Oryza sativa
tccagaaactgaccacaaaagggcaagtgaagcacaaatggtttgccgtctcgtcgccactgttgcagatcacgcaagacgctgactgaacaatcttcttcttcaagagattttcattgtggacagtctatttcgaaccagcagccaagcaaacagttttaccttcaacagtgctctgctgctccaggtgaacttccaatttggcgaggtaatacctgcaggaaattttgcctcataaatttgtttagatgtgagtgtgccagaacgatcgtcttgctctctccggtcgccgacggccgctactcgccgccgctagtccgccaccttccctccttccctctctaagctaaatcggggcctttgtacctggtcgccgaccacctctccaagctaaatcaggccatctgtccctctacctctgctagtaccgagtaacagtctccaacccaaatttcgacattatcgatttgattcagttgaatcgaggcaaggtagaatcgtttaagatcaatccaacgtatccggcgcctgtttttttaattttcactctctcttctacctaattgctgcctctcgtcggcggtaagtatctctctgtttttttttctgtatgctgaattgctgattgaggtctcctgagcgatctatttggaatcacatacctccggttttcccacctaaattgacaaagtatagtatttacttaatttcgttttgaatacggaaagacacaatccaatttcaatcaatgaaacgtgtcgtttttcaggtccggtgacctgttttattcggtttatcatcaatctgcaatggctaacaagggagggtatctaagcgtgttagcgcccattgaaactacaccaaccatcaagcaagaccacattacttccgtaagcgttttattttgtaaatctacgtcattcttccccctcccccgtccatgaatcctccaacttttccttcgaatttttctgcggtcatatagttcccttctttgactgtggtcggtatttcagatttcatctttaagtttgcttaatgttttcgcaccaaatgcagaatgctgacctacaagacaggattagccagttgccagatgatattttgctagccatccttgatggactcaatgtccgagatgctgcaagaacaagcctcctctcaaagcgttggaggccactccccactatgatatcacatcttacaatagatgtttctgactttgatcccaagagcatgtccagcttctctgatgatgaactgggtcggatcaatgcaacagtggttaaggcaacgaagagcatattggcatgcaggaagtcaaatgagcacactatcagcctcctatccatgagattctacttgagagacgatgactgcatatcctttggacacactgttggccacgttatggcaacccaaaaagttgagatgattgaatttacaattttgacagagaaagatgacaatcagtgcattgacgatgatttcatcgtctatgggagacgttttgcgttgttcttcagttattgtccaaatacattcggaggtctcacaggactccaacttgagaatttgagatttggtgaaccagaaatcattgatgtcctcaacacttgcaagcgattaaactatttgcgtttgtataactgcagctcaggaatttccacttttttggaagttgaacacttgcaactcagtgaacttagtattattaattgccgttttggaataatcaaacttagttcactcccaaaactcacacggatgatctttggtggttggatagctttccaagatccactttcttttggacatgttccattactggagtctgtaaccctcaccaatgttggtcttagttggcacaatgcggtgaagttgagcgaatttctgagcaatatctctataagagatctgactttagattttaatagtgaaaaggtatatcaatgttattcttatagttccatctaaaaaggattattcttctgctctgatggctttacttgtatgtttgtaccatgtcatgtactcatgtgttcttttccttgttgcatatttgggttcaaccagaaggcccaaaagcacttgcatctgcattccacaaactaagggttgtgaatttagttgatcttcctgaagggtatgatccctcgtggacaatgttctttcttgaggctgcaccctccttgagggagctatacgtggcggtaagcacctgcaactgatgcttgattatctgctaagccttttacatcaggggcgtagccagctaggtggcaccgtggttcacggaccatctaaaaatttgaaattatagtatatgtgctggttaatatagtaaaaattgtatagtggaccacccttttaattgacatattacatatagatggactacttttaatttaaattttaactacgccactgttttacattttgcattgactgcaatttctgagatatgttttgcggcctgcaggtatgggatcatctctgcgaaatagagacggatgatgagaggaggaaagcctactcatacagcgagaataagaacgcggattggaatgcgtctgcgtcagatttcaagaaccacagcctgtcaacgttagtcatgtttggctttcagtcgaacgacgaaaacttgattaggtatatcagacttgtcatggatgcagcggtgaaccttgaggatatattcctgtataagaggatggcgtgtgaaaagtgcaagggcaagaatccaaggcccttgaggtacccgtcgaccaagaaacagagacaggcactgaggaacagaattgctctggggacacattcgcttgctacgatccatttcccaactgtattaagggctaatcactatgcaaaactgttgtattaagggctcaaagccgcgtactaagttatcaattttttttttcatacttcctttttaagctctaataaatgtcatcggcgagcgtctaaaaaataccataccattgtactccctctgtcccctaatataaggtattttaacatcttgcttgtattatttgatcattcgtcttattcaaaaaaaattaaaattattatttattttatttgtgacttactttattatcctttattatccaaagtattttaaatataactttttattttatatttgtataatttttttaataaaacgtgtggttaaatgttaaaagaaaaagtgaatatctcttctattagggtatggaggtatccatctttcctaaagaaatgtcatcgccgtcggttttccattaatagccaatcgtgtttactgtcggtcaacacggtcaaaatccgccgtaacaaaggggagctagatgcatctgaagaatgccgtaaacgctgagatcgactgcatcctctccatgtctggccgaacgcgagtttgccgattgctttgcagctggtgatctagcggccgattcctcgcacgttgcatcgacatggaggagccccattgccggcaacgagaggagggtgggaggagaaagggaaggagagatttgtacacagctgcagccaggtgagacccaccatggtacgttgcgccgcgccggcttccgcgcggcggcaacatgccgtggcggtggccgcagatgcctcgactgcaaagcatgtcggcgcggggtgcagcggccagctgcagccgtggtcgtcttaccgcgcgcggtccgcggtgcttgccgtgccaagacgtggagctatgccagtatgcctctcgtgcgtgctatgttatgagcaaacaccacgtagcatcaatataatccctccattttatattataaaactttctagtattatccatatttatataaatatttataaatctagacatacatatatatatatacatatatacatatacatatatatatacatatatatatatatacatatacatatacatatatattcattaacatctatatgaatgtgggcaatgttaaaaagtcttataatatgaaaaaggggaagtatgtcgcaaacaccacatagcatcaatatatgtcgcagagttaacgttgcaggtgcggtacgcctcaccaaaacacgtaaagaataagtacgtggctttaacctagtagtaacagataaagttctcgttgtcactgctgagacttcacatagcccggcaataacctagaggccgcgatatgatatgggctgggcgccctgcctgcgagcccctgtaacataggctggctgggcaagtaggtgtacaccgctacatacatgtctctgtattctctcagggttagcaacctgctagtgaacttctaattactcctctttccaggaaaacaatagtgatatccaccatatcagtagcattgatcggaatggtcttcagaatacacaattccttgctagtttggtactaaaaacgccaaatgtcacaataactcaatcataagcaaatgcagaaaatgcggatacccgcaagcaatacgtcgtcttcagcgtaaatacagataaatctccagcacatcaaataatacgacgctaataaggggcaggaaaatccggtagaagcattcagaagtcagaacagcccatggcataaacgttcagagtgtagctttcagcagcgacaacgttggacttcttgaaacgctggtggtcgcttcctcc

SEQ ID NO: 45419 - DNA, 1214 bp, Oryza sativa
atgcatgaccgtgtcctgtgtatgttggcgctcccgagtcccgagtcactgcacgacctgctgacctgatagtttagaagttagaaccctcctgatgaccacatgatgtagccgagtttgtacacagcgtactttgacacaaccagtatataatgctaatacatcattgccttttttattctggaggagaatgttttttttttaacacaaccagcagcattgccttctttttttggagggagaatgattttcttttctgaggtatactctctgtattcaaatatatgaccgctgttgactttatttggttagatttttaatactttcaaattcaatagtacctttcaaggtatttagtttggaaacgtgaaaatcatatgggtggatttttctttataagtacttataccatataatagaatagattagatattatttttacaattgttgtaaaaattgcatgccaaaaaataactaaattcaccggtgtcacgtatttaaacacaatatataatgatagacatgacgcaaaccagcacacattcaactggaagctctcaaaaacaacagaaatgataagactgctaatcgatgtaaaatttctatagctcagcaatatcaaaacaaattagttcgatacaaacaatgcaactacaaagtcgtgaagtcgaagcctttgaggcattaactttgacagcatgccatagagaccataatactgctatacagcgattagaagctgcgattagaagctatggatcacctttctgctggtcctatagcatctagtccatacggaaatcctacacctcatcttttggccgtcaaacaaatgagaaaatttgagcaaccaaaattttgcctctgacaaagtgccttcttggagtatcagtatcatcccaacaaatcctacggggtgccaaggttcacgctaataatcacaactcatcatgagcttcaggttctaaatcgtcagtcttttgtggttcagactgactctcttcaggggcagctgattccgacgatgtttccgtggattcagcttctttggattcagattccgaagagtcagttttctctttgttagcagactcttcttccttgggaggtttcttttctatcttgggttttggtttaggtatcctattgacactagaaacctgcagacaaagatgaatccccaatgttttgagagcggtgaaacatgtgcatat

SEQ ID NO: 45420 - DNA, 861 bp, Oryza sativa
gtacctgtttgaaataaccacatggttaaattcatgcagtgaaattaaacacatacaaattgccaatggcaatggtgttgagatattatttagaaatagaataaacatatgtactgcagcctcgaagatggaatgttccgcccccaaaaaaatagcagttgaaataaaggtactctatgttcagcttgttataagcagtaccatgacacaaaaaaagtacataagatgatatgcattatgcatgcttacttttcgcttgcatctgtcaggcctgatacagaatactccacaaatttgtgtgatgtaacacctggaggcagttcagaagctttttcatagctgatagaaacatcgaagtctttagtatgtctaatggacctgaacatctgtagacaacaaaacaattgcaagctagattattttttaaaaaaaacttttttttttgcatataatcaaaaggaaacaagaaaggtgcattataaccttaattcccaattttttcatccttggcaccagtaattgatcagtgctttcatctttgacataatctgggccatttatttcaaacacaaaaccataagtagaaccatcaatcatccctaacttacggttcaacttaattccatcacttaagttagctgcatgcagtgaggcacccagaacaattgcttcatctgcatcaagatgcttatccaggtcacttcttcccaggaattcctgcagcttagcctgtaccaggagaatggaattttattacaaaaataacaaggtgaatgatggaagcacaactgtttcagaagtacagttaagtcatctgcatagtaggttaccgtggttaacaaatgcctgggctgcaggaat

SEQ ID NO: 45421 - DNA, 1626 bp, Oryza sativa
aaggtactgaatttggggggatatgacatgattctgggtatggaatggttagaatcattcagtcccatgtggatagattggagaaggaagaggatcagattcacatatatgggagatagggtgtcactaaatggagttaaaccaaacctctcccagaccacaatgctatctgttaagcagttgaagggcttgcataaagatggggcaatatcacagatggtgcaactttgtgcaatagaggaagttcctgatattaagcaagagttaccagcagcagttgagcttgtagtgaaggagtttcaagataggttcaagaaaccaactgagctgcctccacaccgccagtttcaccatcacataccactgcttccaacagctaaatcggttactaagaaaccttataggtatgcccctcagcagaaggatgagatagaacaacaagttgtacagatgctacagcagggaattattcaggccagttctagtccttttgcttcccaatgttgctggtaaagaagaagaatggctcttggaggttttgtgtggattatagggggctcaatgacataacagtaaagaataaatatccaatgccagtggttgatgagttgctagatgaactagcaggggctaaatggttcactaaactggatctaaggtcaggataccatcagataaggttggctgaacaagatgaacataagactgccttcaggactcatcaaggtctatatgagttcagggtgatgccatttgggcttacaaatgcaccagcaacctttcaggggttaatgaacaccatattcactgctgccatcagaaagtttgtgctagtatttgggatgacattctaatctatagcaggactctctctgaacatgtggagcatttgagatgggtgttcactctgctaagacagcatcaactctttatgaaggcaagtaaatgctcttttgcacaacaggaattggagtatctgggccacataattggggtcagaggtgtggctactgatccttagaaactgaaggctgtacaaatgtggcaagttcctaagaatttgaaacaactcaggggattccttggtctggcagggtattatagaaagttcattcaaggttatggcctgatgacaaaacctcttacaaatctgcttaaaaaagaagtcaagtttgtttgggaggaaacccatcagcaagcatttgagtctgtcaagaaggctttaaccacagctccagttctagcacttccagatttctctcaggaatttgtggtggaaattgatgctagtgacaaggggataggggcagtgcttatgcagcaaggtcatccattggctttcattagtaaagcattgggggtcaaagcgcaagccatgtcaacttatgaaaaggaatgtttggcaatattgttggcagtcaataaatggagaccatatttactgcactctgcatttgtgattcaaactgatcacaaaagcctaacacatctgggagagcagcagttgaacacatcaatgcagcataaagcttttgtcaaattaatgggcttgcagtacaagattcgatacaaaaaatgggtagataatcaggtggcagatgctctttccaggaaagtggatgatga

SEQ ID NO: 45422 - DNA, 2158 bp, Oryza sativa
aggtagttgtggaccgtcccatcagaaggtgactcggatggcaactatacaaatctccgtccatttatgaaaagggtgcatgtggtatccccttaagataaaaaaggaggaccttgcccacttagagggaggaggagacttttccagattgggaacctagaacgagggagaggctggctcatactttgtagttccttcatacacaaatccaccaaaacacaggagtagggtattacgcttctgagcggcccgaacctgtatacatcgccggcgtcttgtgtgcttcctgtctcgcgaaccttccacagattgggagcttagagtctcacccagagtccccggccgaaccggcaaaggggggccagcgcggtctcccggtgaggagccccacgctccgtcatctggcgcgccaggtagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctggcgccgcactttctgccggaccggcctcgcgcccggccgtacagcaagacggtgctcaatcacctccctggggaccccgggcatatccgccggtctccatgcgaagacgtcagcgtttgcccgtaggaaagagacgagcgcgtcttcctatttgccgtccagaagaccaccgatccgtgtggtctttgacgggccgtcgcccagggcaacctccttgaccgggacctcattgcacgtgactatccgctgcctcggggcggcgggggtggatgtgccaagcctctcgccgccaccctcgggcttggacacgacggcgaggcggtccgcgcgctgctccatacaagcgagcgcgactttgaggtcgccatggacagagatggggccaccggggcccggcatcttcatctgtaggtaggcgtagtggaccgccgccatgaacttcaccaacgcgggcctcctcaggaccgcgttgtagggcagactgaggtctgccacatcgaagttcacccgctccgtgcggaagttggcgggtccaccgaaggtgaccgggagatcgatgtgacctaacggccacgtgtgccctggcgtcacaccgataatcggctgggatggccggagcatcatccccggggccttgatagcgtcaaaggctgcgggggaaaggatgttgagggccgctcctccatcaatgaggacacgccccagcttcacgttgcaaacagtgggggaaaccaccattgcgatctgtcctccccgggcaacgcatggtgggtggtcggtctggtcgaaggtgagggcaacctccgaccatcgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggccatcatcgccgtcatcgatgtcctcggcgggggccttctgcttggcctcacttcgccgattgccggaaggaaccgccggggacttgccctctcggcgctcctgcctcctctcctcctcccacttcctcgttcgctcagccaaacttttgaccgcacggcagtccacgaggtcgtggagggaggtgttgtggacggtgcaccacttgccggctgggcgctccctgctgggagcgccggcctttttctttttgtcgctcgcaggcctccccttttgggtggcccgcgaagcgccctcgacggcgaggacatgaccctcgtcatcggaatggactgacctcttcttcctcctcctgtcacgccgccctgtctgagcggcggatccaggggcggccgaagctgccacaccggaaccggaggggttccaagtccaggcctcctccttgcgagccactcggtccgcgagctgaaaaagctccgcggtagtctggggctccttggaggcgatcttttcgagcatgcggttgtgccgcatgccccccctgaacgcgtagattaccgcgtgtgcagggatgcatggtatggtgttgcggacttgacag

SEQ ID NO: 45423 - DNA, 2576 bp, Oryza sativa
catgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggtagcacgtcgatcattacgccgccgctcgatgctggtgcgggcgtccggccccccacgcagatcttcccgggttgaaggagtcgacgaaggagtggtggccgaatggcgaacggcagctgccgctcgccgcgcccttcgtcttgacgacgcggagccggtggtagcagcaccagaggccttggtggcggaggaccgcccaccagcatctagacgctgccttgcagtcatgaccaatttggccacatcgtccagccaacgttgggctggagactccgggtcatgggcgacgggcgggtgacgtaggagcgcgcccgcagcttggagcgcgccctggggcgtgctgccgtcaccgtagacgaggaggcgacgctccccatctcgccgtttttctccatcgcccgcaatcggtgaagtcgcggatctttcgaccctctcgagtgcctccccccgcttaggactttggcgtggagggggcggtggagtacgagctcgacggcgtgggttcggctccccgtcgtcaccactcggcagggcggctgttccccgggcccctgtcgcgggacccagaagcacgaccccctcccggggtagattgttccccctgcggctcccgcctgcgccgtcgtggccctttggagctcgctcctctgaggccccgaccgccatcataatggtcaggatggagacgcggtctggatcgctgcagagggggaggattccttggggaatgagggacgcctccacggagttgagattcagcacccgttggaccaatatcttgaagtcctcaggagcccagtcccatctcactccctggtgggtcctcatgaagtcttcggacccggtgtactcccaggcgccccgagcgcgccgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcaaggggggtgtagaaccagtcgctcttccagtcgtcccacttcttgcggagggcgcaggggatgtagcgattcagcaccggctcccgtggctggaagtagcagccaccaactaccgatggcggcgacaccgactgtacggtgaagaaccaccggaacagccgaagagatgggcgcaccccaatgaacatctcgcacagatgcgcgaagatggccaaagtcatcaccgcattgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagatcccggcatgaaacggcgcgccagcccagcctgcctctcgctcacaatgcgggaaggcggcagcacgctaccatcgagcagagcggagccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccagcgctgtgcccggctcctcgcttctcgcgcccactatttcgccccctcgtttctcgcgcccacgcttccactaatcccattcgcccgcttgcggcgcatgaggtggatatgcggttgtggcagtcgagatagatcatatcatgcgtgcgttaattacgctcgccgaccgaagcgacgttaccatatctccagacgaaatgaatcgccatgtccagattcgtgtgctactcgagtaatgtggcagtctcgaagagaccgctcattattgacagccgagttaccactgccgatgtgcgtgatttgtgaccgttgggtttctgcccaattgaggagaccggtcccgcctgtcaccgggccttaggagtggcgtcacgcccaaccgcttcccttaaagagggcgatcgccctggcataacgccgggggctactgtcggtgacatgggatcaggagtatcatgactagaggtttgaggcagacacaatcgcccacgtggcctggcaccctcgggggacgtcgggcccgagggtaatgtgttcgccctcctcttagtccccccgagggggtcggaccgcacccgcctcagccccgagggtcgaggcgccctgacccct

SEQ ID NO: 45424 - DNA, 3990 bp, Oryza sativa
acatttattgcggtttggctgagcgtgtcacgctgcatgtaacgcagtgcagtgcactcatttatccggtctgtgaccagtcacagaccggtcagatcgcgggttaggtggcgacaggcgatctgacgcacacctcgccccatcccgtcaggacgagggcttctaggcgcttgtccccagctggagctagcgtgttacctcccagagatggcacgttagccctggtcaaatatatgccaggcttcatcctaaccattacaggcaagatgttgtgtgaagaaggacgaacatatagattgctaagctgacacgtggtggacaagaatgaccgacatgactggtctgacaccggtcatgtcgtcagcagacagccacgattccacgtcgcatctgctcccggcgaaagtggaggtagttgtggaccgtcccatcagaaggtgactcggacggcaactatacaaatctccgtccatttatgaaaagggtgcatgtggtatccccttaagataaaaaaggaggatcttccccacttagagggaggaggagacttttccagattgggaacctagaacgagggagaggctggctcatactttgtagttccttcatacacaaatccaccaaaacacaggagtagggtattacgcttctgagcggcccgaacctgtatacatcgccggcgtcttgtgtgcttcctgtctcgcgaaccttccacagattgggagcttagagtctcacccagagtccccggccgaaccggcaaaggggggccagcgcggtctcccggtgaggagccccacgctccgtcaatgagcatgatccaaaaactaaacagctcttggaaattctgccccttcagcctaaaggatgtgaccacttccagttggttaatggggtaattcgatacaaaggaagaatatggcttgggcatcataaggaagcacaacaggcagttttgcttgcattacacaacagtggggttggtgggcattctggtgttacagctacctatcagagaatcaaaaatctgtttgcatggacagggttgcaaaaggatgtgcagcaatatgttgctcagtgtactacttgtcagcaggccaaagttgaacactgcaagtctccaggtctgttgcaaccattgccagtccctatgcaagcttggatgactgtcagtatggacttcatagagggactgcctaagtcaggcaaatatgacacaatcatggtagtcgtggacaaattttccaagtttgctaaatttatccctcttgcacacccttttactgcttatacagttgcttaggcatttatccagcaggtgtatgatgtctttgggatgcctcaggttatcatttctgtcagagacaggatttttactagtgctttctagcaggagctgttcaaactagcggatgtcaaacttaacatgagctcttcttaccatccacaaaccgatggacaaactgagcgcttaaccagtgtttggaaggtttcctcagatgcacagttcactttgctccatctaaatggtccagttggctgtcccaggctcaacactggtataacacctcctaccacaatgtgctgaataaatctccatatgaggtcttgtttgccagaaagcctacacattttggccttgtggatgtgggtgcaagtacagtgccggatgtgcagctttggctccaagagagagctcatatgaatgaacttttacatcaacaattactaagggctcaacagaggatgaaaagtcaggctgataagaagcgttctgagaggcaatttgctgttggagatcgagtttatctgaaattgcaaccatttgtacagatgtctgttgcccgaagatcttgtcagaaactgagctttcggtattttggaccgtatacagtgttggaaagggttggcgctgttgcttaccgcttggatttacctgctactagtcagatacatccggtggtgcatgtttccttactcaaggcggcaatcaaaccaggcacccaggtcagttctgatctccctctcaactattctgacgaacaatctaccattcagcctgaagcggttcttcgtcgaagtctgattaaacgtggcaagagtgttgttccctgtgggctgatcaagtggattggcatgcctgaggagctggctacttgggagaacctgcgccaactccggacacgttttcctgatgctactgcttggggtcaagcaggttcttaaggggaagggaattgttagactccaggagtcttttattgcttggcttcactattctatttgggatttgggcctgatggccttgtaaggtggctggtgcgtgagtgaaggcctagttgtgagctgtgtactagctggaacctttatatactttgccgaagcgctggtcgtaggcaacgaataagaaaatacaatatcaccaacctcctctccaagtcaattctccactctgttcttactcagttcctcttttcttcctcccgaattgctcgatccgtgcccagtttggcgtttcgccaagggagatctcactgattcgtgacatgctggcgccgaagaccttgtggactatggtgaacttgtggggttcgtcggccgggaagaagggcgcaaagatgcaatccttggtgcaccgccgccgcagcagcttgcacgacgcgcacggcgacccactgcacatcgtcccaatcctctctatctaatgttcacacacgtataaaacgcttatacgaatgacagtggcggtcagtgacgggccacgtggcggcggcggcggcaacgacaacgtgggagaaggagacgcgcctctgctgtggggatcggctccgacggcggattgctacctctccgcccgctgccgcgctgctccgcccctttggcttcgagcgccgtcgctccacccgccgccacccaatccgcccctttggcttcgcgcgtcgttgctccgccctgctggctttcgccagcctgcgccgtcgccccgccggctttgggcgcatcgccattccgcccgccgtcgccccacttcgccttcctacgccatcaccccactccacccgccgccaccctgccacccccgcttgcttcgcgtgcgtcgccgctccgcccgccgtcgccccgcttcgcctgcctgcgcgccatcagcccgctccgtcgttgctcgcctgctccgccgttcccctcatcgcccaacgctgcggggccgcttcgccgccggtggtgacacaacaccattcgtgaccggccgccgccctcgccttctctcgcgtcgcagccgccgcctcctcctttctcgcctcgccccggcggcctcctccccagcagcgccgctggcttgccagagaagagaagagaagagtgagagagagaggaggaggaagggagaggagaatgaagagggagggtgctgatgtggcatcttgacaatgtggggctgttaacaaccaaatttggtaacatctatgtcaggaaagaagattggatcaaagcaaagttggaggcggagatcgagttcggaaacagagcaggaatcggctgaagtccaaatcggctacgattaggatcagctgggtctgagtcgggttgagtaagccgatacagccgattccgacaatacgaatcgtacgcgacatcgggttcaagttaatgtatttcaagatgattgccacgcacgaatagagtcctgggaaggcaattgtatctattaattagaatattttatgtaaattccttatagataaatgtcggtgacatggggccgggggtatcgtgactagaggcttgggtagccgcggtcacccacatggcctgaccccctcggggggggggggtcgggcccgagggtgacgtggccacccctccctctgtctccccgaggggtcgggccgctcccgtttcggccccgagggctagggcgcccccgtttcggccccgagggctggggcgccccgaccccctgtggttttggcgccacgtgtgtgggttagg

SEQ ID NO: 45425 - DNA, 1454 bp, Oryza sativa
ggagttggtatgtcagtcccggtcagatccattccaggcttcagcgcaagcatggcaaggaagtcgctggccattgaatgaaggttgaaatgggcgtccaccgggaaagctggcgagcggggcaggaggcgtgtgctctgcttgtcagaggtcacttccggctgtagactagccctcattgtaaaaagcatgtttcctttcttaggcagctggaggcccatgtggtgacccctgaccagataaaaaggaggcccaggcctaggagagggagaggagggagaaaaaaacaggagaaaaagaggaagaggggttgggactctggcgaatgggggctagagcctgaactctctctcgctctccggctctctgtattccttcacgcacagatccaccagaacacaggagtagggtgttacgcttctcagcggcccaaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcaataaatataggcaaaagtctgccgcaaagacttgtggtatcttagagtttgatagagataatagtcgtgtccggtatgggcatatcttgtaattctcaggtataaatagaccccgagccttatgtaattaacaacacacgttcaatacaatcttggcgcatcgccacccttttgctttagttttgtttcgacgagttcttgctttcgggttgagctgcattggtttcgatcttcaacaagaggtaaaactcgttatgacggattatgtttttacgattagtgcttccatctttatgatactctaatcttatttatataattcgtcgagttatcatatatcttatataatctctagcaatatcgccacctaatctactatcggctaacatctgtacgcagagggcagctgattgggttagatcttgatgttgatctagattataagagatatctaccattctatgaaacttctagcggcttgattgtctagatatcgttattcttttcatacttaatgttgtatcagttgagtttgacctattgagtcgtgcttagaataccgatctatagcctgccttctagttgccgattagaatagcgtcagagtttcagccgatcttatctgatttacttatatttgttctatatgcttcattgacatgttaaatctgccctctatatcaagatattgttgtgtctaagtatattaggctcttgttcagtatattattcttactttaatatcctgatatagagtagtatcggagtattagccgatacatgctagatctatctgatcggctatgctataaacatatatagtcctgttattgatatatatttcgatctaagtgatttatactgtctcggcatg

SEQ ID NO: 45426 - DNA, 3660 bp, Oryza sativa
tcggtagaactaattttaactcggtggagtgtacatctccaccagaccaccaccttggttcgagttgtttaatactttgatccaatttgtgtgctttttatctgttttgttaataagaaatgtagttttcctacatgttttaattttcatctttgttccaattatttacttaaaaaatcaataattcaaattattgctgatgttgcttaccaatctccccagtattaattaaaaggtgtgtcatgtaatcacaaaatgaaagggggcttgtctatttgtattcagaggtaaagataaacgacacaggtacacaaatttaaaccacagctgatgccattatgagctgtcgttgaattgttattgcatggttgacaggtttttaagttgctctcttgatgtccagcaggtgaagcaaggtaatttctcaagtgatgccttggacataaacatgtcaagctgtcaactcttcttagttgagaggcagtacctgacatttaactcaagaagaagagaagcaatttgtattagagaactacaaaacctgctgaatttctgggctatggtacattcatgttctcgtaccaaggtttgcagtcactttacttagaacttacctctactaaaatctgcttcacttactagaagaagtcgtttcgctgactggccgaaccgtgcttgtcggggtttgagtggcactattttcttagagatagtaacagctatgcatgaactcatacaattgacgcccccatgtgccgtagtgtattgatgcctgtgcagttggccttcccgtatgtgtgtactcgaactgttaagtggatagtaaaatgcacagcttcagggtaaataggtgtaaaaaatagtgtgtgacagacttgacaatgctagtgctattgtggttacccagcatacttgctagaaaagggtgtgtttagttcacgccaaaattagaagtttggttgaaattaaaacgatgtgatggaaacgttgaaagtttatgtgtgtaggaaagttttgatgtgatggaaaagttggaagtttgaagaaaaaatttgtaactaaacaaggccttaggaaaatggataatcattcgtcatgatcatatacgtcagatttgcaatttttattgtagcttgctgacgcaggatttgccggccagagcagtgaaaggcacctccaggtccggactccagatgagagctacctcgaaagataatgcctatccagcaggcttcgcagaagggtccatgcgaaggaatttccctaatccagacactttaggtaaccggtcacatcaaactcaaaaactacatttgggctgagtttagatccaaactttttcttcaaacgtccaacttatccatcacatcaaaactttcctacacgtacaaacttccaacttttccgtcacatcattccaatttcaaccaaactttcaattttgatatgaactaaacacacccttggtctagtcatatgatgttgtatatctatgtactaatacatgacagtgattgaactagtataagaagtctacaaggcacgtatgttctctgtacttgagcatgtagatgcgcatacatctgaaagaaaacacataataagggagattgagggaggggcttctaaattctcgaaggaacattccgtcgttatttatatatcattcaaatggttgaaaaaaaataaaaaaaattcaaccaaatagattaatatgagatagatcactccacaaatatgcaagttaaaattcaacttctacatgttgaaaaaaaaatagaaaacactatggctagttaacgtgttttcacagtcaaatttgtttttttcgttacaacttgtgaaagttaaatttgaccctacatatttgtggagtgatttatcacatattaatctatcttattaatttttttttaatttttttataatcatttagatgacatgtaaataataagggatatcgccttgagaatttataatagtttcccgggagattgatcagggtgtacattgcttgctcattgggcaaaaccctgtttgaaatttgagaaagagatagagagatgatcacaagggtttgactttgaccagggatagaggaaggcgcaacgctgggagcaaatgaaaattgaccattgaccggccgatcggtatgacgagagattagcccgttccttctgcacagagacaaaaacatcactggagccacaccagcacatgttctaaccttcaggattccaattttttaatgtggaggtaatagccattcgcctgcaggtaatcacttttttttttctgtgcaagcttctgttatatgagtatgttttcgccgggtgttttatgagtatgtttgctttttttttcttttttctctctcattgtttttttagaaccaacagtaccagtgttgaaattgatcttgtttatttcgtttgggagaaacctgttagctgtgtttgagacatctgaattttgtgtactctgaaattgatatatgccttgacatttactattttatttcccattgacagattatacagtgacatgccgagcaacaaaccggcctactatttttcttctttccggatggagtcacgatcgctgttgcacggacattttgtctatgacgcggtaagagggagggaaaaaaaacagtacatattatggacgtttgcgttgcagccttgcagttgcgggttagcccgttccttctgcacagagacaaaaacatcactggagccacaccagcacatgttctaaccttcaggattccaattttttaatgtggaggtaatagccattcgcctgcaggtaatcacttttttttttctgtgcaagcttctgttatatgagtatgttttcgccgggtgttttatgagtatgtttgctttttttttcttttttctctctcattgtttttttagaaccaacagtaccagtgttgaaattgatcttgtttatttcgtttgggagaaacctgttagctgtgtttgagacatctgaattttgtgtactctgaaattgatatatgccttgacatttactattttatttcccattgacagattatacagtgacatgccgagcaacaaaccggcctactatttttcttctttccggatggagtcacgatcgctgttgcacggacattttgtctatgacgcggtaagagggagggaaaaaaaacagtacatattatggacgtttgcgttgcagccttgcagttgcgggttagttggatcagtaggaaggtcagagagtttctgcaagcagagaatcagatctggggaatggaatggcgcgagcaaggaagcaaccaaccgtccacttccatttataagtcgcggctcgcgagctagcaaaccccccttgctacatcaccaacccccacccttttctccatttcgtggccaactcctccgcagacctgcccttccgtatgggccttcccggccgtcgccaccgcggcgccatggccggccgcgccctcgtcgtgctgctgtggtgcgtgtccgcctccgtgttcctcccctccgcccgcgcgcagaccaccaccttcaccagcgccatcgacggcaagaaggcgaccaccttctccttccccacgttcgacaagtccctgatgcagctcggcgccaacctgaccttctccagcaacgc

SEQ ID NO: 45427 - DNA, 1748 bp, Oryza sativa
gctggcgtttgtcatcgcgtccaccaacgccatcaacccgccgccgggcagctacggcgagtatcttggtctcaccaacgcctccaccgacggcaacgccaccaacgggttcgcggccgtggagctggacagcgtgaagcagccctacgacatcgacgacaaccacgtcggcctcgacatcaacggcgtccgctccaacgcctccgcctccctcacccccttcggcatccagctcgcgcccagcaacaccaccactgacgacggcaactacttcgtctgggtcgactacaatggcacgtcgcggcacgtgtgggtgtacatggccaagaacgacaccagaaagccctcgaccccggtgctcgacgcgccgctggacctctccaccgtcctccgcggcaacaagggctacttcggcttctcggcgtccaccggcgagacgtacgagctcaactgcgtgctcatgtggaacatgaccgtcgagatgctccccgacgagggcgccaccaagaagaaggcggccctgcccggatggaagctcggggtggtcgtcggcgtgtcatcctgcgccgtcgccgtggtgctcgggctgttcgccgcgctgtacatccggaagaggaggaagaggatcggggacgacccgagctccgtgttcaacaccaccattgatttcaggagcatcccgggtgtgccaagggagttcgattacagggagctaaggagagggaccaacaacttcgacgagaagatgaagctcgggcagggcggctacggcgtggtctaccgcgccaccgtcgttggggagaacggccagaacatggaggtcgccgtgaagcagttctccggtgccaacaccaaggggcaggaggatttcctcgccgagctcagcatcatcaaccgcctccggcaccgtaatctcgtcaagctcgtcggtaagctctactacttttctgaacattcaaatcttagctcgatattgtttatgtttttgttcgatgcatgatagtatctttttgtgatttagtgattaagaatagctgagtaggacattgatgccgccctgatgaactgctaatttcgtgatgaaatatttcctcaagaacatcaccttaataaatgccaacccaaatcgccagattatcttttgatttgatttgatttgaaatattttcgcttttattgaaatggatgctccgataagtttagactttgtactttgtacttgttattagaccgcgtagatgttgtctactcgtgccaatttttaactgttacattctcagcaacaatttccttcgtacggttgcgtgaaaatgaaagcttccgagttccgagccgtcggaaatttcagtagccgtctgagaatagacaaaagtaagcaatttttcatacccacaatcacatgaaaacgatacaccacgacaacgattactgcctttatctcaagaaaagtagcagataaaattctaagataattacacacaacagatgtactagtagatatttttagcagctcagcacgccacatggcaacttggcacctaagttcaaaattaaacactgaccagttcccaccgattaccgagcggattggatcatggccaatacaggttggatcaaggcaaaggtttgacatcgttttgtcgcttgcattgttgttcggagaaaaatatttggtacggagtagttgtagaacggtctgtataccttgcaacactaattaagccttttttttaaggaaatcctattaa

SEQ ID NO: 45428 - DNA, 1730 bp, Oryza sativa
  unsure (1)..(1730): unsure at all n locations
tggggcagggcgggtacggcgtggtgtaccgcgccaccgtggtcggggaagatggccggagcacggacgtcgccgtgaagcagttctccggtgcaaacaccaaggggaaggaggatttcctcgccgagctcagaattatcaactgcctccgtcatcgcaatctcgtcaagatcgtcggtaagcgatcatttctcgttctggttaaccgaaaaggatacttagtttagattgaagttgtgattagagtattagattgggtacggtttgtctaataatttggagtaggaaataatattctgagatggcacacaagttggcacggcaaatagatgttttaagaagctcaccacgctatgtggcaacttgggccacttggcagctaaatttaaaattgaatcatcagtccatgacgtctttgcaagcagattgaatcataagatagatattggagtgctctggttgacaatatgataatgcaagatttgatcttttgcttgcattgtgttagaagaaatatagcgttcgttagttggaacttggaacagccatgcaaatgcacatctctctctatatatatatatagtttaattagctgccaattcaccataagaggagacattcatatcccaaaacaaacaccgtacgttcagtcttcatttttcaaatttcaaaatgatacgaaattctgtaagcaagttctaaacacattttggacgacatgcacgtctgcaggttggtgccgccaaaatggcaggctgttgctagtgtacgactacatgccgaacggcagcctggacaggcacatcttcggcgagccgggcgcggcggcgctggactggaagcagcgctacaacgtcgtcgccggcgtcgcgtcggcgctgaactacctccaccacgagtacgaccagatggtgatccaccgcgacatcaagccgtccaacatcatgctcgactccgccttcaacgcgcggctcggcgacttcggcctcgcccgcgcgctcgagtccgacaagacgtcgtacaccgacatcatcggcgtcccggggacgctggggtacatcgcgccggagtgcttccacaccggccgcgcgacgcgggagtcggacgtgttcggcttcggcgccgtcatcctggagatcgtctgcggccgccgcatctcctgcagcaaccccgccgggtgcagccagctgctggaggccgtctggaagctccacggcgcggcgggcggcggcggcngcngcggccgcatcctcgaggccgtcgaccagaggctcgccggcgagttcgacgaggccgaggccgagcggctcctgctgctgggcctcgcgtgcagccacccgaaccccggggagcggccgaggacgcaaaccgtcctgcagatcctgacgggcgccgcccccccgccgcacgttccgccgtcgaagccggcgttcatgtggcccgcgatgcccgtcgcgctcgatggcgacgacgacgacgagacgtcgcgcagcagcacggtgatgaactcgtcgtcgtcgtactacgtgtcctcgtcgggttggacccagaactaccaggtcagcaaggagcacgaggtggcggacagggacgtggcgacggtgtgaccgtagacgagtccacggcccacacgtgcggccgggacccgacccatcgcatcggatttggcacgttaccgtggagttggtgacaacgttgagaacaaagatgggacgggggctgcaggaatt

SEQ ID NO: 45429 - DNA, 7477 bp, Oryza sativa
  unsure (1)..(7477): unsure at all n locations
taaatacaatctagtggtgtacggcggtgagtgtagtttatgcgagtagtagctgtatttgtcacgtcagaatttttttttcccatggtgcgcaagagggaggggaaaacacttgcttattgttccaagctttgcagccaccttagtactaccatactggagtattgcgagaaaggaaggtcttggagcacgttttcaaagatgctttcttattttaatggttcaaacatttcggttggggttatcgacttggattatatcaacaatactagtgtactggaaacgtggttgtgaatttatggtgctcttatcatccaaactagctgggtggtccgctcaattgcgcggctagcacctaaacaaaatcatatactttttagtatgatttaacttaaaatttattaaatagctatctcattgtcttaagactttgaaagaccaaaccttatcatcatcgtgtttctaattatatagtttttaaaagtcacaccagttgctaccccttatgtcatctcattatttatttgcttgctcgatctaccactatttctattcattcttcttggaacctttaaaaattggattttatagtttttagagtttattgtcacgttgggtttcatttttataatttctagatatcccgtcaaacgttgctattatactcctttacggcccgtccactgtctcttctctttattgttattgagattttaaaaataaaaaataattattgtttgggtttatttttactttctagaagtcctgccaaaccgttagcggctttgccattatactcatctatggctcgctcgctgccttccttctttattgtcattgagattttaaaatcgaacatgattatcattgggtttttttttactttttagaagttccgaacctttaaaaattttgtagttttattttttttataatttttagaagtcccatcatacgatgccactatgcccctctacagcccgtccaccgcctactctttattgtcattgtgattctaaaaatcgaacataactatcgttggaattcattttttattttctagaagtcccatcggcgacggctctgcaactatactcttatacaccctgtccactgcttctcctttttattatcattgagattttaaaaatcgaatatgattatcaatggggcctggtttttttttactttctagaagtctcggcaaccgccttattcgtttgcttcacggcatgcatgacgtccctccttttaatcgtcattaagattctatttgatgttttattaataatttttatatgtcgtatcaaccgccaccactctactcctttataggcatgttacttaatttatcttgtcatgtgttttagatggtattttctttcaataatctttatttttataataaattttagttatttataaattgtattcctaattgaaatcttttttttctaattttagatttcttttgctaatttttgatttatttattttgattctgaattttaattaatctcgtattgggttttatacggactcttcttttaatattccttatttttaaatccgaaattcagttatttttaaattgtattcccacttagactctcattttcttttctaattttggattttattttatttttatttctaattttgattaatctcgtattgggttcttatatggaaacttctttcaatattgcttatttgtaattccgaatttcagctatttttaaattgtatttctacttggactctcctttccttttctaattttggattttattttacttttattttgaattttgattaatctcgtattgggttcttatatggaaatttctttcaatattgcttatttttaattctgaattttaactatttttaaattgtatttctacttggactctcctttccttttctaattttggatttattgggttcctatatggacacttctttccatattgtttttggactctcctttccttttctaattttggattttattttatttttatttcgaattttgattaatgccgtattggcttcttatatggactcctctttccatattgcttatttctaatttcgaatttaagttatttttagattgtacttctatttggactctccttttctttttttatttctctccgattaatgtgggaatttctagctgggtggcccgcgcaactgcgcggctagcttccattcaaaattatttttttacacacatttttctttaaaatttactaaatagtcatctcgttatcttacatattttgaaaatgaaccttatcatcatcattttatagtagtaattcttaaaagtaacactaatcggcaccccacactccttagcctcccctttattttcttatcatgtttatcacgacttctattcatcaccctttggaacctttaaaaacatgtctcgtcaggctttctttttcatagtttttagaagtcctatcaaacttaaccactatactcctttacggcatacccattgtactcctcttaattatcattgggattataaaaattaaacttgattatcattagtttcttttttttactttttagaagtcttatcaaccatcgcgacaatactccttcacagccaccctgtcgcccctcctcttaatcgtcattaggattctaaaaattgaatctaatcatcatttaggtgttgtttcatagtattagatgtcccatcaattgttatcatcctacccctttacggcttgcttgatatcccgttccgtatagtcattttccataatgtcccattctttatcgtcatttgccaccctttatcatagatagactttttttaatattctttattttctattttgtatatgtgctatttataaattatattattactcttattttcttttttcttattcctatttttatttttattttttattccaaattttaattaattttgtgctcctattttctacatggactttttaaattattttttattccaaattttaattgtctccctagttgaactaatatttttatttttataattactgaatttatttatttttatattgaattatacttaatctcgtgtttatgttcgagatggtcttttattttaatattatttattatttattctgaaatttagtttttttatagattttatttctacttgaactcttatttctccttttccattttcgaattgattgtattctttttcctaattttaattaatcttgtattgtattatacatggactatctttaattttaaactcttatattttctctgatcaatgtcaaaatttctagcttccacatacgaagggcctcatcttttcgtttatccttatacttatctgccaaaatttaaattttcaacctttatatatatatatatatataagttttattcacaaattacttttcgtttgcaaatatgccgcgaaacgatggctctggaaatttctgaattgtaatagctaggtggtcctcacattatgctgctagaagccatataaaattatctaacttttttacgcatgattttctttaagttttgttaatcgttgtcttaggatttgaaaaaatcgattatgttttccagccgtgtatgttgagcatcgaacagactccgtgcgtgtgctcaccacaactaacggttgatacatatatacatgcatgtggtttctagttgccaacttgagatttaagctgatcgtctgattttgataaatgcaaaccaagttggtttgcttttcccgttccagaattaatgccgattggtttttttaccataaatggttactttatcgnnnnnnnnnnnnnnnnnnnnnatatgatgctagttagggttaacaacctgacacctataatgcctcgagttataggtgacgattgttagcttcaatgcctcgcgagcacgacctcgagtaggaaattcgctatagactgggtaatgcgagatggaaatctaaacctgctatgtcttaatgatgtaaatattttagtgtttcaataatattttgagtcaacgatttatttagggatacaaagggagtaaatgtttgtagttgtatatatacatgcaaggctataatttacatgcaatgagcaatccagatgatactgaatccaatataaatggtacccaggctacataaacatgtatgggtcaacagcttgctagtttgctccatcgcttgtttcatttgtaggtccactggtatgttatgacatgcatgagaatgcttatgtggacagcacatgtacggcagcatgttaatccggctgcaaacatatatgcaatccaactctgcttcggcttgttttatccgattcattctacagcaaaagtgtggggatatttgctgtgtatgattatttctctaactctttatccgtttgtagaaagacagtaatatttctatatattcatagctcaacctgaaccattataatctagacccactacgatctaacggtgtagatatttctttttttcttcgattaatgtgggaatttctagcctccacgatgaacgtgatgtcttcttttcgagctgtcttaataatataatatatagatccgtgaaggttgtcgcagtcccgttggctactgccagaaaagaattctcctgtaaagctgcatttgcatgttacttgtcatagaatttcttttttttccattttttttaagaataggctggagatttacctaagaatatattaaggccatctggatcccctggcttcaagaagcttgggcaagttgctatgtgccgctgtgtaagactgtaaggttattctccctgcagaacaatctgaaaaaaagacttgttcagaattctttgggtgctcaagtgcaaagttagggcctgttcactttgatgccaaaaaaaaaaccttaccaaattttggcattaccaaaattttgacaggatttcttatatagttaccaaaatttggcagcaaactaaatgtagccacttttttggcaactttactaaaatttgataaggttaaaaatgacatcaaagtgaacaggcccttatttttcggagccttataagggcccaattcaccatgatggcccaataaaactatcggtgctgtgcaccccaggcccgccatctctctgggctcctttcttgtcgcgaaatttgtattgggcccaaatcaccattatggctcaaatcaccattacggcccaattcatcttctcttcgcctgctgcccaaaactgtatgtaggccacccagtcgacagccatctgggcttctttacaggctaataattacagcccaacgccctcgccgtcgtcagaggccgaaaggccatcccgatgttcgccgtcgagtagatcacggcttccctatgtacttctatagtctctattcatcctcaacacaactacacaagcgacggcggcgcggtgtagtcgtgagttgtgacgcagccggtgcgccatgcgactttggttggcatcgtcgaagcattttggttggcatcgcgtcctcaggtgcgagtgtgtgacagttgttccgcagcgcgctcatgcccactactgtgaaacgtgaatgccctgcgcccctgcctgctgatcacctgccgcacagtgcccgcactccggtatttcgcgatcgcggtggtagcctgtgcaaaggcagcgagcagcagtactactactcactttgctatagcaaatatagcgcccagtcgtaataacactacactgtaaaaagtcttcctggctaaagaaaacagtaaaaaaattactccctccgttccataatataagggattttaagtttttacttacaacgtttaaccactcgtcttattcaatttttttttttgcaatataaaaagcgaaaagttgtgcttaaagtgctgtagataataaagtaagtcacaaataaaataaataataatttcaaaaaatattgaataagacgagtggtcaaacgttgcaagcaaaaacttaaaatctcttgtattatagaacggagggagtatgtactagtaggccgtgtttagttccccaaattcctaacttttcatcacattacatcacatcaaaaactttactacacatataaactaccaattttttctccaaactaacaactttcttccagcctctcaactttttcagctctaaacatagccgtagtatcgatgatttgttccctttcctcgatcctgggctggctggacccgaccgctgataccgtaaatcgggacgaaacacgaggcgagctgaccaacgagtatggccatgctttcgctttgcagcacgcagagccaagagaaaggcgacccaccaacgggaggactggcccgcgccgcacacgcacacccaaaccccacatcgtgtcgcggagctcgccgtcacggtcacgtgtcgcgagacgccaaccgctgccagttaccgttggttcagctggccccgccgccccgtcgcgccccgcgcggccggcgatgtctcactacgcgcgccagcaacgttaccacctcccttcatgtgcgcctgcatgtacagtagagattgcgtggctcaaattatacagatgggccgaggcgtctcccggtcgtgtcgcgatccgccgcgcggcgcgcgcgcgcgtcgggctggttccacgtactactactgtactccctctatactcgtaaagaaagttattttggacagcgacacagtcttcaaagcataaatttaacttcttatttatataaaaatatttattgaaaagtggtatatgtatatttttataaaaatatttttcaagacaaatttttacattttcaaactcaacaacttgagttattcatgatttatattcctaaagtttaatttaaacattgttctaaacgattttcttacttagtattagggagtactccggtgtttatcatcggcacgcttgcgtcgctgcctggtacagtcggcgtttgtcgtgacagctaacgcctcgcgggttcgcgtggcgctcttcccagcttgaagacaaaggtttggctctcttcgctttcttcttctgtctttcgtggggtatcgacgcgcaaagccgcaaacggcgcaaatggtgtggttggtggtacgtacattcgcttcttgccccagcagattactccaccaggtgcgactatactactactgctgctacctcgtgatattacttttctatgccaaatatgcgttacctgtcttattccattgttggttttgatttgaatgactgtgccgcagattgcgtaatctgatgggcctgaacccttatgttactcgtgttacatgatagctctttcaccaaagaatccagccaattcatgctaaaaggtttgagtatggaggagtcggtgttgctggtgggttacggattatcaaaggaaccaacttggaaccttggactgaaaaacggggttatgcttgttcacgtgtgtgagttgatgatcgct

SEQ ID NO: 45430 - DNA, 13521 bp, Oryza sativa
ggattgttctgaatctgtcacgggcaaacattggccctccctttccggcacattgaccttccatcaacggactgtgacattctagttgcgaaattagatttggaatgtgtttgctttcattggatgatacgtcttcgtcgacatggacgcataacccaccgtatttctcagacccgagttacgttcaagtttccctgtgaggctgttgtcagttgctgaaacaaccgttcttctgtgaagcgacgatggaaaaacatgttatcgtgccgatttaatccagtagtgagattaaaaacctttttcgatacttgcatcgatctgacttcgaagatgggtggtgttgtatggagacattcaagaacgcgaagcgatctcgttgccatcatcaaccggggcaaattcgattcggttacggcaagcagacgatacagcctgcccgcgcgaaagcagatgttagatcgaaatactgacagttcagatacaaatcgccaaggacgcacgtcgccagaaattacctcccccgagctcgaactgccatctcgggctctcagcatccaacagagagaaaagaaaaggcaaaaaaaaataaagaaaactgccgcctcgtaatcatagagtagtgttcctacctggaagtttaatcaccgttagtgctgatgcggttgggcacaaccacacggaaagcaagcatctataatagacttgtagagttctatagtgcagaattaagaatatacattggattagcatatgcatcgttagaaatgtggggtactaatacttccgaaaatcataaaggagaaagtcgaaagtattgaggggccctctgttggaaaggtgtgaccttgatggggacgatgaactgttggcgtgcacgatacaggtgtaaggctgcaagcagaggggagcgcggccggagagccagcgaggaaggccgggaaaattagaccgacgagatgacgatcttcttcagacggatagagagaaagagaaaggaatacgagaaccgcaatttcgctgacacgtcgaattctagaactgctcggccgctttgttggagcacgccgtattatttatcctggatcagaacagaacaaaagtgcagtgctgtgacgatcaacgagctgctggtgaagctctgcgctgacacgttgatgcagcggagcacggcctttggagctgcatggcatgcagtgcatgcattgcccagtggtgtctcggatgcgtcaccgatgcactgcccccataccatcatatctatcctaaacaacacaacaaatcttgggcaactttgcaacacggcctctgcctacgagatcggcgacgacgcgatcaccggccgccggtacgacgggctgaacgaacctggctggcatcctaatcttttcgcgttcccattccccggccgttttcttggtgtttgcattgcaccgccaggcgggcggggggccgcactacggttggtgggacgcgcattgcgggtacgtgatgcagtaaacgcggcaggagcgaccaccacggctaccggtggccataactcacaccaggaaaggagaaggcaacctgccttgactgttgctccgctgcctcgccgcgcggctcggcccggcccccatatcccgtttctgccatttcccatcacaattcacacccccacggcgaggagtccagaagcgtcccttctcctctcctctccacgccgtctagtctcgtctcgtctcgccgaccgacccatccatccatcgatcgatcgatcgctggattgagggttcagttcacgcgcgacaccagcagcctgcctcatcaccttccgctcccgtccccttccgcctctcgcatcatcgccttctacattctccgcgcccctcttgaggcgtgataccttggccttctctgcccgccgatctgcctcgccacgcggttcgtcgtgctgctgcggggcggcgtccggcggagagggggcgcgcggcggggtgtaggtagctatgaagaacggggcgaggaaagacgcgggcggcggcggcggcggagtgttcgtcccgtgcgtcgacatcaagtcgttcgtgctctcgctcgccttcctcacggtgttcgtcgcattgtggcagctccagccgtacggctcgttgctcaccgcggcgcgctccaccgcctctgtctcggcctcgccatgttccctcatcgccacgcccgccgccgccgccgcgagcgcaggcgtcatccggtcggagaactccaccgccgacacggccaagaccgcgccggccgccgttgctagcgcagtccccgcgcggttggctagggcggcgaggccggcgcgggtggaggaccccaacaagcgtgagctccggccgtacggcagcgcggcggcgctgttcgttcagatgggcgcgtaccgcggcgggccgcggacgttcgccatcgtgggattagcgtccaagcccacccatgtgttcagcaacccctacttcaaatgcgagtggctgcccaaccccaccgccggcaacccgtcgccgcgccccgtccgcaccaaggcgtacaagatgctcccggactgggggtacggccgcgtctacaccgtcgtcgtcgtcaactgcaccttcccatccaaccccaacgccgacaacgccggcggcaagctgctcgtccacgcctactactccaccacctcccgccgctacgagcgcttcgtggcgctcgaggaggccccgggctcgtacgacgagtcccgcttcagcccgccgttcccgtacgactacctctactgcggctcgtcgctgtacggcaacctcagcgccagccgcatgcgggagtgggtggcctaccacgcgcacttcttcgggccgaggtcgcacttcgtcttccacgacgccggcggcatcagcccggaggtgaaggcggtgctggatccgtgggtccgcgccggccggctcacggtgcaggacatccgggcgcaggcggagtacgacggctactactacaaccagttcttggtggtgaacgactgcctgcaccggtacaggcacgccgccaattggaccttcttcttcgacgtcgatgagtacatttacctgcccaatgggcagacgctcgaccaggtgctcggcaagctctcgggatactcgcagttcaccatcgagcagaatcccatgtccagcaagctctgcgtgcaggatccaagcaaggattactcaaggtttgtctttttgattcctcgcatgttctaattttggtcctcttcttgcatacctactcccattttatatcgaagaaattccatatctgctattttgtttttcagatttagggggtgcttgaatgtaggatatttgagtacttttgcgtgaattagagcaaatgctgtgaaaattttgcaattttttttgttatagccgttcagtatatcagttttaggctgcagggtgcattctgctgggttcggtagcatttttcttttgggtagtttgttgtctgccatggaatgtgcattgtgttgattaatctatcagacattctagacgaggttaagtaagtcagcggttacttatttgtgcaatttgttgatcagttgggcaatgagctgtagtataatatagtagtagtatttcaacttgcaagtccagactgcagacgttgattgactggtatgttcaagtgtgtaaccatgtcttgtattgtattctgatttctgactggtatgttccttcaagttaactttgcataggcttcggttagttcggtacaaaagatccaattttcttttaagagttggtttgaggtactccatctttattcattgggatgagtaggtgatggacataagtcatcgcaattcatcatctttgccaacataggctgtgtttagatccagggtgaaaagttttggcgtgtcatatcggatatacagacatatatatttgaagtattaaacgtagactaataacaaaacaaattacagattccgcctgtaaactgcgagatgaatttattaagcctaattaatccgtcattagcaaatgtttactgtagcaccacattgtcgaatcatggagcaattaggcttaaaagatctcgcaatttacacacaatctgtgtaattagttattttttttcgtttatatttaatactctatacatgtgtccaaatattcgatgtgagatggtgaaaaattttgccaggggatctaaacaggcccataattgtaggaaactgcaaactaattaaggtcactaaaggaacacaactaatgtctggccaggaaaaagggatgcaattaatgaaattaattgatgtctaaaaactctcaccatgctttgctgaataatactgtatagatttccatgtattacatgaaagtgaaactatctatgtgcaagaaacttctttacggaatattcagagcatcatctattattattatgtaacccctgctaacaaatttgacttcacaactactccctccgtttcacaatataagtcattctagcatttcccacattcatattgatgtctatatatatatatatatatatatatatatatatatatatatatatatatatatatatatatatatatatatatatatatataattttctatagatgctctttctatctgcattcttgatctttgggcaagtcattgcctgtacaagtgctgttgtgaatgttggcgcctgtaaaaggcccaatttttacacaacaaagggctcatgactgttggttcctgaaaaaaaagaccttttttaacaccaaaaggttgaatttttatgctctatcatgcttttatgtctgtttgcaaggaaacaattatagtaactgtttagattggtaggtttgacactgtttgatgctaaaacatattacgtgtgccgttcatatgcagggaatggggttttgagaagcttgtcttccgcaattcaattaccaaagttaggcgagatcgcaaatatgcgatccaggcccgaaacgcatactctgccggcgtacacatgtcacagaatgtctacgggaggacaacccataagacagaaagcctgatcagatactaccactatcacaattcgatcaatgtcatgggagagccttgtcgggaatttgtgccggtgccggtcaatggtagtaagttgatgttcgaggggatcccttacgtatacgatgataacatgaagcgtttggctgggcagatcaagcggtttgagaaggaagcaattggatctgctcatacataggcacatagcaactgaactactgaagactgccggtacataactacagtctacatatatacctgatgatattgtttaggatgcctggttgagagttgagacgggctcacgcttctgctgttgcaagccaccgtgtctggctggtaagcagagggaagagcttgcaagtgggttggtccaagtggtgtaaagttttggttctttttattgacatgccattctctacaggagcactgctgtttttgctccattttctcctttctcttttctccttacccccacatctgttattatagatctgtgtaaactgtaaacttatggccctgcctttttacagtagattctttgatagatctccctccggggttacatgcagtgtttgttgttttgtgtgtaaatctggattgcacattactcttctgtactatccattaggccatcagcaatgggtaccttcgacccgtcccctcacaaacggccgtttccctcccgtcctcttttcggcgtgagccgtctccccagctaggagcgcgtctactccttgggagacgcggctctatgcaaggagcgctcgcttttcgcggagagccggccctcgcccctgcgaggagacccgctgcgaactcccgtctcctcaccgctccccccaaatccccttcctaccctcgccccctcgcctctctcccgcggcggcgcccactcgtcgatccgctccaccggccgccatcgaccgacgggcggggaggtccgcgacggcaggcaggagctcggcggccttgaagaggaggagggcgagccagtcgtcggcgaggcggcgctgggcggaggtgccgggggcggcagagtcgagggcggagtcgatgtgggagaagagggtgtgggagatggcgatgtggatgaggaagaggaggtagagcgggaggatgaaggtggcggcgatgcgggcgaagagagggcggtcggcgacgatgatgatgagcttcgtcggcgacggctggagggagagaggggagcgggaggagggcgaccggcgctgacctcgccggcgagccgccgccgtcgctgcccgaggccagatccggcaagcccaggccggatctggccacctcgccgccactccgacgacgacgaccctgcggtgttctaccttcgcggccggtcggcgcggctcaacttccccgaggagatctccttgctggcttcgccgtcagagggtggcggcgcaggcgagccccgcgagcccgacggcggcacgctgtccgcggcctcgatccggaagaaggccatgaggtcggctcccatgtcgacgcgctccagaccggcatgatggtcgcgccgacccaccaccgcgagcagcagaagcaccaccaccacccgcacctgcaaccgcacggcgaggagcaacaccaccacgaggattggattagttctaagtatgaagacattcatacttaaaaatctcttgttgatctcttcctctcgcccctgtcttggttggattagttgccatattagagtaagcactaatccatccatacttcttgctcgatcttgatttcgcgtggttaagtaagtcgtattagcctttcaggttaaggaggttgttaaggtttttaagtaagaacctcctgtagcttacttactagtttgtgatgcttgctgtattttcttctagttcttggcttggtcttaaggagtttttgtttgattgtataagctgttttcttagataatggatcgtataagttgttggatggatcagcaagtattaggcctggtccttccttccttgtgtactactattactcccatgtagtactatgtttggttcagttaagcatttttgtgtgtaaactgtgtttgaactctgctttttgatgatgtggaattggaatttgggggagacactgagcgagagagagaacggtcgtcgccgacgccgtgtggtgtgattggtgtcgaattgaaacggcaacgaacgaacccacaggtacggttgggctcgtctcgatcggaattgactagagggttccagggtatttcgggaatttgccacctggggctactgtggactaggacacccactgtggcctgagtacccccacccggttgctttggattttgaagccactgctcagggagataatacatcgtgaggttgttctctatagccactctatgagtgccctcagccactgctcagggggataatacatcgtgaggttgtactctatagccactctatgagtgccctcctcggttaatgaggacactcttctagtagtggctcacattgctgatgcccttagcagtgtgcttctcttctagtagcttgtctggtgagcacttggaacgcaagcaaacatacagtaggctgctactattctgcattgaatactgttgtgctgaatctggaaatgacaaagctgaggtactctctccatcctaaaaaaagacaaactctggttttccgtgttcaactttgactatccgttttatataaattttttttataattcatatttttattgatgttagatgataaaacatgataaatattttatgcgtgacttgtctttttattttttttataatttttttaaataagacggcggttaaatattgggtacggaaactagggtgtctttttttttttggacggagggagtaggcgttttgcacaagtgtagtgcatatgtgtgtggcttcacttacctttgatgagctagctggccttgtgcatgccgagattggctaggcaataagtaggcatttttggggatgtctccaacttttccattagccactatgattggagcatggcctgagatcggacggatataaggtggtgtttagaaaggagggactaaagttcctccaccaccttaagagcaggtacatcaatagactatttcataaaaaagctagctataagtgtattttaagaagataaaagagaaagagaaaagcagcgtgctataaatttatagccagctacagcacggactttaagatataagatacatatgtgtatgataggtaggactagatattaactgtgtagtatatatttataagtaactattgtataaattgactataaatgatttaaagacagtagttggctatactattaaacttgttctaatgagagagcaacaggggggacaggctaaatgataacgcgtgatggctaggcggctccacgtggtcacacgctctacaatggcttttgtgtctggtccaagtaacaacagctgcttaagagcatcgccaacaacatcttcaaattaagctctccaaatactgatatagccaactctctaactgatttgggtagtcaaactaggtattcactccaacaacctctctatttacatctccaaaataaaaaaaagacccactgtcagtctccgttgccttcttcttcctcctctttctctttctcctgcatctgcagcccatcgatggcggcttcccgcgcgcgtgggcagcgacgaggcgggcggcaacggctgcggcggctccccgtgcgcgcgaggagggcgacaacggctgtggcggctccccgtgcgcgcgaggagggcgtgcgcgtgaggcgggcggcgacgatccactgcgatttaggcaaagagaaagatggtaggagtggtgggacccatggatagccagctgaaatgactctccacatttggccagtgactgctatgatttggccagccatatggcttagccaaccaaatatagagactgttggagggtattttttcttcatactctccaaattttagcttggagagccatttggctattctcttagagatgctctaacctagatgcggcaaacgttcagccccatcgtttcgtggaataagcgaaatagcatatttacaaatggaaagtaatttgtgaataaaacttttttatacgtgttcatagcgatctaaaagcaaaggctgaaaaaaatccgataaagaaaatctcaaaatcagtttcaaatttaagattgaaaattcaaaatctgcctaataagcaaaagaatgagcttcagagattttttttttttgtcggtcgggctacgatgaccctttcattatagggttaattagatacatgccattaaaaattcaccggttttgaaatataccattactatttgcgtatttggaacgatgccattgatatttgtttgtaatttcagtagtgccactaagacacgtattttgcatgtattggacaaaaatgccctcatcttctacctctctccctcttctctcatcttcaagctctctctccccgctgcttcaactccggcgccgtcaccgccgctgctgctgccgctgccgcgccgttgctgctcgacgccgctgctgctcgccgctcgtgctgctgctcgctgccgctccgcgtgctgctgccgccgcaccgccgctgccgctcaccgatgccgtcgctccaccgccgctgccgctgctgccgttgttactcgccgccgctccgcacgctgccgccgccgctccgccgctgccgccgccgctccgctgctgccgcccgctccgccactgccgctcgctccatcgctgctgctcgccgctcgctgctaccgccgctgccgctgctgccgttgctgccgccgctgccgctcgccgctcgctccgacgctgccgctgctgccgctcgctccgccgccgcctgttctctgagctgtggaagaaaggagaggggagaaaaagaagcaaaaaagggtaatttggtccaaattttttcgtaaacggtaggtagtggcatatcttgaatatgtgtaaaattgtaatggcatagttccaaatacacgaatactgatggtatatttcaaaactgataaatttttaatggtatgtatctaattaacccttcattatatggtagattaagggtaccttacacaagcatagattagatagaacataactagacctgcaggagcaagcatttatttgcataacagggcattagcttgttcgtatgcacggcctgctataactcgctaatgctttggttcccaggcactaccttaaacattaaaagtataacaccatagcttagtacataaatatcctgggcggctgatgattcatggggacttaaagaggactttatcagcactccccacaatcaccgaaccccgtgagtaaggtacgccctcaaaaagcttggccataggcactactttccaggcctgtagctctgaaatctttccatcaggcctctcacagtgcggtgagctggaccggtgctacacggtgccagcaaggcttttcgcgtgcatggcagatggatgcacgccctagctaagcccctcgcctccaagcaaagccgcgcggaacatggacggcgcgaggagcgcgcaacaccgaaatccccaggcacgcgcgctgtgggcagcgtcgcctcacacgcgcgtgccctagcgccgtgaaatcccagaatcgccctcccaaaatccactcccgccgcagcttccgccacaacactagcgctcccgccacagccactcttcctccggccaccaagtcaagaaaatgcacgaaaaaattcgggattggaagagaagaactcaaagaagacggattcaacaaaacaaatcgagacgtatgtacaccacatgatgaaaaagaaaaaaaaatccgccagatccgccgccgaccaccgcatcagagtcatcttgctgccaaggggagctcggggagaaggagggaggcgtggagcggcgacgtcccccatggcggcgctggaggaggcagggcctcgcgccgacgaccgccgcgtccgccagatccgccaccttggccgggtcgtcgccgagcccgtccacctccttcctggccgcggcccttcgccgccgcctcgaatcgctcgccgctccagggccttgcgccgacgaccgccgcgtctgccagatccgccgccaacaccgccttgcccgggtcatcgccaaggcaacctgtcgtccacccccccgccacggaggatgccgaggtgctgtcggccacggccgcctcatccggcgccgcatccacagacggagccgaggccgcggacgaggaggacgagcggcgagtgcggcggagtgggaagagaagcggagctggcgccggacggggaggacaagcggcgggtacggcggtgcgatgagaggagccggaggggatggaatggataggatcgaatgggcggagtgggaggggaagggtaggtggaggaaattatttcttccactcgcccatgctaaccgcacccaggtcacgcgcactgtaggagtagttgccttgtatagcgtctccatccaattaaggccctgtttgtttcagcttttgattcttataatttagattattaagccagattactataagttggattataataagctggcatagaataagttgtgagttgtttgtttgtctggattattgaaggcatagattattgggtctgaaaggctaaagtctataatgccctcagctatctgttcagttaatgatataggtgggtaatttttctcaagtatgtagaggtagtgggtctttagccactcaataatctgaaaaaagctcctctagagcagcttatcagattataataatctgacttatagattataataatctgctataataatctacttgtttgtttaagcttactcctaataagttagattataataatcctaaactgaatcaaacagggcttaagccacacatatatgggtgcttacactctggggtgagtgtttttgggccaactttttaggctaagggtacgggacccatagcttgcaatgtgagaggcctcagtgaacttgattattccaagtctgcgggacagaccatctctgatagcttccttgttagctctgtccacaaggagcacactgcacacgtctcttgaaggtttcgaagcgctgaaccatctcggcatggtcacgctcctggttgaaagccttgcaccactgcttatacaaggcccacagggcatcatctgaaacaaggtccttctcttctgccacaaagatcaccctaccttcgccgtcgacgtggcaggaaacgcccctaggctaaacgcataggcctaggcaaaattaggcccaaaatccctacagaatgtagactgatcatccggcccattataccaaacgtagccataatccacatggatcatacagaaactacgatccgttttggcccaacacgtttagattagcctgaaattttcatcagaggcctaatccgaaggagatccgacgaaaatatccccccctccggttcgcgtgacctcggttggtggtctccccttctaaaatctcgccgagtccacaagcgcatttaccagcagctccactcccatccatccccgcgaccctcgctgatctcaccaccaccccgacccacccgcaccgccccaccatcacatcgcccgcgtgagattgctacccaaaaatcctcacctccgacgacgaattgaggaggaggggagagagagctcaaaaaccctaggaggaggtttgaggggccagatcgatggagagccccgcgaaggaggaggcgggaggggagctggcgatggagatcgagtccaccgtcacggcggaggactggcgccgggcgctggcactcgtggtgccctccgtcgtcgtcctccgcaccaccgcgccgcgggccttcgacaccgaggtcgccggcgccagctacgccaccggcttcgtcgtcgacaagtccaggggcatcatcctcaccaaccgacacgtcgtcaagccaggtaggggcccgcccgatcccgcccgtttccctccccgggagtttccgtgtgatttgtgcattgactcgtgtgctactggtttgatgctgctgtcgctgtgttcgcagggcctgtcgtcgcggaggcgatgttcgtgaacagggaggagatccccgtgtatcccctgtacagagatcctgtaagtgtttgctttcatttcatttcatttcatttctgttctattctattttgttctccctgtgctaatggcataatgttaatccaaaatttttccccctcttctcgaaacaggtacatgattttggtttttttcgctatgatccaggtgctatcaagttccttaagtatgatgagatcccgctagcacctgaagcagcatctgttggtctggaaatccgggttgtcggcaatgacagcggcgaaaaggttacgtaaaaactagattaacctctttcctagttgatattgtgaactatcatataatgagcaatgt

SEQ ID NO: 45431 - DNA, 3742 bp, Oryza sativa
acttccaacttttccatcacatcaaaactttcctacacacataaacttccaacttttccgtcgcatcgttccaatttcaaccaaactttcaattttagcgcgaactaaacacacccattgttgagaagcacaatgtagagctcacaaagcaaatgttctgtacatcgtacagttcattgtgggctctattatcacatgatgcagtttggcatttcagcaacagcaagcgaactgtctcttcttgcatctaataaaggctaaaatgatacaattcattgaaacctctatgttccacacatgtagttcactgaaaactatataatcaaatggtacagtttggcatttcagcaagtgaactgtctcctctttcctgtaatattgtgtggtctgtagtgcttataagattttagcatatagggaaaaagacaatgcatacaacatcctattacgggcctttaatcaatatttgttgattcaggagacatctcttcaactagttggctcagaaactgtagatatgtgccaatcaatggtatagatcaaaacatttcacatattaggctggaaagaggcactggaacaaattattttacttcctatttaagtgtggtaattcagattctgttgtgtcctatgtgacatgctttgacgggacaatgatttgtactaacactagatagtgatgcattaatatgtatatacattttctggacctagatgtggaggttaatcacttaatcctttacattccatgggtacacatcagcataataacttcaaaaattatccgatagattgtgtttcatactgcaacggtttctgattttcattcaccgaatgcaggtgtcaattttggcgggaacacttgctcgacttgatagagaagcaccttactacaagaagtatgtctcctttctagttaccataacggcccattacattagtgctattttcttttctcatgattacccctggatctattgttggacatagggatcaaatatatagtacaaaattcatttgttggctactgaacttagaaaatagtaataaaatatagggagatacatatcatagaggatcagagatcatagtttacttgctatgcgaactttatttagtttcagtaagtgaagatacatatggagaaagcggattaaatctcaacctttcgcttcatttttctccaagccttttcaatccaccgaacttgggcaaaaaagactttgtagttcgtattcactctatattctctacccacccaaatggagcagcttgccaccaccagcttctactagataatactatatgattaataatttttatgtgcagccttgctgcatataatcttacgtttaaccttttttttttgacagggatgggtacaacgatttcaacacattctacatgcaggtacttttctcgggctactcaatattacatccatactctcgttctcttctgacttgtcagttgggacattaatacacaccttttaaccattacttatctgaatgatgtgctcatacaatatcgatattaaaatataatgatacccattttaaaaataatgacattaaagtagttctcgtgacaaatatactcttataattttttgcatgacatatttgaatatttttatgtatataataatggccaaaatttctaagtctgactgtatgcattctagaatgaaatctatttgagaatagtatatgtttaattcaaattggtgatgttcatgcatcttctgaaatatcgggcatgttttagtttgatgccgaaaccagccttatcaaattttgttaatgccacaccttatttatttatttttttgggtaaggtaggtatgtggtggtacgtttagtttgaaacctcatctatttgggtgtgatgttaggtcaggaagtttattagctaccaaatattggtatggaaaggtaggtatggttggtttgttgccttgctaaaatttggtaaggttagaaatggtagcaaaccaagcatgcccattatccgtgattttgtcttatagttcaattgcttttatccaatagaggttcactaattttccttttactctctctgtcattttaatgtaatcatatgtttctataggctgcatctggtaccaaaggtggctctagtggttcccctgttgttgattgtcaaggaagagctgtcgccctgaatgctggaagtaaatcttccagtgcttctgcgtttttccttccattagaacgtgtaagttgtttacaaaatgttcattgaaactagctaaatgcatgtgctttgctacggataaaagaaaacgtattaatgtgttacccatcttttttgctatagggaatattcatcttactctaatttaatgtggctatccatttagatttgatattttttaatattaagaagttcagggattaacttgcaaaatttacaatgggagtaggtggggtgacagattcattgccaccaccactaccttcttttaaaggagtatagatatactacttttagccaggaagcttatgcttttgttctaaaattgcaaggtctcttatttaataagaccaacgaagtggtcctgctagttgaaattgatacgagtcataaaagcacacatgcaattaggttaacatctatactagacatcacaagaagagagagagagagatagaaagaaaaatataatttggcattgaccgacatccgagttcatacaaaaaggaatagcattgctgtttaatattgattaattgtaaggtctcttattgacaggaacaacgaagtggtcctgctagttcaaaatgatgtcattataaagcgcacatgcaattaggctaactttaacatctatactagattagctggcttaatgattttcatcaggtaaaagtatggtatgaagtatcctattatgcactagacatcacaaggagagagagagagaacttatagtttggcactttggcattgaccaaaatccgagatcatacaaataggaatgccattgctgtttaatatttattgattgcccgtggcacccttatgtttattatattgtttgtccaaactgtttccaggttgttagggcacttaatctgatacgtgacagttgggaagcttttggtagcaagcctgaatctgattacattcctcgtggtacacttcaggtgagcatgctgtctgatgatcccattgttctattttttttaccaagacctgctgtgtcattagatgtttatttctattacggtggagctactgaagatgtatggtgaacaagtaaacattttagcacttaattgttcttctttctttgtatgtcagtgataaagtttgtgaatttgcaatgatcagcaccacaagtgtacagagtgctgcagcagccattgtatagtcaattttgctcctctgactgctgtacttttattacagcgatagttaaaaagcacaatctgtccatgagattattagagttaacaaaggctattactcttgtttgtgttgccatttctacctattcttgttgcccccctcctgccagtccttagatcatttcccttttcccttgtttttaaggtgacctttcaacacaaaggatttgaagaaactcggcgtcttggactcaggaatgaaacagaacaggtatttttgtgcatcattgctggtttgctattggctagaatttccaccctctttgcaatttgaatgacatcagtcagcatcagaaaatagt

SEQ ID NO: 45432 - DNA, 1508 bp, Oryza sativa
atagcggaatgtgtaagcattagtcatgataggcgattgctccttatactcgcgtgcaacatgttcctctttgcgttcgatccttcaagttagaggttagtttttacggcacgtaaaataacacgagtcattaacacatgaataactaactattaattattataaatttaggaaatggaattatttgatttttgtgaaaaaaagcacaaaatatatcgtttacagtttgaagatgagaaagctacacgttcaagtttctgaaaagaacggtgtcttagtgctggtcgacactggaccttaaacttcacattacactgtcacactgccttttctgtggcttgcaacgtgagagcaaactttagcaatacatggatcaaacctgtgggagcaaatctgacatctgtggcttgcaacgtgagagcttccatgcttatatattacttaccccagcaatacatggatcaaacctgaccattgtagaccatgcaaatgttaatggagccaattggttctctgtattttgttaggcaaatctgcaatcggagaagtcatgaacttccaaaggatgctaatgtgctttccgaagaagggcatgaaccttcggcataacccaatcggaagttgctggtcccagtctgtcttggtctctttgttcagtcatggtctctcttggactcttggagaagaagagttatgtacaatgtatgtggcaggtggcacgattggcaagtccgcaagtgggagaagtcgacaaccactggaccaattccttcccgcgaatacccccttgactgtacatcagtacatcaccaactccatctccctttacttatgcatcgccaactccactgctccatgttgcttctgcgccgtctccgccgtgccgccatggccgtgctcatgctagtgtggtgcgtgtccgttttcttgctcctcccatctgccaccgcgcaggccaccaccttcaccagcaacgtcgacggcaaggagttcaccacattctccttccccaagttcgacaagcccctgttgcagctccccgacaacctgaccttctcaggcaacgccaccatcgcccaggacgggttgcagctcaccccggacagcggcaacaggcccgagatattcctcgtcaaccaggccggccacgccttcttcaccgccccgttcgtcgtctgggaatccaagtcgtcgtcgtcgtcgtccaactccgccgccgctgccgccgatggaaagtacgtcgcctcgttctccaccgtgttcaaggttaacctgttccgctcgaacctgaacaagacggtcaagggcgaggggctcgcgttcgtcgtcgcgtcgagcaacgcccgcgggccgccggtcggtagccacggcgggttcctcggcctcaccaacgcctccaccgacggcaacgccaccaacgggttcgtggccgtggagctggacacagtgaagcagcgctacgacatcgacgacaaccacgtcggcctcgacgtcaacggcgtccgatc

SEQ ID NO: 45433 - DNA, 827 bp, Oryza sativa
attcctgcagcccacaacgagtagctacttcagcaatgtgtatatgcactagtgaagcttatttatgaacatgtacgtggtagtacagagctacagatgattaaggcgcacctaaataatcttgctctctgttatactgtcttaggaactcagcatgcctatctttctccatctgcagaatttgttgcatccttccataataaccagatctgccacagagatacataaaacaaataaatgtgaacaaccagagatatttaagtgatcattcggaagataattatcaggacggttatacccatatgatctcacgggcagtgtaaaacagtccatgcttgttgcattaaatacttgttgaaatatgtcagccatagtttgccccttgacatctttgttgatcaaagccaggttgttttgagcatcgtcctattgcaggataaacatatcattttgaagatcataatagagtaagtatttatatcattggttatgttaacaacctacttcctcctcgctagatgtttcaccaattacatgctccaagggattctcggtctcaagattcctctgacctagaagtgcaagtgttctcttcacagaagtagggacctttggcttttcttccttaggtctggtgtgttgatgcaactgcgttgagataatatttagagacaagctaatcgttgtctaagaactccaaataacaaaatagcgcaactaaacactaaccaaaaatggtgtcccagcagaggaggcacttctatcctgtaaactgtcaagaagttcagaaattgaaacatttgctttcttggttgaacaagcaaact

SEQ ID NO: 45434 - DNA, 2345 bp, Oryza sativa
taattctctttgcacttccttcagtcggtacacgtcgttcccagaagaaactacgagtgtgcatttcttgccacaatgtacggcaatctaaccatagagtaaacttcctacttactgataaattatgacacttccttgtcaccatttatcagaacctggaaagttggaaagaaactagagaactttggagtgtgctcagctccatttgcatgacggtggagatggttttgtcagattcaagatgggttcttcttttatcagtctcaagttggatttgatagagttagctgaaagtgtgtttccctattacagccgatggagaaaaccacaaggccaatgccacaaaactgggtgtcatagagcaaattttacctagtagaaatgggagaggatccctctctttctcaaacaaaccaaaaagaaaatccttgtcaccaggatgtcatgttcatttcccaacgccacatcatgtcgaaagggagaacaaaactcaaagaaaacactggaatttctacgcaagaaacgcatgcaaaagaaaaacattaggagagtcaagtttaatttaccaaactaccttaccaaatatgtcactacattgtacacctagctttgagccaatgctttgcaacttttactgatgctatgcgcataatgttcctatagttgcagttgcaaccagaaaatcaccatcaaccgctactcagctacttgggggcaaaatgttagcttttcttcccctgttatatttaaccacaaagaagaggtaaaaatacctagtgcgccttccattttctaagtaggtgatcgtggatatgtcctttataaaccttcatcagacattgcttcagctttgacattgtggaagagctcaacttgatacatcgatcaatcatgtcttctgcatatttacatgcctcgggtaacctctcatcctttagctttgatacgagcatgttcccactctcctccaatggtggaagcccattctccaccatgcatttccacaacttgatccctgaatcccagtctcgtgtatccaagaacatacgaagcgcgagcgaacaatttgcctcattgggccagaactcgttcttgaccatctcactaaatattgccgacgcctcccggagtttcctccccttcagcaagaactggaaaaccatattgtatgtgtccgcatctggaaacactccatcaaaggtcatctcatcaaggtactcaacaatcacctcaggatgcccaagagtgccctgcagcatgatcattgtgctatacatttccttatctgggatgagtccccgccttacgacaaagtcgttccagagcaccaccgcgccgcgcaattcacgcgccttgaggtgtgcggccagtgcggcgcggaagaacttctccccaggtgagcacctctgccggtgcaagatagcaagatagtccatcgcatccattaacgctgtggaggaaccacttgaaatcagtgtagtgaggaaagaatcataggcaggaacattggcaggatcgaatccgatgacgtgccgcatctcgtcgaacacctcgcgtgcaacgtgagggtcgccggcagcctcgcagccctccagaaggatggcgtaggagtcggcgtcggggcgggtgccggcctcggcgcgcgccacggggatcgcggcgcgggcgtcgtccaggcgggaggcgcggcagagcgcggagaggagggagttgagcgccggcgtgtcgcggtccatgccgtacatcggcagctccacgaacgccctgagtggggagctggccgggttggccgccagggaggagaacacggaggcgaaggtggccagggagagcaggccctgggtccgcatggaggagacggtgtcccacatgggctcgaacaggcggttcttgccgaggaggtcgacgacgaggttccacgagtagggggagtgctggtggcggaggtgccggtgccccgcccatcggaagaaggcgacggcggcgcgcgggtgggcgtaggagaaccggagcacctgctcgacgtcggaggaggtgacgcggacgtcggcgtcgtcgagcgccgcgtcgacgtcgggtgccgaggacgccaggatctcgcataggagacggatcttcgggggcaggtcgggggcgtccctgtaggtggggaacgccggcgcggacgggtcgcgggcgcgcttcgccgccggcgaggcggcggcgaccgagtcggacggccgctttggccgctggtcaggcatcgccgccgccgccgccgcgccggggacacgagggctagtggtggaattgggggaggagagaggtggccaaagtccagaggtggggtttttgccctatcccaa

SEQ ID NO: 45435 - DNA, 2908 bp, Oryza sativa
ggaggccgagggggctcgcccacacgcgcggccggagaccccggaatcccaatcggatcgcgaggaaagccactgagagagtgtggatggctccctccttgctcgcctcggcggcgagccaaatcctcgccgctccccgccggggaggccgcggccggcggcgtctggtcatcgcctgctccgccggtgccggtgctcctcccaagctggtgactttcctcgggaagggcggctccgggaagaccaccgcggccgccgtcgccgctcaggtgaaaactttctctccatcgattgcgttcgtcgttatcttgatggaaaattgtactagtttggtgtgagctcgctgtacattacttagatttattgtagtatcatttatcgatcattagccgggatgctccatgaattgaaccgagtacaatgtagcatgacattaggtaaaattaaatggcgagttcatattgccgaaatactgaatatgttctgatggttgtatcaattcctggttagttggttcatgaaagaattgcctttaacttgttcttttccacgttttagtattatgcaagtgaaggcttgaagacatgcttggtcatacagtcccaagatcccaccgcagagcaattgatgggttgtaagatcggtaactcgctgaccgagtgcgctgccaatctttccaccatgaagctggagactagtaaagtaaactactatcttgaaagtgatatcctctatgttttagctatagttatatcataaactggaatgatattctgattcatgatgctgaagaatgttgtatggttacattgtagatgctgcttgaaccccttgaccggctaaagaaagtggactcgcagatcaatcttactcaaggagtccttgaggcggtaggcaatttaactttgctgtattatgggacatgaggataaagcagtcatttggattgatgatttttcatgggataggttgtaggggaggagcttggagtcttacccggaatggactcggtctgttcagtgttagctcttcagaagctgcttaacttcttttcaactcaaaggaatagttcacaagaggaatttgatgtggtagtgtatgattgcaacaatacagaggaaattctacggctaattggtgctactgagagagcaaggtataggttttccttgctccaacttcaccttagcttcccacaggagatagtctctaaacttaatgctggtgctacacaaaagacaggtcttacttgaggtatgtgaaggatctagcagaaaagactgacataggaagactggcttctccttccgcgatgagactaatatacgattctgcaaggccaaatggtaaaactagtgaaggaagactgagttcagagttatggaatgatattgaacaacttattcaggttaattttcccgatttagttcttttgtgcagcaacctagtagatatgtgttcaactagttagctgaaatctgcttttttttttcttttagagaatatcggtttggtttgccgatccctcaaaatttgcatgcttcctcatcatggaccctagaagatcaatctctgtatcttctgcattgcgatactggggatgtacaactcaagctggtggaaatatatgtggagcatttggttataccgaacagcgtttcgaaattcaccaaggagttgcagagaagtttttgccgatgactttctcgtttctgccatttctgccaactgattcttcagcagattggagcagagtgctgaattctttgagccaaaatgcaaaagatttactgaggaatacaagcaacaaagtatacccttcagttagttttgattctgttcagaaatcggtgacccttttcatgccgggctttgataagtctgaaatcaaactatatcaagtaaggcagttaccagtactctttcttgattcaaaggagcacatcatctcagtactactcatctctattggctgttttcgacaatctgttgttttgtctgaaaaatgcagtatagaggtggatcagaactactgatagaagccggcgaccagaggcgcgtcgtaaagctgccgccggcgatgcagggcaaagttggtggcgccaagttcgtcgacaggaacctcattgttaccatccggtagcagtgcggaccagcagttgtgtaaaatctgtcagaagagacccaaactgttataataaatcggtaagttaagtcttatttagacgtactgggtctgatcgtatggcaatattcgttatttctttgttgcaaaatgtgtaaaaagagcaagatttttgcagtgtcatttacagaaaacggaataaatcagcaccaataatctgtcaaatctcccaattagcacaaattccttcagttccatgcctacagagttgccgtctgcatgcctgcgtggaatcatctgagccgtcgataacacggatctattgatccctctgcatcgctgtgttcccctaacccgttttcttcccctgcgaagaacacgctgaagaaaacgcgagaaactaccagaaaaatcgcgtgttcgcgcgctcctccctgcgagtctgcaaacacttcccgcatccggatgcaaccagacggggagaaaaaccgcaaaggaaatgtccgtacacgcgttctcgatcattctcgcgcgccaccgtgctcgcatctataaaaatgatgacgaacactcgtgcatgccaagtcggagtgaactcgcaagattcacgcgaagaagcttaggagaacatcaacaatgtctttggtgctctcgcggatgctgctcgacaggttcttccccggcgccggcggcgtcgtcgccggtgaagcccggccgccgatggactggagggagacgccggtggcgcacgtgttcgagatggacctccccgggctggccaag

SEQ ID NO: 45436 - DNA, 10059 bp, Oryza sativa
acgcggcggcggacgaggcgagcgcgcggatggcggacggggtgctcacggtgaccgtgccgaagcggaagggcaagaagcggcacgccggcaacggcaaggcggccggcgacgacaagccagtgtgctgccgcttctggccgtgacaccgccgaggccgcggcgcgcgccggctcgtgtgcccgcgtcgcgtcgcgttgagtcacccgcacgacacgagcctgtagtagtacatgtcaagcctacccgtcaaaaatcttgtcctttcgccattggaattgccgtgccagtatggcgcatgagtgcacttgtacaaaatataaattgggcctgtttagttccaaagtttttttctaaacttctaactttccatcgcatcaaacctttcatacacacataacttttcaatcacatcgtttcaatttcaatcaatttttcaaacttcagcgtgaactagacacagcctaggtgaaaatggcgatctctgcatttctgtgtgcttgtggcagtgaactcagcgcatatggtttggtttgcgacttgtgacagtgactagtatcccctactgcctcctctgacaacctgattaattattccagatttttcttgttaacgagatgattttgtgcgtgaaatgttagttaggtagcggctcattcaattaacgtggttcgcgttgtcgtacgggcgcgcgagagcgagacgggacggttgccgcgcgacgcgatgcgcgatccctcctcacggcggcgttggccggggtgggtggtggcgccgtcgttttccgggggaattatttgctcctcgcaacgctatccggccgcataaagtcgccgcataaccactgttcgctggtactgacctagcaggcaggcaactaggcaagccatttcatctgttcctcgtggaccattttcgtggcattatcaggttcaggtatttggccattttcgctaggaaaatactagaagagcggtaaactactactccaaccttgcaagacgtaaaaaaaaaaaatcttgtgtcgcactgtagcctcctaggcgagtagaaaaatatttaatgtaaatctgaaaactaccatataatataaaaatgaacatttgagatttgtttaagagcactcataatgccttacatctattttcatattctacaataattttcaagttttcattataataggtggaccctgtgtgttgatgcgggagtttagtatgataacactgagtaaaaataatgtgtaagatagctagatactataaacttacgtaaattgatatggtttatgataattcaaattcaaatagtatgtagaatgatgattcaaatgaaaagtaagggcatgtttggcttgcaggtacaacagctgcctgtagccagtcgtggccggccgctgcttttttttttgtgcttgcttcactgttcctacatgctgcagtgttgctgcagctgaacagaccctaagttgatgtggctttacgagagaagaaaatgagggagatagtttggatcatagattaatcatctaagggctaaaaacaattgaggtgatatgatttaatgagagagagagagcacattttaactaagttaggagttaggatgaactatataagtatatgatattataaaaatgatcaagagacattgaaatattatgcgaattatgtgagatgatgatttaacaagcttgcatttgaaaagctataaaatttaataaattataaataatataatatgcttgcatgatgtttaaatataataattgttaatggatgatgatgtggtatcttttcatgttatgctttaggatttagtggactttatagtaagagaggataggttgtttccgctgcataattttccgagttatgttgggattaagatcctctaacttacttctctctaactgatgtcattgatatgtgggccctctatatagtaggctcatatgtcagtgactcaaagttagagagaagtaagtcaagaggatcctcttccgttatgttgtacagagctcagaggtgggaaggcataagcttttttttaaaaaaaaaacgagaacggcaagagcattgccgattatattccgattatattagagggaaaaaaggcataagcttttttgagagtgctgtaaaattaattataattgagcatgctggggaaaattaattgtgggtctaggatgttggagagtttgcttgtgcacgttggatcataacaaacatttggaaacgcataatgagtagttccacccgaattgttctgtcaaccaattctttccgtttaagtcaatccctcctatattttgtaggaaaagcgatgggacttgagctgccccctctgttcaatgatcagtgcacaactgcgcagcaactgggatctcaataatggtacaagatgaaaattgacagtaaacttattcaagtcaggttgtcctctgtttgatttgtgtgcagaaccgaagttctgagccacgttaccaagaaaaatgatatggtggacaaacttgataaagtgatacgcatgctaatgtagaggactacatccgacatgggttgaccatgatctcgcaaacaaacaacgaacaaggaatggaacaatggtattggtagttgatagtctataaagaaaataatctagtccaacttgctagatacaaccttctactgttctacatactagcacgagacaaaccactgcatgcaccaaccaccaaacactgatccatttcaaccatcatgtccttgccaaccctggataagttctctgaaaattcgtttactaacttcaatttcttaatttgctaagagtagtagtactacctaagaaacaaggtgcaaaaaatacgacaaaaacaaagacatgaaaaggtagccggatagtaaatgctaatgaacaactactagatgatcaaagatattcagagaatcagagtgatgaccgtaaaaagaggtgccaacttctgaagagcatcaagctaagcttccataaactcttttacatggtactgatactgatcagtgatcactaatcactacgcacaccaaaggaagtaaaataaaaaaaaaaagaagaagaagaacagatcatcagaagcagagacctattactatgtcgcaggaaagcagaggaaggcggctggctaagctttggctccaaaagttcagagatttgctgcaagcctgcgagagagcgggtgtacgtgtcgatctccggctagtagccgccgccgccgccggcgttggccgcgagcttgatggacgacggcagcgggctgcgcagcggcgagcgcggcggcggcggctgctccaggcgccgcccctcggcgtcgtagtagatcacgccggagaagtccagcggctggcaccgctcccccatcagtatctccttcctccacaccccgtcctccgcgcggaagctcagctccgccccggccttcctcctcctcctcgacgacgagatagccttcttcccgccgcctccgccgcccaggaacggcacgatggcgcgcgacgagaacgacgccgcgatccctcccgcggccgcaggtgcagccgccgcgccgcccgcgacagccgcctcgcgcacgtccccatcagcgccgccaccgcctgcgcgatgctcatccccatcgccgccgccgccgcctcctcctcctctcctcctcgcgctcttgcttcctcttcgagaccttgatggctagcttagcttctcttctcttctctcgcgcgcttctgcgtctccttctgcgctagctcgccattcccgcgggtatttgtagctggcgagctggtcggacaagtcaaacaaagccggttgggacggtgtaattaattaataataataatcacttaatcaccctgttcatgcttgactgatgcggttagatgacctgcttagctagctcgattggattaatttaatctttttattcgctaatggatggctgtggccatacctaggtggtgagtaaccttgtgtccctgaactacacgtacttgcgagcttgtttaatgaagtgaaaatgatggatttgtgcaattgtgtgcttgtggctgatgaatttacatgtcaaatttggccgttttgactggtgcgtgttggtggcagttgaattaaattaaaacctaagccgcgcgtaaccttgttgattgagatttgagcttggagacggttggggattaagagagataattaaggatccatggtagcctgctaggggttgtgttggcttggctctgtactgcaaagtgcagacaatgaaggggtattaaaggagatggctaatcagaatcttccaaatatcatcgtggtactatatagacctatagagagcatacacttgggaagaaggtaatgtgtcagtatttggtactagtacatgattacgaataagtgtatccataatcccactttgcctgttcataattaaaatccataatcgagtattccctccgtccaaaaataacccattcctaacatccaagataaaaatagtgaagcgtgagaataaccaaaatgctattaatcattgaaaaaagtagtaagagtgataggtagttaaaagctattgaaagagataaagtttctcgttttacatgccgtgggtagattggatggtataagttagttttttgtgagataaaatttaaaatctagaaattgagttttttttagacggaggagtaatcctatatatctgtaaaatttatccccactaaatatagttaatgataattctctcttctctcatgaagccacatcaccttaattgtttttagcctttggatgattcatcgagggtgtataatgtatctcttcacatcacctcaattgtttttagtctttggatgatttagcaggagtgtaaattacacatcttcatcctaaaggcacaccatacaacctaatcatttataacctttgtataattgataaagttacaaaaatatataaacatgcacataaaaaaatagtatagtaggtaagaaagaaaattttagaactcatatatactatattatcacacaattcttccacaagaacgcgcggggtacccatctagttatatatacaactctgaccgaagtgaaggagtcggtcaagttgatcgaaatcatcggctcgatcaaatgctcaataaacaagtgctaccagtcaattggagcgaaattaaaaataaatcagtgtgcacacacctgctgctacatctacaagcataatcatatcggctaaacagaattgaaagaatcaatcatgacacgctcatcatgattcgtgcataagctaatccagacagttgtacgtgcaccgataatcctccctcatgtcgatcgacagatctactcctacctaccaacaacgtcagatcgattagctccccgagtgcgcctgtgcactggccgtcgtacgacgagtattcgaccatccgagctagtagccgccgctgctgctgctgcgactgtgtgcgacgtacgggtgttggatgcgcgtggttggggcggccggaaaagcgcgatcgatcgagagatcatccagtggcgttgcgaattgcgatgcacgccgctagctgcatgcgtcgtgcgagtgcgccacatcgcggcgggccgcgggggcgggggcgcacgagaaaatgctcgtcgtttgctgtccatttcgaagccccggccggtaaagttggccaacatggtcagcacatgttggcgtttccgtggtggagggttgatctagcccactaacgctagctagcaagcttatcgcgttcagaattcgggtcgtggcaaaagtttcccttccactgctccatggtcatttgaagataaataaaaatctttggggttgttttttttgccggaatgaccgaaggaggtcattcaatgtaattaagataggaagaaaatattacaagaaaagttttacatcgacagctgactgtcgaggaaggatgtgcaccagagcacacgccccgaaccaagtgccaaccgcccaaacacacactatagacaggaaagccaagcaccgaaccggccatcgctatgcgagaccgattgccacctggccaacaacaccactacgatacgaagactcaaaaacgacgccctcacgaaggtcgcgatgccgaagacgccgtcgtcatccgtccaaagaactggactaggttttcgtccagagctccttgccgagggaggagggatacctcaacaatgcccccaggagggttaccacgcccgaagacatagtcattgttggcacaaagacttgggctaagctttcgctcgggatccctaccgccgtggtccgtcgcccaatctgaatccaccatctaaacatcggcggcacatggcttccaccacacccgaccggcgcccctccgtcggtcagctttcagtcctgccaatgacaagactgccaccacaccgcaccgacgccccgccgtcggccgacttcctcgaaccaccatccctgagagctggtccaggacccctccgttccaccacccgccggcctcctcgccagatctggccgaaggagaacccgggactaggtagcattgcttcggcagcctgagcttccccactgacaagcggccgcctcaatccagcctaaaaactcctcgcaaagagggggatgagctctagaaagggtgagggtgccgatcggcaacgaggaagatgacccaccgccgccagttccctttgcaccatctaggcctgcgccgacaccggaaatgcagccgcacgccgccgccactccaggctggccgcacgccttcctcggacgagcctcacgcgcgtgccagcctctgttgcggcctccactgcggcctcctcgcgccggcctgcgctgcctccgccaccgcgtcctccgctgcctccgccaccgtggcctccgcctccggccgccaccacgtcctccgctacctccgccaccgcggcctccgctgccgaccgtcaccgcgtcctccaccgccgtcggtcgcgtctccgcgcacgccggcctctcaccggctgccgctagccgccgcctccacctcccgtcgtcgcgcacgccggcctcctccactagctgccgccagccgccagccaccgccagacgccgctgcctccacctcccgtcgttaccgcctgagagcggcttgctccggccagctccggcgtggaggcgccggatccacccgtggggaggccggatccggccgcggcggcgccggattcgccgcctccacaccacgtctgtgacgcctccgcaccgcgcgttggcccgcctgtgatgcgtcgagacggggcaccgtcaaggtttggcctcgccgccgccatctcggctggccgctcggttatccggcggcgggctccggcagcggcgaggggagggagagggggagaaagtggcggcggcggcgctaggttttcccctgtgtcacccgcgcgtgggcgacgcggaggctaagctaccggaattcttttcagtcaagttttatttggctgagtaactaatctttggggatgtatcgcatgaagctgggattatacctgaactatcctattatagagcctcgtccgttacccataagtttattataagccataacaacttattagcaattaaaaaaactgatttcctattatagagccattttataagccataacaacttattagccatcagaaaaatgatttgcgaaaatttttatatatgtgtctttaacaacttaaaagctaatattaaaaacaaactaagttgaacatatcttaaaatcaattcaaaatttaaattttgactttagttttagtttttttagggtaaccgatggggcaataattggcatcgtttttaattacaggcgcaaatataagttgaatccacaacaatcagctgccacattttacatacgtcccacacgtctcgcggccctcggatcggctgatatgcacgcacaagtgactgaacatgtggatcagtggatgcagcgacaggcaggacatagagcggccactactactagctagtggccattattgacgtgctctgctcttacctcatcacattctcataccccagtacgattcctacgaacacttttgccttgggtaagtggtgagttgagtgatctacagattgacagcaccgtgtccctcaatcaatttgctttcgccggcgccaccacttgcaaccgcggcgtggcgtctctcttcttgtctgcattctcgcacttgcacagttgcaccctctgggaaaggaagcacgagggtgaaaagatctcctcgcttcgctcactcactccatgctcatcggtttgtgcatggatcatatcttctgatctgtaattgcgtggacacttcgagcagtagtggttgcagactgggagggaatgtgctcgcaagttgcagttgctgatgatgtgggaatgttcagaaagtgcagagacactttcgaagttttgataggcacaagacaacgatcgatcacagtattattcttagaatctctagttgtgtacttccattcaatgtttcagttgttctctttgggtagtttgctcttgcacgtagcaaccagaaattggttaaccctgagctgagtggggtactggtgttcgccttggtacagaacgtaaccatcttgcattaacgaattagggataggtagggtgatcaatcagcatccaggacttatttagcaacactgttttcagaattaaggtgtgagtacttcttctctgctctggtatatgatcaagcgtatgatgggccaaatttaataggtgtcgtaccggccgtcgtacatgaacatatatttgaaaaagaggttgttcaattcactgaaactctgaaagacagacgaatcttctaagcaagcatatcgattgattgttcgagaggaatcaaatgagcgtgcactcagagactttggtgtatactttctcagactaaatttgatttagtctttcgctagctgcagttgagcaattccagtttgttgtcgttatcagtgcaagtcatctgtgcgtgcaagtagcgaacgaattttggtgcaagtgcaaccttgtatgggagtaattttttcctttaattttgacccagttctttctttattagaggattaataagctaagagaggatggccctgtccccttgacagggatgcttactggccgttcggttgccatgtaaaggaatagagcgagctatggtcatataatctacatttctttaagcagtttgatcataagaatattgaatttttttccagaaataaacaagagtcttatgcatcattgtattaagaaaagtaaagttgatacaaaacgaaccgtacaaaaacaaaaccagaaggaagaacatgaagaagaaaaggggaagaaaaaagaaacagcacagttggtctattcctgtgactgaaaataggcggcctaaactctggcactatatatgctgagctgaggccgtcctagccacagccgccaccgcgctgcctcctccgccattgcctttgccaccttgggctagctccactctatctgattgaacacgtgattgttgtgctcattccatatcattcaagctccgagtgtaacgaccgtgtcaaaatctctcctctgtccttttaggatctttctctggctattgcaaagccggaggtggaaggagtgcccgttgattgacatacaataacactgtcgaattgcaccgaggactgtacacaaaagttttcaggattccagggagacatctaggatgtggtagatagtctcctcatgttgatcataaagaatgccatgatccgagcgtggtagcccaatgttgcttagccggtcaaccatctagcagcgtcatagtgccaccaaccataggaagtagcgacaatgtgggggtgcgaggggttctccaaatcgataaggaggaaggacacaccctagaaaaaggccttggtaagccgatcacaaggagtagagacatgaactctcctatttccagacgaaggagtctagctggcggagaggctaccgaatgacctgatccacaaccaatgctacaagtattccaagatcgc

SEQ ID NO: 45437 - DNA, 5262 bp, Oryza sativa
gatcgccaaaatttgtttggtcatagactcagcagtagccgccctgtgcatttgatctacctgcccagtggaacctataatggatcttgttgattcccttgattacccattttaggggttccacgccgaccaaatggtaaatagatatggaactcaaaactgccttcatcgtgatgatctagcttataagagctatttgcttcgctttcagcaatcggcacaccacataatcaatgagaggttgtaaatcttgcttccttaaccttcgagaattgagcatagatcaggtggtgtggtgtgaaggtgttcacccagtctaagtaggttcaaatcctgaacccagggcacagcgggcagctagggcttgagccctaggtttgcctctaaaattttgttaaatcactatataaattttatagaaaacaaacactctattagttgatccatatcctaaccttagtcttcaaaaattctgactctaccatgctgaatccaatgtgtttcttatgaggtttcttgtgcccccttcttctttacaaaattaaagtagctagttcatcctagttattcccttgagaggcatatcgaatatggattctgtagattagaaacttaggcaaaggtcctcttgctgcttggaaatctttcgtaggaacatagagatcctccaaacgagcagctgcaggcgtgcaggcctcttgcagaatcggaatatggttcacatacaacgccttttgcaatagtgcgtaatgatccaacagctagtactaattactcaatttgtgcttggccattgatttgtaatgataatctaggagtatatgcgactgtggccggtagtgtgcggtgataggcatcgaagaataagaaacgacgtaacagagaaaaatgagcgtctaataatgtggccccttgacacctttcggccagagagttatttatgtgcttaatcgcattctgaaccactagtccggggctctacttgcagcgattaagttgacttgggactgttcgatgtgacgcggcacggcggtgatgagcgggccagcgttgactcaacacctacaaagataagagagatcgatacactgtcgaatggagaagaacagtcagcgcgacaagggtagccactcactcagtttcatactcagatgatacactgtcgaaggagcacatctcgttgccccggcgtatgggcatatggccgtgtgtccgtgtgtctgtgtgcaatgcccacctcacgtctctcgggccgaagctcacggaggaaggagagaacggcaaaacagggccggtggaacgaggccggaaagaagggacgcgcgcgatttcatgcgtatctccgtgattttcccgtcccgcgcgcgacgactcccgagtcacatggcgtcacggcctcgcgaccgtgtttgcttttgtggccaccgcgcgcgtacggcgctcggcacggacgcggacgcggcaaccgagccgcagaaaccacacggagaggtacgtacgcgaggccgcgaggtcgcagcgttgcaccggcgttggccggatcgcacggagaggctctgcactgtgaggaagaatgtgccttcgccgatcgctctcattctggaaaaggaacagcgatgtacacaactttctagagtctgctagggcatccgaagactggagtcaccaaattgttgcgcgcactggtaaatttttaaggtatcggtgaaagaaaagggtttgcggttaaagtgagagatgctcattcgacgacccacaaagagtaatttaaaagaggagatttaattagtatgcatgttagtaatactttgtcaatgcgttcccacgtacacacacacacaaaaaaaacctagctaacatgcatgttaatgtcattaactcttcatccgtgtcatgtagccaacgatttttgactaatatcctagcaactttgtgaattaaaaactgaaaagtggaagggcaataagagccgaaaggcccgaaaagcaagagaaatgttcatctcagcatatcaggcgatggaacagaactaattcccagtccttatctacaaacacctacaggtcaagcagaaccggattcctgcacgaattagagccaacaaaccgaccaatgaacggtcccgatgcaatgcaacgaaatgggcgcgcgcgtgcgtacgtgttcgtacggattttgattattcctcgcgccggcgccggcggcggcggcggcggcggcgaggctccaccgatcatcgatggcggatggctcacatgatcgcgcaggcgttggggttctcctcgctgaagatggtggtgagcctgttggcgtcggtggccatgcggtagatcccctcgcgcaccggcgtcgggtagctgtagcggtactcgccggagaagtactcgtgccgcctcggcgtcgccgcctcccacctcggcagcggcgacggcgtgtaccggaagtaccccggcggcgccgacgtggcgtggcgtgccggcgcgtgctcggcgccggcgttcggggcctgctgcgtcgtctgttcttgctgctgcggtggctgctgctgttgctgctgctgctgctgctgctccggtggcggcggctcggggccgaaccggacgcggccagacttcttgttcttgccacgcttcggcggcttcggctcggccggtggcgcgtcctgcgccggcggaggcggctcttgctggggttggggctgcgcctggtggtgctcgtgctcgggcccgtgttgctgctgctgtgccggcggcggcggcgtctgtggctggggctcgggggattgctggtgcggcggctctgcaggcgggatcacgtagacggagttggcggcgctgaaggtgaccgtgcgcgccaccggccgcatgtagtacgtctccgtgggtgggccgggcgggtaggccatggcgtagtccagcctctcctcccgccaccccctctcgcgccctgcatgtcgccacgcttcacaactcttagcaaaaaaatgaacttcgcgattttgagattggtttggacatttggtacatgaacattgactaacattatttatcaaattattaatccattgtcctaagaaacatcacacatcatattatcatttacatgtggctatgtgaggacgatatacatgcttttgaacgggttttacatgtgagattattagctgaaaatctatcgtacttatagtagcgaaaacttaattaagcagcctgcatgcatggctgcagattagcagaagtacctagttcgatcgatcatgtcctagcacgtgatcgatgcagaccacgacgtggcaaggaaaacaacatgtgcagtgtagaagacgacttaccgttgcattttccgagagctttcgacacgaacttgcccagatgatagcaacccatgcctggctcggccttagttttcctcttatctttctccctagctatctcgctgggatgtagcgatgtatgatgcgttggtgcgcgtgtgctcgagtgagcctgtgcgtggaatacatgctagcttaggaggtcgctcaagttcacggtggcaacgagagagaatggaaggaacggggccaatttaaaaggagaatactacgatcggttggtagcaagagggaatccggcaacaatgaactcctacctaaaacgcctcttttctcctcaggggaaggcatcgactgaagtggcaggacgcacataaagggtggtcctcgttttcgtggacgttggttcgagctaacaagtggtggcagaatatattctgctcggccgggacaatgcgtttgtgggagaggagacgcctaactagggatgaaaatgaggtggtgcatgctgcgtggtttacatttgtcatacatggcacaaaagggtttgacagatttgaccataaggttgcatagataaaattaagttgctgtcttactctctactcctacttgcgtgtcgattccttatttttgtaccggtgaaacgtgctagcctcattttcctgaaggcaatctgtttgcatgtaaagtagaaagctcggagtaggaaggtgacctttttttattcagggaacgcgaagccaaaattgagtaataggctggcgggttgtgactggtgcagacggcagaatggggcgggcaatggcaaggttgaaatctgttgctaggtactcaaaatgattaactcggtttcaaacaaaaaaatgattaacaatgttgttacgcagaaaaatggttatatggtcgctaaagagctaaagatttattattactgcaaaaattgtagcaatagaatagattatacaaaaagcagatgctgcggtctaattatccacaggcaatgaatccatatatttttctatgaataactatatccttcaacttcaagcatcctatcctaatgccaaccattccatcctgcattacgcaggattctagcttaccaacatgggcagttgggcacgcattccccatttccgcacctccatgcttaggctccctaaggaacaccctctgagagcatgaagagttcaaacacaaacatagttgatcacgctacagttgattgcaacgcttttattattcccctcttccatgtggaagtctctggttcaaacctgagctcccaggtcggccagtagtgaaggtcctgtttcaaagtaagcacacgaggtttgccattcaaatggacggtccgcaccctaacaaattcaccattttccaatccctgaaataaaaggttatcagtattaattcaaatcaattgaacataagcttgccaggtcgatatatcacatgaaaagacttgactataccaaaggaagataactattgataatacgtaccttcaccacttgtataaaagtttcaagatctggagttggcttcccattaacttccactatccactgcagagcatagagaccatatctatgtacgggacttccatgacaccatctgcataaaatatttgatactcattcctcgttcccattaggtatctaaaatgtgcttaacaccaatgctatggacctaccgccaagccatgtacacatcttaaattttcaaccaactctagatttaccatcaaggagggagaattctaaatgattacatatatatgtatataagatttggagcgctacactactattatgacattgggagtggaattagaggaaacactatcaatatggcttttatgaagctgatttgctgtcggtgcccaagataacacaaatgggtttcattattggataggatgtactaggaagagattgtaaagt

SEQ ID NO: 45438 - DNA, 1073 bp, Oryza sativa
cttacaaccagtcctcacctgacggaatattgtcatgttaaggactccatctgaatcaacagattggtccaatttctggcaagcattctcgatatctaggaagcatgtaattggctccttattgatagcaaggatcatgtctccctgttcaaggagattttctgctttggatccagccaaacaacctttgacccgcaaaacttgtcttcgcacagggtccttcttagctagagcctgcaaggataatcatattgaacagtaaatatttcatgcatccaaaacctctccacttgctcataacactagcatattagacaagtccaaaaccaatcaagcgaggtcctttactcctcttccttacaaactgcagcatttatctgtcagcgaacacttcaagtgaatggcatgaatatttctccagaacaataaatattgcactcgcgtaattacatagaacattcaggttgacagtccatcaggaaacgaatcatagctgtccgaccaagcagagcaacttcagaaaagactaaaggcaaggccaacgtgaaattacctgcacccagctatcactcaatccataacttcttgcctttgaaagcaaagttggatagagttccacctccagaagtctgatgaatggtattggcctcctaactccattgataatacgaaatggtccaggagtaccagagattaccttctcaaggacttgacttattgcatatattggtatacctctaacaaattgatgatcctccgaactgctacaaccatatttcagctggagaaaataattaattgatttacaaccccgataagcacatggaagaatggctaaactgctaagaatggtgccattataccattgcttacaagcattaaatgtgtagggtatgaattaatgctaggacaaagaatctatcaactttagtcaaacatgcagaaaagtctagggcctttaagtgtagtgaatatagtttcttatattgtccatttagttgattgttcaagatatcaaacggctaaccttccgtgtaagacggcgttttgttctttctttttttcttttgaat

SEQ ID NO: 45439 - DNA, 1022 bp, Oryza sativa
cagcaaactcagacaaaactagctcttcatcacttttatgttcttcttcatcatcaccttgggaaccatcctcctgcaattggagcacttcaagcaattcttccaaaacatgtaattgtacagacttaggacacttgtgccctaggccatacttttctccacacttgaagcactctcccctagctctccttgctgccttcagtgtgtcaaatctttcctcccacttgggtttctcctcaggcttcttagcctcctctggtgatgctcccagaatccctttgccttgataaacaggtttaatcaccggcttgtaagcatccttgtatccttctttggagtagttcttcctgctactctccagcaataattcctcctgcgtttttgccaaagataatgtcagatcaaccgttcttggtttgtgtaactttatagttgttttgatctcagtttttaaaccccccatgaatctagtaacaaaaaatgtctcatcatatctcttgttgtaaactaagaccctatgcatcaactcctcaaatttagtataatactcatcaactcccccaacttgactcaacccttctaactcctctaaatgttgttggtacttgtccttaccaaacttcccatgcactactacacacaattctggccagctctctacacagtgcaactcctcataggtttgtaaccataacgctgcattccctacaaagtggagtgtggcaaaggatgaccaagtttcataaggaacctggtacatactgaaatacttctcactattagttttccatagctttgggttgtctccatcaaattttgggaaatcagttttgggtaacctagatccactagaccttccaggactctgcaatcctcccatccctttttcagagcaatcccccaaatcaaaatgaactggcgagttgtgaaattgcagcttacccttgaccagggcgcgcccctggtccactggggtaccagttgcagctccctggtggttcaaagctgcgccgtgcccaacg

SEQ ID NO: 45440 - DNA, 7035 bp, Oryza sativa
ccaagctgccctaaaatccactgctctgataccagatttgtcacgaatcagtgagatctcccttggcgaaacgccaaactaggcacggatcgagcaactcgggaggaagaaaagaggaactgagcaagaacagagtggggaattgacttggagaggaggttggtgatattgtattttcttattcgttgcctacgaccagcgcttcggcaaagtatataaaggttccagctagtacacagctcacagctgggccttcactcacgcaccagccaccttacaaggccatcaggcccaaatcccaaatagaatagtgaagccaagcaataaaagactcctgaagtctaacacagcaatgttagcaagatgctccagcctccaggtatattaaatcaaacttcttcttacccaacatacatatatgtgtatatgtccattggcattgcatggcctatgcacgaacacgtataaggtcgtcatcaatggcggcgcccacgccaccgtgcatgcatgcttgcgtctgatgcgtgtttccaatgcaggagctgctggcgcggcagcaaggcgacgcggtgagcagcctggtgtatgaggcgaacgaccggatgcgggacccagtctacggctgcgtcggggccatctccttcatgcagaaccaggtgtcacagctacagatgcagctcgccgtcgcacagggcgagatcctctgcatccaaatgcagcaccgcgatggcaatgagaacaagaagaatgtgagagaggaggaagagagagaagatggaaaaaaagagagaaggtgctgacgtggacactgacatgtggggcccatatggggacccatactgactcagctgccacgttagacaaaaccggggtcaaaactaccgaaggatctaaagtgaatggttttgtaagttgaaggatgtcatatatttggttttgcggttggggatgattttgtatctcgatgacaagttgagggaccttgggtgtacttttttcgcgagttgtgggccctctcgtagcgttgcaggccaagctgaacgttttggtgggctccagtttataatgggccgtaatcacttttgggcctccatctggcctattggcatttgacgtcagattcggccctgtcggttgccatgtgctgcacaacagctccattagttttttttgacgaatcggcacaacagctccatcagtagtatagatggccatgtgggccgcccggcacggcacggcccaggcccggccgtgcctgggccgaggcttgtcgggccggcacggcccgaccgacgcaccgggccgtgccgtgccagcccacgtgccgcactcacagcccaggcacggcccaacacgcctcgggccgtgccgggccggcccgaaggcacgatgggccatcgtgcttttcctcagaataagtctaaattttctccctcctattgggctgtgacattgtatagctaaaaaaagtctattttacctccctcttctttgtgctgtggtatataaatagctaaaataagtctatttaaggtccctattctttagacattgacatttatatgtctatttttagtccctatactttgtgtaccgggcctggcctgccagcccatcgtgccgggtcggcccgaccgtgccgggccagcccagcgtgctggtggggaggcccaggcacgacccgacagtcgggccgggccggcacgggcccgacccaagtcgggccgtgccgtgcttgggccgggccaaaaaggcgtgccgtgggccgggccttcgggcctcgggccttatggccaactataatcagtagcttaccttagctgtactcttttcggtcttcagtcttcagggagaacatcggctctaggtcgtcaacacacttccgtgtttccggaagaacacaataggtgtaaccgtgtaagagcaagtttaatagtgtagccaaatactatctctaattcatctatagccaatctagtagtttattcatacaatatttacatactacactattaatatctagtcccacctatcataaacacactgcgttttggagtccgtgctataactggctacaaatttgtagcccgctgctcttctctctccttatttatctctttaaaatatctttgcagctggcttatatcctgctattgtacctgctctaagagcaaagtatatactactaatcagcagcttaaaacgtactcctactcagtgctgcatgtactcaaatgccattagactcaaaaagtccaaaagtaaaccatccccttttctttaattatacgcacaccttgtggtcgtgctccaaacaaaacgtgctactcctgcttttcactcatcggcccaacacggacacaaaaaggcaaaaacgacatggcgccacgccactcacccacacggccgtcagtcccagcccccagtccaccacacgtgtccccttcactcacgccccctttcccctccatgcgaagccgtgtctccttcacacacacacacacgcacgcacggtcgcggtcgtaggtgagcggccgcgcatgccacgccccgtccgccctcgtgccgagccgcgagattccgcagggcgcaccggcgcacgtacgaccaactccgtctcccgtggtagcctcggcatgagaatacgattatttcctcgcaatctcgcatcgcgcacgcgcgcgcgccatgtgttcggctccggccgtttcgccggctcacggcgtacctaaccgcgcgcgcgcggccaccatcgatcgatcgcgactttgcggatcgcgcgagcccccgtgcctgcgttgcgtgcggctcgatcgatcggcaggtgcgtggcatgcggtacgtgtggctctcctgtgacctcaagctcaacggtttgactaatcgatccaagactctaatttatgtacggacggatttttccatcgatctgcttgaaaaaagttctggaatgcatgcattgtacgtcaagagggagattgtcaaggatatgatctgacgtgtgttcttgctgtggtgttacgtgttaacgttcgttgagctgaatatatgtatgcatgaaaactgaatcgagaggacagcaacacgaaaatatttgggttgttggtcgggacaaagacgtacacaccagctggatatcagagtatccacgcacatcatttcatagtatttcaatagatatactagctcttcgctgatacgcacacagtttattattcaagttcatggggtcacaagaatcaaactgtctgcagcaactggcctcatgccggtacgaacaaactccatccacctccccatataccgtgtgccgagagatctcctgacagatccgtcatgccagtacatttgttaatggctcttttgagtttttaactagccctgccaaactcctgccaactcgcatgtttatggttaactgctgcgcttaacccctacaagtccactcactctgctggacgaaacatcactattctatacgtaatctctacgcagttacgtagaactgagcagggcgcacgcacggacgcatgcccactaattaattcactcatgtctactagtagtaacactgtcagcagctgctgtttgatctgcttggtcgatgacccaaccaatcacgcggcgaaatttggcgtgcaggctggccacccgtttcacattttacacggacacgtcacactgccccccctggcttcactggctgtttgcttgtccgtaccggcttcacatcgcgtgttaattagtggagtagcagcttaattaagctactccccgcgcatgtcgctctcgcgaaaaggctcgattcaaacctaccttcctgcctcgttcctctcccccgacacccgcgcgcgagagctatatataccccagtttgcttcgcttgctgccacttgaccagcagcagcagcggcagccggcagcggcagcatcaagcagagtatagctcgcgatccaggaggccgtacagaatcgatcgcaattcacacacgcacgtaaaggagatcgaagattcgaagagagatggagggttgtgcgtcttcgccggagagctacgtgaggatagggaggaggtggcggaggcggcggccgccggcgagggggttccggctgtgcccgaggaaccggttctcggtgcggcggctgcgggccaagctgctcacgttcctcggcctcgtcggccggtacgtgcgccagctgctggcggtgaggcggccgcggtcgtcgtcgtcgtcttcgtcgtcggctggaggcggctgctcacggagcagcagcacgaggttcctcgtcggcggcgggaagcatcacgtcgacggcgggcggcggacagtgccgccgtcgttcatgcggtccaactcgttctacgcgcaggcgatcgccgactgcctcgagttcatcaagcggaactcagtcccggtcgaggactacgccagctccagcggcaggagatcatcggtagacctgacaacaatctgatcaaagtctggaatggctgcaattttttttggaacaaagatacagattagttaaaaggttgtaaatgtgtgcttcgaatgaagtctaaattaagatgtgaaactagtttttggattgacgacactcatgtcttaatacacatgaggatgtaattaacagggcgtgaaatgtgagccgcataatctgaatttttttgccatgctcattggttcaagatagatattaacacttgttttccaactgccatctgtattagagtagaccttaattttgtgtgacaaaatttttcttccacgaacggccgtctagccgtccaggtccatgggattttattcgatagaaaaggacggggcaagaataatacaactgaatattcaaatacgtgttaacgtttcagactgttacagatatactttccatgcagcgatttccttcaaaaaaaaaaaactttccatgcagcgtgcatgctctctctttttttaatggtgcatgccaatttctttgttctgccgtgtgagtgtactccattttcttctgctgaaagtaagtgtcgatggagagtcagtttgacgatatctgtctttttttttggcaaaaaaattaatgcatgcccaaatggatggggttaatttctcaccaattacagaaagtcagaaacacatagctagtctggccaaacaaatctttgcgtctcacctgttactgatttttcttatcggcttaatttgtttgtcactagctgttctgtggacaatgctggtttatctttgtcaactagttagtgaaagcacgggagcagcggacagccggacaccgacactgctatcgatcaggtttttctttgtctgaaagtgccattgcatcatcctgaaagaactgcatttaaaattttcaatgatgtagcgtgaataaatggtaaaaatgctgaagctgagacaaggctgggtcattagccaaaagcccacgggtagtagtagaaaagcccgttgctacaattagtatcgtggatttggtcgagagaaaaatctgctcatgggccagcggctagtgttgtttattctggtccgtttgaacgaaacgctgcctctgaattttttgtttacagcaaagggatcgaaagcgagatttgatcggctgcatgaacaaaaaggattaaagcagtgggcagtcggcagcatgttcctgtgctcgtgtctctcctgcctgaatcctgaaaagctcgacaggtaatgcagcaatggaggaggacatcatcatcaattcatcatcattagaacgaccaaatccaaataaacatggcgcacgtactggccattatcttaacgaaactgcacggagagtggaagtagtgatgggaagagagtgattcactttggctgtgtcacgcagcggaagtttcgatcgatctgtttgggtttccatccgaaagataaaagatggaagccactatttctcgccatcatctgaatgaagcccttctttttttggcgggcctcatctgaatgaagctggtcggaaggagcaagatttgcagatccacgtatgtgcaaatcgcaccacgaatcctaatactccgacatgattttgcttgtgtcgtcacaccacaaactctatttttgagcttagtttgttaacatcacttgatcgctctcgcttgcgatctgtgaatctagtgcgtgcatactgtgcagttgaaaagtttgccgtcaagtgagcgtagctcaaatccaactcagatcgaagttataaagttgacacatatgctcgcttttacggttaattattctttcaacagtagacaatatagccgttgatagtaatgcactcgcaacaacttcatgaaactcaagatatgttaatccagatttctaaatgtgctaatagagataaaatgtgtgttcatatggagatatatcagttcagtttttttggaggtgtttataggagtacggcgcgtttaaaagtgtggtatgcatcgtgttgtgagtgtttgtgtgtttctttaaaaaaaaattgccatttgtcaattattgtggattttctgcaacttgttgtccaaagaaaaagaaaatagtttcggtcaacaactcaacatccatctgggggtatgaccgaccgagcgcggtggccgttgattggctcgtcgcctcctcccttctcggtctgacggtctgaccagtgccgggtaggaagcgtaattttgaggagagactccgacccgcgccgccgccgccgcagccaagccatggagggatccgccggggcgccgctccgcacgcgcgtgtgcatcatcgggagcgggccgtcggcgcacacggcggcgatctacgccgcccgcgcggagctcaagcccgtgctcttcgagggctggctcgccaacgacatcgcggcggggggccagctcaccaccaccaccgacgtcgagaacttcccggggttccccgaggggatcctcggcggcgagctcatggatcggtgccgcgcccagtccctccggttcggcaccagcatcatctccgagaccgtcaccgcggtcgacttctccgcccgccccttccg

SEQ ID NO: 45441 - DNA, 1685 bp, Oryza sativa
tcgccaccggcgccgtcgcccggcgactccacttcgccggctccgacgcctactggaaccgcggcatctccgcctgcgccgtctgcgacggggccgccccaatcttcaggaacaaacccatcgccgtcatcggcggcggcgactccgccatggaggagtccaacttcctcaccaagtacggctcccatgtgtacatcatccaccgccgcaacaccttccgcgcctccaagatcatgcaggccagggcgttgtcaaaccccaagatccaggttttctgggactctgaggtcgtcgaggcctacggcggcgagggtggaggtccattggctggtgtcaaggtgaagaacttggttactgggaagatctccgaccttcaggtgtccggtctcttcttcgccatcggacatgaaccggcgacgaagtttctcggcgggcagcttgagctcgatgctgatgggtatgtggccaccaagccaggctccacgcacaccagtgtgaagggggtctttgctgctggggatgtgcaggacaagaagtatcgccaggctattactgccgctggatcaggtttgtgaattgatgatttttcaggttacctgtgattaatttttttctgcactttcttagagatcagtcgcttcatgggttgctatttgctagtgcgaattgcaatagaaattgttcagggcttgagtatgtagtgagcgaatgatgatggtcaaaattagaacctttttaagctatcatagagttaacgtgtttgagtttctgaaataagtgctttcattatgtatctagcatagttgattagatatactaactaccttttgggcatgttgaatgcgtgctctgtttccaagctaggattgggtgtattagtcctaaaaaaagttaggtgtatttgaggccggttaatgcttccaaagtaccatgtaggttcatatgtttgactaataagtagctggtagttaatcatggaatttgttgaactgggataagtgactttcaagctattctgggattttcatagttaaggcattccaaatattgttaggaataaaaaaaagtgctacttcccatttagtatagaagagtgcatttcaatttctacactacaaagtacggactgtatttttgcaaaaaaatcaaaaacagaagtatggtcagtacatcactctgtcactcctgtgatgtgagttaactttgttaagcgtttacatgctaactgatgttgcagcaagtatttttactagagtgcaagttacattttcatgtggttagagggcacatgcaaaattctccatgctcaaacttcaataattggtcatgtttcgccattctcccttcttgatcctgtcagagatggagtttgaacttattattgcataaaagaatgaattggaataaacagagactgggttcactttccctgcgtgctgtgaacatgtgttccggatgggcataaacaaagtaaactaatatgttaccaagtatggacttgctgaaataaattgacctttttgatggacaacatagtggaggaataagcagagactgggttcactttccatgcatgctctgtaaacttgagttccggatggtcataaacaaagtactccctcgatccctaaatgtttgacgccgtctgacttttttaaacatgtttgaccgttcgtcttattcaa

SEQ ID NO: 45442 - DNA, 1756 bp, Oryza sativa
ccgatgttccgtgcaatcaatggatatgcaaagtattaatattggtacctactgtatagattaagaagccagtgtgtttcactatcttccaggttccgatgttctgtacaatcaatggatatgcaaagtattaatattggcaactactgtatagattaagaagccagtgtgtttcactatcttccaggttccgacgttccgtacaatcaatggatatgcaacaaaggccaatgcagaacatcaatggagtagctacacttcaggccacagtaaacaacctttgtagctcttaacgaatttgttctaatggaattgcattcatgtaattcaaagataacaaggtgattgatttaattgaaacaccggtcaggtcattttagcagataagagacaaagcaccagccacctagcatgcatgctactccagcatagtaagttgctatgcaagaatttgccaggctgacaagcatctctaattttcaacaaagtttcaattgttcataaccaattaaactcgagagcgttatcttgaaggcttgaacagagaatccaaaaatgttaagtaaatttccatttatgaatttataaatatcggtccatattacatgtgtgaagattatgcaagtggtgaggacgcacctgaaatcgagatcattatatagtgattcaactgaaattggagcagcagtatttgcactcagaatttctttggtacgcttaacttgcttcttcaacttagccatcgccttgggagactggcggatatcaactccattaccgagttgtttattaaattgatcagcaaaatagtttaccaggcgcatttccatttcaaggcctccaagtttggagtcccatctaacatccttaacctgtagataattagctgaagaaattagtaatagattctggcattctgtatctctgtaatgtaggcatttagcaagctcaatttttcatatatttgtcagatcttccatcgcttaggcatgtgaaagatgatgtaaaaaaaggggttttcagtggacttttgagtaagcatacgacggacaaaattgaacaactaaaagaccttgggcaagatcgaattgtacctggaactggttcaccgataccgtcttcccaaactccttggccttgtaagctgagtagtacaccagcgcggcgtaggtactacctgcgcccatgtcatagaagataacatgcctcgactcgttcgagaaatccttgtcgatcccgtactgcaacgctgccccggcgtgctcattgatgagcgcgaggacgttaactccggcaagctgcgccgcctgcgtcaaggcccggcgttcggcctgcccaaagtagggcggaacggcgacgacggcgtcacgcacaggagcgccgacgtgcgcatccgcgagcccagcggcgtagtggagcaccatcgcgacgatctcctcgacggtgtagacctgcccgtcgtccgcgcggaccgcggcggcgccgcgcgcgtcggggacgaggtcgtaggggaggaagagcgcctccgcgacggaccgcacgtaggggaagggcttcgcgaggaggtcccgcgcgcgggcgaacaccttggacgggtggcgcgcggtgatgccggacgcctcctcgccggcgagccggttgccgtcggcgagcgcggcgagcgccggggacttgcgcttcgacatctcgttgatggccaccgcgatcgggacgcgtccgggggcgaggtgcacggcggccaccttgagccactccg

SEQ ID NO: 45443 - DNA, 1082 bp, Oryza sativa
ccctggggcggcacctgcctggcgccgtcctcctgccaccgtggcgcacgcgaaccgacgtggcaggatgagggcgccaggctggtgccgccccagggaggagggcgccagcatggctggcgccgccgcctccattcctgtttctctgtatagagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcctttagtaaaaccctttgatcagcatgttaaacataatgcactctaccactatatgaaattacttaatctaattcaaaatataaccacatgaaatgacatatataaattaaacagtacatagagatgtaatttttttatttttatttcatttttttgatatttttttcacacttaggagaacataggaaccaaccgtataaaaaataaactcaaacggacaaaatatgtgacatgtagaattttccaaaactctaccgaaacggacaaaatatgccatctattaaaataggcataactttctcatacggactcggaatcaggcaaataatatatgcacggacatctacagaaaaagttacatccgattctctcccgctttgccgggttcggcgatattaaaacctccaaattccgcttgcaagattgtgttttcgaggagagaagtttttcggtggagctttggaaaattccacatgccacatatttcgtccgtttgagtttattttttacgtggttggttcctgtgagttcctaagtgtgaaaaaaatatcaaaaaaataaaataaaaataaaaaagttgcacatctctcctctgcactagttcggagagaggaaaggagaggaaaaattctacatgtcacatattacgtccatttgagttcaatttttgtatggttggttcatgtgtgtccctaagcgtgaaaaaaatatcaaacaaataaaacaaaaataaaaaatttcgggggggggggc

SEQ ID NO: 45444 - DNA, 8080 bp, Oryza sativa
  unsure (1)..(8080): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgactttgtgtatcccaaaataaaatgctgcctggtttgtatgatacttaacatggtgatgtctgttgtaacttgtaagtgtggttgaggcagctggtgtggttgggtttgtggtcagttactcagttcacgtgtgttttgagcatgtgaagtatgtagatctgcttatctgaaattctaagcagtagctgcctgattgcctgtatagcctgacagagcagctatctgctgtaattgtactactactactgtactgctttgtgaaatacagtacatacatagctgatatatgtaaattggttttctcattttctacagcagtaaatgtgatgtaagatgccaatcatttcatcatgttattctcatctccagctttgtgctgacacaacgaaatctacataacttcctcaattctctgtttaatcgacagtaattttgtggtttgcatcttccatagccttctacccattataaataaacataactttctgggctaatgaagctggtgaaatccagctataattttggccgttaaaaattggggttagtttcatcgtgttcctgaaatgagctgggagagagatccatcgccttagctcgccggagtggcggcgcatggaatcgactcgccgtcgccggtgaggtgaacttgtgctgaagatttgcaggagcctccggtaatttcggctgccctagctgtggctgcggcgcagccggcacgaacagtgtcgcactcactgtgcgcagccgcagtagttggcctaccgaacagacccactgggccttcaggataggatgaaaacggtccgaaaatttttatatttatgaattcaactatttaatgtaaaattcaatacaacgttgatagaaattagacgattctcgattcagcaaaccgatgaagtcacgcagtgtgatgaaaggatgacagctaaaagcaatcttgtggatatgatatcatctcctttggctgtaccgaaaagaagtcacgtttaaattgatctatgctaccatccatccaccattccaccaactagcttgatttctaaatactcagctttacattctgcttggcaatacgctgttgcttctccaacctctttgccagacagagacgcctcagtgagttaaatactacaaggaggattgataattgagtttaacaaaatgcagctgaaaatgaaactagcactaacaagtagcctcacgagatgaggacacagagatacagctatggtttttcttttgaacaacatctccagtttcatgttagaagtaatatttttcagaggacagagaaggagagacatcaaccaataaacccaagaaatcctctcatttttcagttctcctttttgattgaaaaccagtccgatttttttttcaaactcctgaatctgtatgaaatgaaacagtttgttcaccaaaggcatgcaattccagaatccatctttcttatcttctcacctatccaaatgtcacacacattatatatctgcacattgcagcatttactgcccacaccaaactcccctactgaattccagcaaaccactggttccctgcgctttaaaccaacctttggcctggtttacttcacaaatttttcttcaaactttcaacttttccatctcatcaaaacttttctacacacataaacttctaacttttttcttcaagcttcttattttaacgtggaactaaacgcagcctttgattaatttgtgtggatatgaatttaaattcatattcatttgttcatattctactatacatttagcagaaaactatggatccgtgcagctgtatcccgtcgttttttctgacgtggcacgcatgtggaaggcgtgggacccagttgcctgccgaaacgcatgctgggcccacctgtcagtggcttttacccaaaaaaaaggcctattttttcatatgaacccctcaaaaagtaaactttttcctccatgctcgacacctgccacgtaggatttttttcccctttttgggaattgatttgatcacaacaaatagccttcgtctcccccacgctctcctctctacccaaaccctccctttcctcccccaattctccatttctcctagctcgccggaaaccctaagcgggccacctcgcgccgcggcgggccggcgagcgatcgcattgggcggcggcggcgatggcgacccacgcccccaagtgagtcccccctccctccgccgatctgatcggccgcgcgcgccgctctttgttccattggaatttttgtttttgtttgtgacgtggtcgtggttggttgctgctctgggtgggggcaggggctacctctgcgcggggagctcgtcgttcgatgatcccgacgtggtcgaggtgacgccggcggcggccgcggcaggggggtggagctccggccaccagaagcggaagcggagtcaggtgatgtgggaaggcgcctcctctatctcacctttgtttgtggtgcatgattttattattttttttggtgatgttggaattgggaaccgtaggggggactggggcgcgtgattgctcgatgtgggaaggagggttggtgatcgttttaatggttgcgtgttgattccagttatgccatgacctgttattttggtgtggaattgcactagaattgtgtgggcagatgatctttgattgtgccaggaaatggttgagatggactggcagtggcagtttgatatattgaattttgatcttagatgcgctcaatgttgaatatcaagtggagtttgtgttttttttgtatggtgagaagttgggctgtttttgttagatgattgctgaattatagtttatgattgcagtactgaaatttttagagggtttgattgcattgaaatgcctgataaaccaagcaggagagaagcaatctagactgtctagactttagagtgacaccatgtttcagcctggttcatgatggactagaattcatgttgaaggaaatctagcatgggacatctttggttgggcttttgagtggtagtctagcattctctggcactgcttgagtaaaaatccttgtttgtttcttatctggagagttaggcatgtaaatgtgatgttggcatgtgcaatattttcagttccagagtggatgggcagactgaaagtgcatgccatttgattattctgtctgtctgttaggtcaattgttcaattatttgacatctttacctactacccaatattctggtttagacataatctgacatatgacgttggtagtagagactggaagctgtaagtacatgtcatctgattattccagcttagtctattgggttgtttggttctttgatgtctttctataactctaggattatgttttaacaatcatctaaaacttgtggttaatctagagatgcctcaagtgaaatttgtttgtttaaaggtgtcactgggccttctttttctttctgtaacatatgatattttgtgaccaaaagcccatctccatcaaccatcattgttggaaatcaagatagagttcagactccaaagaacataaagaggccaaatataaagatgaataattagtagtaaccatgtcagtttttattctatgaactcagcattgccgtgacgtttctggctttttcagccaccacgatttcctgtataggatcaattatttcccttcaaaacatttttgtaatatcatgttatgaaatgttaaatggtggggcttgagtttttttttatacgctgaataggttgttcctcatgaagtaattgaactggatgctgatgatgatcctgatggagttgtgattattggtgaaaaatcatcagttgataagaataagcaagctgttggatatcctatagactggctaaagcatgcaaaggtaagttttctcatgtcttctattttcattttcctttttcctataccacgtcagtttgacttattttctgtgggaacaactccagagtagtttggctggtgaaattgctggcccaagttcctacccatcaaaaaatcctgatatattacttggtggcctgaaaatatttcaagagaacccattttacaacaacattgatgactatgcttatgaggcatttgaagaagattatggttatgatgaagatgagtatgatgattacgattatgatagtacactttatgaaagtgaatataacttcactttggcttccaagtttgatggtttggatatcccacctggtgtggaggctcctttaccatggttgcagacgactgcggcagagatggcaaataagaccaaacctgtgaacatgatggatgataaaattgatgaaaaatacagtgcatttaagcaattcgatactgttgatgatcacagtgatcattattattcgaagccagatttaagaaaggttcaggtagtgaaaaaggtaaccttttttttgtaccctctgtatattccttttcttgttagttcgatactaagttttcccattgacagccttcaaaagaatgggcaaagcgtattcagcacgagtggaaagttctagaaaaagatttaccaggtagttttgttgcttcatatgctcttttttttatgaacagctaatggtacagtgtttatgctaagtgtcgtgcatgatgcgatcatgctgttgataagtactacattcatgaggtccttttatgattatttactttggatttttgtcctatatttacagataccatattcgtgagggcatatgaggatagaatggacctgcttagagctgttattacgggaccagcaggcactccctatcatgatggtctcttcttctttgacatttacttccctcctcattatccgagtgtacctccagtaagattttttttttgacttaaccagcatcgatgatgtttcactccatttttaagtatcttacaatagttagtaatctatgcagctggtgaactatcggtctggtgggttgcggcttaatccaaacttgtatgcttgcgggaaggtgtgccttagcctgttgaacacctggtctggtagtggatgtgagaggtggagtccttcaaactcaacaatgctacaagtcctggtctcagttcaggctttggtgttgaatgccaaaccttatttcaatgagcctggatatgccatgcatgctaatacacctcatggcgagaagagttcattaacttataatgaagatactttcctgctatcctgcaggacaatgctatattctctgcgaaatccaccaaaggtatggatatgactctgttcttatcctagtacatggagatgattacttattttcataatagtactaaagttgtttgatgaatatctagacatctactgtaaaatctctcttgtttgatgaatatttcatccattaaaggtctctttgcaatctcctctcgaaatatacatatttattgatgtttctcattttcgcactcgtatgttcctttcgtcaatattaattagtaataatttacacagttacactaactattctcaattattttgaagacattaacattgcgatcatctttaccattccttctactagtctttgttattattatagcatccataattaccatgcctaaccaaaatatgtcacaaaaggaaatggagtgattactatgggaagctattgttgtgcttatgtggttgcatgccatggattccccactatgaatagatatacctgtacatcttcttaacaatttatctttttgttgtggttcttttacagtggaaatatgtgttgtttagtttctgttattttggatccaatcttcacatctgcaaatttaatactaatgcattttttttgcagcattttgaggattttatcgccggtcatttccgcaagtatggccagagcatcctgatagcttgcagagcctatctggacggtgcccaagttggatgtcttgttggaaatggtgtgcaggatgtcgatgagggcgacaagagctgctcggcgaggtttaagagcgcgctgaagagattatttgaggaacttctgatggaattcactgtcaagggagcagagtgtgacaaattcctagctgagaaggccaaagccgcggcttctagagctccagcagacaccacattgaggctataagttgatagcctcgcgtggtcgatagacgggagtaataatttcgctattgaaataggatcctcaactcattatgcccccggattctaaccgtttcctggaagtagcctatgtaaatagccttgtagttgccccggtaaacataaacgacatatccgtgtttgtatttaggggctatatatcttttttccccatagcatgagggtgtcgtctacctgcggagccttaatccgctgtgtatgtgattgacgccacaccatcttggccttctgaagaatatcatattgaactcttatcagcagatccctgcttctacgctggaattcagctagaatgctagattatcagttggtttgtgctcgtgcatgcctggctccgttcaatcctactagtatattttatatatatctggtggtggtacggagcatatgggtctgtttggaggagcttctagttgctgcagcttcttctaaaatcaaaagctctcctaaacagtctagcttttggtttagattctaagaagatgttgttgtggaattcagaaaataaactagaagctggaaaatccggttaaaatgattcactgcttttgggggtgcaattcactgctgtgtgatggtatttcagctctaactcatgacagatgccaattaaaatgaatcattcctataccttttctttgtacccatgcggccatgcctttttctgtacacattccaattgcgattctcaaaggttgcacttttcaccctctaaagtgcaaaatataaaccttctaaactagtacgatttgacgatttatagtatggccattttaaaaacaaatttcatctgaatgcaaaatcgaatgtggctcgataatggcttttacaaataaatttgggataaaatttataatgcatttagagacacgctttagggaagtaatgatagtgtattgatggaatcgtgggtatggctgcacctattaaaaaattcaaatcctgaggatcaaaatgtcatattcatacttgatgtgttttaaattggatttaagtagggctagtgaaagaaaaatgccatgttgctcttcatcaccgtcatgatcacttggatgaaaaactaaaaaaaaagggaaaaaagagaaaaaaaattctcatctacccggaggcttaaacccatagtaaaaaaagccggaccggcactcgaaccgtcgtggctgctgggtcaccgggtcagcggtccaaccgccggttcacccgggtcaattgcagaaccggactactaatttctacatatatgttctttcgttagctcattaaaacaagtagcagtgtagcccaatggtaacatgcaagggtttctaacctagccatccaggttcgagtccccacaatagcagtatttttacacatattcttctaatagtaggtattgggccttagaaggtagtgcctttgggccttcgcatggcccatgtctttggcccactaagcgaaccgtcggttcaaaatcagcaggttcaccggttttcgttaaaagccgtccggttcatccggttcaccccggttcaactgtacaaacggtctttgaagcaaaccgaaccggcgaagtccctggttccggtttttcccggtcgaaccgccgggccggtccggttttttgtactatgcttaaaccccacaaagtcaagaggctgatgcgactgcttcctcccctccacctctccatttccttcgggaaatcctccccaccaaaacaaaccaagagagaggagcggagggctgcaggaattc

SEQ ID NO: 45445 - DNA, 7052 bp, Oryza sativa
tgcatggtcggcaccggctccggccgcgccgccgacggcacggcggtgaacctcctctccgccgtgctccgcgtccgctaccccggccgcgccaacctgacgcgccccttcgtcaccggcagcctcgagagcaccgactcccccagcttcttcgagcccgtctctctcgtcacctacgccgaggagggatacgcgtacgcggagagcgcctcgtgcccgccgccgcccaccggtaggctcgacgcgctccaggtgttcgaaggtagtaaattctcatgcgcacacctcagttcgctgttcaaggcgacgttcaggctcgactacaccaacggcagcagcgagtcgaccgcctcatcgctggggcttcaccagaggttcatgttcatcaaccggatgcgatgtgccgacaatggcgcagtgcgagcttatgtggtgttcgcgaatcagacagatgtatcggcatactactttatgcttggtgagaaggccatggtagtggagggtttctgggacgagaagaggagcaggctgtgtctcaaagggtgtcacgttgtgaattcgggaccatcccgtgcggatttggcggtgggcgagtgtgggattgggatgagcttctggtcccccgctgtgtggtcactacaggaacggagctttgctgcaggtttggtctggaacacgagcctgaagagcggtgagggcatagctgcaagctccaacacaatagctccatactttaggggaagtctttcgggtctgaagtataactacaccaaggttgatgaggcaaagaagtattatgagaagtatggcttgaacaagaagagaaagggaaagttccctgatagcaattcatatcgggacttaacattccggttcttcttgcagaaaggagggggctctggatatgcatcaccagtcacaattgggtcaatgctatatgatgggaactctttggttgattcagatcattcctatcatataatgacagagacgaatcataggttacttaatgtcagctatgacattcactatgtcgggaattggtcgctagaaacatttcgccgtcagcatatctctgcagagggtgtttatgatgctaagacaggctccttgtgtatgattgcttgtcgggtggttaatatctcgttggactgtgaaattcttgtaactgctcagttttctcctttggatacaaaagtagcacagcatgtcaaggggacaattagaagcttgaggaagaagactgaccctcttttctttgaaccgctggacattgcttcgtatgggttgtacatagacaaagtggatgagtcgatgtggagaatggacttggaaagcaccatggccctgatctcgatgacactatcctgtttgttcattgctgtgcaactgttccatgtcaagaaggttcctgaagcgcttcctgccatgtcaatcaccatgcttgtagttctctctttgggttacatgatacctcttgtgttgaactttgaggccctcttcaagaacagtaacaaacagacatttccactttcaggtggtggttggcttgaggtgaatgaagtcattgtgcgaatcattaccatggtaacctttctgatgcagttacgacttcttcaattggcatgctctgcacgttccatggatgtaagcaaagatcaatcatgggctgctgagaagaaagtgctttggatatgcttgccactgtacattataggtgcagtcgcagcttgggttgttcacatgcaatttaacaacaaccgaaggatgcttagaaaggttgctcgcttacctcgggttaatagacatgcattctgggaggaccttgtgtcatatgggggattaatactcgacgggttcttgctccctcaggttatcttaaacgcatgcttaggctccaaagtgaaggcactttccccgggattttacattggaagcaccatgattcgtgcgctacctcatgtgtatgatgtgttcagggctaagcattttgtgcccagcttgagaccattttacaggtatgcaaaccctcgcgatgatctcttcagccttgcatgggacattgccataccatgtggagcaatactgctgtcggttcttctgttccttcagcagcggtttggaggcgctttcttcatttgttcgaagaacaggaaggcaagtgaatatgaaatggtttccacagttagctcttaacaagttttcatctgtgcaagagaaatatagagaaggtttctataggctaagaaataggttgcttcttatgtctatgtttgctttacacacttacatacctgccttgttgaagcaaaattacatacaaaagaagctattcaggttgggcattcagcaataatgtttaaaatgctccgttcatttctatgtgctactagtcagtttacaattacgctgttattattctggtattcagaggcagtcgaggtggatttctgacccatgagaatttacatctgcgtgaagttatggcaaatgctgtttttgggtagtcattgcagatcttgttcagttgtccgggttgcaggccatgtgatgcatagtcgattcggtagctcactgctcaccattgattttgtttgccgttgtccgtacgttgcaatgctcaccattgatttgtttgccgttgtccgtacgttgtaattcaccgtacgagtatgtagtgttttaaagcaacaacatttgttagaagcttgacggttctttaggagcacagaaattaggaggttcagccagcgacgcacacgcagatgcttttggtctttgcatgataatttagtgagagagaagaaatttaccgttagcctccgtgttccttttcttttcatatgttaaagaggcgcacatgcgtatgtaagtcgttttcatattttttttagttaaacctatttaagtttgatcaagtttatagaaaatatatagtgacattttcgatacaaaacaaatcaagatattaaattttagttttaaagaaactaattttggtgttgtagatgttgtcaaatttttttatagatttatttaaatttaaaaagttttgacttgagaaaactcaaaactgattataatatgatgaaacgggagtaatatacatacagacaacggtttcagcatcatctaagccctaattttccctgtggtgaaagctagtatattttttattgggcccaacgcgtagtgggctggcccgaagcctagcccaaactatatcagcccgttagtccatcctatctttgttaattgtaatggtaagtttgtactcgctcccttccaaaataaaaaggatattggatagatgagacacatcttaatactacaaagaatttggatagagtctatcaagattcataatactagtattatatgttccatctattaaaaatctttcatattttaggagtggaagtaataacaattctactcgtttgtgtccgactctccgtcaacgagggcttaggtttttaaaactaaagcatattcaggttgatatatgccttcttttttttgttagtcgactagtgtgaattaatatcatctaatttaggtgaatagttaaacgttataagaaaaatttaaacaacatctgatttgggtggaggtactagaaagaaagaaagaaagaagaaagagagatatatatatcatagaaccgcgcccatctctacgccaatccaacgtgcacgccaccatgtggtgaggcagaaacacagtcgcatcgcatggacatgacaacatccaccacattccattccaacctgaccccgtctgcctcacggcccctggactggaccgcgccgatgcacgcataaacccctcgccctcgcccaacgcgcggttttaccctcttttttttttttcttttggccccgtttcctcccaaacttccccttcctccgcgtcggttgactccgaccggcagccaggccagccagagatatttaaccatttgccacatttagatgtggcaattaactttttgttacttgaccccatatatcataaacacatgtggatccacatgtcattgagataggggtgacaaatagttatttgccaaatctaaaaatgacaaatggttaaaagccccggccacccaacccaaaccccgtcgtctcctctcccgctcgctgtccaatcattcacaagcgaaagcgactagccccacctcactcctcccctcgcgaccgcgtcaatggccgcacccacgccgcacgtcactccactgacgacgacgtcccgtccccgcccggcagccaccaccggaggcctccttgactcggccgtcgccatcgttcgcctcgtcctcctcctcctcctcctccccgcgggtagctttcgctgccacacacacacacacacaaacacaacgacctcgccctcgcgaagacgacggacggactagcactagcgtggcgggggacggggccacgccgtttatagcgcgacgcggacgactcggtggtggtggtgatgatgatgagggtgttgggtttcatgggagatggtggtggtggtgggatgatgacggcgcaggctgcggcggaggcggcggtgggcgcgatcgggtgcgggtacgacctcacgagcgacctccgcctcagccgcgtcaaggcgggcgggaggctggtggacatcgacggggcgagcggcgcggcgagacgggagctggtcctcccctggggagccgtcgtggggggcgtgccggtggggatcgtcgccgacaagggggagcgcacccggttccgctccgacgtcctctccttcgctcaggtaacgacagtgcctcacaggtgttcgatcgggtgatccctttcagttcactcggaattgagcttgagagttttgttgtgttgggtggtttccctgccatggcggttcgcagatggcggagcaggtgaaccagacgatgtcggtggcggggaagatcccgtcgggcgcgttcaacgccatgttcgactaccacgggtgctggcacaaggacgcggccgccacggggagcctctgcttcgacggccgcttcatcgagctctacgccgtcgaggccccccgcgcgcacctcgccctgctcgaccgcgtcaagcgcgacgtcccgcccttctgggaccccgctgctctcgccgagtcagtacgccttcccccgtcgcgcgccgcgcgcccggcgttcgtcgcgtttgctgctaccccagtggccactgactctagtgtactgacatggtcgctgccgaattttctgttcagattcatcgacaagtacgggacgcacgtcatcgccggggtgaagatgggagggaaggatgtggtctgcatcaagcagctcaagggatccaatctcacacagagcgatgtgcagtctcggctcaagaaactctccgacgacaagctcgctcaggattcacctgaaagtttaactgcaagagacgacaagttcttgctgggattaaacgtgagctctctactctaacattatatggcttcaaaattagctttcttaggtggtgtttacatccagggacttaacttaagtctctgtctttagacactaatttagagtattaaatacagactacttacaaaactaattacataaataaaagctaattcacgagacaaattttttaagcctaattaatctataattagagaatgtttactgtagcatcacataggctaatcatggattaattaggctcattagattcgtctcgcaaattagtctaagattatggatgggttttattaatagtctacgtttaatatttataattaattttcaaacatccgatgtgatagggacttaaaagttttagtcccatctaaacagggccttagaagcttcagaattactgtattggactttcataacccatgattcggtttctgaagatacaggcgccattaatgattgtaagtagccttgctaattgctgtgatgttgtgcaggggagtttattattgggtcctggatctgctgcttggcggtcgttcagaccatcagtcgtgtcacacaaagatgtaaggcaatcacacatgtactgacgatgttcattgcgtgatttatcactccaacagcaggaaattaatgagagagccatgattaatttgtttggtcgcatgtcctttcgtttcacaggacatcctcagtatccacatcagaagagggggcgttgataatggccaaggccacagtaattggctttcgacgatcagcggttcaccggacgtcatctctatggcttttgtgccgattacttctctgctcactggtgttcgaggctgcgggttcctgaatcatgcagtgaacctctacctcagatgtaagcactttgttagttactgctggtgacaaacaaaaccatgccagttcaaggatcacatcgtatctcaagtactgacatagctaaattactcaggttacaagtctaattatctgtctgttttctgctggtaaattcagacaaacctccaatagaggaactccatcaatttctggaattccaggtgccacgacaatgggctccagagtttggggagctccctctggctttgggcccgagaaagaagaagaacagcctgccatctcttcagtttactctcatgggtcctaagcttcatgtcaccactgccaaggtaacaatcaataccggcattctgcattagtgaaattcgtcagtttgattccatgttgtttgtagtagaactcagctcacagtgtgttccgttttgtttcgtgcaggctgattctgggaatcgtccggtgaccggcattcggctgttcctggaaggcaagaagaacaaccggctgggcgttcacctacagcatttgtcagcgacgccgggcacgatcacgatcgccggcgaggtggcgtcggcggaggacgccaccgtgagggagcgcgactacatcgagcccatcaagtcgccgctgctgtcgcacgtgtgcacggcgccggtgcagtacaacggcgcgcggatcgacgactgcgcggcgatcgtgacgagggcgtggctggaggtgcaggagacgtgcctcaagaagg

SEQ ID NO: 45446 - DNA, 3232 bp, Oryza sativa
gccggtggctccgcgcagatgatgcagcagcagcagccggtgggggagaaggtggaggtgaactccgccatcttccccaagggcccgccggtgcctctcccggtgcagaggatggcgaggtacgtcgacacaacggaggtgatgaggggccccgccgacttgccggggtactgggtggtcaccggcgcgaagctctgcatcgaaggcggcaaagttgcactcaaggtcaagtactcgctgctcatcgcggaggtgctagactaccctgagtgactgttgagaagaactgcacggtgtgtgcatctttttggctcgtttgtgatgctgttgtgtacagtacagtacagtacaggtaaggtcggctcagctcagcgtatacttgtacagattgggcacacgctagtagtcaggtatactatttgtatgtataaaccacagagtagagcagtacactaccagcaggcaattgttttggtttgcacttggattctagcaaaactaggagcatacacagttgttgaaattggtttccttaggcatgcagctcaaaaggttatgtacgattatttctcacctctggtattgccctgagatgggatcatttttactggcaatgttgagaatgtgagacggtttggtaatttggcatcagcaatcatccttgttcccaacagtataacaggaggccttttacattgtttgcgagttacttagagaaggagctgaaccgttgattaataaaggggcaagataagaaataaaattattgtaatacgatagcaatggaataattaactagtgaaatatgggcatttcatgtgaattgaatacctgctagctccatttatcagttttgttatagagaaaaaaaaacataaatcatagatacttcgttgatttagcgttcaatatgatccgtactgatgaaaaagaaaatcaaagatcgtgtctcatttcttctttaccttcacttcattcttgttctaggatgtaactggttcaatggaaggagagagagaagacaccggcatggttgagggtcgaagaggagacgagatcgtccaatcgatggctagttgcaagcgcatgattagttatttatgtagttcacaaatttgttgaataaggggttgaatcgagatctcctatatgttttttgttctagggtttgaatggtgcacccacaaggagacacggtcgtggaatatttcatctttctaggaataaatcgataaaatgtgtaacttaaatcgatgcaaatcttcggtgatattttaaccaatcatgtttgtgaaacacaatataaatctcttcttgtaaaacaaaatatatatctcaaaagaaataaagggaggagttttgacatgttctttagaatatagagtaatatagagaaaataacgcaaataataaaattttacgctagtaacgtgttcttcgaaacaaaatacaaatatagagaaaatcacgcaaatgagaacattaaagtatacgacataaatctagaaaaaatcacacaaatgagatctactaatctagtactaggcaaatgacttaattggttgattaaaatttagagacaattctaccattttctctcaactagcatatttgtcataaatacttaactagcacataattaattaagttttaatatagagaagcttaattgttactaacatatggctatatgaggaaacttgatttttactctagttattgatacgagctatgctgaaaactacctttatttatttacaaagtgcatgcgcaagatttacttttgaatttacaagataatcatgtgtatttaggcctgcgccactgaatttgtcggagtgtgaaggattcaatactaacctttcatacttcaacctgcatcacacctataaacactctagtcctgcgcgttcttctcaaacttccattatctttactgaggaatacttttggcatttatgtttcccatttaaggtgtttataagacatctgatcatatgtgttagcagtacttttaacaacaaaatatgttatataaataataagcaagaaaatatttgcttaaaggaaaaatagtgagaattcttggagttggtatgattgactatacatttaagaaagcaattagtaatttaaacaatgttgggttttttagagttttctaaagcggatggatttgcagcagatttgaagctagtcatgaaaaactctgttgcgattataacatgatcaagaatttatctgttggagggatgaaaatgaaaaaaaaaatcatgtcattaaggatctggtgggtaacttaacttgaggttggttagtatttcctgctttcaatgtgtggatggataaatttgaacagaaaaaactttctttcgatgattgttagggttttcaatttccttaaaaataaaacttaataaacagaaaaactttatttcgaggatttttagtgttttcaatttgcttaacaagaaaacttaacgtagacgtagaagatttgtatgagataagagatttgtatgagataagaaccgacctacttatcaatatgaatcatgacaaacatttagctgactatatatacagtggtaggaattactttaaatctatctacaatgtggtgaaacatttaatataaactccgtttgaaaagttatatataatattctttcagttttgtaaacagtaataaccttaacttatatttaacttaactcatatttttatgttttataataaataatgcttacagaattgtggttttatatgtgtggacagttacaagttggttggatgtgtgtctcatagtttatttatatgaggaattgacaaatgtatatttaccataatgtaattattgttaataccgtatgccaagttaagttttcgacctaatttcaattgtatgttgctaaaataaggttattgtgatctttttcttaatatttcttttttagatgtacatgagtagtcactgttgcatataattaatatctttatgcaggattttagtaatgtacttagatggagaagcgatggctaactgttgtaacaaataatggacactttctacttgagttggtgtgttctttataaagtagtagaattagctaggatgatgttttaaagaagtaagttagctaggaggatgtttcaaaggtactaatcaggaataacacattgacatatttgttgttgatggactaaaacgtctatcgaaaggtaggcttca

SEQ ID NO: 45447 - DNA, 2393 bp, Oryza sativa
tggaatataaagcaataaaaatgtgttgatttatatagtggtaaaaatgtatttcttaaaaattggatccccaattacacaccctttggggtctatttatagctgtgcaggcttacaaccccaggggctagggttactgttcactcgggaattaacttaactatccttataatagggacatttataggggtaataatcgtcttatggcccatcctacaggcccatgggccctaaagggtccttgttgggccatttgttgggcttccagtgtgaaggccccaccgaggaatttgtccttcttcgccattcgatgcccctttgttgcatgcttggtgaagacgcttgtcattggcctagcgaagttacttgccgcttgccttcggcatttgtgcgggtcacatccttcggcgtccgacttcgtgacttgacgggtgtttcaagagtccggtcgaaggttctcatgacatggctccaataatatttttttgcaattagttggaaccctgataatcttggaagcaagtggcgtgtgagtcggttatggtgccaaagtttcaccttgttggcctggcgaagctacttgccgcttgccttcggcatttgtgcgggtcacatccttcggcgtccgacttcgtgacttgacgggtggaaggttctcacggcatggctccaacaatattttttttgtaattagttggaaccctaataatcttggaagcaagtggcgtgtgcgtcggttatggtggcaaagttgcactcaaggtctactcgctgctcatcgcgcaaatggactacccgaagttgagaactgcacggtgtgtgcatcttttttggcttgtttgtgatgttgtgtgcggtacaggtaggggtgaaaacggggcgggtatttcccgaccgcccgcctggccgtattattttgggacaaattcgggtcagaaattcgggtacccgaaactttatacggatatagggttcgaatatgggtttttttggaggatatgagatcgggttcaagagcgcagtatctgacggatacggattatccgggaaaaatacggatattacccgattatatatacggatagtaccagtattatatgttacagccgtacaggcttgaggctagccagcccaaacggccaaccactagccaccaggcgccacagcccatcaacccactggcccaataggccaatactaagagcaacttcaatagaatggccaaatgggtggccaagctaaattttagcaaatatgaggggaaaatattctccaacagtctctccatccggttagccaagccatctggatggcccaatcgcacctctcactggccaaacttagagtctctctgcctggctattcgtgggccccaccactccccctcccgcaccatctctccctctcctagctagagcaagaaggcgtcgacggtgctgctcgtgaacggcgatggcacagaggagagagacactggagccagctgcgaccaccgccgccgtcctcgccgtcccagagccaactgcgaccgccgccgccgtcctcgccatcccagagccagccgcgactgccgtcgccgtccgctgccgtccccgcgtggatttgactgggcggcgtggattcgggagaggaagagtgagaaaaagaggaagagggagagaaagagaaagaggaagaagaatgggtatagagggctaacacatgggtcccgctatcacctgtcatagactcaaaataaagaggatagatggagaggctgttggagtaaacaatgaatttgacttgacaaatgaaatgaaaaattagctaaatagacatctggagagtcgaatttagagagactgttggagatgctctaaccctaagaaataggagagagcttgagggagatcgagagtcagagagagaggtgtgaggccgtgcggcgtgcgcccgtgcgtgaggggatttccgccgccgctgcccgctggcctgccatgcccttgcgcaggctgcgccaacgtcacctgcgccaggcgccaccacgcatccatgccggctgcgccaccctcgccactacgccggctacgccacctgcgttgttgacctgcatcgtgcagcttgagcccgtcgccatcgccagtgctcgtcgcgacggcgctcgtcgccacctctgctgcacggcctgcaccggtgcccgtgttgcctctccctccatcctagcaaacttctcgcttcattggccgttaaatcatcaggtagcgaatagtgttgaggctgaaaacaactgatgatttaagtggcgctggtacttgtgaatttgtgatatgtttcctggttggcaaggcttatgttgtgagcgatattatgatgacatagtgtactgataagtgatatcaggggctgcaggaatt

SEQ ID NO: 45448 - DNA, 1394 bp, Oryza sativa
gttttggtttgcacttagattctagcaaaactaggagtatatatagttgttgaaattggtttccttaggcatgcagctcaaaaagttttatgtatgattattttcactgcaagtgcaagagatgggatcctttttactggcaatggtgagaactgagaatgtgagacggtttggcagtttggcatcagcaatcatcctcgttcccaacagcatccactgagttatattacttagctgaaataacagtatcttcggtcgtcaaagacatgtttagcgcaccaggaacacaggtggtacatccatcatctctatttttggttaaccatatacaaaaagccagctgcataggcatcctcagttttctctgggttgcaaaggttagacggcctgtgcttcaggtaaagagttaaaacctctctgccgggacaaccaccggctgtggctccacacgcttcctctcagaaagataaggaccccttttaaccgcttcattcaactgtcacaagatgttttccttggtggtcagcacctcactattcacaatccaacagcaagatcagaaaacaatggaatttacgaggatacctttccaatgagttcagaaaggcttggttcatgaagaagatgtgatgatgataatgccttgctgatcgccagacaacaatcatgccgtgcttccatgcctacaaaaatgaaccaacattactcttttttcatttggtaaacagaaaactgtatgtccacgaccacaatagtaaataagagccactactccattgcattgctaagcgcaattctgattagtaactggtgctaagtgctaaaagtggagtaagaagttgcttaagcttgaaaccatgatcaactctaagcagtcagcaactccaaaagcagttgtacaaaagttctccaaatactaaagcaaacatcatactgtatcacccttgggctggaaaactagaaaaggaggcgctaaatttactgcatcagcatcatcgcaattcataagtcttcctaggtacgtaccaagttttgtcatctccattttgggatctgtaacaaggttgattatgtccaactttgaacaaatttccattaggcaccattctctggcaacaaggccagatattactctgtaaccctgcagacatccaaaggcaattagcatagcctcactatcaagggacagcaattcactttctcactcataacgggtcagcaactgggggatagaagtagatattcagtataaaataagttaagagaactgcttggaatacaggagttccacgggaaatagttaagtcccagctgaaatctgggatgcttcctgtgttccaaacaggttctaacttcaacaagcatgtgctgcttacagttatccttatgtctgg

SEQ ID NO: 45449 - DNA, 3325 bp, Oryza sativa
atgctccagcagatgctgttataccaatagagccaaataaacagtacgcttagttaggatgatgacataagtttctagtaaataccccaccccaataattgatgaatatttcattattgtataacagaagggtaatggacgcataaacttacttgtaccaatcaggcctaaggcctccaatgcactctcagtttcatctgtattttgactttcttccatcttcaataatttgtctatagctagaagcagatttgcaacacctaacatgaacaaatcttgataagaaacttatctgtaattttttttaaaaaaaaatactgtaaatacctgatagcattaacacgaatatgatcctagtaaaagtgccaagaacaatccaataaataggttatcaaatagcattcctcgacacttcacatgaaagatctgttaacaactaatgtacataccatttagtacagtttcattataattcaaagaaacccccacaaaaaaattatgatgcgaagttgtcataaatggaggaaacagtataaatcatagcgattaaaaaactgtggattcgaaaatcttcaatgctcaaaaggaaagattttagcacatctggtagaatagaaattccatagctgcaaagatttttagcacatctggtagaatagaagttggatagctgcaaataaacctgcttacagtttcgatctattgtcgtgaaagcatcagctgaagaaagaagcctcccactaatcaatgttgcccttgaccgtacaatagaatcagccgatgaatcgctatacatgaccaaaaaaaaaatcaaatggatgaaaattgcaagacaaaacatagttacagaagcattaggggaatacttgatcacatcaaccatgagttgaagtaaattagtcttcagcaagaagatattgctgtgagggtgttccacgagctgcattacaacacaatgcattattagctgcaacaacgaaacatatagctacccttagatataacagaatctccaagtcattgatcttgatcaccaaaatggaagggggaaaaaaaggcatccaaagccatattctcctcactgcttctattctgaggattttgctgcagcttaactaggtactccctctgttgatttttataaggcatattttttttattttaaaatgttagtacctcgtagattataaccaatgattagtcaaattacaagtacatttagtataaagatctaatggcattggtctggtttcatccagacattcaacatatgatgaattacaactatcaatgcaacttatgcaaggctcttgcaaatgaagagaaaagaagaatcccaccacactattgacgtaaagccagaaataagccaatttgccataagtactttctttcaattgtaaagctttttcagtaactaaaagcaaaagggcctatctacttagaaaccaagttgatggaaactatcatgtatcaaggaaaactgagggatgcaagccaaagtgccaaacatttagcaagccatgaaagtcaaactggagtactgcacaaaaaatactagtatattgttacctcatagaggacctctagtgcactcagggttttaagcatgtctcttctatcttttatctcatcctcaaataagctgagaagatttgagtcgtaaatggcagtagcagtataggttgacacagcaaagagcttagctatcagtgatagaatgcgaattcgtgcctacaaagaagaggaagcaaggaacattaacacaacttaaacatgtgtattgataaattcagaaaaaaaaaaactttgacaagaacagaatcaagatgtcataccatggacgatgactgagctgccactttgtggagttgcacagacccttgaccatttggtggaaatatgatctcctaaaagccaaagcaaaaattagccacagtgataaccacaatgcactaaaggaatatatactcaacaattcaaaaacatgattatactcacaatgcctttaggaatttgtgctaaacgttttatgccatccagagaaattgctgaaatctcctcatctctacaaaaggcaaacagaattaataacaggtatatctccaagaacacgtgtcatccaaccaacagaacttgctatatgtagtttgtgatgtcgaaaataattacccctcagttaaacaattcatcagaagaggatatagattgtgctgaacaaatgtgtccacaacaacagcactatctccagccttatcaagaagatgtatcacctagtaaagaatttgaaaggaattatgtgaaaacgtttatttcaacgggaattctcagcagtcaaaatatttatatatattcagggacaataggacatacagctttgcaggctagttgtctggtattcttcgagtttgcaagcaatccagcttgaataaatgcctgaattatcaaattgaaaagttgaacttcaggtagacagatgtatatagttatagattacttaaggaataaaaagaaacagaataatgtagttggtcattttggaatatgcttcaaagaagcacaagcaattgaccaaggttaacaggtgtatgtgccaggtttaaaaattaaagagactatttcacacatacaccatagcttggcagaaatgatgctccatatctcgaagaaaatactttgtccaagcatgcggcaatagtttcatccatcccaggtacatcagcctcactctgcaatgcactacaggaccaagacgaaaattaaaacgaccactcgataactaattcattattttgcacaacaaactagtataagcaccatagcatttgtggggactagagatgtaaatagatgacttgaacaggtcggctgtaatttcatgaactcattttgaggaacaagcagtttaccctaacagcttgggcagagggtattgctccaggaactgcctcacggtgtcatcaccatgcgctcctgccacaaaggaagtaatgcagtgagtgcctaaacaaattgtgccttctccaaatgcaaacaagtccaattgaaaattttaatacgcgccacctgagtaattagcaggggaaaaaaaccagtcattcacaaatggactgaagagaggaaccctatttacagcaacattgcaaaaccagcaagccataatataatccaaccctaacgcatgagttacaaaagttactgaaagcaagcgcgatcaggagtgcggaatcagatgtttgcggtgatatgcaacacctactaagcaggctcccacctagcaacatgcaaagcaagctaatcccatcgactcttacgcgcaacccaa

SEQ ID NO: 45450 - DNA, 35370 bp, Oryza sativa
  unsure (1)..(35370): unsure at all n locations
ctagtgcgggccaaaaaatgattcgccctgagccagatgagatggaggaggacgaggaggggccattgcctgggtaggacgcgaactccgctgccgcccggagcatcgcttccatctcgccgggctccatcgccggcgcctccatctgcgacttgcttggggggaaaccctagttgcggatgcggagagcgagacgaactcgagcactgactggcaaggcaaaggcagaggcagccgctctgctcggaactccgcttgtagtgatctccaccgagtcggttgcgccgcgtgtgctcgccgcgtgcgacggcggcgtggcgtggcgatcgctggcgcgcgtgggccccacacgccggccgtgcctatccaaatccgagagcggcctgagccgtccgatcatcctcctcctcgagcgcacggatctcaaagagtggatgacaaccttgttgggccgagcccaagaatcttttcagtttgacttgggccctctcgaacctcgcactacttcgatgcttggcacaattcggcagagcccaatttcatgtttgttcgtgctcatgacttcaaatatatgcttctgaattttcaaagagaaaacttgtgagatcctgcagagaactgaaagtgcaggtagcgccttacattctcttttcctagtccaacagttgaagcagtcgaggcctcgagggcttcacataattctgcagcctacctattagagcaagtttaatagtatagcccactaccagctataattcatctatagtaaatctaataaccaattcatataatagttgcttactatactattaatatatggtcccacctgtcatatacacattgcgtctcgaagtccgtgctgcagctagctacaaatctgtagcccgctgctcttctctctcatcttttatctcattaaaatatgtttacagctagctaatagtctactattgtacctgctcttacaatgcagcatttttcatctctttagttttggtaaattttcaccgaatttcatgttttctcatgtcattatgtcatatgtatacttgtgatttttcaaaaaataaaacttgtgagagtgatagatatgcagcttatatgcacaatacagtaattgtacgccaatgaccacattcatcggctgatggagatggaacactacagagaactgaaagtgcaggaagcccttacagtcttcttctcctgtagtccaacagtccaagcactcgaagaacagctctatcacaattcacaagccctgtgcatccatatccatgcatcatgcatggatacacgatttgcttctctcatatactactagtcaactgcaactagatcaagctggaagcaactttctgcaagactgtgtataacccttgacctgttcccatgtttcctgtctgaatccgactgtgctcaagacagcaacattgcaatcctgtatcttcatttttctctgttggatactgaaagtatgaaacttgatgacaagtgtaacaacagtagacagcaacagtgcaatcctgtatcttcaaaaacaatttcttggatactgaaacttgatgagaagtgtaatagcaatagacagcaacagtgtaatcctgtatctttcaaaaaaaaatcttggatactgaatgtctgaaacttgatgacaagtaataacaatgcaggaagttgaatcttgaatcttcagatagtgtcacagtgcttcctaatttggaaagttctaggttgacagacctctacatatatatggatcactctgggttcattcattcattcactcattcataatggatcaatctgctggattcatggctgagggccaacaacttttatgtgcacttgaagtgaagcctgcaatttgcaggtagggtggcaattttaagtcctgaatagcacctgatctggaattgcagttcatgtcttatgtagcctgaagaacacacatgatgtcgacgtggagtactggaaaacacgagtactggtcgttttggtaaaggacaagtgaacaatcacatcttgcaatcaatgataatgtatattatcatatctctacctgctgagaatctgaaaaacttcagagtttaaaaccttcagcacttctactatttgcatacatgtaactaggggcaacttttgtctgttctcccttggatctttggtgacatagtagtattgttctctagcctctagctctaccatccaccaaccaaatgccaactaagatgcagcatgtaataatctggcaaaccaaacatccttctgtaaattcctggtcttcacctatagacattgactatgaaattcaggtgtcttttgctaagctgtaaacctaactgaactcaccaaacatgtgttgatatatactatagtagtgcctgaagtttgtacttttgttcctacatgtgtaaactttcatgtatcgtacaataagctaatcacctaaattaagttgtaagcagggcactttcattctaggattgatatagtaatagtactgaacatgtggtggtgtacttggttctacactgtggctttcctgtagtcaatggatcgatgattagctggaagaaaagcacaaatgagtgcttgctaactctgctctcttggcactctcttctcacataccttttctctctattggccatgtgacttgacagaatatttttgcagtgcatgtgccttgcttccaatccacaacatgatatcgatcagcagcagttagggccaatatccaactcgtgagctgtggcatttttccttttgggaacttggagcgaataaccagcatgatagaacctgcatgaagcagctagtcgatgagaataggactaggtgcctgcctgtattttcagcaaagtgagtgagaaaagcattgcaacacatgcagattcggctgaatgatcagcatagaaagtagtagctgtggttcggctgaacatccgtctagcacctcttccttctcttaatccttttagtatgtttcaatttgcgttttgaggaggttgtggtgaccatcgtttctgctcttgtttgtaatccctccgtgtattcctccactttatcctctagagggcttgtgcacttacgcagctaaaacctgccctgtgtaagacgtttagtttgtagtaatattttttttagggaatacgtaaaaggattgcgcatttttatattaagaggaataaaatttatacaaacggcaaacacagaagtgagagagggggaagaaaagggaaaaagaaaaacaatgacttaagcctattctcactattacagtgtgatgactgaacgactaaacacgctaattagggagcgctggcgacaggagatgggcaagacaccaaagggtggcctcttgcgccatagctgtgacaaccttaggccaggacctggaacggttgttgaacacacgattgtttctttccttacaaatagaccaagcgctaagagtcacaatcgtatcgaaccaacgacgacgctctctcggaactttgagccagcaagaacagcgccactcatggaagaaatcaacaccagaggtaaagtaatatatttaggtgagcatttcatccgcgatgaccattctagaaaaagcatagaaagtagagcaaagcacaactgcacaagagataacttgttcatctcctagcttggttgactgaatgaaatgtgcaaggaagtggaaagcattccattcgatgccaagggaagtatatcaaactgtttttctaataatggaagcttttattgaactcaaaattctgagaacacttccaatctatgcacaacagtgcacacagacaaatgaaactgtttgcaccgatcagatcatgattaattctttcgtagcatctagtgtgcatagtggttgatcatgagtgataatgagaacaacaagatcaagctttcacttatgctaactggaacagggcctagtgtttaacacctaagcaaaattatggcgattgatgcatccaatgatgaaagcggttagcaggccaggtggatcaaggcgactagttaacagtgtccaaatcgaacccagacatgcaatatgttacggaaagtgtaaggtgagatcgcttaaaatgcaggcaaattgtacaggttgatcgatcgagctcacccgggccctgcagcatgtactgaagacgagaaccagatagcccattttcgatcggtaaccaaatcaccaagaagttaaatttaaggagccaaattcctctccatgaccatcattgacgctctctctagtcgttgatcaaaatcatgctgcactgtcacgggagcagacatgtttttttttaatcgcgaggacaatggattgagttttgtgagattgcattgttaagtgctggaaattaaaaattagattgactttgtatgcataatgtattaatttaaggacagacagatacagctgatacactctgttgcaattaactgatcaactgttagtagttaggacatgggtgcagcctaattctgatttctgaactactagtacaagtacatgcatttggattgggtttctttctgcctgaactctgaagccaaaatgttgatcgttacgtgcccgccatacgtatgccctgcgagggctggatagccgcagcttttcaaaatcttcagccccttttaaatagtccaaaatttcatcaagaatacgagaaagtatagattgaactaaaaaaactaacattcagaagatgggaaattatttttcagatttaactaactagctaatcaccattgccaactgctttttaaaacctcgagcgtgacttttgtcagaactctaagatctattccatttattctcataaaaaaacaaaccaaaaaaagtgaacgtttgatcggtacatatcttctgaagtgtaagtggtaactcataaacccacatataaattaaaaataagcgaataaataatttatttcgatctataaataagtttcgtgggttaaccatttataaccttgcatgccccgtcgggccgcgaatcattggacgacgtagcgccgccgctggcggggcgccgatgaatgcggcccggctcgacgtacgtactatcaccaccggccaccggcgcgggcccgaacgactcgacggcggcccggctgctttcgccgatcgccatcatgatcctacacgactctgcatcatcactgcatgcatgcgttgcgttgcatgggccattatgtcgtcgcgatgctgatgatgctgatgccgatcgatcgatcgaacgatctctccaaactattttctccgttgatccgttcgcgatatccggagaaataatttggccatccatggcacgcatcatactcgaacgtgtcgtcacaaaaggcgatgacgtgcaccggccatccatccatccacctcctcactctgtccacacgcatcagcaaaaacacggccacgtggaccaatccaatacctaaactgccacgtggcaacagtatgagaaaaaaacattttgtactttcctagttggctctgtgtttagttggatccaaagtttagattttggttaaaattggagatgatgtgactaaaaagttatgtgtatgactggttgatgtgatataaaatgattgaagtttggatctaaacatagcatttatttccttaagaggtggatagaaaattagattagatcaaaatcggcaacgtagtagaacgtacgtgtgcatgcttcactggatcggcaacggatggccggcacggctggtagtgagatggcgtgcagggttcagcgttattccgagattttccaggcctgtgatttgatttgattgggacattatggttgtgtttgttgaaaatcagtgagtttatatacacaccaccagaaaatcaagtgacatgtcactcccatgtggccatgcggcgcgttctgatccgtgagagatcagaacagttcgatcggaatggaagaatcatcgatggtttgtgattggaataatcatcggttaattgcacagcaacatccggcgggtgagatcgtgattgatcctctcctgctgggtcggcacagaactttcggctccatcgtttcacttatatgacatatttacaaacgaaaaataatttgtgaataaaattttatatacgtattgttagtaacctaaaagaaaagtctaaaaaaataaacttcgatgaaaaaaatcctaaaatcaacttcaaatctaaggttgaaaattcaaattttggctgataagtataagcataagcgaaaagatgaggccgtgcgtctaaattaatttcgtgataaaaacggcagcaatatacagtcaccaatgaatattcacccaattatacacggatgtttaagaatagtgaattctttaccatgtagaaaattgtattatactcctcaagaaataaaaaaaattatcccttgctatgtaaaaaataagaaaccggcagccaaatagttatacaatttaaggagctatacaacttttgaaaaaaaaaaacttcaaaatcattcaaatataactatggtatcatgggaaaaatatccattgaaaacttgtatactcactataagtgaatcaacttattagtgattaaaaataatttataggtaaaactttatataaatggttttagtgacttaaaacaaataaaaaaaataaactacaataaaaaaacctaaaattaaccccaaaattgtgttttaaaattttacttatgcttataagttgaaggctaaagtgcaaacgataggcttaaacgatgggcttaatagtgtaaatatactgtaataacttatacatatataacttacacataactaacaaaacatgtttacgaacaggaggtcatgggttctttctcctgctaatttctatcaacggaaatttcgcaaatctatttaaaagtagcatacagtaccctttactatgtgaagaaattattttactccatgcaaaaatttatataaaaaattggataggagtatgaaccggaggcgatctgccaacgcagcacgcataaaaccgaccgccgcagaagcgcgttctatccatgatcatcagtagccgctgcacggcaggtcggcttttataaaagacgacgtcgtctcgtcctcctccatcgccgtgccggacacagccaaaaagcggcctccgcttagctagccgcagctgaaaatctcctcctccatttcgaagcagagcagagcagccgccgagtgtttgattgctgcagtgtgtctcggcaaagcgcgacggcgacaatggcagctcgtgtcgtggtctaggaggagggagcaggagcaggagctgcgtgcgtttcttggtttcttcttgtgcgtcgcctcgcgcattggggacgacgtgaggtgatcgggcgaggaggaaggaggaatggcgcgcgggaaggtggtgttgatggtcgtggtttgtctcgccgtggcggcggcggcggcgtcggcggcgagcggtggggggcacagtcgcggacgcccgggcaagtcggcgaggctgcagctggtcccggctgccccgggcgcgtcgatggccgagcgggcgagggatgacaggcggcggcacgagtacatctccgccaggctcgcggcgtcgcggcggcggcggcgagcggaggagacctcgtcggtgtcgtcggccggggcggtggcggcgtcngcgttcgctatgccgctgtcgtttggggcgtacaccggcacggggcagtacttcgtgcggttccgcgtgggcaccccggcgcagccgttcgtcctcatcgccgacaccggcagcgacctcacctgggtcaagtgccgcggcgccgcctctcccagtcacgccaccgccaccgcctcgccagcggcggcgccgtctccggcggtggcgccgccacgggtgttccgtcccggcgactccaagacgtggtcgcccatcccgtgctcgtcggagacgtgcaagtcgaccatccccttctccctcgccaactgctccagctccaccgccgcctgctcctacgactaccggtcagtatcctctcctctcctcgccattgccattgccattgccatgattccatctccattgacgcgcgcgtagatctcatctcacaatgcagtgatcctcgtgctcgtggctcgtgcgtgcgtgtgcagcgcagccgtagtaagtgccgggttgttgggtgggtcgggatctcgcttgcgcgccataaatttcgcgggttttttccttcgtctccatctgctgctgcgctgatcgaaaccccattaactgcgcgcagctgaagcaagcaggagtagtcctagttctacagtagcacgacagctcgtacggagcgtggtactctgcaatctgcagtaattttcgcgtgactttttttatggtcttcttggtcggagctgagcccgattttaatgtcacacatttactgagctcatctgctggccgcgcacgacgccgcgccgcggcgtggcgtggcgtggcgagagcgcgcgcgcgccgcgccgggcacgtcgccgcacgatcggctacggctggtcgcgcgttcgcgttcgcgagcgccgatgcgctgtcgcttctcgtccccggaagcgcaagtggggcgagttggcgcgcgacaccgcgcaccgaacagtgggcagtgggcggccgggggcgcgcgccatgtgcgcgccgtacgcagcgcctcgggctctgcacgcgtcgcggagaacggagcaggaaatattcagagaaatgctgcaactgtaaacgcggctgattgactgaagcccgtattgaattgccaacctttgcagtttgctctgaccgtcgtgaacgacctatatatcactgtcgtataatagtgtaacggttaccttaaacccaaagttagccggtgtactaaaccaggcacgttagcagttaattcaacctgtctgactgaccatatccaaattgtggccatgttctgtatgatctctgtatatccaactgagttttttttaatagtttgcagctgttttacactaactgcagtggctgtactagctagtactcctagaataacccaactccaaatatgaaaacggcaaagctactgctcaggagtcaggagtactaccgttctgctctcctttgctggatgcttatcttgaatttttaaggttaaaaggcataataaataactaattataccgacttcatgatgttgatactgccagtcagattcattcaccttactgttctttgtcgacgacagactggtcatcacttggccggcgtagacgatgtgaatgagctgccgagataacgctgcaatctcggctagtcttttccctgtgctttacagttcatgaaaagatatgtcttacctgttccatgattctgatacagatcatgtagaagatgagtaacttacaagccggttctttgtagaaaagccaggtcccaaagtcatatcacgatcagttctaatctagtagtaaccaagtgtacattttgggctaaaaatattattactcattagttctaaagtttggcagtttttttttttgtgtgtgtaatttagcgcacgaatcttagcatgtgcatggatcttaactaacggtggctaacgcgttggtggtgggcagttacaacgacaactcggcggcgcgcggcgtggtgggcaccgactcggcgacggtggcgctctccggcgggcgcggcggcggcggcggcggcgaccggaaggcgaagctgcagggggtggtgctggggtgcaccacggcgcacgccggccaggggttcgaggcgtccgacggcgtgctcagcctcggctacagcaacatctcgttcgcgtcgcgcgccgcgtcgcggttcggcggccgcttctcctactgcctcgtcgaccacctcgccccgcgcaacgccaccagctacctcaccttcggcgccggcccggacgcggcgtcgtcgtcggcgccggcgccgggctcgcggacgccgctgctgctcgacgcccgcgtccgccccttctacgccgtggcggtcgactctgtctccgtcgacggcgtggcgctcgacatcccagccgaggtgtgggacgtcggcagcaacggcggcaccatcatcgactccggcacgagcctgacggtgctcgccacgccggcgtacaaggcggtggtggcggcgctgagcgagcagctcgccgggctgccgcgcgtggccatggacccgttcgactactgctacaactggacggcccgcggcgacggcggcggcgacctcgccgtgccgaagctggcggtgcagttcgccgggtcggcgaggctggagccgccggcgaagagctacgtgatcgacgcggcgcccggcgtgaagtgcatcggggtgcaggagggggcgtggccgggggtgtccgtgatcggcaacatcctgcagcaggagcacctctgggagttcgacctcaacaatcggtggctcaggttcaggcagacgagctgcacccaatgaacagtctattgatgcagatattattcaattattgtaattggtgattttgcgatcgtattaattaaaaagtgttaatgcaacgggttctcaaagaaacaaaaaaaaagaggaggggggggggggggcaggaatgtgcgtacagcgaatggaaatgttttgcaagcagaaatgacgaatggcattttaggggatgcatgtaaatgatttagagaacttcacaacgtttcatataaacatcagaaaagcaagttagggtattagagaacttcacaacgtttatgaacatcaaggcaaagtattcagaagcaaaatgatgagcggctatcaggcatttgttcacagaactaagaatcaggatggcaaatcttggaaatgctcgcatttgttcagagaattaagaatctggatcgcaaatcaagtgctcgcatttgataaaattagcttgggaaatcaagtacacaatgcggacagatattccatctacaaatagatagataacattctagatttctctttttagctaaatatgcaaaatggcaacttcaccagtcttgatagaactccaagaacactttctcaaacagatcctgatcaggcttctgtctgctccctcaggcgacggattgtgcttctgaccgtgaccgcactggcagtgctggaagagcgtaataacaaagttaggaaacataatagtggacggtgcaccttacaaaacaccacacttacttcatggtgtaggcaccaccagccttgaccttgccacagtccttgcatccccagattccaactgctttcctcttcacagcaaactgtgaatcaggaatagcagtagacatggttagcaagaagcgattatacagaaacaatgcagataaaatagaaaacaaaggtaatacagaacaacacactgattaagagggaaaacattgtagatagtgagcatattgcataatcagaggctgttatttactgtttgattatctagatagttgaaatgaattgcaaagaggaatacttaacctaacctaaaaaactaataactaaatattaagcaagtgatgtagagtagcatggtcagcactacgcaaatttgaaggtatggtgctattcaagttccctctaaccagaggtcatgcaagaaacaaaccacagcagaacaaaaccagatatgattattttgaatattgtgctgcttttaggatagtcatatgacaacaagcatgacacatcataatacagtcaagcaaacccaaagacacttaaagcatcttgctgacaagtaatcattaatatccttggaagaattaccttgccacagaactcgcagaagtacttggagtgctgggaaacctccatcttcttgatctgcttacgcaaactggcaccatacctggtacctgtataacattgatattacaagggcatatgttaacatgagtgatcagacattcatgatgctatgaactaacagtgtgcacagttacaatgtcattaccatatttgccaacgattcctgccttcttggtgcgcttcgtctgcacaaacatcacaaacaagacttaaacagagcacaagcatagttaatggtacagtccacttttacgtatggtgatgattgcagacaaccccactctgtactaaaaatacttggaaagtataacttgtatatacttaaaacacatgacatttccacagtagagcagaaagaacttgtgctaataagaaaccccactctactataagtattatccaaaacagtatattaactgatcatgcagtaccaatggaaacatcggcacatggcagttggcctcaaaggaagcttaacaagctaaagtgtttaatggtgcataatttgaggtaatgatcatgcactttattaatcaacccactccaactaataatttggaaggcagaaattgtcactttaacaacagaagacggcaacaccagttcatcaggtaataatacagcgggggatctcacagtgatagaattcgtatcaagaactacaagggcgaaatacaacggaagcatcacgcaagtgtttgtaccacgaaatcgttaggtgatcttgtgttggccacgaaaaagcgtcaacagcaagatctcacacgactcccaacgaggacattctaccggcacaaaccaaaacctcctaaaatcaaacaggaacagcaaattcctcctaaaatctaaccggaacgacatattcccattgcgctgaacaaagctacaactaaaccgaaaagggtcaggatgattcaatcagcacagcgagacaacgagttgatacgaaggggaaatccgagtgcacgcgaaggattggagaggacgtaggtacggggagaggagatcgtaccatctagtcgccgaagagttggagtacgaggcaggcggcggcggcggcagtgagagaggcggcggcggcggctgcgagcgaactcgagagggtggcggcgtggtggagctttatataggtgagttttagggtttcggggtcacgttgctgctggcgaagtgacacgttgggctttcgctatgaattccataagcggaggtgggccttccggcctggtagggccttccacagttgggcccttttagtttctcatcggcctagtattacaaggacttgtttggattgtccaaaataccggcccatccaggtctgtaggcctagtcccacataggtggactgggtctagattgaggcccacacaaacaaggcctagattaagccgaatgctattggacgaaaatcttcccactattggagttctgtatatgttagttttcttttgtttgattgtgaaatgccctcaggtgatttttcctgaaattttagtacgaatttggtttgtttaataactagaaaaaagccggtgcgttgcaacgggtaaaaactattttaatattattattgttatatggtttagttaagatgaaattcatagtgagaattcgggtctgttcactttgatgccattttcaatcttaccaagttttggtaaagttatcaaaaaaatggctacatttagtttgttgccaaattttggtaattatataagaaatcctgccaaaattttggcaagttaccaaaattttggcaactatgctaaaattttggattgccaaaatttggtaaagtttttttttttttttgcatcaaagtgaacaggcccttcgcttggatgactcctatattttcaaaagtgaacgaaattgaaaactgactcaaatccggatatgtatttccaaaagcgaattaacataaaaaccgacttatacatggatgaggtaccaaagtaccggcaaaaacatctttaatttttatttttaaaaaatactaggaatgacttaaattgtaaaacggaggaagtaatatgggactatgagtaaaatttttaatcggaacggattcgtctaatccccacctatccagactcacacttgtaattgcgccttgcatacgtgtgcgtgcggtgtgttctgctgttgttatctcgaaaaaaaatatatagcgattgaaaaggaaatacttttatcaccaaatcggagaagaacagtaacacttgcttgcaggtccacagcaatagtcaacctagtgcttacttgatgttaactgcaattattaggctccaatcacactcactttattctctccctaatcacacagaaaaacacacacagcacgcgctatctcttgctgtcagacgccgaatggatgaagaacacacatctatcatcccaattagatgtaggcagatcggtcgagcagctagccggttaattcttccagaaagtactgccggctagctatctactctatctatcctgaatttcctgatggattatctatctgcagttctgcatgcgtacataggtagctagctagtgaatggttaatggccaaccttaagatggatggcatttctgctgcatgaatgatggcgccaatcatactacatttcgtcgataattatccttgagctatgtgcacttatgattttctatcatatatattaattaatctagcttagcacttcaatttgaccatatcagctaagatcggttttagatttctctacatactttgagttacatcaaccttagtcctatctataaccctaaaacctaacctaaaattgatcaagaataacaatattatcgaagtttcaaccaattttacctgatatatttattttagcgtaccttttaacttgctacgtattgtgtctgccacttatatgagataattgatcttttcaaatatataagtatgattcaatctcaggccagatcatcatgttggggattgggccttatttggcatatttgacttggtcaacacttttatataaaacacttttatataagtttgtattaaaataatagccaatacattatctttatgctctaaatattgaatcatcgactagttttcataatattgatttattaacttacatgattaattttacagtcgatggaacatactcagggctttgttttgttcaattcatcataaagatcctaacgcactttgttttgttcaattcatcgtaaatattctaacgcgtttatctaatttcatttattgttaggacctacactagagtaaagcaaatcttcaaagaccaccgtgttttgcatcaacaatcagtcagattcaacaaaatatcatcgccgctcatttagatttaagtgtaaacactagggaatccctgattatagggcgtacatttctcttcggaaatactccagcattatagggagtactacagcaatggcaccagcatttgtgctgtgtcatgactaagcaatcagcagaaaaatcaggtaccggcactctgtccgtctaaatgaccaccttctcgattggacaccagatatctgaaccactgaatccatctgcctatcattttcaaatatactcaacgagcagtgccaaccaaatttagatatacagatacgatatcaaacggctgagatcacgatacaaatgctaaacctctgtagcttcaaatccgctaaaaagccttcaaataattgtcatcatgatacagcaaatagtccgaaataaaaagaaaagctaaaactcctcaaaaccgcttaaatttctgactggttaaccaagtgactagctgatataaaaccctccacggtgacaactatcagtttcgcagcataggcaagaaacctgtttcagttaaaaagtgaaattattgttagttttcaaacttttgacttgttatgcaatagggagataggcaaaaaaacaatgatatcaaaatatattttaaccatgcaaagtgcattatgctctgaagacagtatcaacatcaacataaagtcacaaaaacatgaagaaatcccatactgtaggtttctttaataccacaatacccccccaaaaaaaaatggtccctgttccactaggaatgagctgaaacttgactgtctagtcaaccaggacacaacttgactgtcagctaatagatagtaattggcgttttcatcttccaatgctaagctcgcaattcctacatgtatgtatacatcatcgggcaaaaaacccagacctttccacaaacaactggaagcctgaaaccatcccagggatcccagtaaattcctcctgccaccccaattctgttaagttaggatggggccatgatcccgacctggattgggactcctaaacaatgacaaagtatgaaaggaacctagatcaactaaacggcaaagcatatagtgtaacacattagtttataaccctcgagttcgctatatgtcactctacccacatgaacgcttgtgaacagtaaaacactgacaatattagattgatacatgtagaggtcattggaggcaaggttgtgacaaacaggttgatgagaggcccatcaaccaaagcacagcctcgcactatgagaccgctgaattttatcagcaccccgcagagaacctgcaggtatttcgaagctagcagaagagcttcccccattggcatggagcccttacacacaaacataacgatcactcacaccagaacctaacaatgcaccattccatctaattaggcaacaactgttacgaatactgaattcatggacgattgcataagattctgactgaccccacgagctagatgattcaatgaacagtatacaacatgacgggaagcaataggcaataatgcatcactgtaaaagattaaaaccagtgaaactaagtaccttggatgcttttagatgctgctggggtacatgaagacgcggaccttcttgccctgcaccaccatatcgacccaacaaaaacatcagaaatggccaaaactacaatcaggagcggaatggactggatcaaatgatggcgcagacgacggtgagagcgagattcaccatggaggtgggcgggaggttggaccggaacttggcgcggacgacaccggagttgccgtgcgggcgggtgaccttgccccagatgcagcggatggtggagtcgttgctcttcgtcttggccttgtagacgtaggcgatgcgcttcccggcgtaccacccaacctcctccttggtgttcaccccctcgatctgcagcagcgacgtgttctcgtactggttcgacttcgacctgcgcgagcaaatcaacgccaaaccaagatcaacaccactccaccgcggcgatgacggagaaggcggagacgccacgcagggggagagcgagctgtcacctcttgtagccgaggatggtgccgcggacgtacagcctcacgcgctggccttgccgtcccttcatcgccgctgaagaggaggagtacggagcaagcggcggcgacggcggcggcagagagtagggaggcggcggcggcggcggcgagtgaaatcgagcgcgtggcggcgtggtggagcattatataggtgaggcttagggtttcggggtctcgttgctgctaacggagtgacacgttgggcttcgctatgaattccacacgcggagtgggctttccggcctggtaggggtgctagtgttattagtccacatttgggccttttttagtttctcttcggcccaactttagaaggacttatttggatagtccaaaatcccggcccatccaggtctatagacctagccccacgtacgtggactgggtctagattgatgcccacccaaacaaggcctatattgggccgaatgctaagttagtttccatttttgttgcgaaatgcctcaggtgaattttttttatttttttagagaagggtattttatccccttctgaaattttagaatttagtttgctcaatttttcgcgaacgcgtaaaaggattgcacgtcaatatattagaagaaaatagtttttattacacaacgcaaccagccagaccggtttatgccaggggaagagagaaaaagcaaaatagaaaaacaagaaaactgaagcttagaaaactaccgcggctaaacacaactctaaatagtgaaatttggtttgattaatgttggactatgaactcaaatttttaaccggaacggattggtctaatcccctcctaaccaggtgtgcatgtggtgtgttctgctgttgttatctcgaaaaaattatatagcgattgaaaaggaaatactcttatcacccattggagaagaacagtactcctaacacttgcaggtccacagcaatagtcaacctagtgcttactttgatgtcaaatgcaattattaggctccaatcacactcactttattctctctctaatcacacagaaaaaatacagcacgcgctatctcttgttgtcagacgccaattgcatggattaagaacacgcatctatcatcccaattagaagtagacagatcgatcgagcagctagccggctaaatcttcctgaaagtactgccactggctagctatctactctatctatcctgaatttcctgatggatttatctttctatctatctgcagttctgcatgtgtgcataggtagctagctagtgaatggctaatggccaaccttaagatggatgcatttctgctgcatgaatgatggcgccaatcatactacagttcgtccatattatccttgagctatgtgcatttctggctttctgccatacttgcagacatgcagcagtactagggaatgttgattatgaacttctgagttctgatcagcgtactgtactatgtttcttggttgctgcagtgttgcaaccccttgtaagggcctagaagaatacagataagcaatcaatcctacgtggctttgtatgctctcttatgacttatgcatgatctcagtctgttgtagaatttgtcaagttcagaacattcagatatatatttgaaattgacgcaaataattctcggacctgatcccaatttcttcatataaatttctctgtgcatatccgaatggcacagcagagagaatcgctgcgcaatctacttactgtgctaggataattacatgagcaccaacttggaaacttggaagaaacatgaaggtttctgaattatgactgaactactactgtaatgcattcattatcctgcagtttccatcttaagtactatagtagcagatgtagacgtccatctgatcaggttagttccatgtaattttcctttttgagagaaaaaagatcggcgtctcaatttgtaagccgtgacgtgttgaaccagtgaaagagcagctagcttggttctcaatttctcagcgcgtccgtactgcatatccaagaaaggctcgacaagctgttccctgaacgtgatcttcagaaaaccatgctattcatatggccaaaaccatgaaagggtatatggatcacatcatcacacgatacgttgggcgataaatcttacagatttatatattttagaacaaacaaacccagggaaactattttgatccctcgagagaatgtcaccttgttgtttgaatgtcactcaaatggttatgaaaaaaattaaaaaaaagaagaagatgtattaacatgtgatatatcactccacaaatatgcaagtttcaacattgcctcgagagatcaaaatccactccctatatatagattgatatgcctgttctttttcctctgagtgggaatggaatggaatggcgacatgttttccgatctcataaatgatacattttttctgcaaaaactttctatatatgatttttttattggaaaatcttcttaaatccattttcaatcttctaatacctaatttatttgtttgtacctttgaatatttatcacaaatcatttagctattgaaaaaaaaacccttaagtaatcttgaacgtttcggacagcttagcacatgccttgcatgcccaaatgtagcatacttgagacgcaatatatccatggaggttgttagctagctagctggaggcaggtcgtcgtcatcagataagacacagacatatatatcgtgtagtgatctggagcagctagctaggaggagtcatagtgatctcctcgttttcttgggccgtttcgtcctcgatcactcctggtcgcatccgctggttgccatgacaagtgtcaagctcgattcggtagctagctatagctcgatctcgatctagcctgattttcggagaaaactgttacaaaaatcggcaccgatacatatattagaagctgaacccgaaagaatatcataagtgatccaaacacgtgacacactataacacgtgctattttaatcgaagagaaacacctatatataatccgagtcttgtgagtatatgtttcggctaaatatcattaataaattctagtatatatatgtcgtggtttgttatgtctggggttgatcaatggctaacaagagtcttccgcaatttggactaacttttataacaaaaacccacacacaagaacggttcagttattcagttctcgttttggggtgcgtgctcggctggatatatagctagctttaacgtccgtgcttgcttgcttgcattccggcgagtcgccgcgcgccgggccggccggccagccggcatgtcgtcgttgtcatccacttgccagcaaatgcgggcagagcaaacagacgcagatcgggtcagcgtaaaatgcagctggatttttactgcggattaattactactgggctggcattctgatcactttgctgcatttggttagtttggatggtgcagataaatcagacatgaactggtggattgtaaaattcggttcacatacatatgaatcgaggagaatttcttgtctttcaaatgggacttctgcttataggacttgttttgtaccctcgagggatgaaaacattctctgtaatcatcatcttattatcatcaacggatgcattggaatctatatcaattaattcaccagaatgataaagagatatgctatactgaccatttattatcaatttgtagccataattaagtatggtttaatttactccatttttagaacgacctactcatgaacagcacattcatgtatctcatatcccgatcatggtctctagcaattaaattccgtcttcttttgtagacaaaccagtcaccttgattatttttttcagtttcaatttgctacttttaattttgtttgaaaacgaaaggcgtagaacctgaaaatgcaaaaggagtcaaactttggaagaaaaaaaatcatctattatataatacgccattttatcccctctcatctcatcatctgcataaataagtggagactcacatcgccatcgccgcctacacactcctcctcctcctcctcgccgataacgatggcaatcgccgccgccgtcgccgccgccatggcggggcctcgccggcgcaggatgctgctcctaatggcgaactacgcggcgctgctggtggggtcggtggcgtcgagcctgctgtcgaggttctacttcacgcacggcgggcggaaccggtgggtggtgacgctggtgcagtcggcggggttcccgctgctggtcgccggcgcgctcgccggcggccggccggcgtcggcgccgcggccgttcacgtggctgtcgcggcggttcctcgccgtctgcctcgtcatcggcgccctgatgggggccaacaacctgctcttcgcgtacagcacgtcgctcctccccgtgtcgacgtcgtcgctgctgctgtcgacgcagctcgcgttcacgctggtgctcgccgtcgtcatcgtccgccacccggtcaccttcgtgaacctcaatgccgtcgtgctgctgacgctcagctcggtgctcctcgcgctccggtcgggggactccggtgagacggcggagggcggcgtcggcggcggcggcaggaagagctacctcgtcgggttcgtcgtcacgctgggcgccgcggggctcttctcggcgtacctgccggtgatggagctggtgtaccgcgaggccgtctccggggggttcgtcctggccgtggaggtgcaggcggtgatgcaggcgatggcgtcgctcatcgcggcggtggggctggcggcgtcgggcggcgtggcggacgacgtgtccggctgggtggacggcgggtcctcgccggcggtgtactgggcggtggtggcgacgctggtgctgacgtggcaggcgtgcttcatgggcaccgccggcgtgatctacctcacctcgtcgctccacagcggcgtctgcatggccgccgtgctcaccctcaacgtactcggcggcgtcgccgtgttcggcgacccgttcggcgcggagaaggccctcgccaccgcgctctgcgcctggggcttctcctcctacctctacggcgagtacgccaaggccaagaaggtcgccgcggcggcggcggttgcggcggcggaggaggaggagagcgcttccgacggcgagggcagcgtccacaagagcctgacaggtggcggcgcggccggaggacacgtcgagacggcagtttgaagagaacgagccatgtgatgtgatgggctgggccgcgcgcgcggaaacgaagggagggagcgagcggtgcaacaaaaggaaaagaaactgaagcaacaaaaagaaattggcaggatgcgatgccattaggtgtagttgagtcatgcatgttgcatggattaggcttacttgcaagggacaaaaattgttgcatggatcagtagaccgactgtctgtgcttgtaactgatgggttagcttgatttgttcagagggtgatagctgttggtaggaagaggctcccctgacttaaagtctgaggagacatggtcactgacatgtgggcctataaagatgggccccacccgttagggttccatgtctctataactttacgtcagaggagctccgtctctattggtatggctggtgactagttgtgatggagggttcatttataccgaatcgatagtccctccgtcattcttattctagcgtttattttcatgtttaaatccgtgtcagttttgtaaaaacttgtcgttttagcattcacttttcatgtctaaatccacgtcggttttataaatagttgtcgttctagcatttatcttcttatccaaatttgtgtcggttttagttaattttggcatttatttatcacttttgctactgttcagtcaagtgagattctactaaatccgcacgacatcaacttcctcgaagagcccctcaacgtcctcgacaaccaaactctagcaagctttgccagattaattaggctttgggggctagcaacgaagggtgagcaatagaagaacaataacactgtgttcgggaggtgagattggaacctcacatcctgcgcacgcaaaacggagcgacatattttcttatgattaattaatattatttttttaaaaaaaatggattaaaatgtttttaaagaaactttcgtacaaaaaccttttataaaaaacacaccgtttaacagtttgaaaagcgtgcacggagaacacgagggaggtgagttcgggaaggtggggaagaacacagccttagggtggtttgggagagaatgccggggaagtgggaggagatgggcgaaaccatattcataaccgaattcatgttgattttttattctagcatttactttcataaccaaattcgtgttgttgttgttaacacttctcattcaagcatttgttttcatccctaaatccttataggtttcatgtccatattcatgtcggcgttacactgagtcaaatttgattcttgtttgatttttattcccaagagctggatgaacacagcatcgaagccattgatatgcagaatgcaagttgagcaacctcgcaaacctgatgtattatttttaaccagcctagcttctcaccgtcagcaattcagcacgaggattgcacactgtttgacggtgatatgtcagtgctggagatggatcatgatttccatgtaaatgcttgtgcattgcatgattagttcttctagcttgcatgctccgaaacagttttgttgtatcatccattgttgtcgattgatggttcgttatccaggcacagttcttttaattccgttcgtacttttatcctgtgtgttgcatattatgtctctatgatgtgtatggaccattccttatatccttacctttgcaaatcaacagtaggcacctgctcatcaatgatcagataaacaagaaactatggaacattgattgagtcatctaggcctgcagagctcaaagagtcccaagaatgcaattgatagtgaccttggtccatgcttagctcagtatggcttgatgtgtaagtgtaactcatgtcagcaaaacatgtgacatgcccaagtgcaaccaaagggagtaatgttcattacagaaagaatgatgatccaaacagataacatggtacaatagaatgtatactcaagaccgaaacccaacatattttgagccaagcgcacatgagtaaagctgcaaataagaatcccattcaaagtgttccgctgttaggacaaagctttcatgataatacagacccggccgtcccatatgtgtctacaagacgacctgatacaaaacacttcaaaaaaacaaacaccctcagattagaacacaaatatcagacacatcacatcctgtcctcccttctccgtggagcacaagtgacgatctcatcgaccctgagaatcatctccgctgcctcggtagcagacataagaacagcttgcttcgccttaaacgactctgatatccccagcttttccatgtctccaacctgcggaagaagtcttagtatcagctccaacccctagaacaaatgtaaatgcaacttctgatatgcactagcaaacttacgccgccagaaatgacatcaattccagcagtgctctgctctttgtgatgctctgctctgagctgagagatcagatcagcgctatccagaccagcattgtcagcgatgatggttggaatggactgaagagcgcgcgagaaggcttcgatagcatgggacttcttcccaggtgtctttctcgccagtccatctacttctttggccataaccatctcaggccatccaccaccatataacacacgggtgtcgttcactgtttgtgaaagcacacataaggcatcgtgcagggacctctctgcttcatcaagcacatgctcactgcaggtaaaagcacacagtcaacacaagctcaagatggaatatagataaatgtaaagaaaaaagagtccaactataggcatgagcataccttgctcctctgaggacaatagtacaggcttgccccatttcaaccccagagaaatgaatcagcctgtcctccccaatcataatctcttcaatgaccttgcaatgaccaagtttgacagactccgggttatcaaaagtggaggcgatgtcaccaccagtgacaagagcaagccgctcaatgccctcaaaatcagcatgctcgattgccagtatgccagcatctgcaaagagttcctcagggaagttgtagatcaactgcctgttaacgaaacagttgattccatgacctatgatcttttgcactttttctctcattttttgcttttcagcagcttcaatttcagcaaccttagccattgaatcaacccgtacacgtgctccatatatcttaactttgtcggtgtccatagcagtatttgcaaccaaaatcttggcgttttcaatcctcttcggttggccaagaccgattttcttgtctagaatgaacctacaaaagaaaaaaaatcatgaaattgccacctcaagagcaggacttcagtttgatctgctcatggctgcttccaacatatgatgatttacataatttcaaaatttaattagtctgcaatgaataaatatcatgtactactttattcttgaacctaacagatgtttggggtcaataaaggttggatactgaaggaaattttctccctaaatattgtcaaacacaattctgacatacccttcatccaaaaaggagtcctttagagaccctccagttttcttaagaatttgaattgcttccaagttggtactgccctgcaattcagtagtagcacacacaaatcagaatctgcagtgacttaaatgatggtataatgaaaagtatttaaggcaatatagcggcagaatatgtagtaacagtcacaaatcaaaagttcaaaacaactaactgcaaatatatagtataaagcattaacaatttcagtaccttaagtcttagaacagcatcaactgcaagaccagcaaagtattccttgtcctgggaaagtatttttgaactcaacgttgtcatagcaatgttcatcagatctgatctaaacttatctgcagtaacatggaattaaaagctgaatattagtggtgtgattcaatttatggaagagatgctagagtgctagacaaattatgtactgtgaacacaaacaagcaatcaataaatggtagatcttttgagcaaacttccatgcataaatcccaggaggcaaaacattaaatatataggacatcttcagtttaaatcaataaaccacatgcgtaaggaaatgtaactagcctgaatcttccttgttatccatggccctctgtaataaagcatcacgagcacattcagcagccatcctgaaccctgaaattggtgaaacaaatccattggacaggaaataaaaagtttaatctgacccatgtgtacagaaagtgatgctcaatcacacgtctacataacatggatgaacttcttgcaaaaaacttttttgtttattgaagacaacccatgagcaatagaatgtaacagtactacgaacttgctagtgaggaacatatgcattacattgcacatgattctcttgggcacagtcaactctaattatgatctagatgaggacttatgccgtgagaagacaaattaaactccgattaagcatgagtggtctaattgtcaacagtaaatacgtggcatcagtatactggtgatcatgtagaactgaaatatacctgcaatgattgtcattggatgtatcttcatatttaccaacttttcagcttccctcaaaagctcaccagccaaaacaacaacagaagtagttccatcacctacttcgtcatcttgcacttttgagatgtctgaggcccacattaaggaataacttttttttatttttgcattataaagattggccaacaagaagatccaataaattatcaaaaatatgaagtaaaaaacacttcatacatatgaaacagagatttaaaacagtgatattacctaaccggtgtagcaataaaaaagggtcaaattaaaggataccaacaaggaccttagcagctgggttgtcgatatgaagagacttcagaattgtagcaccatcatttgtaacagtcacactgcgtcccctgccagttgattgtaggatcttgtcctgagtatagaacatagaaaggcggttatgtgattacaaatttggcacttgatgagtagattaaaatttgagccaatatcaggggtgatagtttgcaaataaatgaagaaaaccaggatgctttagatttttgagcataccattccttttggccccaacgttgtcttgaccaaatcactgattgccataccaccaacaaaggatgcctaaataagaaacaggttagcatgcaagacttgcctgaaaaagcatttgagtctaaaccattttcgttactgtcagtcagaacattcgccaattccgaatgagaaatttataggatataccagtaaatgtaatactgtggcttcaaaagcaatcagtattagtattaaagcataaccagtaaggcagaaaagcttggtcaccattgggacacagaacaggtatagagtttttggttgtgaaataatcaggaatgagccagagccaagaactagagagcgtttggctgttctataggcagtattttggtgatgcaggacccaaggaaacacatgacataaatggatgtagcgtcatagcatagcactgcagagacaaggatggaggaattgaaagggcaatgatttgaactaaccatcctggcacgctctcccttctcctcggtcgcatcatccttaagcagtctatcaacctggaatatacgtggaaatagagtcaaaacaagtacgcaaacaaaagtgaggtgcagagggaagagagaaaacatgataaattagcttcaatcataaacaaggaggagcagttgaacagggatgtcgatggatcagacgattggatgtgtactgattgccactcgtaaatgctactacgagtgttcttaaattgttgcatctatatgacaatgcacacttaagctcaagttttcagtatcacttaataccagcgagtgatcaggtacctcggacggcagtaactagcattctaataacagttcaaacaagtaatagctccgtcaggtttcacagtgccacattccatatcaagcacaaaaaataaatccaaaaaaacacatagatctaaggaataccacacgactacgggcatcatttcactcaacacaagctaaaaccttcgcaaatctaactgagaaaccatatctccatcgcgcggaaaaggaacttgtgataaagccacaaatcaagaatgctccagccacgaacggacagaaacctaaggctccgcagatggagagcaaggatcagaggagccatagagtagggaagggcggccgtaccatctcgtcggcgaggaggaggagcttcggcaagcggcagttgcggcggcggcggcgacggcggcgacgcgagtgagagatcgagagagtgagggagagatgcggcgcgtgcaggtgcagcggcgagcggtgttttaggtttacaattgggctcgcatttccggctcatcagcccaataaccatccaattgtatgggccgagagctcagcccatttaaacaaatgcgacagtagttgggccagactgtgtgggtctcgttagaatttctcccgagatggtcctgagtctctccctgacctgaacgttttttggtagtaaatggatcaggaggctgcgagtctgcgaccgaccaacgtcgcagtcgtagacgcggcggatggatcttttcgttttatccataaataaatcggccgatcagatcaggtaaaataacatactataaaccaaaaaccaaaggtaaacatattccgtggaaataaataggagagggaaaatcagcgggtcatacacatttgtagccagctataatatagacttcaagacgcaacatgtgtattataggtaagaccagatattaatagtgcattatatgtttacaagtaactattatatgagtaaatttcagaaacatacaactttaatgacaaaactatcagtttgctacaacattagtagcatgtttcagtttgatgtaacaatagcgtgggaaattatcacaaaactgcaacttttacgctatatgctgctacacgtaaaagttattttgtgataactagctgggtggccagcgcaattgcgcggctagcacctacaaaattatttattttaacacataaattttattaaataatcatctcattgtattatgattttaaaatattgatccttattatccccgtgtttctaattttatatatttttaaagtcacactactcgctacctcttatttttttcaccccctttatttttcatcggatctatacaaattatatttatcctccttataatctttaaagtttagacctttttgtttctaaagtttaaaaattggaccttttaacagtttcatagatatgtctggtagtcacgtgtgtgcacttgtgctgtgtgtctgaatttttatgcttttttatcccaaaatttaggtattatttatttatatttgttggtagagttgaatgtttaaagcagtataaaaatactactgccctcgtattttaatagatggcaccgtttacttattgaaaaaatttacataaatacaattgttttatcattaaaagtattttaagcatgagttatatcctaagtatttacgtaaaatgttgaataaaatacatggtcaaatatgtctctaaaaattaaaggtatcatcaattaaaagtaacaggaggactacattattttcaagcgcaacaacattttctttttttaagtcttcgctctcaccactcaccacttcaccggtcagtcagtcatgtttacctctctcatcttcttttccccacttccacttccttgcttcctgattttttccgcctccctctcttctatcatcttttccccacttgcttcctgaaaaatttccctcgttctcccctcccagtggccggcgccagccgccagtcgtcggttgcttgacttttctcggtgtccctccctactccccgtccagcttggcgtgatggaaacgtggaagggctccagcctccagggtcagatccgttctcatgcatcagaggtgtgcggttactgtgtgcgacgaagccccgaggtcccttaggcgcagcatctcctttgctgtccatgcttggagcagtggatctttcaggtaaatagtaatgtgcattcatatcatttgttttgtctcttatgcaaaatatcaagttctcgtcttgcttgttggatgtttgattggattcgcaatgcgaagctcacaggattcctttggggatgtcataaaaaaaattgtgctcacacactccatatccatccaaaatatttgacatcaaaaatatttgacgatgtatggttaatcgagattatttcagtcttaaaacaaataccattgaatgagtagctaataaatttaacaaatatgtaaacatgaatataaaagaagaagatgagcagaacataccaaagggccgttgtgagaggaagaaaccgaactggaaaaggctaaatttgacgataatgatccggcgacaatggcgtcctggacatattttttgctgctgtgttttgcggacacttcggttgtgttgattgctattgacatcttctcttgttgttctggttggtgactccgttctggtgcttagtatttattggggagtcaatcaagattagccaggaatcggtgaaggctggcagagtcggattgtgtgtagggtgtttttattttggaatctactgtcttattgctattattgtcgtaattggtacctattactactgcacatgtcgatccgtgtatgatactatacccgatttatagtgcctgatatgtctgtatacgtgaaaccaagtctaatgttccaaaattttaattaaatctcagccattaaaatataggccatcaacgatcaagcggtcgatattttttctttttcttcgattaacgtggtaatttctagtctctacggtgaacgtggtgccttcttttcgagctgtattaatagtataatagatagatagattttccacgctattgttgcagtaaaacgatagttttatcactaaagttgtatatttctgaaatttactcctattatatagattgttaaattgattatagatgatttgaagctaataattggctatactatttactttaaccttgctctcgggctcagcgcgctgtcgctgtggaccacggatcataaccacgtactagcatcatctgcctgcagcccggaggcagcggcgaacaagcgtttggagcttgacgttttccgtgtccccgccgggagatgcgacgtgacgggcgatctagcagagagagagagagagaggaccagccgctcgtcgttttcgccgcctcggattgtccgtcagagcgccgcccggcgaatcgcgcgcgttgggagtttttgctcgccaatttcatccctccctccccccatgagctccggtgagatccccgaattaatccggctctacatctcaatttctcattcttggtcttctcaactgaagaaccaaactaaagagagatacgcaagagatcacacgcctcgcggccaatccaccgacacgcaagagagatactgaactactgaagtgaatgaaatctcaccgaagcaggagatgatagatcacccgatcggtaagcaagttgcagggattttttgccattttggccgtggacgaggcacggcagtggatggcggctcacagatgacgacggctgccatggagaggagagaagaagaatccaaaagccgtttggtgagcaggggtgccctccaccaaactgtgcctgtgtcacccaacattaatctgcactctacagccgtcccagttatggtactcctagactaatactcctgtatgcactggtcgaactgccatacggagctgcatgatggagtaaccacggagcctcaaagcaccaaacattgcccgtgccctgtccctcaaaaccgagagatttgataatttaacactccacaaaattgaggttcaattatttgataccctatccatttcccttcactcggatagtcccacgtgtcattctcataagtatcaattaaaataaattgataatgaataatatgtcaatttgtcaaatttctactgaatttccgcgtgtcattcgcatgatttcctagtggaacagcagaggttagcttcagtctaaagaagcttgttgtattccctccatttattaaatatacaaaagtagtttatttgagagatggggtacagtagcactataatcatatgagcattgtttgggctctgggcctctgatgacacactgcctgcgagtcttcaaccctgcaaccacagccggaggtcagatctgcatctgctgaagccgtacgaggttgccagcaaatgttcctgcaaaagagctcgccgtcgcaatgcacggccaatagtaaaaaaaacacaggcagtctatgcagaaaaaatgacggaagaatgatacgcagaattgagcgagctaacatcagttttctcctttcttcttcctgagactctgaatgtctctgacagtctaaaactattcacagcccaccaccatcaccacatggcaatggccatggatgtaaaccaccaaatttcaccaaaacaaaaaagagaaaacaattagaaaaaaaaagccgcccctaatcacccagatttacaaaatggaatcgaaggaacagccgaatgaaagtttttcatcatcctttttttgtttgtttttttctcctaaaccaaaagaaggctcatgcttgcatcgccatccatctttgacctatcttcctcctcttcttcttcctcctctactgatcttacgtttctcttttccgcgatttttctccaggctccaacgcgaaattcaccccacttgtgctgctatctctgtgcgtcgcgctccgggttttcgcgatcactcggagtcgctgtccatgctctccatccctttcagtcccctgtatttttgttgctgcagaggagaggaacaaagaaaaacacatagagatattagatttctcgtcagaggcaattgcagattacgcacaacacaaaccgaacggcgagtacagctgttagcaaaaacacaacaagagacaaaaggtctactacttggcacaagtaattcgacgaatcaactaacgatgacccacagttgatgctgattattacatgtcctaatctaacttcagaagtgcaagagaagaaagaaccccacgtaagcagaaacagcaacaagactgcacgagggacccacgtgtcagtgagccacaacgagcgttgcggtgggtcccacctgcagggtgaccgggacagcacgcgttaagaggctaccaacgtgggcccacgtccgctcgtcggcaaaagataataaagtgcagagatgccggttaagcacagtcatcaatgagcacccctcgcgcattcacgggcgtgggccccactcgacataggggacggacggacggacggatcgttttccctttcgctttttttcctgccccttcgctttgatgctttctcaggctttcccggtaattttttattttcaccaaattttacgcaatttcagacgatactgccaaatactagtactatcgatttttaagtagttaggagtattactgaacctatcgatttttaaatacttactaacttgatgcaaatcagagaaagtggatgtggataaaatcgatagaggagtatatgtaccttcttggtggacttcttctcgcggacgatatacttggatctggtcacatccgagagccacattcctgggcagacgaactgcacaaatacagaacaaaaaaatcatgtcagttttctcatcaagaccatcaagcaaaaagatggtagtaaaacacagtttgattaggtagcataatttatccatacgttgacttgcttctcgacaagcttgggcctcttcttgggtcgctggggcagcttggtgcctttcatggccatgaagtcctcctccttctccttgcgcgacagcgtcgtgtagatccgcggcagctcgatcttctgcgccgccgctgtcgccgccttcgacgacgagctgggcccatggtggtcggcggcctggccgtggccgccatggccggtgtggtgctgatacttggagtccgtcttggccagcgccatgaccaccccaccggcctccgccaccctgtgcgccgccggccgctgctgctgcttctccgccttcgtcgccgccgccgactgctcgccggatctgatcatcatcatgccgtcaaattcaagcatagcaacaaaagcaaactcgccactacagcggtggatgctggacacaacaacaaaaacagaaacttttttttgtgtttttatcaatctatctatcttagctctagtggatgcaagagcagccaggtgaaatggtggatgcagatgaaatgagcacagcagagcaccggcaaagcgactgccagatgccaacccacataaagagggaggagatgagaatgagatgagggtgcatgtgtatgtgtgtgtcctatttttatacctatattacatcaacaccttctatatcagctgcctgaagttgatgtcacggttgatcgttcacacacacacacatggcacatcaccacaccacatgaaccaaaagaagccattaatggacatatggattgcaatattgcatacagaaatgaaatgctagatcgacatgaatgggaatgagcccacagattagcaaagaaaagaagaggggaaagtgctctcctcctcgcttgatgatgatcctgacatggacatggtgacagaggctagtagtacaaaaaattgttgcctaaaggatctcgaaaatcaggaaagagaaattctaaaagtcgtttctaaaagcagaagcaaccgagtgattgaccactagtccgatcaaaccagtattgctactacatatttttattttcattgctcttgttgtacaaaaaaaaaagggaaaaaaatggtgtggaaagaaaagaggagaaggtatcttatcatctaaacgcacctcacctcggtggctgcaggaattc

SEQ ID NO: 45451 - DNA, 11924 bp, Oryza sativa
ccgacgccggtggagctcggggaggtggggtcggagtgtcggaggggtggtggccgtggtcgcgctcgcgctcgcgcgccgggctcctgcctggcgcagcggctgccgacgacgacgacggcggggccggagccggtgccggtggcggcggaggaggagcgcgagtgcgcggcttggactcgagcgatgcggatgccgcggcgaggtaggggctggtacgcgcgctgtcggcggcggcggcggcggccggggcgtcgtcgtccttgctcgatctgggccccgccgccggcttccggctacctccgccaccgccgccgccattggggagcgggagacaatcagggctgactctctgaaatctgcagcagaatcaaacagaaacacaagagcgattggatcagacaagaacaaggtctccccttcagaatggaggatgaaacgaacagcaaaaactctcctttttcgcgagaattcgcgacaggaaaaacagtagaacatccccaaatttgcagagtgcaaaatcgaagaccaaacgaaaccattcagagatctgttcgacacaaaccagcacaccacacaaactcgagaaaacgctgaaaatcgtggatatctgaaacaattaggccactcagggaacgaaaaatcttcagccgtgagctctcatccccatcagcacggagccgacgaagaacaagcacaagaacgaaatcgacaagttactcagaaaccagtcaaagtgaccatgaaatggggaaaaaagcaacgaaattgcaacaagcaaagataagatacagccggaccgaacagggacgaattggcaaaatccagcagtaaaccgaacatagatcaaaggatgccttttgtcaaacaaggaaatcaagacggcacacgaacagaaatccgacggcgagcaagaaaaggaatgaacaaaacttgcctaaatcgggcggcgagagccgaagcgacacaaaccagaagcccaaacgagcagataaaatcacacctttgatctcgcgaaagaacgcagcggcagcagcagatagaacacccagaagcacggcagcaacgaacgcatcaggggattggagattccaggcctcacctcatcatgtccaatgccgatgggggtttcgccgggctcgacgacgcgacgtctcgagcaacggcgacggcctcgccggagccacgcatcaaatcgatggcctccttccctctctacctctcctcgcccctcttcagtttccccccaatcacacgcactctctcccacctctgcgcctcactctacagatcaaacatctcgagccgagaagccgaggagaaattgcgcgaagaaatgagtttcttggtgaatctaacagcgagaccagaagagaagagaagagaagcggagcgagcagcagcaatggcgatggagaggcgagccagacggcccaaggctttatcgtttccactcttccaacaatgccctccattcctcgcacctattctcaattctgccacctctacgactgcacctcgaggctagggtgtagatgtgattagcacaagaaccagtggtgttcgagtaaaatcctccaatggcagggagtgtgattagcaccaaattctctggcctaatgcgaaacctggcccatgccacagtgcgggattagctcagaattccggggggcggtttgcataatcacgcgtcttcttcagttcatccccgtgctccgttctgcaagccacccgagaaaattcctagcgccacccaagctccgagtcatccacacgatcagtcactgacagtgggtcccagctcagctccgagtcacccacacgatccagtcactgaaagtgggtcccagctctgatccgagtcacccttgatccagtcactgacagtgggtcccagctcagatccgagtcacccttgatccattcactgacagtgggtcccagctcagctccgagtcacccacacgatccagtcactgacggtgggtttgtcctcgcagcacctgcgcggacaaaatggacactgccgtgtgggtccagcaactacgtggccccagaaaagcagagtgatatacatctcgtgtgcgatttaggtaggagaagacgtgacgtgggggttggggacggacggccaggattggatagcgtgaggacgtggatgtgcttatccacttccacgtcacggattgatgggtcatgtgagcgcgaagagggaggagagcgtgaggactccccgggtcttgcgtggccggtactacgactacgagacgccggtttccagagtttcttacttttcagttaccaagaaaaattagttttatccaatccaaagatgttttagaacaaagtaatgggattggtaaaattctatacatggatcactgttctatacgaggaatacgggcctgtttagatccatttataatggcaaatggcaaaagttttggtggcaaagttttggcattgcaaaagtactagttggtgtttagatgcatgttaaagttttgtcatttctagcactaagtgagagagagaaagagagagggagtggtcccaaagcactttttggcacaatttgctactatggactagcaaatgccaaatgccaaactgccaactttcgctactagtgtttagatccaaaatggcaaaaagtgctacaaaatagcaaaacttttgccatttagaggaaaacagagcctacattgatttcctgccttaacttacttagagatccagttcattttgaaatgcataattgaagaaaacaaagaaatataatttttgataattaaatgccatgaatagtgaggccatattggaagtgaatttgaggtgtttggttcaatcatagaaaaatcacatgaatttcaattttgaatgatttagatatgagagggaagataaagagacatgttagcttggacctatgagaagaggaggaatataaggataccggtaggaatttgataacctcggcagagaccaaggcccacttagtgacggtgacggagacgggccctaggggacggtagcgactcactgatcaggcagccatgcgaagaagctcgagagagtttagcaaatcagagtcgaggcagatccaagcgaattgtggtgcagatgacgatgagaaagaaaactagtgtggttggggggaacagctccatgcttcggcgacaacttcagccctccgatcagagatgggacagaggaggcataggcccagccaccagctgtggtgaccaagcaattcactatcaagcgaagaatgaaaaaactaggaggagtataggtcaaggagatcgggagcgatggatatataatggcttgttgttgcctaaagatggcatggatgcatagacgatgacgaaaagctaagcgagaagaggtggggcgcccccaagagacccatcttcctaagggcggcagtagtggggaagtttgtaacggcactaaaccacccgctataatgacatgaaagcttgtgtgagagagatggtaacgtgtaatgtcggttgttgcgttgagcatcgaggggcggtttatatagagagatagaggaaatatggaaggatcaaaatagaagggcggactcaatacaattcaatcatgttttaaataaactctaacactaagaaccagcaacaatataagaatgtatttgggaggttgaggatccatgtagctagaggaaagacaaaattgtatttcttgcattgcaacacaaccattgaattcaatatactcacaagatttcttctaacaatattttctttatatgtcaatcatgtaattgccatctttgtaatgcctaaaaaccgtggcatgggtaagaaagccacgccacggtttgtataccggtctgtttgtattgaaggaacagaaagcacaacaatatccccgcaaaaaaaaagaagaaagcacaacaatacacattattacaagtgatccacactaaacatagtttttttctagataatggatggttatcattgtgtcaaagacacacaaagaccaacaaacacactattataaatggtccatgctaaatgtagtttttattggtaatgaatgaaccacaaatacatcactaaaaaagatccacacaaagtggagtataaataaataagacaagctgctagtattaatatgataaacaaatgccaaaatttcaatccgtgttttataacccaaagttacactccttcagtttttatgatattttccatgcacattggtgcatccatatggggcgaaagacggagttcatatacccatgtgtagccttagggccaaatccagtggtatgaaagtatggaatccccaccgttgcaaaggaagggcatctctctgtattcatcaagtgtggtcgttaatgtgattgccactctttggacctcttcatgtcaccttcggagtttggattacgggcaatttcatgcctaatataatccattcagatttcagaccgacaccggaactaaatctcccgtcacgctgcatcgcaaaaatatcccaaacctaccctcattagcaacgtacgttaggctgtgctacagtaggatcggtttccttgccttacttgtacgaaccccaatttggtgttttcctgggtgcgaaatcaagtcgtaaacaagccagttgacacaccaaatacgcacgtacgctgaccgcagcaatgcaggtgcaggtgcagccacagagccagcgcttgccgtcgctgatgcgcgagttgcgccattgcggacgccgagcggactgcgcggttgtggcatgcagcgggccgcttggagcgcgtggcgtgcgtgggctgctgcggctgctttgctttgctgggttgggcggcaccggcgcggcctgtatcagcgtgagcctgccgcccgccgcgcagcctgctgctccaaacgaattcagatcatgtgtgcagttatagtaagtagtaacgaatgcaactttaacagttgaagcacattataaccgttggattgatggagctaaaggctcagatttgctgtgccttgctattacacattcacaccttgatgatatagtaatcgctacaggagaaattcactacagtaattcatcttttctaatggtctgagggcccgtttagttccccaaatttttttcccaaaaacatcacatcgaatctttggacatatgcatgaagcattaaatatagataaaaagaaaaactaattgcacaattatgggggaaattgtgagacgaatcttttaagcctaaatagtccgtgattagccataagtgctacagtaacccacatgtgctaatgacggcttaattagtctcaaaagattcgtctcgcggtttccaggcgatttctaaaattagttttttcattcgtgtccgaaaaccccttccgacatccgatcaaacgtccgatgtgacacccaaaaattttcttttccccaactaaacacaccctgagctgttggtttttattcatcagctacattgcaattgctaaagttgaaggcatagtaatgactgcacctgaactcaatccactccaagcggtggtgtgattggttctgaacttctgatccggatgtctcagagagctcacagttttggggtaagaaaatattttaggggctagaattccaatatttttaatgaacattttaaggttccgtttggtagagttacaaactccaactccagtggaaacaagctccaatagaaactgaggtgggtatagaaagtgtttggctagatttgtcagctccacgccaccacatctcttgtcgccatttcatcgaccaccttgttgacgtcactgcctccggcggtcagaccacgcgtcaccgacgccactccactcgcgtgccgccagcagtcagcccgcgcctgccaacgccgctccgctcgcgtgccgccgccagtcagcccgcgcgtcgccacctactgccacgcgcaccgcttcacaaccgcgacatgcgcccgccgtcgactccaccgcaacccttcgtcggtcgtcgcctaggtcgggaggaagatggggaggagagagaacgagaggagaggggtttgaagggggtagttcattggcatttttgtgtaaatacattaaaaaaattaaagggtagtgggtcttttggaggtagagtggagctgtggaggagaaaaaaaaacagctccacccccgtaatacaaatttgtggagcaactctactaactccgctccgaaaaatgaagaatctgtaccgtttggcacaactccagctttaggtaagttggagttgagaactagagctgtgccaaacgggacctaaattctctagaagtcgttggcaccactttgttgtcgctacttcgtttggctagtcactctaaacatgtgctaggtggccgaccgcctccgtagtcatgggctagcacacccctggtcgttgtgtccttttcgatcagcaagaggacaatatcaatcatatcttggtcgtatgcccggaagactggcgctcaaggcaattgggtagtcatacagtctgtcaatgcgtgagaacttgttttactagtggctctcaccaaggttcttcgacgaaggttcaacactattgcaactcttgtagcatggacaatttaaaaggaacggaaaataggatgttcaactttcaacagagatcctgggcggaggtagggaaggctatggctgcggaaggcggggcttttggtgtttggctaatgtgttaatgccgacgttaggagtttagggcgtgtttgcttgctgccctcagattcgcgcctggctcaggcgtcgatctcaggcgtccaatttcggtcgcctgcggtcggatcgacctgcctgagcaatggtctccaggcgagggcagcaaccaaacagccccttagctactaggggtcctggtgatcaccaaccaacttctgtagcgagaataggttttcgcagttttgctcttttcagtttcccctttcccgttccccttctctttttttttgtcttttagttggctcataaataacttttatttctcttaatgcaaagatgtgcttattgaatattccaaaaaaaacatcttgaattttgaatatatttttgctgaatctgtttttttttagctgaatttttttgatcggtgccaagtcctaccgagatactcttgtgtattcaacattttgaaaatttcgatcagaaatgtcctgaactgtgaactactatctggtacgctgtaaactcctagcagcagttgtcctatgcaccatgaccgtcattgactttttctgctaagcaagtggtcttacacctcaggacagtgcatctcagaaacaaaaacgaaaacctatcaattgtggcatagtgcaattgcacctgctcacgcttacactttttcacagtttcacttgacagcaacatgcagaaaatcgaacagcacagaaggccaaaaaacaatcacaacaccaccagagctaagacacagtccagcgcccaagggcacaaaaaaaaaaccaaaaaatagtgggttcgcggcatcaacggcggccgccggcgccgcgcctagtacgtcggcgtgggctcgctttccttggaccacctcgtccgcagcatgaactccagcccgatgacggcgaggaggatgatggcgaggttgaagccgtacccgatcttccacgagttgtccccgccgccgacgtggataccgagcacgatgttgacggcggcgaagaacagcaccagcctgcccgaccagtggtggtaccagttccaatacttccggtacttggagtccgtgttcggccgcaggaagaacgccaaaatctgaaacatttcagaaaatcatcatcatcatcagttcatctgttctgttcatgcagtgaccgtgcttgctttctgcaagaacggagcagagagatgtgatgcgtgcaatgggtgacgacctgaaggatgccgaggacgaggatgaagatgccgaggcccctgtgcgccgggatgtcggcctggatcttgttgtagagggcaactccggcgacgacgccggcgaggccgatgatgaaggcgacgaactggacgccgacgtggaggtagaaccagagagggtccatccgccggaagtagcgcgccaggatggcgccgatcggcatcaggacgccccacgcgaacaggttcagagcaccgtgtgccctcctcagaccgtaggggaacgacccgtccacgaaagctttacctgcagattcatcaactctgctgtaaaaaaaaatgttttcgaaaatgctccctcaagtttcacaactatcggcctcatcttttcgcttatacttatacttaccagccaaaatttaaattttcaacatcaaatttaaaattgattttggggtttttttcattaaagtttatttttcagtctttgtttttaaatcgctaagaaaatatgtataaaagttttattcacaaattatttttcgtttgagcgatacgatggggccgtatatttaggatgcaacacttgattaaatatttatatagttttttaaaagataagtagttaaagtttaaagatgaatatgagtagtatccaataagaggtctagtatttgaagacggagtgtgtaaaagcatcttgttgtgcacataatgccaccaaggaagaatgttgatacggcaacagaaaagtggcgactgacgactgaaacttcaagaatcaaacacctttttcgctaactgacacattgattacagttcaagtgatattgtcagctcattttttatggtatataggatcgactaagatgtcaactgtaatttgttactcctattattcaattttccagttaggtgcaatgtcattcatcaacagatttgctaaccaccgtcagggacttcactctgaacctcacacatagtgcagcgaaaatgtcaagttgtccaaattaaacagagggagagaggagaagatcaagatcaggttgatgagaagcatataatatactccctctgaaaattataagacgttttgacattggtcaaagtcaaactgcttcaagtttgactaagtttatagaaaaaataatattttcaactcaacgtaaatttattatgaaaatatattcaattattgatttaatgaaactaatttagtattataaatattactatatttatgtataaacttagttaaatttaaagtagtttgactttgacacgtcttataacctgaggaatatatacgtaccagtggtgaaatcgaaggtgaaggatgtcttgtcctggtgcttggtgagcttgttgttgacggggatggaggagccgaaggcgaggatgatgtgctggtgggtgagtcggtaggagaactggagctggaacgcgaggtagatcctggcctgctgcaccacgacggtgtggtcgtggttgttggagttggagacgaggaagccgcggttgacgaccaccttgccgctcgtcttgccgcgcagcgcgaactgcttgacgtgcgggaggcccttccgcccgatccacccgaccatggcgctcgagcccaccatgaggccgtcccgggagaaccccatccccacccaccccgtgctgtacatcgtcgacagcaccaccctcagcacgttgttcttgtcttggtgatactgcgcatatatgcattggagtatgtgagagtccgaatttttagaaaatggaagtgatttacattgtcataattgtatgagagtctgaattgagattgttttggaatggtagagtcgaaactaactgtaacacttcaggatttttcttggcaattgtgtggtttggtttgctcgaattcactgttttactgtcactgaaaagttactggcttactgctgcactagcgaatcatacatcaatttcagttgggcagttggcaatgtcctagcaggttaggtacaaactagatccacctgaaatccttgcagatctcagctcattgcaagcacacgcagagtactgaacttagagctagctatgctcgaacagcgctacacaacctcaattatgtgctgagaagaacaggtaagaacaatggcggtgggagaaaccacttacccggagcacgaaattgttccagaccggctggcaattcaggccggagtagttgccgacgagcacgcccggcagctcggtgttgcagctctcctgcgccgccgccgccgccgcgaacgccaccaccagcacggcaaccgccgccgccgacacgcgagccatgctaaccaacctccttccaagacaatggcaatggcgacactagcttagctgtgtgccccgcgcgcggcagcaacgcgagagagagaagctgcccggtttaggaggaggagagagccggttgatgagaggttgcagtcatcagttggtggcgctttggatgagctagtagaggagattttgctggtggcgtgtcgctgcggctggggccccgtggcctctgcgcgcctatgattggtgcagctagcggaggaggtgtgtggttgttggtggtgccggtttgggtgtccctctccttgcgcgcgcgccccgcgccgtctcggtggatggatggatggatcgcctccagatctggaggcgagcgagcgagcgagcgaacggaccgacgctcgcacggtgtggggagcttggagtgcaaaacgggcaaaagcggcccacgaccccacgtattcgtcgcgtacggtttgctacggagcgagatcctctactgttgaaaaaaccgtgccgttctcaataacttgtgagtccaggacctatcatgaagatagtggattttaaaatcaaatagttatagaataatttgagaaaatgtattattaacatgccacttcacaaacatgcaaaataaaatttaacttctacatatcacaaccggaaaaacaaatttaattatgaatacacattagatggttgtagtttaatttgttttttcgttgcgaaatatagaagtcgaatatatatatatatatatatatatatatatatatatatatatatatatatatatatatatatatatatatatatatatatatatacacacacataccaaattaagctctggtgaaaattaccatatagtcctagctggaatactagctactttgaataaccatgatgagtagtcatttcaaaccaagaatacacctgcagttcctgccacggtggaatcatggatgagctgctgttcctggaaacccgattagtaaattttgaatcgtacgctgttgcacggccccacgtttatgctccttgctaaaacatcaagcattgtgggacaatggataggaagttaaacatcaaatatactgggacggaggtagtatttgtgtagtgatatatcacatattaatatatctactcatttttttaaaaaaaaattataaccatttgaatgatatgtaaataataagtgaacatccttttaagagtttaaaatagttttccctatcaagaataaagtcatgtgattttgaagcaagaggttctgatccgtttgctactgctgcgccgtgaacacgtgacatggattgtagcatattcgtaagagagtttctatgtgggagggaggtgtggtgaatctgtgtacgtgctgtgagattcgggttgcttctgttaggagatgcagaattccaggatttgcagagccgtaaccgttaacaggacaagccggacggtcctttcagggaaaaggaaatctgaaggaccgacatgtcagtagatggtgtcaaaattaggcagtccagatggggccattttattgtgacaagaatattgaatgctgaaaattgtggtacaactaagtttttactgattggagggtgcactgtgattctttgtgcttactaccaatctcaaaaagtgagagaaaaaacagtctagctgcttctatgattttgttgaagctgcctgccggataagcctgaggga

SEQ ID NO: 45452 - DNA, 4280 bp, Oryza sativa
tttgacaaaaaaggcttgcaatcacaactggagaattatcattggaaatgtttcactttatgcctgaaacttaatcgctacatgtcatcaccaaattaattaaaaacggtgacttctgaacaattatctatgtttcaagcaaagcaggtgataatatatcaatgacgtgtgaaagctgacgtgcaacctttacaaatgaacttattttctcattaaaaaaaaaacaagtggttacttacatgtggatgcccatatacacttggggcaatgtactcgataggatgcccgtagaactccaccttctctgcaggtccgaccatgctcgagaatgacagagtggtattagcgagcatgccatggcagagagcagctgcagtctacagaagttgccatgtacattacaccaatgaataaacagattaattaactaaagacaagtggcctcagttagcatctccggttaatgatcgacaaaattcagataatagaactgctctactaattatcccagcaaaacataacgtagagaatcaataccttaatgccaaaaagtttgactattaggttgccgctccaataagtgaagattgcttccaacgagctcttcttcctgtcaactgttcttttcccctgacgaatatattcaagaggatcgtggaacatggctatacggaaaggaagtacgatgtaaccaattagatttccccatctcgcaacattgttcttgttggaattcatcatttctgccaatacctgctcaaagcagaaacaaaatatccaaaagttcagtaactatcatgacttgactgctaaaaggaactgaaatacccattcatgaaaattataataagagtggacagatcataatgaatccttttcttacatgtaagccaggtgttttcctgatgttaacaagaagagcagaccgcacacggatgtgctttcgtcgcgtacgcttctcgctgttcgtatcatctgaataagttcagaaaacatgacttcagatgcagctagcagtatatatactacgtacgattagcccatgataactttggaggaagatcactcactttctttgcggaagtaatagcgcgacaatgctgcagaagtcactccaactaacacatcattcacagtctgaaaaaacaccaggaggaatgacatttcgtatgatgtttcagagttaagctgacatatgcagttcagcaagaactaagaacccaagaatagggagaagatggtcttacacacttcatggcattcttgacgagcttgacgtcgtcgaggctgagcgtgcagtggacgaaccgcttgcgccggaactcgacgccctccgtccccatgagcggcgtgcgcgcgtcgcggaggaacagcgacgtcgcgacgaagcaggcgacgtcgacgagcgtgtgcaaggcgagcacgaggtaggaccaggcccacgcggcgagcgccacgatccccgccgagagcggcggtcgccggcgtgcgtacactggcccgtcccgccgcgccggcgccggcggcagcgccggcagcctcgccgggtcggcggcgctgcgcgtgcacgcgatgaggagggacagcagcgagatgccgtcgccgagggagtggtgcatcctgacggcgacggtggcggccgcctcggaggtcgggaagtcgaggacgtggagctcccagagcgggcgggagtggtccatcggctgcgtggacagcgtggacatgtagtcctcgatgacctggtcggggctggctgacgtggcggtggggtccagctcggggaagatgaggtggtcgtccaggttcactgtcgtccggacccaccgtggcttcgcccgcttgctcgcctcatccgacacctgcagaaatgcacttcttaaagtgttttttttttaactgtacgctgaatgcgacaggttcagaaaaaagacgatggatacaatggatcaagcattaccgacagtgttacactatgaaagctaatttaaaaatggcaaagcgtttgccttttttttaaaaaagagagaaaacactacgaacacgtactatgcaactaggcatagcaacgctgttccaaaggatttattcgaaagcaattgatcacgtagtagtggggtttacaaaatcgtatcattatcatgattattacatatggtaatccttatagtttttttcaaaacatggtatatttcgtggtaattgtacggttttcgcggtagctatatgattacaatgataaccattaaattacggggtgacggtaatcccacctaacatggttcggtgaaacctaactacttaccactggcagttaacgatttgcaatacgatctggaggcctctagccaacacactacagatgtttgtttcacctggctcgcaatccatacacggggttaacgaagaaaagcgagccgtccccgtgcgtacagtgacggactgacggtacttaattctgacgttgatttgcttcaaatcccgcacgtcgcggaattatgatccacatgtccggtatctgctttcagctggaaaacgtggacgatccatcgcgatgaaagccagcttctcggatgattctctccacattttcatgccaaacggctgctcccggtcataaacacagtagctgatgagtagcgatagtctaggacggctgctctgtatctgccaccgcattaataggagggcatgggtgcagtatcaaaccagctacttcgcgatccaaaccataaatcaggcaataacagcccggttaactaacacaaaagagatttgacggggagtaaaggtgatggtgattcacactgattcgtggcttcgcgcactatctctcgccgggattaatgctcgctgagccaatggattggtcggttcaagcatcagatgacttcgagaaagctagcaagagcattgtacacacagcacagccacttcctacttttgtcccagcttgtttttggccggagtcacggccgccgtgcgtatcctcggaagcagccattctagcccagacaaccgcaagaaagtgagccggcgaggcgccaggagcgtccatccaccggaaaaatgaagcagaaatcaatgcttccacgcggccccagaatttttttttcaagtaggaacaacgtgcgcgtgtcagcgtcgacaccggcggtctcaactccatgtgcgcccgagatgcgggatgcttcagcaaatttaattttgccaccaaacgagcgcatttttttgggtgcaagttggcgatcgaggacgagatgagaaatcgatgcaaagggatcatggagcggtgggtttagttacctggacgctgcagaagcgggggtggcggacgagggtggcctccagcccggcgcgcgccgccgcgacgtccacccgggcgccgagcccgatcaccgccacgatgtagcagttgaagttggtctcccggaacagccgccccgccgggctcatcggcaccggcaccgcggcctccacgtccctctccctctccgcctccgacgccgccgccgatgccatcacgctctcctcctcctcctcctcctgccgcgccttgctctccctctccctgccgggcgagccacgcgagtcacgcgacgacgtgtctatcgagagcacccgcttccgcagcgaggagggggagggggtaggggtaggggaggtggtggtggtggagtgggtggaagtactcgagctggcaggatcggccgtcgagcgaggatccatcggcgcttgtacgggcggtggcaagtgtggaatgtggacgcggtcgggggcggcttgacggtggggacagcgacggcggcgtttgggggcttgccttgcggactccggcgtccggccgggggaggaccgggaccgggggttgcgtgcgggttcgcgatttgctgcgtcgtcgctttgctattctatataggcgacgcgaagcgacgtggcgcgaactacccgaccgtgcctgcctgcctttggggttcggactctggacagtggaggttagttggctgggctcggcgtttcgggtagtcgtcgttcttgattggttggttgggctcggcgtttcggctagtcgccgtcctaattggtcacggaacccggaggagttacgactcacggagtcacatgtagggactacggagtactacctccgtccaaaaataattacaaccataaatatccgtgtttagcgttttgaccatccgtcttatttaaaaaattataaaaaatattaaaaaaattagtcacacataaaatagtattcatgttttatcatctaataacaa

SEQ ID NO: 45453 - DNA, 1860 bp, Oryza sativa
aaataatactaaaattacatttattttaggacggagggattagtagtactgctccacgactccactgtactacagcctacagggctgtgttcgggagggggcctcccggcaaaacaaagcacctagaagtattattgtatgatttattaagtatttactaatttttttaaaaaaatggattaatatgatattttaagcaactttcgtatattttttttgtgcaaaaaacgtaccgtttagcagtttaaaaaaacatgtgcgtgaaaaataagggagtgaggttgggaaagggaggtaacgaacggagcctaatggtaggtataatagcagactattagttagctataaatatattttaataagataaaatatgagagagaagagcagcgggctacaatctgtagccagctgcagcacggacttcaagacgcaatgtgtgtatgacaggtaggaccatatattaatagtatagtaagcaactattatatgaattggctttagattaattgaagctagtagtgggctgtactattaaacttgttctaaattaagagcagatacaataacaatctataagctagctataaacatatctaaagtagataaaagaggagagagaatagcagcgggttacagatttgtagccagctatagcacggactcccagacaagtgtgtatgacaggtgggaccggatattaatagtgtagtatgtaactattgtatgaattgactatagatgacttagagctagtagttggctataatattaaacttgctctaagagctaggctaataatacggccgacttattggctttaaggttttgtagcattctcacagtctacctatataatagttagctctttacaattaatactgggtccacttatctctcacaaagttttttggttcttgtgttcaagccggctgtaagtttatagcccgcttctcccctctctcctctcttttctcctttacctcactatttagtcggcttgcatcctcctattatacttgctctaaatggggtgaatgtgtgaccgattaactgtcaaagaaggcattatttgacttggcaaaaagaaaattctatttgatatctctatataaaaaaagcaggttttgatttgatttgattcgattcgattcgacatggttgtgtttgtttcttttttctccccgtccagtcatcgtcttcgttgattgagagagcgattcttgacgagaaaatgggctttcaaacttccagacccttgggcctaaatacgtactagtagttgttaaacgaggcccagtcgtgtacatcgggcctaatgctgacccaaaactgttctcttttcccggaaagaataagttcaccagaggtccctcaacttaacagcgagatttgttgagatccctaaactacaaaaccataaacgtatacccctaaactcacacaaaacattcaaaggatgtcccatggcagtatatgtgggtagtttcgctgacatgacatcctagtcagcaaattttttataaaaaagtacgtggggcccacatgtcaattacacatcgtcctcttctcctctttattttcttctcctcctcttctctttcccttcttcttcactgagtgagcgcgatgggcgggcggtgggcgagaaagacaacgggtctgcgcggcagctgagcggcggacgacggcgacaagtgagcgcggtcggcggacaaagcggcgatgggcgggcggcgggcagagcggatggcgccccatgccccatggcgtggtggcggagatatcggccgatccggagtccaggagcacagaaagcgtgtaggactcatcgacgacggggccgagcgggctgcaggaatt

SEQ ID NO: 45454 - DNA, 2826 bp, Oryza sativa
aattcctgcagccccacatttatggttttgttgtttagggaccttgaaaaatctcgctgttaagttgatggatctccgctgaacttattcctttcccggaacggaagacggcctgtcccttagttgggctaagtctggggcagtgctcatgggccgctgaactgatccaaccaggccgaatttgcctgtactctgctgtacagcactctacaagtgaaaccgcgacgacgtagagcgactgccgcctactggcacagaggatcagaggagcgtagcaacgtgcaatcccgctccaaggtggataaatgcttcggccaaatctcaccattttgcaccgtgcatctcacgtggcacgtgaccggagtaacgaagcggagcactggtacaactacgctgtagctgtagcaccaaacggctagaacgaacgaggccgggtttcaaatttgaaacgcgaggtgcgccgcgcgggccccacagagcgtcgacggcgaggtgaccgcccacccgcggccccggtagtcagtccggcagacggacggtccagatcgcccggtgggtcctcctctcgcccttggggaactacaggcgctccagtggctccactagccacaatggatgctagggcaagttttataatagatgtggtggtcacctccaattttatccacatcatctatccaaaaattaaaattaacttatgtagatgcattgtatttaatacactagtcccaatacacttgccaccaatcagccatcttattttctcttctttattgaaatttgtgtgaaggttgtcccttagagcaggttcaataggcttatgtcagccgacgataggaataaacaatttagtttttggctaaggtggagcagagagaacggaaggagagagaaaagctggcgcttaattagtcgcgagctccagcacatagttccatgcatgcatggctgccctgccaatcgcaagagctgatcagattagaagattataaaataatcttttagaggaatgtgctaatgtagctacttgttttacaagctaatctctttccattattttttgttgacatggaacttttggagccggtagccagctatactattaaacttgctcttagagcaaggtcaatagtatagcaactactggctctaaaacatctatagctaatctaatagctcattcatacaatagttaactataaaaatatactacatcattaatacacggtcccacctctcatacacatataacattttggagtccgtgttgcagccggctacaaatctgtagcccgctttcttctctctcttctcttttcttctcgatatatggttacagccggtttataacctgctattgtacctgctcttacatgaggggtggctcctcccctttctcttcttttctctcctccacatcattatttaagcatacatgtcactttggagtttgtgcttagaaccttatagtacttgcccttatcgcaagtgtaggatgggcccttctgcaccggagcggtcttttaacacatactccctacgtcccgaaaaaaggcaaaccgtgagttcccgtgccaacgtttgactgtccgtcttatatgaaatttttttataattaatattttcattattgttagatgataaaacatgattaatattttatgcgtgacttatctttttaattttttccatatttttttcaaataagacggatggtcaaatattgggcacggaaaccagggtttgtctttttttgggacggagggagtaattaattaagtattagctattttttttaaaaaaaggattaatttgattttttaagtaactttcgtatagaaaatttttgtaaaaaacacaccgtttagtagtttaaaaaacgtgcgcgaggaaaacgaggaagatgagttggtaatatggggttgcaaaacagccaaatgtccttttgccccccaaaacacgagcgaaatatttgtgccgccgtgagaggagagcccaccgactacggtagctagctcgtcgttcgccggatggtctggacgtctggtccctgcccgttagttctggtgctatgctgcgctttgccatcctgtgcagctaccaattcgaaatcaaacccatggtgaaacctgtgattacgcagttaccccctttggtttttggttattacgagaagcatgatcgtttcgtttgcagcgatcaacagataaaatctttatatatctgtttttaacatgattttttaaaattactggacaataaattataataaaaacctaaaattaatttcaaaattaagtttttgaatttatttttttacaacggcttataagttattataaaaagcaagcaatggagtgtaagatataaagacatgattatcattaaaaattgttgaccggttctatagcggtatcatggataatcacttatcgcttgataaccgatggtatttggataaattttactaaaaactgatgcaggtagcgcgcatgtatttcaagttcaaattttaggacattacactacaccaagcaagggcccgggtgtaagaagtgtaagatacaaaaaggatcattcgaaattaccaaactggccctccatcttccacacgctcaaactggcccgtttcttctggatttttcacattttggtccttttaaaaaacttatttcgcaagtagatccctagaaaaacttatcccaaaaatggtcctttttggggcgccagagtggctggcgccgtcgtttaacaggacggcgccagcctctttggcgccgtcccaccgccgacgtggcggggcgatgctgaggtggctagggggag

SEQ ID NO: 45455 - DNA, 7310 bp, Oryza sativa
tggcgcccaaaaaaggaccatttctgggataagttttttaaggggtctatttgggaaataagttttttaaaaggatcaaaatgtgaaaaatccagcccgtttcttccccacgaagcctttttccaaagtccaaatcaccaaaccgtcgcggcgcaccaccatacacagcccgaggccgcgcagctctcgaccccgacgcggctcggcagtcggcatcgccaaccctcatctccccccctcctctccaccgacctcgatctcgcccctccccccacgcgcgcgatctcgcccagatctcgctgagccgccgccgccgccgcagcagcagcggccatggagaacctgatctcgctcgtcaacaagctgcagcgggcctgcaccgccctcggcgaccacggcgaggagagcgccctccccaccctctgggactcgctgccggccatcgccgtcgtcggaggccaggttcccgtcgtttcccccctacccgtttttatctcgctcggatctggcccctcgcgcctcagctgcgtcgatctggatctcgcgagttgctggtagggcagaaaggattagtagccgatgcggtctagctacgattggatctacgattgctgtgctcgccgaagactagatttggacgcttacatgaaatcgataggttttgtagcaactgaagctactaaactagttgatggaaccatccagctcgatggaattttgtgcggagttgcgcctgttagaaatggtttaagcttatttctgtaccagaatgggtgtacttcggtaacctgacgtttgaactttcctgatacgtttgatagagttcgggtaaatcctcggtgctggagagcgttgttgggaaggatttcctaccaagaggctcaggtatggcggttccaatagcaagtgcttgtataattcagtgttattgctcctgttttatctgatttggaatttttggatttggtttccaggcattgtcacccgtcgtcccttggtgctgcagcttcataggatcgacggagacagagaatatgcagagttcatgcaccttcccaggaagagattcactgatttcggtactccatctaccttttccttcatttttggtcatatcattctgtgattaaaattgcgagattgcatgtttatggagatcatatattcaaactgaactagattgccaatgttggatgatagtcaaacatatatgattacacctgtaattgttggtggaaacagtctttcaagtgctaaacatatattcaactgcatgatggttaatgatgatagtcgtattcttgcagctcttgtgaggaaggagatagctgatgaaactgacagagaaactggtcgttcaaagcaaatatcatcggtccctattcatttaagcatatattctccaaatggtaagataacaataatataaaatgtcagttcgatgtagttgctttatcacagtcaaattggttcattttgattattgtttgctgagatggatatgtggcttaaaagctgttccttttgtctgttgcttacttagtgagatctctgtcattgataagatgaccataccttatttgtctttatatgtgcatgcctgtttatgatttatctggtttctagtatctatttttgttagcgtcttaactcccactcttttgcagttgtgaacctgactcttatcgatcttcctgggcttactaaagttgctgttggtcagtattacccattgtcatttgtgagctattttcttttgtttgttctttttaaagaggtccatttcctgatttaccacttgctatatgctttccagagggtcagcctgacagtattgttcaggacattgaaaacatggttcgctcgttcatagaaaaggtatattttttgctgtaaccttttaatatttgtccactgccattgctgactatgcttgccttatttcggtaccatagctttgtatgcacatatacagtaatttattctatgcatatttgtttcgacattcttatgatttcagccatgtgttagcatatttggaatatgttttttgtatcatgcattatgcttgtagtgtgtgagctatgcttatcttgtcatgtatcatgtctgtaatgttgcaaaagcttatatgtatatcgaccctttttggtttgtttcagcccaattgtatcattctggatgtttatccaggcgatcaggatcttgctacttctaatgcgaatcatatgtcacggtaagttgagccccgcaatggtatagcctcatgcttgtaagcacattctggataaaggatggcaatcatgttttttgagatgtggtttgtcttgtaatgttcaggtgaaaggacgtttggtgtgcttacaaaaattgatctaatggacaagggcaccgatgctgttgatgtaagttttttcccagctaaaattaattgctaaaaactttattatcgatacattttgtccccggagatgtcaacatggattattgttcccttgcttttgggaccttttaaatctcctatgttgaatattcttctgttctatctgttggaagatatacagttgtagaaaatgaaggttatgtttgttctttgagctgtattttcttacggttcttttctgcagatattggaaggcagatcataccggctccaacaacaatggattggtgtcgtcaatcgatctcagcaggatatcaacaagaatgtggacatgattgctgctaggcgcagagagcgtgaatatttttcaactacgccagaatacaagcaccttgctcataggatgggatcagaacatttagcaaagagtctctcgaaggtatgcctttcatttcgtttctaatgtagaatacctgtaactctgtttggtatattgactcttaaatgttttggtgtatatgtagcatttggagactgttattaagtcaagaatcccagggctccaatctctcattacaaagacaattgccgaactggagacagaacttaatcgacttgggaagcccattgctacagatgctggagtaagattagggcttttttattctttaattagatactggtttattgagcctaattctgcatcccctttttatgctaattgctaatgtagtgcccattttttttgtgtatgttcttgatcattgtgctaatggacataattggtttgtacatatttggccatgcagggaaagctgtacacgatcatggaaatatgccgcatgtttgatggtatctacaaagaacatctggatggagtgtatgtttcaaacttaatgtttctgttgctaaatgttctcttagaagttttattgtagctacgtgtgtgcttcctgaattccgagataaaataacattttatcctaaaataacattttcccctctctgatctgtataagccttctaaaatttgtgtggccctaatttgataagctctcctttggtgttagtcttgtgtgtttactccaacgtaagcatacagcctattttaggttcttggcaaagtaacctgttaatttgtcttgtatttttaaacaataaatttctatcaaatgtaataaagatttcaataagcttgcttgggcgtacatgcacctagaatctccagttgtttttctttcagaagaaagggatcgtcgaatttaaccctaaaacctaattacatgatagcacttacaaagttattgctaataaagatttgcatattttcttgctgctgaagtatgcaatttaacacaatttaacttgtagattgttatatgcaattagcatcattctcccttgtgtgcttgttcttttgtgaattgaatgttgctttccctgatgcttacccacaaaaattctaatgtccaggcgtcctggtggtgagaaaatctatcatgtctttgacaatcagtttcctgtagccattaaacggttgcagtttgacaaacaactggcaatggaaaatgtgaaaaagctcataacggaggctgatggataccaacctcatttaatagctccagagcaaggatatcgacggctcatagagtcttgtcttgttagtatcagaggtcctgctgaggcagctgtggatgcggtatgctatctattaatttgatctattttttagtcttaacaaaatagcttgagcgtttctaacttttcgtgtcatatattgttgaagaatgtgcactacaacattatcgtatgtttgttgtactgacaggtccatgcgatactcaaggaattagtgcacaaggccatcaatgaaacacatgtaagtcttcgcactgttgcacaatgttttctgtaacttatactggggaatatgtgcattctgatggtacatgaggtatactgattgtactaggagtttaggaggtaatcaattatactgttgaaatttttgccttctgttgtttcaatattttgtctttctaataaaatctgaacctggaacttttttgctcgacttaagatgagaagcagcatgataattaatttgcatgcttgtcaaattgtcattactccacttgtaattgtgtaagcgtcctaaaagatgtgagtgagttctctgcaggagctgaagcagttccccactcttcgtgtggaagtaggcaatgcggcttttgagtcattggacagaatgagggatgaaagcaagaaaaacacattaaagcttgttgatatggaatgcagctacttaaccgtagatttcttcaggaaacttccccaggatgttgagaagggtggaaatccaagccactctatttttgatagatataatgattcttatcttagacgaattggtaagtcatcaaccattcttccttgtatatattcaatgtatactgttactgctttgcaatgatggccatttgttgaagttgagaagtggtttatcatattgttgcaaccttgtgtaatattgcccactaatttagtttaatgatgaatatacatgccatcaaggctttgcttggctgccttttaacttattttacctgtattttctgctgaaccttgctacaattcatactcaacaggaacaacggttctggcatatattaacatggtatgttcaaccttgaggaactctattccgaaatctattgtctactgtcaagtgcgggaggcaaagcgctcactgctcgatcacttctttactgaattgggagcaagagaggtgagttcttctttcttaaagcttaataaagcataacataagtttttgggccctgttttacattttttttggtgtgccttttaaagtccaacagaattgatctaactagtaatactgccttttaaatgttatgcagattaaacaactttctaagcttcttgatgaagaccccgccgtcatggaacggaggactaatcttgcgaagaggctggagctatatcggagtgctcaagcagaaattgatgcggttgcatggtccaaatagtcctgatcatctacttatcatactcatgtttctcctttactcccagttggtgatcctcccctatcttggggcatatatagctgattttaccccgttctaggtcattcatagatcaacgcagctgtgaggtgtcatttggtttgtgcttttgttccttgtgcttgaggatctaggagacacaggctgctgtactttttgtattacgaccaagttcatatatcgtgtttaatttttgtcacagcccattctttcgttccgtttacatatatcgtcttcaatttgttactagtccattctttcgctccctttattttcagcttgtttaatttgtattatttgtatgtgtctttagtccatgtagatgtttatccgagttttcagagttctaacatagcatggaggattaaatataaatgaaaaaaataactaattgtatacattgtgtaaattgcgagacgaatcttttaagcctaattgctccatgatttgataacgtggtgctaatgacattgtgtgtaaatttgtctcgcagtgtgcaaatgaaatatgtaatttgttttgttattagtctatgtttaatacattaaatgtgtgtccgtatatccgatgtgacacacccaaacttatccgatgtgacaccaaaactttacactcatagatctaagcacccccatactacagaggaaactcaatcaagtatggtgaagatgagtgtagtggaaactgaaccaagaaaaggtgacgctgccaccggtgttgttgcttttatcgtaaggaaaaaacaattacagtagacacattttttctatgattggttgctcgaatctccagttcaaaacacacgcagagaacctaacagttaagtttgtccaggttgcactgacgatttcactgctagtacgaaacggacaaacaacaattgaaaattgcatgcgtattgtagtgtttcatgtctttccctggtaatacttgttcaccaatctttctgaatactccccgaatgtaagagttccattcggtgggatcaactgccagaagttaaaacatagattactatatcagaaaaaggcacgcaggagcactgaatgcaagtttctgattaggaacaaacctcttgatgatacggaatttcacttggaaacttgagcttttcatccctacaaaatatttcacaataaaaagaaaatgtcagcaaacccacattaatcagacctaggctttgaaaatctacgtgccgaattcgtaacggcaagcatattactattgattattgagtattgaccgtataaatgaacaaacccacataacacataatgatgagggaaaaccagtactcttcatgtgggctaacattatgtgttgaaattggttgggagctttggcaagtggcaagtcactagtaggatgaggggcaggaaactcaaaagttctccatgtgagagaatatgtgaacactacaatttggtcaagaaaactgcacataccaatctggttgcatgaacatcgcgaaggtcgaacgatcaacattcgaggcgttttcactgctgggggcctagagacaacagtaaaagtataaattactttacaactgcaggaactaggaacactgattacccatgactacaaatttatagtacaataccttcacacagtgtggagttgcacatagacgacctcttgatagtatttcagtggtttctccaacttggtaagccaattcattctcctcaaatgtaaccttatgcagtaaaatttcaattagtgcagaccacataaccctctcctgtataatatgctaatgcaattcacaggcaattattcaactaacaatgattaaacattgtttcaaatgcctggctacatttccaaatctg

SEQ ID NO: 45456 - DNA, 15531 bp, Oryza sativa
caccgatcaatttcaatgtagagatgactgcgtacaacctaaattacaaagcatcatcttgatgataagtctatagtgattaacaggaaattaccttaacaacttatcatcacgagtccttatatacaatccagcagcactatcaggacaggggatctccattgaatttttcgtaaacaaggcacatgtaagtcctgcatgtaggatgcataatcagaattgaaaaaaatatataaattaaaacaaacgttttttaaacgctaaagcctcatagatgatagtagtaggaaacaaaacggagatcagatttatggttatcaatatatgtataatacagtaaggttatgggttcagaatttcaccacatgctcatttgaccacaacaaactttcatgttcaggagttatcgtgcaactgataatattcaaccatagggataacatgtattacctgttaaagatccatggtcagtatgccatccacaccacgatgaaacagaaccaccttcctcttgtttactgaaataagagacatgcaagcatcaatccttacaactaaaaggctagaacattgaaaaatcttgaatccaaaaaaaatatattgattgttacaaaggtaagaaaagttagaaagctttgatctacatggacaacacatgtaaaatgccttataatatgcgcgatgatatcgcgtgtcaatggtgtgtaatacttgataggcaccatcttgctgtttagtggaatcgcgtgacattgatcttgtttatccattcctaagtcttattaactccaaaatacaagaaggtcataaaggaatcactgcctagagatgcaattcatgcatgttttttcttgtcagaaatactgtgtatacatcatatttacctaaattgccgggggtagtaatacagaaggcggcccttgtgacaccttgagctggcaattgtctgctcaaggctttcaccatcatatggtcccactccttgctgcattactgacaaacaaacagaagttggtccaattcaccaatggaataccaaacttaaagaccaaagtacagagttgacaattataatcaatccaaaggttaaattgtggagattttttacttagccaaacagatgtggtttgtccctggacatttttaaaggaaatatcaggtaagcctatagaattatatagtacataccatagcgatcacaatgatgagccaacatcaagccaacttccaacatcagctttccaagagctttaaatgctacaaatgaaagaaatgttgtaaaaatggttggattctagcatggaaatacataataagttctacaaaaatcaaaaccacttaaaaatatatttcagcatgtaatgatcatgaggcactgaaaatgaacattaaccattcagtatcttacatttagcaccttgagatacaagacagccagtaaggtaaatggagtacaacctttggtacatttattcaatacagatatcctgacttataacatataaacatgtgctatgggcctatggcaagtcctccattttaatggctaaaataagtaggaatgggttattaaaatagtgataaaaggtaacaaatatgtactgttatactgagaaatagccctcaagtcagtcaatatacatacatatggtcagtcagtcatacctatttcgagctcaggaagatgactggctggccatatatttgttcggcaataagatgggtacctgctggttcaatattacattaaaaacacctataataagggtcatatttggtctttatgagtatatgatacaactcttttgcactagcaatacaataggtcattttgagtgatacaaatgatcgaccatagtaagataattaaactttaattaactcaaatcatactaaattcgttggagttagaataataaaggttgccaaattgttcagttttctccagtgctaaattgtaacagtaaactgagttaaattatttatgtatgaaaaaacgaaccttctcacaagtacatcatcagtggttggagcatccaaaattgggttggcataaaaggagcctttgaatgtgtctgtgatacagatcttttcaataaagtgcaatatctcacatatggtaagatgtataattagataaaagtgcaaaagtgcttaccgagtttccctgactcaagtttctctttcccatgactccatccaaagttaaacctaagaggcaaaggagcaaactcatcattgctgtgtactcactctagactgtcaaaatggatagaagttgaagtacaattcaggtgttgatcctaactaggagctcccaattggaggacataataggctacatcaaattcgtgattaagaacataagtacagaaccaaatggcaccaccatgcagttctgttttcacctgctgtctgggtcttcaagttctttcttcacatcttcaggaaggtttgcaaatctaaaaaaaaatggaagcaagcaacaagagatttcactacaaatatcaagcaaatgttgaaactgaaatgtgcctcctatgaacaacacaaagatgagactaagagaagaacatactttggtgccaggcgcagcaacgttttccttagcacgggaaaaccaggcacctgcaaaaagacggctacaaaattcagttcaggaactcgaaattttctctgcaggccaggaacgcagcgcgcatcagttttcaacgcgtcacactcacgtcagcaatggagatgatcccgagcccgttgggcccgagcccttcctcgatcttcccgctcaggtccctatccctctcctgcatcagcagcagagaaaacggcgtcgcaactctgatggaatcaagaaccatacgacgctatgcagcgggttcctctcttaccttgaggtcggagaaggggatggagaccgtgcgcacggacggcggcggcggcgaagtctgcatggcggcgaggcagcggcaccgcaccggacgacgggacgagagccgcccgagcgcgagagcgagtggtcgtcgtcttcctcctcctcgggtggttggtgcccagcctggctgcgtctgcttccgcacgagacgaccaatctccatctcccccgtcacttatctcggcgtcggattcgtctgggactcgaatgccgggaggagtgtaacaactacttttttttgagaccgagacgtcagtgtgtgtagcgtcgcagtcgcagcctcgcaggtgagaggattcacgcatccgcgccggcgattccgcggtggcgcggcgctaggcacggctgctccggcatttcggaagagttgaaaagccggttgatctcgcgcggtttcctgtagatttgatctcgtcgcgatgcagcggtgccgaaaaatttgatgtgggatagtgttttcaattagcaaatttaaattctaatatactagtactgtgaacacgactcttcttgtttgaagtatactacatttaaattcaaatatacttgcttcttattttaagtatactaactagtaggattgactgggaggtcgcaaagaatattggcacactacaccacacgcagttcacttgacgcacgacacagaagtccagtacaaagtcatccaatcgaatgagatccctgtagttcccattttacacgcaaggtatcacgaatcagataatggaagccaactactacctccaccacaaaatgttgctacgtagtaaaaaacaacactttagcagtcgcaagatcactatcctaaaatactgcaagccaacagttttgaacttttgatacgatgatttggttcacaatagcgatgttatgtttgtatagatcaaagggcatctggttcatggaaagctatagaaggttgcatttgacagtcaccatgacaatcagacagaaattacagataaagagttaacaccgcatggaaatatcatttcaacgcaaatgagtgattggcatgcgttgtacaagatgcaaccagatagtctgtgcagtaaaacaaaagctaaactcctcaaaatcgcttaaatttctctggccggtaaaccaagtgactagctgatataaaacctccacgatgccaactaccagttttgcagaataggcaagaaacctgtttcagttaaaagtgaaattactgttagttttcaaacttttgacttgttatgcaaaagggagataagcacaaaaaaaaaaacacaatgatagcaaaatatattataccaaacggactgcattatgctctgaagacattatcaactatcaacacaaagtcacaaaattatgaagaaatcccacacggtaggtttctatcataccacaataccgagagatggttgtgttccaagttgtgttccactagtcaaccaggacaccactggatcagataatgcagatagccgccaataaatagtcattaacgttttcaacttccaatgctaagactcaccaatttctacatttatgcataataagggatttgatccatcatcaggtaaaaaatccagagcaaaccgatctcagggatctcaggcaattcctcctgccaccccaattcctttttagtcaggatggggctatcatcctaaactggattgggacccctaaacaaggacaaagtatgaaggacacctagatcaattaaacggcaaagcatatagtgtaacacattagtttacaaccctcgagatcactatgtcactcgggctcgcatgaatactagttaacagtaggaaactgacatattagattaacagatattgaggtcattggaggcaaggctgtgaggaacaggttgatgagagacccatcaaccaaagcatagcctcgtactatgagaccgctgaattttatctagggccccaacttccgagcaccccgcagagaacctgcaggtatttcgaagctagcaaaagagcttcccccattggcatggagcccttagacacaaacataatgatcactcacaccaaaacctaacaatgcaccattccatctaatcaggcaacaactgtcacaaatacagaatccagggaacaattgcacaagattctgaccaaccccacgagctcgatgattcaatgaacaataaacataaccagaagcaatagtcaataatacatcaccacattgtaaaagcttgaaacaattggaactaagtacagcactctaccttagatgctgctagggtacatgaagacgcggaccttcttgccctgcaccaccaaaacaatccagcataaaacatcagaaatggacaacgaaactacatacgactggaccaaaacaggaagggatcaatggatagcgcggacgacggagagagcgagatttaccatggaggtgggcgggaggttggaccggaacttggcgcggacgacgccggagttgccgtgcgggcgggtgaccttgccccagatgcagcggatggtggagtcgttgctcttcgtcttggccttgtagacgtaggcgatgcgcttcccggcgtaccacccaacctcctccttggtgttcaccccctcgatctgcagcagcgacgtgttctcgtactggttcgacttcgacctacgcgtgaaaatcaacgccaaaccaagatcaacaccactccaccgcggcgatgacggagaaggcagataccccgccacgcagggggggggggtgagagcgagcggtcacctcttgtagccgaggatggtgccgcggacgtacagcctcacgcgctggccttgccgtcccttcatcgtcgccggcggccgccgaggagggtggagatggcgatggcggcggcggcgggaaccgaggaggaggggaagtgacggcgcaggggaatgagatgagatgagccctagggcatgtggggttttaaaagtttcttgtggtagattggacggccgagattgcgtctagatggacggcggatgtgcatcgagatccccgtcggagaaggcccaagatgaaaggcccatctaatatatgggcctacaaacaaagtggacctatagtcctttttttgcgagggaaaatgggcctgttaacatagagcctcatctttttcttatgtttatcagccaaattttaaatttagagttaattttagggttttgtcattaaggtttattttccatcctttgcttttaaatcactaagaacacatatataaaagtttcacagattattttttgtttgcaaatatgtcgttcatgattgggctgaataatctctttataaccatctcagtttttttcgacggcttcaattatgtgatataaaatttcatctgcagaatattaaaaaaacatgacataatttttctgaaaacaaaaaaaatcaatatatgctttacactattgaataatattgaattattatgcatgaaaaaataattttaaagtagtatttgaagactgagagagtatatacgtgatattgtagtatggaattacgcactgcgtacgtgttgacgcttctgttcattgtctggatggtggtgtgttgatgtcgagctcgcatgtgtgttgacgagactttgcaagtgtaggtctcggcagattgagatgtttggttttcttatgctttgatggcgtagctgtgacataaataatcagactctgggtgtaaaaaataacagataaaaaaataaaatgatgtggactaatacctataatacctattgctgacttggacaaagattagcttcgattcagactttcagaggcaaatcatttgctcgcaaatttctctacttctgtacgtatttttattgcagtcatgacaacgaccacagggggataaaagaaaacagattaacgttcttgttcagacaaagttactgtgtgaacagaataaaaatatacactagtaaattatcactcgattaagtttctcatacagctagcgtcagtgttacgaccagactaactactgtgaattttttttttcaacgcttacgtgtgtgcagataacaatacctaatggtaatcacaggcttctcagatagaacaaagatagctgatgcttgaactggtcatgctgactagctacctcgatcctctgaactctgaagtctgaaatgtcatggattcagaagatactgcccagcttgcccatgatagagctagcttttgcttgctttgaattatgaagaggtcaatgttgcctaaccacaatatgccaacatgagttttagagtattatccgttggcatcaatagcttcacccatcatgattcatggcagtgtgacgaaggtaatcaacactgttttgctgatgagtgacagctaagctgtgtaacgtctcacctcgatcgacaacactccgtctgaatattccgatcacaacaaatatgtcaatgtcgaggacaagtttggtagaaggaagctggtaggcagcaacatccagatcagccgatcgaatttcgatttcaattcaaaaggttgtttttagagaattcacaaagagttgatgtgctacaactgcaagtctgcaacatatgaatcaatctcctcttgcttgctaaaatagcgtgacaagaaataaaaacctgttctttatcaagcaaggatgcatcttataaaacaaggggattatttacacatggatatgaacatatcatgctcatcataagttgcacaattgataactctctgcatacactgctgcgccatggcggagccgacagagttcgtcttctcaagaagccaagaggaatcaagagaaggaaaaaaaaacaaagagagtagaaatcaccaattcaattcaccatgtcactaattaaaaacttgctagctaatgtactcgagctatatgtaattttatcagggctccaaaaatgttacagctactgtactgtgcatgcagaattttttcgcagttgcagttcttgcttaatttgctagttctccggtatggccacgagccgcggcgcccacgcgtccctggcgccaccgccgccgtgaccgtggccgtggccgccgcggagcccggcgttgagctccaccatcttggccttcctctcgacagcgcaccgctcctccagcctcgccatcagctccgccgcgtccttcctcttcatcaccaccttcacccgcatgccgtcgccgccgtcgacggccggctccacgtggcaccccggccacgccatcctcatctcctcctcctcccccggcgtgtctatcaccggaaccacgtgcctcgacgacgccgccgccgccgccttgctgctcctgacagcggcggtggccggcgacttcttcctcctcttcttgactcccgaggtggccaccgccgtggcctcctggcacggacatggcagctgcaagctgttgcccatgcgactactactagatgcttctctctgtgtagctaagcttcgagtggagaatcaatggcgatgtgtgagctttgagtggcacctggatggagaattggagaaagtgtgcgttatatagcggtgaagaggagagcttgacttgttcagtaggagaagcgagcgtaagtgatggggtatcaaattatagactaaaattaggcaaatttttgcactaaaaaagaattctgatagtagcctattatgtacgtcatgcgtgtaacctcgatcgatggactagtcagccggtcaggtacgctaatgactgttgactagctgtcaacggtctttggctcgtataagttgcaatagtaaaaatatttttccaagcatactgcagcgagtatgtacttccttcgtcccaaaatgtaatcatttttagttataaatctggacaactgtgtatccagattcataactaaaaattgctatattttaggacggaggtagtacgtataatgaatgtatccgcaaatacattttgtgcaatgacatttaactttgaaactaaatgcgagtatgcctgtgtttagttcacgttgaaaatagaagtttggttgaaattggaacaatgtaacagaaaagttggaagtttacgtgtgtaggaaagttttgatgtaattaaaaagttgaagtttgaagaaaaactttggatctaaacacggcctatgtacaaagtgtatccacaaatatggtatgcaacagtatagctttgatttttaaaaggactgagcaaccgggggaatctttttgtcaaataattaaaaataaaatattatcatgttgagaaccaaaataaagggatcatatggttaaactaatacatcctactacaataccattacactagcaagtgcatatcattactttgaaattaaactctcctgttgctagtggcctcgcgggaccttccaacaaaaggagctcctggcaaccagcctcctagccaagattaaagaggaagccaaaacatgtgttttggtgggtgagaagaaccttggcaactggctcattatgtggttagctcggtccaaaggctctgagcttgtaacttttttcatttttttttgggttttgtacaatttactccatctctatttaatgaaattggcggcttgccagtttgttcaaaaaaaaaaagtcctcgttaaaaaaagttcttacagagaaattctcaataaaattgtttacatctaacaggtatatacatctcataattgaagcagcaccattttacaaggtcaatcttgttacccgttctatatattcttttgtgtttcgttgctcaatccagaataattattggtcgtcatgcacgcagtcactaatggactgtacttttttttttcataacggcattgccaatttagaacaaggcatatcaaatatgaatttcttttgcctcaggtgtcgtcagtaatatcttctagtcagactaataatgcgtgacttcgctccaattataaaacagttaataacaaccaaacatgtcacacgaggattgagtttcttttcaataaaggaagcgaatcaatgaaatgaaacagagcttctgcttttgtttaagaaaaaaagtttaactgattaattatggctgcagatcgattcttgaactactcaatgacaacacttcaaaaactttaaaaacatttacaattcatgcagcagcattgtggtaggttcatggatggaagagaaacacgaagatccattatgtacttacacataataaatagatgtttttaacagaatcccctcacatttatttaacaaaaaccagacattgctcttataatcacaggatttgcatctcttcacaagaagaaacagggaaaaaatatacgcgtccgcaaaatttcccttttatcatacttatataaacaaaagggcccccttttcttgtaaattatttacaggccctttattttacctttttatagctaaaaaatgcatggccctactatcttcgcatcatcaatgctgtatcaaaattgcagaaatgttctctcggcctatgcaactacgggttggaccagaccttcacttgagacagcaatgtcctctgtgccattggtttcaccttcatcatccttcgacaggtaattgtctacggctgctgcagcttggcgcccctctgtgatggcccaaacaaccagtgattgcccacgtctgcagtctccagcagcaaatacaccttccacattggtcgcaaagtttccaaattgagctttgaagtttgacctcatgtcttgttctagacccagcttgttagcaacagtctgtagaaggatatgcagttaggcactatgtgttggttggtctctaaacagatagctatgtgcacaattgtgtaatgctattcttgtcataactcataagagaaagggaggaaaactaaccgcttcgggacccaggaatcccatagctaagaggacaagatcggcctcaataatttcttctgatccttcaacttccttgaattggaaccttccgttcacctttccccattcaacacgtattacctcaagggccttcacatttccattctcatctccgataaatcgcttcgtcaggactttgtaacttcttggatcttttccaaacttgctagttgcttcctggtgcccataatcaacacggaagatcctgggccactgaaggcaatagtagaaacacaacagagtaatgttagtggaatttcaggcaaccgtagtggcgcaatgcttacattctaaacatacaaagattttcactaaaaaaagaatataaagatgctgttgttttatatgatgagggaactaacctggggccaggggttgtcaggtgccctctttcttggtggctctggcaaaagttcaagatttacaaggttggtgcaaccatgcctaatggatgtcccaatgcaatctgtgcctgtgtctccaccaccaatgacaaccacctttctcccttgggctgatatgtagttaccatcctccaagttgctgtcaagtaaacttttggtattggcatgaagaaattccatagcgaaatggatgcctgccaactcccgtccaggaatagggagatctctgctcaaggataatgctctaaacattagccaagtttcaaaggcatgaatgatatagactgtgttgcttagactttaaaaactggtgccaagaaagatgtaaactagagttacaaactcttctttttttcgtttttgtattaactcactttggctttgtagctccacaggccaaaataatggcatcattctcagagcggagcttttcaacggagtataaagggtcacttccaacatgggcattcacaatgaattgaaccccctccttagccatcaactcgacacgtcgctgaacaatgccctctttgtcagccttcatatttggaaccccatacatcatcagtcctccaatacggtcagcacgttcaaagacagtcacgaaatggcccattttgttcagttggtctgcagcagctagaccagctgggccactgccaacaatagcaactctctttctgcaaaaaaatgaagtagctttaggtgcagctattgttacatgcttcaactcatataagaaagcaagtacaaagttgtgccgaacacacaccctgttctccgaagtggaggccgtggtaccaccatccctcttcaaatccgttgtctattatggagcactctatgcttttatggatactggattgtctataatgccaagtacgcacggaccctcacaaggagcaggacaaactcgtccagtaaactcagggaaattgtttgtctcaagtagcccgatccaaggcttcatgccatctattctgatgaaccaattcattgaattcaggaatcttatttccaagaggacaaccagcaccagaaccctcctgcaaaagtttgatataagaaaaatacaggaaccataccaagaaaatttcacaaatcttaacaagtgaaaagacaatctgatgatgcaaagagaaaaagccacatcatgtagtaaataatggccatagaatcgataaaaggacaaaaactgaagaataaatctcagctgtccgatggaagagtggcaaggaagttactagatattccaagtccacctctgaacctgccaatatgtcacaaccatggcacctttttatttttaagcctaaaaaatatttttttcttaggcgtataattttggaggttttgagttttgaatattggtaaattatttttataccttgtgtacaattaaaacctcgtatacgtgaagaaccttgaaagttttgagttttactattgaaactagcatggtgtcccgcgcagattgcgcggctagcatcattatattttctctcatataatagcatatatgttttctcaatatattatccaaatatattaaaatgacaacataattttagattttgcaataactttacgaaactactaatgtgtaatattcatattgtattttatatacgtgttagttattaattatttttaatatcaaattttagttatttgtaaaatatatatattcctatatggactctagactcatcttttaatatatttttttaattccaaattttctgtaaattgtatttctatatagactctaggctcttcttccaatattatttatttttatttctgaatttttattatttctaattgtatttctatgtggactctaaacttatctttcaatattctttaatttttaatttcgaatttcagttacttctaaattgtattcctatattgactttaaactcttctttccatgtttttcttaatctcgaattttagttatttgtaaattgtatttttatacagactctaaactctacttttaattttattatgtttattctgaattttagttagttttaaattcctatatggactctatactctacttctaatattccttattttttaattccgaatttattttttttcttaattgtatttctatatggactatatactctacttctaatattcattatttttaattccgattttctattattttctaattgtatttctatatggactctatactctacttctaatattccttatttttaattccgaatatcagttatttcctaattgtatttctatatggactctagtctcctcttctaatattccttattttttaattccgaatttcaactaattttaaattatatttctatatggactctagtctccttttctaatattccttattttttaattccgaatttgagttatttcctaattgtatttctatatggactctatactctacttcgaatattccttctttttaattccgaatttcagttatttcctaattgtatttctatatggactctagtctcctcttctaatattccttattttttaattccgaatttcaactatttctaaattgtatttctatatggactctagtctcctcttctaatattccttattttttaattccaaatttcagctatttctaaattgtatttctatatggactctgtcttttctttttctccgattaatgtgagaatttctaggccatgagagcgaacgtggaggcttctttttctattcctttaataatataatagatagattatattctttacacacttttttaaacattgcataaagtacactcgattgtcggttttgtttagcacacaaattaaccatctcagtttttttttcaacgaacacactttctaaagtaaagtaaaatattatgaatttagtttacctaaaaattaaataaaatagaaaaaaataccaaattttatagggtaactaactaagcataccctaccattgccaacttaccaaaatatcataacgcagtaatgataaaacaagtcagaccaaaaaaattaacatttacataatattttttaataagatgaatgattaaatattatgttaaaagttaacagtgtcatctattaaaaagggaagtatattttgttactacaaataatatgtaaagatattcagtatagaggatggttaaattcgtgcgaatgcacgactatatgcactaatatatatggacaagaaatcaagagcatcaaggacattcatataaaacttttttgccgggtgacattcatataaaactactgtactgaaaagcatcattgtattttatgaaaaaaaactgcttaatacaaaagggaaaaaaactgagtatcacctgatgacagaaaggagtgccacaatccatgcaccgagcagattgcgtctttagcagtggcccaggaaccaattcaattgcaacttcattccaatcttttacacgctcatttggatctctgtaagaagtaccctctcgctcatattttatgaaacctcggtactttacagcatttgaaactcgtgatggtcggcttgatggctcttcgttcattactttctgcatatcaaagactttaagtcagactagaaagcttagcttacagaattacaataataactattttaagaaggacatcataaatttccaacagtcaagttaaatatcaccgatatagagaatgagaaataatcctgcttaaaccttatttacctctgtctttactgaaatgccatttggagcttgaattacttcaactggcttcttatccaccacttctcttgccttttgctctgcttctttagcagccttctcttcttttagtttatccaaaacccgcttgtaatcccttggatatacttttataaattttgggaggagagtatcaaaattcaagagtatatctctggccaaatcactttgtgtatgaagtctgtgctgttgtatcatcattctcaatgttgtgatgtcatcctcttcaactacagcatacaagtcaactagctcatagttgcaacggctactgaacttcccatccacatcataaacataagcaatacctccactcatgccagctgcaaagttcctaccagtttttccaagaataacagctgtacctcctgtcatgtactcacatccatgatcgccaatcccttcaactactgcttgagctcctgaattgcggacacaaaacctttctgccgccataccattgaaatatgcctctccctttgtagcaccatataaagccacattaccaatcacaatattgtcttgtggattaaatcgactatttcttggtg

SEQ ID NO: 45457 - DNA, 3017 bp, Oryza sativa
ccatctggaggctccagtgcctccatcatgtccagagatcagaacatggtctgcatgtcctttcaccacaccactagcgacaattcctacaccagcttcagagactagtttgacgctgattctggcacctgggtttgcattctacagtagaaagaagcgatatagcataagcaagcaaaactgtaaagtgcaacatgcatgatttcaattaaaaaggttctctaatatgaaacattacaacaaaaaaatgccaattaataaggaagtaaatgtgtaagtggcaaactggagtcttgcactaaatagttataagccaccatcatgagactttttacaaatgagactataccttaaggtcatggataagttgtgcgagatcctcaatagaatatatatcgtggtgaggaggtgggctaatgagccctacaccagctgtagaatttctagtgactgcaatatcaccaatgaccttgtggcctggtagctcaccaccttcaccaggtttagcaccctatacagttagaggaacaagacataaatttctactgcctgatgaaatagccagaccagtggtcatggacatattgcaggaagtaactcgtttagttttacaaaaaaccaatctggtcaaatacctgagccatttttatctgcacctcaactgcattagtcaaataatagatggaaactccaaatcttccgctggcaacttgcttgattgcacttattcttggattctttgatccatcaggaagaggcaccatacggcaaggttgttcccctccctcacctttttagatgtcccaattaacatataaaatggagtcagttagcaaattcactacagtagtaagttgatattctaaataaatagctgtgcacaaataagtcataaaaaggtttacataagatgctctgcagataggaagtgcaatattagagaagaatgaacaaaagttgataaataacttgcatcagcctagctgctgtgctcaaataagcaaacaacaggcatcttcccatttgtttctgtgtagcatatgaaaatagttcagaaggaatttaaaataaaggttcatatcaaattgcgactagccctgaaatcggagaacaaacaaagactatgatctaagctactggattgaatccaagtgatatatgcctactatcaattaacaaaaaagaaagccttatacgccgtcaaaggatcccctgatttattcacttacgtttttcttagggaatgcgcataagctttgtgcatcatttgtattaagattgaaaggaacaaagttctcacaacaccatctacccaaagcaaatggttcgactggaaaggtaaaaaaaccaattgcctgtttacctttagctatagtagcgtataagccctgttggcccaaaatataacatttcctgatcttgttaacctttctgggaaagcaaggatgaaagcccaagtaaggtgctatgcaagagtggcccatcccccaccaccaaatggaggcccagccattgggcgaattttgggtcatatggtgttacaactctacgcttatgtggttaccctcccactatgtaatgatacgcagttcaatcgacaccgtcaaaaattggtctggcaactaatggggggatattatacttctatttccaatatcaagggtaatttggctactataaagcttaacctgtgccacggaagaaggtcagtgtttgagttgttaactggcctttgctcccattcttaatagttatataaccttcacgttccaggcacatataattaagaactttaagcataattcaagtgatttgggaataacaatgttaaaaggatctaaaagagccaactagtttttagatgttactttttagctcaaagtttttgcaagttatcatgggaaatcaagaagcttagaactatatcaagcaaacatgcaacacaaagcacacatgacatttaaagtaactgactcagcaaaagttcaggtccgtatatgatgcgagatacctgtgttagattttcctccaagggtgttcatagcctcagccagggaagtatgagcttccaaggaaatggatccataactcattgctccagtacagaaccgcttcactatctcctttgcaggttctacctcgtccaaggaaatttggtttggaatttctctaaatttcagcatgccacgcagagtacatgccttattcagctcgtaaatgcgcctagaatattctttgtatgcttccctgctgttaatccgtgctgcttcttgtaattttgcaatggaaaaaggatcattaaggtgtacttctccatttttcctccaatggtaatccccagggttgggaagagcatttgcatctgcacttccaggaggtaaagttcttgatgggaatgcaatctcatggagacgaagagcatcttgtgcaagcatttcaaaggttgcaccttcaactctactaggagtaccttcaaaacacttgctgaccacttccgaagcaagaccaagggcctcaaaaatctgagcacctttgtaagatgccagagtggatattcccatcttcgcaagaactttcatcattccatagtttgaagcataaaaatatttctcgataagttgttcttgtgtataaggtttcccatcattaggaggaatcctcccatcaatttgcaaccgccatattgcttctatagctaaataagggcatatagcatcagcaccaaatccaataagggtggaaaaatggtgcacttcgcgaggttcagcagattcaactaacaatcctatgcgtgtcctctcaagatgtgagacaaggtgctgatggacagctccaactgccaatagggaactgacagctacacgctctgaagaaaaacctgtatggaaacttctagttaaagcaaatgttttaatccaaatgctacagatgacggatcaagttaattttgagaattaaacattgaaatgcagagcacatatcatggtgacaagcttgggaaagctgagcttggatgc

SEQ ID NO: 45458 - DNA, 12023 bp, Oryza sativa
  unsure (1)..(12023): unsure at all n locations
caaaaaaaaaaaaaagaagaaaagctgagctatgttgacacatgatccaagaggagcaagaaaaactaagtacgacctaacctaagatgaaactaagatgttgactgttaacatgttgttacgaaaatatacttattcatgatctgtatagaaaaaaatcttgatatctttcataccacaataacacaatattgaattcagctcaaaagtaaagattttggggagaatattgatttcatactaacactattgctcatgaatctatatctagatgatgataaattcatggatcataaaattcatgcttagtgagtctggtgtaactgaatcttactgacctctatcagagagaactagaatagtgtagccctcatgaatagcttcacgtgcttgagcacaaattttatctaaagtctgttttaagcccatcctgccattctttttaggataagttatgtcaagcaccttgctgcgccaaccccggtagttcatctttttaatagcctccatttcatttgtattcagtaaaggactcttaagcgtgaggcgatggcactgccgctctgttgtttcagacaagtcaccttcaggaccaatcatgcactccatagatgtgacaattttctcccggatcgggtcaatcggtgggtttgtaacttgtgcaaacatctgcttgaagtattcaaaagtcagcttctctctgtttgacatcacagctagaggagtatcatttcccattgatccaagagcttcttgtccatctttggccatcggtagcatcagcatttcaagggcttctcttgtatacctgaatccaaccaaataggtaatttttcaacaaggaggatgagaagaaacatactaagattgggctgttgcttacccaaaagccttcagcggagtcagaattccgcagatacccatatctgctttgttctcctttgtaatctgcagcaaagtgtgaaaaatccataaaatacctcaccattacatggtaaattactaaccaacaggacactccaaaagttagcaagataattaacttactggaagtgcacccgaaatgctcggtgcaattctctctgcttcatttacagattctatgatatctgtgagttgtatcctttgtcttttcagccactctccatatggacgaactttggagtactctttcttcaattcatcatcattcacaacacaatggttctcaaaatcaactaaaagcatcattccagggtttagcctaccctttcttgaaacatcttgaggaggaacatcgaccacaccaacttcactagccataattacacggccactgtaggtcacataaaaccggcctggcctcaaaccattacgatcaagggttgcaccaaggtagcggccatcagtaactgtgcgtgaagaccaggtcagaattgatacttatctatcataatgcatgcatcaatattaagaagagagtttagttttatcttgttacatgagattagagctggtccatcccaaggctccataagtgctgaaaagaactcatacaaagcttttctctcagggtccatgttaacatcgttttgccacgcctcagggatcatcatcatgacagcctctggcgcacttcttccagattgtatgagaagctcaagaacattgtcgattgcacctgaattcacaagataattcaataaataactttgcaaagatggccatacttccatttgacaggtgaaaagggatatggaatcccaaatatacacatttatttctcttaatacaaaaatgtgcgtctcacgtattcccaatatatatatgtatacatacacacacacacacacattgtttcagagacagagctagcagcaaactactgcttttatttttatcatgtgtaaattatgataaaggaatggaacctgaatccgaagatgtagcatccactatcggcagaagtttcaacatttcatcccttgttagacctagtccctcgcacttcaagagaccctcacgtgccttcatcctaccaaacatggaaataggacaaaagtgcaagtaagcatataaatataagctccatggtccataggcatgtgaagattcttgctcacaagaaaatgatgagagatgtgtttagtgaaattaccagttcttgttccctctaagggtattgatctcgccattatgccccaaaacacgcattggttgcgctcgatcccaactagggaaggtgttcgtggaaaatcttgagtggatctgtttgcatgcataacttttaaactataccttgttcatcttttgcacaactacatataaatgatatgcaatatggtttcatatgaatacccagtaggccagtactatctatccttgaatcctgctccatatgctatcatccatgtaaaacagtttcagaacctaagctacctcaagccaaataaagtttgttcaaaccacctaattaggatacacattctgaaaaagcagtacctaatagcagaactacacaaggattctgaagtgtcttttttgttgggcatcagctgacacagtttcagtttctacagcttcagccaaaggcatcacgaaacaggagggaaatagcatattaatattaataaaagaaaagaggatatttgatgcctgcttagaagcattatatatcctcacaaaaatcttgctgctagtaatcctatcttctgactatgatcatggattttgttgttcagacaatattgaaatggttattcacttaccagtgccatgtaacttgtgaagctttcatcgcctaagtctgcaaagaagtaccccttgagttggcttggcttaagctgacccttataaacaatggtcctgtaaaaaaccgaatttcaggaaataattacttggcagaaaatggaatgcatgcacatgtgaccaaatcaaacttcacttcagatgagatcaaatcacaaaggaaaaaaaaacatccaaaagttttcttctattccttgttatcaaaatgaagcatttctgaaacatgtttttttttattccatatcacagcttactgttgcttaatacagataactgaaatccttagtggctagcgcttcaaattacccaaggttggaaacttaaaccacattctttaatgggatggtaacacagaaccttgaagatagagagcacatgtagaaatcttttgttccgccattcttgacgcctagaacttctcgtatggacataactgagaacctccgtaggacgtacatctggagttgcagtcaacaaaagaacaagtcaaggaaaaattaacagctacggatgaaatccataaagttcaaatgtgctggctcatcaaataacctgccgctcaaaatcagcctttgaacttgcacttttggtgacaaacacttgctcaatcactggttctgtatctaccgctgattgacccaagcccgagttgtctgtgggaacccggcgccagccgaggacggtatgccccagcaactctgctttctgcatgaacccaaacaaatccaaagatacaacacgaaattgagaatggtatcatgatatcagttacaataggattgaactgaactgttctagtgttctgcttggtcaccaacctcacgaaacaaaagcttgctcttttcacggcgtttgtcatctgtgggcatgaaaaacatcccgacggcgtactcaccaggcggcggaagctcaaaacctgcgtccttcgtgacctgtcagaacacaaaaaaacaaaaacaggcagaaaaaaaaatgattcccccagcggtagaaaattcccatatttctcggcttaaaacttcaagtaggtttgcctctctgaagaagttgtgcggcagagcgacgaggatgcctgcgccatctccggtgttcttctcgcagccgcaggcgccacggtgagccattctatcgagcatctctatggcgtcgtcgacctgcaaaaccgagaacaatttcagaatatcagaaattcacgccgcgttgggggtttcgattgtttgcacgggaacaatcaactccagcgccgtgcttagccgcggaaacctcaccgttttgcggctgtactcgccggagagctcggcgatgaagccgacgccgcaggagtcgcgctccatggaggggtcgtacagcccaatgctgctctcggggatcttcgacatcgacctgggaggaggacgcgccgcccccgccccagcccccgcctctgcctggcgcgacgccgatgcccgcggcgccacccggtcctcggcggggagcgcgccgccgaggaacccgccctccagcgacatggcgccgtggcgaggccgcgccgccgccgccgcggtcgccgatgccgcgcggcgccgcttctccccgcggacgccacccgccgccggcgcggcgcgcagcttcagcgcaaggccctgcgccgccgacattgcccgcgcgggaacgaatgcctccgctactagtagagtagaactgctattttaaatctgcacacaaaatttgcaaatgcaacagaaaacgttagagataataacaaaggtagttaattaaattataaaaaaatattagaattttttttaaaatatagaactgcacattagcttgcagaaagttcagaattgtctagttctacccatcttagataaaaccaagataagtactactccgtattacggataactaaaagtgaccaacaactcctcggataaaccgagaaatctaccgggaaaagaggaacagaaaaggagacgaacacacgtagtagaagcagatcacgccgtaaaaacaaacaaagctgagattcctatacctcacgattctgtggaagatttgaactgtcgtttcctcttcacctcggatggatggagatcgccggcgaactgcggctcgccggccgctttctcccctctccgatcgctcggcttcttcgcctctccacctcgtggtagtgtagtgtgtatcgcttcttctctctctgctctgaagttctacagagcagcacgcgccctcatttttatagggttattttgtgtgggacccgcaatagccgctaccaccccctatcttcccgtagattttcgtgtggtattttcttggacttctttttttttctccctctgattcttcgttgattcttgttgtagccttgtaggtggcatcaatgtttttttttctaaagcaacatggccgggaggggggactccaatgttttacagcaaatacttccagggacatatcataatttgaaaaaatttctacagtatgctataaattatactcctccgtcctaaatttattataactaagaattttatcaaatggcatgcattttggtaggaaatgtaactgcagtctgcaggtggtgaaaaaagtttttttttctaattatggaatataaaatcatcccggcctttacctagcgagttacagccaattattacatcaaattacttgaagcgagtgtatctcaaagtaaacttaaaaaacactcccataattaaagcaaacacaaaggaatgaacatcaacacaagataaaaagcacataattattgaaccatatttctatactgtcatccaaagttacaaagaactgcatgacagttatatgaagattacacaatgtagacttcaaaagctcacaatcttccatcaaccctcacaagaggaaaaaaaactatgggcaaaatgcgcgataatttacatcttcagagggtgttgatcgcaaaccgcaaagcccgtaatccgacgcagctaaagcagaatcttttagctcagctgcagcgagccgagagcgacgtgcggaaacggggagcggctggcgggggccacggcgacagcgaggcacagccggcgatgcggcgatgccgatgaggcgagcgggcgcggggagccaaagccgcgcgctcaattaggcggcgaaacccagttgtttttcaccttttctcatcatcatcatcttatcgatccacaagtttaacggcgatcgatccggctgtcgcgttggatttgttgggttctttgttcattagcgcgtagcgccatttgcacgtaggacaacgccgctatccgctcggctcgagctgaggcgcaagcggcgcctgatctgatcgatctcgatccggctggtcaggcggtcaccgattgatcgcttgcaccagcaagctgacacgtgcactcgtgcaggcgacaacaaaaacaggaggagattttggaggagagtcgtacttctaaatactttttaagtataaattgtagcgagttagggattaaatacaagatctcgaagttaaaattatgggccaatttaaattgctaccctaccaaaatttgccctaccaaaattttggtagggtagcaaaccaaacatctctactaaaactctaccagtgccataaatttggctttgcctatgaacttgtctcttatgggcaaattttggcttcaatccaaataaacattttcaactctaccctactaaaattttgatagtaccaaaacttgcccaaaatttgacactaccaaaattttggttgggcatcaatctaaacatgccctatataccccttgttactgtcctatcaaggatatctccttgcagattacaacaacggcttgtgacaacggaaagacaatgattcatgacaaatttctatggacaaaacaacgcttctctgcaaaattgaatgctaaaccaaagcctaagatgagaagttcaagaatttgcttctttttaaaaataaaataaaagggaagatagagagaggtcttcaataatttctgggctcgaatcaatgtgattaatcatgctaccgagcacaaagaattagtatgtcaattaatcagttgcacataatttaagccttaacaattgcaagctacaccttgattattagttcgtcggtaatgaagtaattaactttatttacacatgatagttaccaagacgtatccacaactgcttaagtagtcaaccaatcgcattaccgtgatccacaaaattgaccaagcaaggttggcttaaatccccttattctcgaccactagtagcacccaaagagttgacgtgaacgaaagggatttgaagggttgcaactgcgattagtgagaggtgaaagcgttgaatttgccactatcacgattaatatattgctcgttgtctgcacgtatccactggtatattcaggtcagcctacctagctacacaggaatccgctgcctccagaagagtatgtgtcaagcacggcaagaatgggaccaggaatctgatctctgcaaaaattaaaaatcataaacatgttactactttatatatgtgcacgatgctactcgtgagatcatactctgaaacgctacagaacaaaggatttagcctgagaaaccaagtgcaggggtgctcctagttctgacatttcagaaactagatatagatgtcgtcaacctacaaagatgaaagttaaatactccctccgtttcaaaatatttgacatagttgactttttagtacatgtttgaccattcgtcttatttaaaaattttaagtaattattaattcttttcctatcatttgattcattgttaaatatactttcatgtacacatatagttttacatatttcataattttttttaataagacgaacggtcaaacatatgctaaaaagtcaacggtgtcaaacattttaaaacggagggagtaattcagatgactcatgtaccattctatttataatttttctctcgtttgtttatatcacgatacagatcatcgaacccgactaatggctccagaaccaatgggtagatttgtccacaggaaaaatgacaataagtgtggtaagaacatagaggtttttctctgcatatgcacatatatataatcacatcccaaacggaaaatgtagctatcgtcattgtcaacttagcagatgttttttagataatagaagtaagaatgcaatttcctctctagacgtattcaacattaaaattttcaactctagatgccaatgaggcaatgacttctcttgtatctgatcactggaaataccaataaacacatgcatatgtcaaaatccttatgatgctcgatcagtttgtcattttcaacctattctttgattgaacagttgagttataacattgctggttctgaagttcgagttctgtttttgatttacaattattttcgcatgtttaactacgattcagaaaattatcggaggatgtacgtactgtgatcttcgggatcaccggtccagattatttctttaagtttcctagtgttacccaacctgaacatgaaagccaaaagaggacaattaattggacaatccgcccggtgctgatcagcattcagcaacgtcttatctattgggtacgtggattggaaggaagtacaaatcgcctgctaaatgccgcatctctcttcatcagcatgtcataatcgcgctatcttctcagacgcgtcctctaatcacataagcctcataaatggcagtattaactgatttatttccagttttccaccattatctagtggtcatgtctatgcatgcatgacattttttcgagacactgtagtcaatagatagagtataattcacaagtagatatataggggtatatacatcctcttacaagtcaaatagtcaatcgatcatatacagagtatacatttactgcacatagatatataggatcaatccaaaaaaattgtttcaaattacttcttgttatagttttacctatatatcttaagtcaaatatttattttgactaccggtttctaaaaaattatataatttaacatcataagatttaggagtatgcttttagattcaccttgaaaaaaatttcataatatatacttcacatgttgtcaaactatttttttttagatttgtagatgttggtagtcaaagatagacatgtttaacttatggaaaatctaaaatgggaagtaatttaaaactgctaaaatatacatgatcataaatgagaaaaacaaggaaataaagacattcgggcataaacaccaccatagaagtttcagagtttgaaaaataccactagatatatacgttagaccgaacgagtctgagacacatatatatagttgagtcattaatgttgttgcaagaattcaacaagtgtctcaatttctctcatgtattcaatctgccctctatgggtgatatttacatcctacctccgtcccaaaatacttgtcgttataggttgtttagcatatactaatattttgaagaaaaatactataataccccttaattaataatggatagttggatgtggaatggtggttaggggtagaatggggagaaatttgaattggaaatggttgatgtgacatgtagtacttcaaaatgacaactattttgggacaatttttaaatgctagaaagacaagtattatgggacggaggaagtatttatttacatggatacataagaggaaaaggcctcagtgtccctatccttatgatatgcctatgcgacttaccggtgggcccaccttggtcctagcggtaatttgacagaggacaggagtgctgcccccagcatgggggcaccgctgtttccgagcgacctcgctattacccgggtaaaggcatcccctgggtaatagcgtgctccgcttggcagccatcaacagtgtcagagttagttggggcgcgtagtacgcatttattcacgtccactagcgcctggttcttggcttgtcttgtgagagcacatgagatatgatccgctccggccggcatatcgggctttaggggcccctcggagctcccacgccctaaggtagcctccggagctctccttccagactttgggaacccctctgggcttcggagcccagtcacctttggtggtaccggagcccatggtgctatgacctcccggagctttcccggagccgggcggccatcatccggagcctgcttaggtcctgctcctctcgcactgtgggatccgaatcggatccccgaggcttccggagtgaggggccatctgcagaccgacatggccatgactcacggtcatctcccggggaggatggttctccggagcgctgcagcccttcggaggctagcttcctttgatccggagatactcccccaataattaacatgtgggtttcacttttttacggctcacatggcagtgacttaacagcataataattaagttagatgatccctttccatgtcagcctattgttgagccttgacaactcatttatagttgatcgagctacaatattctatatcttttaattttcacgatcacattaaagcttggcctgtcaatatattaggatcgagaagatgccatgaaatcccatatcattttcatctttggacacgtctgagtgggcaaccaccagacaagtatctcattgcttaaacagttggctgcagctacaaaatcttcccatagattcaaggtccggccataacaaaaagtaaagtggatatagtgtacgtatcatccagcccagattttcttccttaaaaaaagagagaaaaaaattagtccgttctactgcaacctttgcaacgacaaagtcaggtcgtcagatcgagtaactaattaatcatgcaaatatccactgatctaaaacttcgccatcagttgatcccttcacggtttcgactagcctgcgtccgcccacaaatatagcgaaggaatcacacattgtttttttttttttgatgcgtcacacattgttaatttggactttaaatgacatgacatgacatggttacaaaactaacacacgttcatgcgtgcatattacttacagaataatccaagttggcatcaatgggttaatattctgcaactcctgcattagaatatgatagtgtattagtgtgcggcgacgtttatgccctggctcgcaattacatccaaactgatcacaattatatattgattggttctacaaaagctgcttgaggtgttccatttctccttgagttgcagctagctctagcgatcaagggcgacgtcaatgcatgactcctactgaaggttaagttagtttctttccggtgtgctagttgctgggcgattcggtgtgctgcctgtgaaagagaggccaggttgacgagagaatgcactgaactgatggcaaccaatgtggtggtacaatcatctgctgtcgttggtacccaacaccggccggtcgtgtcagcagtggacagtggtggctgctgcgacaattggctacgcaacagccagtcattgcctcgagtttatccataaccctgcaggatattttgatccatgcatgcaggagcaggaagtgatcttcttccccatccagaatccagatgatgatgatgatccttcagaagaagaggaagaagaatctagctagatgatgagatgttggttactttagctagtttagcatgcatgcatgtatatgttccattgaaatcgatcagttgagaattgtcctgaacaatattgtagaagttttgataaattacgcggcatgatcgaattaggcaccccatgatgatgaagatttcgcgaacacgttaaaaggattacacgtcaatgtattagaacatgatgataagatgaaaagtgtctgcattggatcggatcggatcaccaaatatcttcaagattcaccacctctggccggctcgatcgaccatatgcatgtacaaccgtcacccagaacactggcgcaaggttgcagacaaacacgtgcacatcatcaatggattgttccatatatgtgcatcatctccggcctgatgctggccaacgccgcaggctcgcagctagcattgttcaggttgggatcaatgtcgtttgtgacaaaaagacaccggttacagtgccagtagatggcatagcaatatagcatagtgccatgcagcaagtggtnnnnnnnnnnnnnnnnnnnnnnnnnnnnnnnnnnnnnnnnnnnnnnnnnnnnnnnnnnnnnnnnnggggatcgactagttctacaacggccgccac

SEQ ID NO: 45459 - DNA, 18058 bp, Oryza sativa
atctgtttttgtttaatcgtttggtcttaaggtggttggacggttagcatcttcctcctcaagctgagatttgggaggggtcgttaccggcggggtcccggatgcgacgacagtgggaagtcgaaccctgtgcatggcggtgctctaggacaggcggctgcgtcaggaccgaagtggttttcggcggcgtcgtggataggaggtgaggcgggcagctccgaagctcggcggtcaggcataaaccggtgcggcgcagcaggtgtgcggcggcgcgcttgggccgagagaaaggagaacgaagggagttaggaggccgtagaaaaaggaagaggaaggggaaaaggagagagaagaggagagaggaagaagaaaggatgaagatgatgacatgtggggcccacatgtcggtgggtcccactattttttttaagtgtgaatcacatgttggtcccacgtatttttgttttttttattctaaaatgccacatatgtgacatgtcaacgacacgtaggacggagaccgggtcaacactgccacgtaagcgccacgtaagccaaaaccgcttccaaaaccatctcagatatattttgcaccggttttgatagttggaggagtcgatatacccggttttgtggttggaggttatgaatcatactcgtgccatagttaagggagtcaaattatactttttcctttcacaaacccaaggctgcggcccgcgatcggcggtttatcctgtcctttgatctgcgtgtcctggttcatcgtctgtgacaccgttcacacacacgaataatcccgcgttaattactaccttacgttgacttggtatcaaaagaagaaaagttcgaggaaacaatagtgcgatgttgttatttgtttttagaagtatatgaaaattaatactctatacgcttcgctgattcacacacacagggacatgggttttagcacgtatatactccctccgtccctaaatgtttgacgccattgacttttttaaacatgtttaaccgtttattttattaaaaaaaacttttatgaaatatgtaaatatatatatatatatacataaaagtatatttaacaatgaatcaaatgataggaaaaaaaattaataaatacttaaattttttgaataatacgaacggtcaaacatgtttaaaaaagttaacggcgctaaatatttagggatggaaggagtatatgataatatatgctctcttcatagctgcacgggggctttgtggcacgtgttacattgaagcggattcatgattcacacacatgtgcatgaaccgcatgtgcactagtagcttcatttctaaatgaaggagaacttataaattaaccaacaaatataactagatcagaacgtcctgcatgacttagctacatgctgattgagtaaacaattagctatttagcaaccaccggctaattaatcaaacaccaattgacagctcccctcggtctctacgactctaccagtccatctagctagccgtactattttgggcaactgaattaattcaatcacgtgcgaaaaaacaacttaaccaaacttatgtccacgccgaattaatcgaaccgatcacgtggtgatatgcataaattagcaattaaaactgagggaacaacataaaaaccaccaacccacatctcctaactccccaatggagattacattgaccggtccaataatccaagcagcgtaacagtttttctctctctctcttttttttttaaaaaaaaattcgagttgaaaacttgaaatggacagcacgcagttctcattaaattttgctgtttcgaacaaaatcgtaatgtagatagatcgggtcagtacaataatgcaaatctgctaactaattacgcacgtacggactacggagtacctggtatgacgtaacaacgccaagcgcgtcggtgatcgatgtacctagcttaattgcacatagatgaattcctgataatgtgacaattaattgacggtgcatattaattcacatttatattttttttcaattcaattacacggatcatacatcgatcccaagcaaactcctaaaactatacctgtactctccaataataaccgaattcaaattcatcgctaaatttgttcagatcaaaatgaattagttgctgccaaattaaacaagaggagcagctagcaatctgatcaaatgaacaaatcaagcggcaatcaagaacggaaattttgagcttaattaattacaaggctttctgatcgatcgatcagcttagctagcttgctcctcggtccaggccgagcagcctcgccgccaccggcgacagccgcccggggctcaccgccgccacgacgatcctcctggcgcccttgcgctccttgatcgtctccagcctcggcgaccacgcgcggcacctcgccgcgcccaccagctgctcgtagtgcttcctcagctccggcgtgctgcacagctgcgccccgccgccgccgccgccgccctccaccacctcgtcgccggcggcggcgcaggcgcctattggtctcgaggaggtgatggatctcacgatgaactccggcgtgaccttgatgaccgtccggccgtcgtcgcccttgacgtactcgaaggggctcttggcgccgccggcgatggacgtcgccccggcggcgccggcgccggcgccgcccctgtcgtaggagagcgcggccagcgaggcggccgtgacggcgtcgtagccctgcgggaggcggtcgacggggagcacgaggtaggtcctcccggcgacgaggcggtcctcgatcgccagcaccggcgccgggcggccgatgcagaacccgtcggcgcggcacacgacgctgtccgtgaagtcgagcatcacctgcccggccatcttcccgtgcctcgccgcccgcacctcgcctccccacagcaccagcctcaccgtccgccgccgccgcgacaacatcccgaagcacgccaccatcctctgcaccagccgccgccgccgccgctgctggcatcggtagccatcatcatcggccatggcaagcaaagcagaaataatccaaagtacaaaaaatgaagaaataaccttgctagggtttactggtctcgcggcgctgagcaagagaggtattaatatgcattggaatgatcgggtacacccaccagaaggggtaggtttttgtcgacgtgcgcgtgtcgcgcgccattggaagtaaggcaaggttgctaggtagttctcccctgtttcagattataagatattttgattttagttaaagtcaaattattttaagtttgataaaatttatagacaaatataataatatttataatactaaattagttttatcaaatcaataattaaatatattttcacaataaatttatctttagttaaaaatattgctattttttttttacaaatttaattaaatttaaagtcaaaacgtcttatatcttgaaatgaaatgaagtaagctagcttagctatgtggctagatgaacgcgcgcgtcgccgccacgtcggcggtcaaagtcgacggcgaattcgatcgatcgcgcctcgcgcgcgtggcgtccgcgtcatcatcgatcacggcagcaggagtagcagcagcagcagcatccagcgtgtggatgcgttgctgcgtgtggtgtggatgggatcatgggaggagggggaaaaagtccaaggcaagccttttttaactagcagcgacggcacagcgacagcttcagactttcacaagttgagagatacgtatataagtaacactgtagcagttagccagaagacaaacacctttccgttactgagagggtacgtagtatgagtctatgagatatgaccgcatctgcatgtatatgtgggtaaggaagggtcaattggcctggtgcgagaaagtcgtgcgttggtaattaagagtttttttttaaaaaaatatagtactatatccctctcattttaagtgcatccatgattttccgtgtccaacattaatcgtccgtcttatttattttttttaaaaaaaaattaaaaacataagtcacgtataaaatactattcatattttatcatctaataacaacaaaaatactaattataaaaaaatttcaaacaagacagacgatcaaagttgggcacgaaaacttatagcttcacttataatgggacggagagaatataaagcagatgctcattcatctctattaatgaacaattgcatatcttatatctatgaacacctttaagagattggatcggtatatcttcagattgatgaaatcaccatatggtgtcttatcgtcgacggctaacaggtttagccataaatacgagcatcgatgtctaagtccaggtcctaactcgaatgggctgattccaccacaagaaacctaaccaattaaactactctcactttacagtaattaagaggttggtgccggcaaattaaaatggttattactaatgctacttaattaatgtacattctgttctctcaaagtaattatattatcggtactccgcctattgataaatgtatgccactgttaattttagataagtaaaattttaaaactctgaccatcctaactctcaaaatatttagtttgaaaacataaaatctatattttctttataagtatttttacaataacataattgtgttagatactatcatcacattcttatagaaagataatcactaaagtatatcaagatccaataaactcaataatatcatatagtagtattatttaaatatagagttttagtatattggatgtgtttaattcctgaaaaaaagttaaaagtttagggaaagttggtagtttgaaaaaaaagttaaaagtttatgtgtgtaggaaagttttagatgtgatgtgatgtgatggaaagttgaaagttgagggtgaacatggcctaaagacacccataagggctattaaggctgtgttctttacccctctttcccagctcacttctctcgttttccgcatgcacgcttttcaaactgctaaacgatgcatttttttaaaaagttttctatatgaaagttgctttaaaaaaatcatattgatccatttttcaagttttttaggctaatacttaattagtctcactataatcacgtgcttcgttttccgtgtcaggaggcaaggttcccaacctcgcctcccgaacacagcctaagtttgtgcatggctgcaccacagtcagcttgaacagtaccgttgcggccgcagcgcgcgtccgtctgccgaacaacaccatgagttaattgttcagtgcttgcctggcatagcttgtatggcaatgcagagagagtgtagaccatatgccaacaaatgcactctctccgtaacttataaattaatattatatctgggaatagtctatttctatataaaagataaaattatttggacgaatagagtacgtaaatgtatttgtagacgccgtacaggtatgggcattatgttgctagctagcccatcttctagcgaggcaattaccagtcaccacggcaagaccactactgggttggagctaacatgattattttggtaacaagattgtcaacactataaagtattggcattattcgcttggggttactcaatcaaaatcctggattataagacactctaaaatgatgtccattatttgcagggaagtactagacttattgaaatacagtttttttttattttggtagagaaaatatctgaaaatttagcccttctagcctaaatataaataaacgcgaaataatatctgaaaattataagaaaacaatgataccataaataaatatactatttctattaatgaagcaaaaaggagatttcatgttggatcgatcgacctaattaattaactatagcagaattcgtatatcgtgcacattaggaattagtaagtaatttcatgaataaatttactagtactgaaatgatacttttgaggagataaagggatttatttactaacaaattaacaatggtttccgacaggccggtaaacccatcacgtatatataattttacagatgtttacaattctgttgtgttttctggctaaaccattaattgtgcttgaatgtactatgtcttagcccaaatggcagaatttaacaacgtcctatctatagaaaatattaccagctaatcaattcagctccagcaattcaattagcttggcaaccattaaatattaggacgagtggtatatattactcagctaataattaatattcttaattaaaattccatatcattatagtaggatccgagtagctagggaactatactttgattttttcctccatctttatttacccatgcatattaatgtcctatccaccggctagtatttgttttccataaaaccatacaaagcattaaaaaattattattgaacctctgtcagatctagaattttaatgcttttgcatgatataattaattaatgcatgatatacaagggcgtggggagggatcgagatctacatatgccagtatgccacttctgtacatgtgcattaatagttgattaattgtacagtcacacacgatgttaaaatacttgaaaaatgagttaatttaacacgaacaaactataggctcaaccgtaaaattaatgatatgaaaaatataatttgagctgggattttgtcgaaaataatagtagcttgtgctttaattaagcaaatccaaaaataacatactccctctataaaaaaaattaattctaaagataaatctgaacatgttcagattatatatttggaattagattatttctttttacaaaaagagggagtactccatacgactatatgagcgctaagtctaattcaatttgtagagccagagcattaattaaatagaccagtcaacgctgattattcgtcacaccaattactcattttcgtaattccaataattagcacatgtatagttgggttaaacatcacggtcagtgacgttacgaaatattgctgaaaaggtgcacctctagcgtcattaaaagaacagattgcggctctggtacctgaccgatcgagttctcttccagtggttagagagaacatgttaattaagactgcgaacaaatttgaaaggtggggggggggggggataattagggttttgcgctcatgaggatgaacgcgagtaataaatatataatgcggtgggatttgagatttcggagacttatcctattattttgagatgaaatagtatatgatctacaaaattagagtaaacatgatgcactccctaaaaaaaaacatggtgcacgtagagaagcttatgaaatacttcattcgtttcaagttataagacgttttaactttgatcaaaatcaaacagctttaagtttgattaagtttatagaaaaaaagtaacattttcaacccaagataaatttattatgaaaatacattcaattattgatttgatgacactaatttagtcaggggcggtgtcggtaacatgggaccgggagtatcatgacttagagacttgaggcagacacgatcacccacgtggcctaaccccctcgggagggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccgcatttattgcggtttggacgagcgcgtcacgccacatgtagcgcagtatggcacgctcgtttatccggtctgtgaccggtcacagatcggtcagattgcgggttaggaggcaacaggcgatctgacacacgcctcgccccgtcccgtcaggatgagagtctctaggcactcgtccctagccggagccagcgtgctagctcctggagatggcacgttggtcctggtcagatatatgccaggctttatcccaaccattataagcaaaacgttgtatgaagaagggcgaacatgcagattgctaaactgacacgtggtggacaaaggtgaccggtctgtgactggtctgacactggttatgtcgccggaagacaaccgtgttcccacgttgcacctgcttccggcggagtggaggtagatatgggccgtcccatcagaagggtcactcgggcagcagccgttgcaaatctccgcccatttatgaagagatgacagggtgatctccgaggtcagacgaacgaggacgcgtggccacactcaaaaacaggcagtgtttcagcttccaagagaaggcaagccaagttttactatagataggatgggcccccacccaaaaagagagagagggagaagtggtgcatgtggtatccccttgagatataaaaggaggaccttgcccacttaagagggggggttggaaggggggaggatctagagaggagatcccacgagagaaaaaaaaaagagaagagggtttttagaataagagctctctggctctccagctctttgtagcttcttcatacacagatccaccagaacacaggagtaggctattacgcttctcagcggcccgaacctgtatacatcgcccgtgtcttgtgctttttccattctcgcgaactttccacagactaggagcttagaatctcacccagggcccccggccgaaccggcaaaggggggcctgcgtggtctcccggtgaggagccccacgctccgtcatctggcgcgccaggtaggggggtctgcgtgtgtttttctaagctctcgcattctttcgtgtgcgccaagcttttcctgttcagcccaatggccgaacaagcaaaggcgcacaacctctctccgagtgttagcggtgacgacggggagccgaacccacgccgtcgagctcgtactccaccgcccctccacgccaaagtcctaggcgggaggaggcgctcgagagggtcgaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcccattgtccctgacccggagtctccagcccaacgttggctggacgacgtggccaacttggtcatgacggcgcggcagcgcctaaatgctggtgggcggtcctccgccaccaagacctctggtactgctaccaccggctccgcgtcgtcaagacggagggcgcggcgagcggcggccgctgttcgccattcggccgccactccttcgtcagcgcctccgacccgggaagatctgcgtggggagccggatgcccgcatcagtatcgagcgccggcgtaatggccgacgtgctgcccacgcaacggagggcgcctcctcgtccggagtgtcacctcaacacggacgcggggatcagccctccgtgcccccggttggtggtgtcggctgtagagcctttgtggtgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcgcggggttggctaatgaacttgccacccgcgtccgtccactcttgggaggacttgtgccaacagttcaccatgaactttcaaggcacatatccgcgtccaggtgaggaagcggacttgcacgcagtacagcgaagggatgatgagtcacttcgctcatacattcagcggttctgtcaagtccgcaacaccataccatgcatccctgcacacgcggtgatctacgcgtttagggggggtgtgcggcacaaccgcatgctcgaaaagatcgcctccaaggagccccagactaccgcggagctttttcagctcgcggaccgagtggctcgtaaggaggagtcatggacctggaacccctccggttccggtgtggcagcttcggccgcccccggatccgctgctcggacagggcggcgtgacaggaggaggaagaaaaggtcagcccattccgacgacgagggtcatgtcctcgccgtcgagggtgcttcacgggccacccgaaaggggaggcctgcgagcgacaaaaaggaggccagcgctcccagcagggagcgcccaaccggcaagtggtgcaccgtccacaacacctcccttcacgacctcgcggactgccgtgcagtcaaaagtttggctgagcggacgaggaagtgggaggaggagaggaggcaggagcgccgagagggcaagtccccggcggttccttccggcaatcggcgaagagaggccaaacagaaggcccccgccgaggacatcgatgacggcgatgatgacctgggtttccaagagcctggggccaccattgccactgtcgatgggggagcgtgtgctcacgtttctcgccggagcctcaaggcgatgaagcgagagcttctggccgcggcccctactcatgaggcgatgcgccgggcgcggtggtcggaggttgccctcaccttcgaccagaccgaccacccaccgtgcattgcccggggaggacaggtcgcaatggtggtttcccccactgtttgcaacgtgaagctggggcgtgtcctcattgatgggggagcagccctcaacatcctttcccccgcagcctttgacgccatcaaggcctcggggatggtgctccggccgtcccagccgattatcggtgtgacgccggggcacacttggccgctaggtcatatcgacctcccggtcaccttcggtggatgcgccaacttccgcacggaacgggtgaactttgatgtggcggacctcagtctgccctacaacgcggtcctagggaggcccgcgttggtgaagttcatggcggcggtccattacgtctacctccagatgaagatgccgggccccggtggccccatctctgtccatagcgacctcaaagtcgcgctcgcttgtatggagcagcgcgcggaccacctcgccgctgcgtccaagcccgagggtggcgacgagaggcttggcacctccgtccccgccgccccgaggcagcggatagtcacgtgcgacgaggtcccggtcaaggaggttgccctgggcgacggcccgtccaagaccacacgaatcggtggtcttctggatggcaaataggaagacgcgctcgtctccttcctgcgagcaaacgctgacgtcttcgcatggagaccggcggatatgcccggggtccccagggaggtgattgagcaccgtctcgccgtgcggccgggcgcaaagccggtccggcagaaagtgcgccggcaggccccggaacgtcaagctttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttacccccttcctcgcatagatcagattgtcgactccacagcggggtgcgaccttttgtgttttctagatgcatactctggttaccatcagattcgcatggctagggaggatgaggaaaaaactacgttcattacccccataggaacttattgttatacgacaatgccattcgggttaaagaatgcaggtcctacttttcaacgtactactcgaatttctttgggtagccaaataggacgtaatgttgaggcttatgtcgatgacttggttgtgaagacccgcgaccgagaaactttactttcagatctggcggaaactttcgagagtctccgctccacctgcataaagctgaaccccgataagtgcgtgttcggtgtacctgcgggcaagcttctcgggttcttggtctctgcccgaggcattgaggccaaccccgagaagatacgagctatagaacggatgcgcccccccagcaagcttagggatgtgcaatgcgtcaccggttgcatggccgccctaagtcggttcatatcgaggctgggagagaaggcgctacccttatttaagctcctcaaacgcttcgggccgtttacctggacggaggaagctgaacgtgccctcgctcagttgaaggcgtatcttagctctcccctagttctggtcgccccggagccaggtgaacccttgctactctacttagcggcgaccccgcaggtagttagtgcggcgttagttgtggagcgcgatgaggacaaccctcattccgcgaatccccaccctgtgttggcttggcccgggagagagcagggaggagaggctcccgagccgaacggtggcccaaggcccccgacgaccggagctggccctctgcccgcttgtcagacggtgccaggtgcccccgacccccaggatggcccgggggccactgcgggaaggccgcacctatcgccctctgaccccgaggttaaccctgtgccgactcgacccgggagagagcagggagaagaggcccccgagccgaacggtggcctaaggctcccgatgaccggggttgaccctttgcccgcttgtccgacgacgccaggagcccccgacccccaggacggccctgaggccactgtgggaaggccgcacctgtcgtcctccgaccccgaggtcgtcagcacagaagacaagtgcgccccgcgaggccgcttggacgaagagcgccccagggatgcggcccctggcgaagaggatcggccccatcgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcgcccaaatcttgcataatcgagagggtacaggacgggtggtgaaatggacaattgaactttctgagttcgatttgcactttgaaccacgtcacgctatcaagagccaggccctcgccgattttgtggcagagtggaccccggctcccgagcccgtctcagtccccgaggccagctcgggcccctcgcagctgcctcacaccgcccactgggtgaagcagttcgacggctccctgtctcttcagggcgccggtgcgggggtcatattgacctcgccgagcggagacgtccttagatacctggttcgccttgactttcgggcgaccaataatatggcagagtacgagggactccttgcgggactcagggtggcagctggactggggatccgccgcctcctggtgttaggcgactcccagctaggttaaccaggtctgtaaggaataccggtgctctgacccgcagatggatgcttacgtacgccaagtacagcgtatggagcgccatttcgacgggatagagcttcggcacgtgcccagacgggataacacgattgccgacgaactctcacggctcgcttcctcgcgagcccagaccccaccgggcgcctttgaagaaaggcttgcccagccgtcggcgcgacctgaccccttaggggagacggacgcgcctgaccggcccccgaggcccgtcggagtccaggcctcgggacccgaggggagcgctcccagctcccttagattgattgcttggatcgttgagatccaagcatacctcacagataagactctacccgaggaccgcgaaggaagtgaacgcgtccagcgcatctccaaacgctacgtgctgatagaagggaccctctatcggcgcgcggctaacggaatcctcctgaagtgcattcctcgggaacaaggcgtcgagcttcttgctgatatccatgaaggcgaatgcggagcccactccgcctcgcgcaccttggttggcaaagcctttcgtcaaggtttctattggccaacagctctcaatgatgcggtcgacctggtccggcgatgcagagcgtgtcagttccatgccaagcaaatccatcagccggcccaggcactgcagatcataccactttcatggccgtttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggggtgcctaaccgtattattacggataacggcacccaattcactagtgagcttttcggtgactactgcgaagacatgggcattaaactctgcttcgcctcacccgcccaccccagaagcaatggccaagtggagcgcgccaatgcggaaatcctcaaaggccttaaaaccaagaccttcaacatcctcaagaagcacggcgattcgtggatcgaggagttgccagcagtgctctgggcaaaccgaaccacaccaagccgagcaaccggggaaacgcctttcttcctcgtctacggcgcggaggcggttctcccatccgagctcaccctgaagtcccctcgggccaccatgtactgcgaggttgatcaagatcagcttcgcagagatgacctcgactacttggaagagcgaaggcggcgcgcggccctccgagccgcacgctaccagcagagcctgcggcgctaccatcagcgccacgtccgggcacgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaatggagttcgggtgtcaggtttcgggctcgggccaaccccgcacccccttcaggcgtgcagggttggccgggggctaccacatatgcatattttttcttctatctgtatttcaataaaagcattttcgatttcctaaaggctgtatctgtgctgttgtttccttttgaagaatcttgacttgaaataggtcacttgtgctcaatcctgccctcgggggctcgggtcggctaaaatcgtcaaaaggggcccagaaccgagccgtgccccggggcgtggtgaactccgggggggaatcggcaaaaacccacaatcgggtcacccataaccctcggtcaccacgctcccggcctggccagtctcgacacgtggatctccccaggcactagccccgacccgcgccttttgaggactgggacctgggcacgagcccttaatcaagttaagacataaaaggaccacggcacagatcatcctcatctcatacacatagcaaaatgaaattgacacataaatttctttattttgattgcagattaagttaatctatacaaaaaggaggcccgaaggccttggaagaaagaaaagaagaaaaaactgaggattggcgggggcctgggggctcactccgatgcacccgggtcgccagcctcgtcgccactgtcgcccacaccgccgtcatcgccctcctcgtcggagttgagggcgaacgcgagccgaggggccgaaccctcgaagctgtggacgatatggtcggcggcatcccggacctgcgcgcgcgcgccgtcctcggtcccgggagggaactcgtccagcgccgtccatggggagaagtcggggtccctggcctggtaactcgccagtacgagctccaccgctcctcgggcgaggtccctcgaggatgacttaatcgtcccctcgagctcctcggggagccgctggagagtcccggccatctccgagaggcgctgggcgaggcccccttggttggcggcgtacttcacagtccgcccgccccagagactcgcctgccgcccggcgcggtctaaacgggacacggcgtcgcgaagcatgctgggccctatctcgcctgccaggcgaagggcctcgacctccccggtggacgaatccagcgcgccctgcagatccgcgatggtgtgttcggcagctgcgaggcgggcggctaagtcgctgtcgcccgtggccgccccgccgctacgcgcccttgcatccagcttccttgcctgcgcctcgagttcagcggcccgctggttcagtgcggccctctcggcgcgggcactttccagattgcgacgcgcttgttcctcttgcgcagcttcgcggagggacgcgctctccgctagcctctgtgctgcggcctcggcctcctcgagggctcgctcccgctcggtgagcgtatcctcgcggaggcggagtgcggactcttcttcggcacaggcggcttcgtgcaccgccagtgtgacctcccgaatagcaacggcggcctcgcggtccgccaggtccctctccacgacgcaggcacgctattccagcgccatggcacgggcctcaagggtttcttcgcgccgccgggatgccacctcggtctccgccgcccgccgttctcgggcagcggcagcgtcaaggaccccccgggcggcgtcgagcttcttccctagctccgcctcccagctcccgtattgaaggcggaggtcgtcctgcgcctcgttcatcacggtagtggcgatgagggcagcccccctctcctcctccacctccctggcgatctcccccagcatcttccgacgggcttcgagctctgagacgtgccggcggtgtgccttgcggcccacctccaccatggcctccaccgagcgacgcccctcttcgacacgtgcccatgcggcgtcgagctccacccgctctgcttgcaaggcctccatctgggcacttaacccgtccaacaccgtggtgttagcgacggccaaggcctgcagaagaggctctgcgctcagtggggcagcggaaggcgtgggggagagccgcctcggtgaggatgtcgcgcggctcggcccgccgatggacgtgccggattcagggatgtcccccggacctggcttgtcctgagcgtcgcccgagggagtgggcccaagcgatgcgcccgcggcctcgtcgcgagctgcctcggaagtcgtcgccgcctcggcctggcgaagtctggcctcctcccgagcggcttcttcagcttggcgagttcggacggccacctgggcggcctcctcggcttcccgtaggcgatccgcggcttctcgccggtcagattcccgcctccgagcctccgtggtcgccgcattctcggcctcagattggccggacttgaattggcaagaaggacgcgacgggatctcgctgaagcagaagaaaagccagaagacaaacaagatgggtgaatgaaaacttgtgttggaagaatgaatacagccacaatgggcgtgggacgaacctgcgagggggtcggttaaacgaccaccttggaggggaaatgaggtttccccgggatggttctgtcccccccatcttgcggagccgtttcttcttccgctccccctcgggctgcggcgtcggcgcggccccctccgggcgcctgctgctgacacgcgccgccccgccccctcggggaggagatggggaggaagtaccctcttgcttcctcttccctcgggcgtcggcagggcggctgccccccgagcccccatcacggggcccggaagcacaaccccctcctggggtagattgatctcccttgtggctcccgctcgcaccgtcatggcccttaggagctcgttcctctgaggccccgccgccattatgatggacaggatgttggcgcgatctggatcgctgcagagggggaggactccttgggggatgagggatgcctccgcggagctgagattcagcacccgttggatcattaccttgaagtcttcggggacccagtcccatttgaccccccggtgggtcctcatacagtcctcggacccggtgtactcccaggcgccccgggcgcgccgctggagtggcgcgat

SEQ ID NO: 45460 - DNA, 12682 bp, Oryza sativa
gacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgcagggcatccctcgcccagtgagactatctcccggccggtggcagattctggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtaggacacaggaaacaaggagttagggcgcaagcggcgaagacaaggggaataatggcgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatatcgtgcgcgcgttaattacgctcgccgaccaaagcgccatcaccatatctccaggaaaaacgaaccggcttgtcccgatttttagaccggccccacctgtcaccaggccttaggaagtggcgtcacgcccgaccgcttccctcgaggagggcaatcgccctggcataacgccgggggctactgtcggtgacatgggaccgggagtatcatgacttagagacttgaggcagacacgatcacccacgtggcctaaccccctcgggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccgcatttattgcggtttggacgagcgcgtcacgccacatgtagcgcagtatggcacgctcgtttatccggtctgtgaccggtcacagatcggtcagattgcgggttaggaggcaacaggcgatctgacacacgcctcgccccgtcccgtcaggatgagagtctctaggcactcgtccctagccggagccagcgtgctagctcctggagatggcacgttggtcctggtcagatatatgccaggctttatcccaaccattataagcaaaacgttgtatgaagaagggcgaacatgcagattgctaaactgacacgtggtggacaaaggtgaccggtctgtgactggtctgacactggttatgttgccggaagacaaccgtgttcccacgttgcacctgcttccggcggagtggaggtaggtatgggccgtcccatcagaagggtcactcgggcagcagccgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggcccccacccaaaaagagagagagggagaagtggtgcatgtggtatccccttgagatataaaaggaggaccttgcccacttaagaggggggttggaaggggggaggatctagagaggagatcccacgagagaaaaaaaaaggagaagagggtttttagaataagagctctctggctctccagctctttgtagcttcttcatacacagatccaccagaacacaggagtagggtattacgcttctcagcggcccgaacctgtatacatcgcccgtgtcttgtgctttttccattctcgcgaactttccacagactaggagcttagaatctcacccagggcccccggccgaatcggcaaaggggggcctgcgcggtctcccggtgaggagccccacgctccgtcaggcggatctactcattaggtggggtgggtcaaccctcaagaccccccttacccccttatagtagttatgggccatcaaatttagatataacaaggtgtgaacacccaacaaattgagggagttatgcgaatgaactattaatatgatatctgttgtgttcgaatgctcttatcgagtgaacatctccgttctccgccccatctatattttaaagctacgtccgtcactgaatttagtattataaatattactatatttgtctataaacttagtcaaacttaaaaacagtttaactttaaccaaagttaaaacgtcttataacctgaaacggaggaagtaaaataataatcaacaatgtcatatacgctcacgaggtaattagtacagtagttattttcgatgtatataaataaatatatcatgctgatgtagtttactgaaacatattttggacattgtcatcgtatcctttctctaagcagccagcttgaagttaaggagtgtctacggctatgttcttccccttcatttctagctcacatctctcttttttttttcttgcacacttttaacctgctaaatgatcttttttaagttttctaaaaaatatttgttttaataagcatattaatttatttttaatttttaattaatatttaattaatcatgtgttaatagataatacttttttgtgtggagaggtggagctcagactagatgtgtgtacccagaattttttttaaaagtaatatgattttaatggaaaatcgcaaaactataggtcagttaggcgaaatcgcaagtttagcaccctatcgaacaaccgtggttcgacaaggtacctatcgaacaaccacagttcgatagggtacctgtcgaactacggtagttcgacaggtgattaaaataattaaaaaaagagaaaaatcactgttgcacactgttcacaataccctatcgaactatggcagttcgatatgtgcctgcgagcactgtagcatcactgtagcgcgctgttcacgcaaccctatcgaactttggctgttcgatatgtccctgcctagtattgtagtgatactagtcatgtaattttttatttgtttttggaccacctaccctgttgaactcccgtagttcgacatgtacctgttgaactgtggttgttcgataggtatccctgtcgaaccgcggttgttcgatagggtgctaaacttgcgattttgcctaactgcctatagttttgcgattttccattaaaatcatattgctttttaaaaaaattctgtgtacccacgcttcaatatcatgtccatactacagagactgcagtgacgactgagtactctatttgtttttcttttcaggacatgtgattgctgatgtggacaccaagtcggccctcggaaaaggcgaagaaaaacgccaaactccgtttcatgcatgcatgacgccgagaaaaaacgtgcaaatatatatatatatatatatatatatatatatatatatatatatggactagtccgagagtagaaaatctcgtggcaaatactagtatgatttacatatataaacaaataataatccatccggatgagctagctacataggtcaagtcaattacttaaagtacagtgacaactactctatatcgcagcatctatgatcatatccatccatccctatagactaactaattaaagagtatatttaaatagctaacttaagatctttgttttggcatgatctaaattaagatgttagattcaaacagtgagtcgtcatctttagactttggagtgcctgttaaattcaatccggatatgtatatgaattcataatttagatcatgctggtggttttattcgtatagtctttgaaaagtctgacgagataggtacaggaaccaataattaaatagacaaacatgaagcatttagtccttgcgacaccggtaaccacatctacctctgtaccttgttcaacggccaccgtctgtatttatgcacaacctgagcttgttaattaatttgagtagttggtctaagcacggttctgccatgcaaattacgcagttatttactcgtctagtactgggtcggacaactaattaacacaccgtttaattttcatttaacgagattaccatatattggataaggatagaagtatgtgtatatatttataggggtgagtttacgtacgttatgtgttgagattataggcatataatgatttaatctattccataaataaatcatgatattacagatgaaaactagcatgaacgcatcattagatctacacatgtaaactacacagtataacatgaacagatcaaatatgcgcaacatattgaacacgtatcgaggtggcggaaagaccggctgctcggtcgaaacttttcgcaggcatctatgaaggcacgcagcacgcgagcgaagaggaagacaagccgtcgcggacgaacagggagcagtcgcgcaaagcgcttcccaaaaaactttattgccgccttctcccggtgcaggacgtcgaaggcagaggttccggagatctactctcccgatcgtaggtgcacgtcggcgagcgggatggagtaatctacgagcgacggcgcagcacagagtaggaggcaaaccctagattgatttcgcgtgtgttgcgtgaagacggcgggtcggtttatatagagaagggtcgcttgatcagggcgcccgcatgatctccactgcgcgtaaccgaaccggataagtcgcgcgtaacttatccggactccacgccgtttgcacgcaccggatttttcggaacgtttccaaaacaaaaacgaatccgaatttgcagcaaaataaaactgcaaaaggaggctgcatctgcgcaaggcgaggaaccaattttggcggaccattcgacgcgtacgtcgtgcacgcgcgcctaccaggccaggcgagcgagcgcgcgcgtgtgttccccctcttctctccaccacacatgcttcaagtggctagaagggcatcatcccttttaaggaggtccccctctcctagaataagcagggtggtactaaactccacatgcatgccattccatgaggtgggcttttgtgatttccaaagaattaatcttctagtgggctaaggcccattcattaattccaacattatgagtatcaggggcgaatctagaataaaactagagaggaaattcatctcctccttcaacccctactcttcctcctatctctctttttctttcgactctctctccttttatcaatgatgatctagtgggcacggaggactcaagtccctctggcacacccatgctggatctatcctgagcacataagtaataccattttctatcttttgaaaaaaaaaacaagctggtatataccatcatctttgtccaaaaaaattagtactgcagctgtaaccgtcagatcgagggctaaacgatcgcaagccgtccgatccgaaggatggatccgttcatcagctaggttacgttagcctctggtgcaccagtcgttgcagttgtcggacctgcagcgctggtagcatccgccccactggaagaggctgttgacgaggcacttcacccggcacgtcgcctcgcagatctggcagtcgatgctgctcgccagcttgctccgcccgcctccgcctccgtctgcgccacggtcgcggtcgccgccgccgtccctcgcgcgcccggtgccgttgttgttgccgccgccgcctctcgcgcggccggccgtgccgttgttgttgccgccgccgccgccgccgccacccgcctggtcgatcgccgcggcctgatcgtcgccctccggctctggcgcctgccccgccaccacgacgaccgctaccagcagcagcagcagcacgcagatggctctggcggccgccgcggcagacgtcgccgtcgccgtcgtcgatgccggcgccatcgatcgatcggtgcggccgcggcgcggcgttcgaagtcgatcgttgtgcacgcgcgcgcgcgcgcgtggggggacgagacgatactggcggcgccttttgtacaggccgcggcgtggcgcgagcggcgaggaggggatgggggatttgtacgagcgcgcgtggactctctcgggtgttttgtgcgtgggcgggcgggtgggcggggaggcgttggtgcacggtggttgggtcatgcatgcatggtggtttctgctgccaattgccatcacgggtgtgcagtgcacgagacgatgaaattgagcctcgattcgatgggctgcgacgtccgaccgatgggccgggaggagcttagctagcccacaaggaaagagacgttttggtccgggtaatgtatagcccatgaggcaacggcacgcatgaaagccgcccggccgtcacgccgatccacgtacttcagtacgacttcactgcatgcgcgtgttgacatggtacagcaacgacgacgatgggcggcgctactagtgtatcagccgaacccgtaccttacggcttacttcctccgttcctccgtcccaaaatgtaaggatttttgagattggcataggtattaagaaagtaggtgagaataattgaagaaggtgtgtgattggttgaaaagagaaagtaggtgaaaaagaatggatgtgattggttgagaggagaaggtaggtagaaaaatagcttcattttaggataaagtactgtgctagaaatagctacattttgagacggaggtagtacgtgcgtgcattaacctgatcgagtaccggacatcgatccgatattttatgaccggcctgaccataggccatttgtcttaaaaaaaatcaacccatatttccctactagaagactgatttctttcagacgggaaaaaaagatttttataggcggccattagccccgcttgcacttcaaaacctgcaaaaatagacgatttttgcatccgatcgttatccccgcctgcaaaaagtcactttcgtaggctgctacatccactcgcctgcaaaaaacaatctcacggaacaaaaagaatcccccgctgccacccttcccccctccagccaccggttctccttctccgtcccccgctgctgccctccccctctgacctccggctcttttcctccatccgccgccaccacccgatgggagcgttgcctctgccgctaccgccggccggctccctggctcccctcctccggttggatctgggaaggaggggagagccgactccgccgccaccgtcggcttccctctttcagccaaatctgtgcgggagggagggaggggggaggggagggggagcatcgcctccaccgtcgctgacggctcccctcttccggtcggatctgggagggaggggaggggcctgcgtcgttgctcctccggccaaatctaggagagagggaggggagtgcagctagcctccatctccaccgccactgccaccggcaccgctttcctcctccggccggttctaggagcggggagagagggaggaggggagcgctgcctacgtgccgccggttgctgtggctgcggccctctcctcctccagtcggatctaggagggaggggaggagaggagaggggcaccgccaccgctttcctcctccggccggttctaggagcggggagagagggaggaggggagcgctgcctatgcgccgccggttgctgtggccgccgccctctcctcctccagtcggatctaggagggaggggaggagaggagaggggcgccgcctccgcctactattgatgcccgactggatggaggaggtgaggagaggtagtgaggtgagggagtgaagggagaggtgggtggagggggaggacttagtgggtgggaggtgggtagctagcaatggtgcaacctaacaggccgcacctagctactcccatcatctcagaatataattaatataaaaatctaaaaccatatagaacattatgtacagattcgtagttcgtagtattagaaaatgttccatttgatcctaagtttttatatttttttgggacggagggagtagtatgtagtagcatgccatgttcaattgcaatggcatgaatgacgctgcgcattttttcaggggcgtagccaaggggtagtctcggtgggctcgatactaccccagaatttggctcggagacccaccccccctcccccaatcccccaaaaattaggcccaaattgtctgtttcgcccaaatccaattgtaattgtggaggggaaaacgacaaaggcctgctccataagcatgcctccctagcctcgggcatccttccccagatcatgccaacgccgatcagctgcatcgcgccaacgccagtcagggttgacccagccctgtgctgctctgacgtggacacgacgaggaggccggcacgagacgacgacccgatgcttctggagctggcaacggctactgttgtgctatcaatgagggagatgcctgcgtatgccctaggtctcaccttcttggatgggtcgtttgatgggccattcttgtcgcctgatgggccgcttgggcttatcatgcttgggcaagtcggggttcccgtggaggcataggtacggcccaagaggacctagtgttgttcgctacactgcagtcattgctcgtggtagcgacgtcgtcgcttcggtgctaaagagagtgcaagaaggttctggtagcaagctgctagaccaagagtctcgaaggggggtatcttcggtcccggtttcactgcgagctcaagtccgtatcatcaaggatatggggattttgcaacaaggagagctggtgggcaatgatgtggttgctgatcagtacatcaagcactttgaggctcctctgccgatggttgtggtgaagggaatcgggcactcgccaggatggatggaggcacgcctctgccacctgatgtggcaggggagaccgatggcacgcagccagagtggtctgattttcttgcttgcattcgaatgtggcggctccctgcttagtgctaatgtacccttgactctctgtatcgtttatggtcctacataccccctaccagatattagtgctgtcggtgttgatgtttggatgcttagcatgtccaatgatgcctagtcttcagctaggctttagtagttcatgatggttcgtgcacgacaggagtagttattttgggaaaattgtaaggaactacaccaccccatatgtattgtgtaaggtggtatctcttgttttaatgaattgccattggagaatgttcgatgttcttgtgatcatgcataggagatacatgttgtttcagaaatgatggatggcttaaaaatcttaaattggaatgtcagggggctcaacaacccagaaaaaaagcaggcctaaaacgtgattgggacgcgcgtggctgatcactaaatagcaattttgcccatacgatggtcgtgactccaagcgtacctcacgctggccggtatccacaactgtgcctcgcttggctcaactcgtgcttcacttgtgggcgtggctcccagaaccagaaccacaagcagaaaagccgagccaattggtactccgattctccctacaacgccgccgcctcgatctaccgatctccctccctcattagtcgtcgccactgatttgccctttggtggacccttagcactattaagacaatggccaaagtaatgcatgaggtcttcgaaccaatgctgtatggtgggattcagtaccattgtcttcatcatcatcaggaccgaagtcgtcccgctggacacgatggatagcatgcagtcatgcaataaccatctcagccatggcactccttgccatggtcgttggactggcctgccccgcaccaattgcctaatgggactcctttggacgccgcttccccgataaccattgttgcccaagaccgacatccctcacagtgattccgaccagcatgtgtagcccaccgcttttctgctaaccgtggactacaaccgggcaccttgctcatcgagattagtttgatatgttagaatagctagcttgctccacctttgtactcggtgtgatacatctcaaatgtatatatattcaccttctcaggagtctaaaccaatataaaaaccattgtccttatctctttattccaaactcgtgcatacattcgtatcagccgtaccataaaataccattatcgggcataccccgtcaacaagcacaccctttgtcccaaaaacacttgatctctagccccttacatatatcctagttcacaaatcgaaaagtacttatttagttttatcccttcaattctacttacctacccatctaacaatgctcgtattaatgatgatactttagttttttcctctatacttagtttgttttgaaattgctagtataaattaactccttctcggagggagatagtactaaattaattctaccacgataatataataaaagaataattccgttattttcgttgtctgtacttgtaaggggccatatttacttatccattgaggcacttcaggcttgtactactagtaagggcatgtttacatgcttacgcgctacattgatcctcagatcaaaaagttgccagcacgatttatggcaacagggtgatttaattaatcacttaattggtgacactttgccgcaggacactgagaggaaggagagacaatgcatacgctaatacacatgcgtatagtactcccttcaagattgattattttttaggatggagggagtaaagcaaatacgaaatcagctatagaggtgggccgggaagatgcaggccatgcagaatatcagggcccatcaggatcacctaggaataaggtggggcccatacgaccagccaagtaatggtgacacggcagcgcagtgtcagcttaattgtactactaactagccggtgtccttgtctgacaggccgacactataacggggacaacacggagacagtggatggatcttggaaatggacagccacaacggggctcgattatagactgcatgcaattagccgtagaccgtagttaagtcaggtggtacttggattcagtaacttaatttattctctgacactaatttagagtattaaatatagactatttataaaactaattacataaatgaaagctaattcgcgaggtaaattttttaagcctaattaattcataattagataatgtttattgcagtatcacatagactaatcatagattaattaggcttaataaattcgtctcgcgaattagtccaagattatagaagggttttattaatagtctacgtttaatatttataattagtgtccaaacatccgatgtgatagggacttaaaaagttatctcatctaaacagggtctcaataagctactgtctactgtgatcttgtatgatcttagtataatacttcctccatttcataatgtaagactttctagtattacccacattcatataaatattaatgaatttagacatatatgtatgtttagattcattaacatttatataaatatggataatgttagaaagtcttacattatggagcggatggagtaactcttaatgctgttaattatcatatctttgtatttagttggttcggttctactgcattagacattttccatctatgctgactgagcagctgagctagcgtggagcccgtctggcatggcttcacctttagctccatcttttcgctcaaccagaaaaagtgaatttgattagagtgttctcctaaagtaaactagatatatagctaaatttatatagtttcacaactttactctagacctaatttttaaagttaaatttagaagttagagtactaccaaacatgtccttaatagttacttcctccgtttcataatgtaagtcacttatatatattctatttacattataattacaagttaattatacgttgtaattacattgcagtcgtattatagttacatttaacagagttttaagcgggtttctatcgaatgttatataaaatgtcccaataaatatcagggactaacttaagaagtttcaggccttctcatttcagcaagtatggattcatttggggctcgtttggttacctgcatgttgcatggctcgcatccgcgcgtgcagtggagggatgtttggatacctgccatagcctccagggcttggctcatcgcatacaaaatcaccttcccaaccaggccaaagggaaacgcccgaatcgagcttccctcctcgtcggagtggagcgcgtgcaggcacggggacgagcgcgtgtagaacggggtcacgtgcgtgcaggaggcgagagggaatcgcgcatctcatcacctcttttccaccatttacccgctcagtaccttccgagtcgtcatcg

SEQ ID NO: 45461 - DNA, 9187 bp, Oryza sativa
  unsure (1)..(9187): unsure at all n locations
gatattgcagtggtaacttcactctaccactaaataaagaggtaaccacactcaaagtccacgcaatcaaccaaacaaaatcttacacgtccagtatattcaatacaaccaaccaaaacatctaaccgtagtctgactcatcttatgctagcagccaaacaagtgcatatgtatatcctcagcctgggcaaacttagccagttaacctatatgagggagatgagtccggctagagtgatacaaataaccaaacacgcccttagttatgccaattagccaaaattagtgatctagaaaagcttgtaccaaaagaaaacaaagggatagcagaactgtaacagtgtttaaaaaaaaaacagagatcgagagtagagtgagtagcgtttccatcaattaattccagtaggtttggttgcactaatgcactgcatcctcccagtcatcccgatctcgatcagaattcatacatgctatagtacgtaccgagaaatcgacggatcaattaagagggaggggggaacgcggattaattagtggggaggcagggcaggagcagaagggccaagccggccggtcggccggcgaaagcgatcgagagaggagccccacgccgtccgccgccgcgtgtagcccgacgcgggggcagcgcgcgctgttcctcgatctccctgaacaattcctatccatccaccatcgcgcgcggccacggtggcgcggtcgtcgtcgtcgtcgtcgtcttcgtttgcttggggagagttggggttgggtaacggagacggaggagaggggtggggagaggagaaggagacgcccgaaccgtcgaattgatgatggtgcgctcccaccggaaatcttgaccactagtggcgcgcagtacgtagtagaagccacttttcaatttttgtttgaaaaaaaaagttctaatgtatggggtgatattattatttttgttggaattacacggtcgaatgtatggcagtatgggatggtactattgttccgttgaaattacacggaaggcgttgaacatgcaccactctcacatattcgaaaatacgtccacttcaaaacatgctcaaagaaacataggtcacaccatacttaacgaggagaaggggattgaaaagattgggaagatacgtaaaacgaggtgagctattagcgtatgattaattgagtattaattattttaaattttaaaaatagattaatataatttcttaaagcaactttcctatagaaaatttttgcaaaaaacacaacgtttagtagtttgggaagcgtgcgcgcggaaaacgaaacaagctctctccctttctccagctgccaaacgcagtatacatcaacagatacacttattaacatatgcttgggcccctttgaatcacagggttgaaaaaacaaagaattttaataggaattgaaatgtaaaacaagaggttggagctcttgttaagtttccttcaaaatccacatggaatgtgccattccataggaatttcataagatttgaaaagcttcaatcttttaaattaaaaggtcaaataggaaaattttttataggacttgaatcatatgaaattcctaaataaattctttgattcagtctgaaaccaatgatgattccttgatctcagtaaatttcttttgcacgcgtgtacaagttacgaacatttcaatagaagttatatgcacccataatcctctaccagcaggggtaataaaacgacgctataaaatttcaaaactaaatcgtttttccttacgaggtaagaaaataataaaaaaaagaaaactattgtagttgtttccacggtttctactattgtacttcaaattaaggacaaagaaaaaatagataagtgaattagacatgtaacacggtaaccatacggggactcctctttaggagcggagaagagagcaccccctccctcatcgttttagtgttagctcttttagaacgtagtaagattttaaaaacgcatgaacatgaaaaatatagaaatatgatttcatgcataatagagtcctatggaattcaggcattaattacaagcaatgcatttggacatttggagagttggtctcaaagtacaactaagtgtgcctttttaagagattaatgttagacgttagagatggttgtgatcgattgatacgagaaagtatatgaggaaattaaataagagaggtacatggagaaatagttttattttaagataattttaacacttataaatagttatattttgagatagatgaagtaaacattattgtttagtgaaaaaaatatgtatcagcctcccaaaagaagttgattttgtcgagttaagataaagaaaccgaaagatttacagaggaagaaaaaacatatcgccatgggctcctacctattctggtatcagtctcatcttcgtccactttaaaaaaaacttttaaattagtacattttgatgaacgcaagtagtatatgtagttatatatatttaacgtgcaaagaactttgatagtgtaagtatacttttaaatacttataatctgtttttcgaaagaaaaacagtctaaggttgtacattaaaagtatattagtctgatattatccagtacccgatcaatcgatcattcactttccccggtggagaggaagaccagaaaaattttgccccagattgtgggtgatacacattccgttcttattcatacacgccactaatttggattttggtgtagatcccatgactttacgttcatcaaaagtctaaacatacatgcaaaaagagtcatgtgcaactcaataatgcatattaaataatcatacacactgtcccttgtatacagacacatgtactgtacacatagctgtgtgagaattgattgaagcaaacgaaaaataaaaaaaaaacagagaagatcttggatggaatatttgattgagttggcttaataaacgtgtcaacgcaacaattcaactatttctcttgctaatttttctcttagaaaattagatacatctatttatgccccatatttgatatttccttttctgccccaccttaattactccttaccctatttttcattttcctgtccaagtggcttactccaatttcacctaaattgcactaatttagccatcctcttcagacacatgcatcaattttacaggtgtcattatttatgcatgaacttggaaataatatccgagggtgtgtttagttttttgggtgtaaaatttttgaagtatatggacgtacatttaaagtattaaacgtaaattaataacaaaacaaattacagatttcgcctgtaaactgctcgatgaatttattaagcctaattaatccatcattagtaattatttactgtagcatcacattgtcaaatcataacataattaggctcaaaagattcgtctcacaatttacatgcaaactgtgcaattggtttcttttcacgtttttaggcaaaaatttttggatccaaacaaggcccgagtataccaaaatatatctgacttaggttttgttaaaaactttcgacacatttattttccaccgtcaaatgttctttaagattcatgctaccgagataaatataataattgtgcatgcgcgaatagagaatcgaatccttgacttgctgctttgcaagtccactgccctagccacttatgatgctgggtgtttttggaaaaaaaaatcacgttacgtgttagttacatactagttgcattgtgattatatactagttacatttgtaagtttttcttctacaaaactatcgaatgttctacgcgtactcccaaaacttgtctgagtcaaaccaagtagatctgaaaatataacaagtagaagtactccatattgatattattcaaaatgaagaaatagaacatgagaaaaaataatagaaaaaacacacgtctttgcacgttgttgtggccctcctctcctcgtccactccctctccccaagccttcggaattgggaatggtctgaaaaaaaaaaaggagagaaaattatcatcccaccctggcgcctcctctccacccaccgactcccgagacaatgccgccgcggcgcgcgcgggcgcgcggcggcagcagcagccggcgccgctgctagatcccacgttcgccgcgcgcgcgcgcgggcggcctcgccgtggggctcgaggcgacgcgaccaatgcgcgagcacgaacggcgtgggcgagggagaggaggaggaggaggaggacgcgtgtcaccgatgccccccggcgaggacgccgacacggcgtcgtcctgcagcggtgccgacgaaggcgaggcgcaggcgcaggcgcaggggaatgagcagcagcgcgcggagcgggtgctccccaatggggacctgtacacggggcagtggcgcggcggctcgccgcacggcgccgggaagtacctgtgggcggacgggtgcatgtacgagggggagtggcggcgggggaaggcgaccgggcgggggaggttctcgtggccgtcgggcgccacctacgagggggagttcctcgacggcttcatgcacggcgccggcgcctacgtgggcgccgcgggggacacctaccgcggcgcctgggccaagaacctcgagcacggcgccggcgagaagcgctacgccaacggcgactgctacgacggcgagtggcgcgcgggcctcccggagggctgcggccgctacgcgtggcgcgacggcaccgagtacgccggcggctggcgcgcgggcctcatccacggccgcggcccctcgtctgggccaacggcaaccgctacgacggcgggtgggagggcggccgcccccgcggccagggcaccttccgctggtccgacggcagcctctacgtcggcttctggggccgcgaggcccccggcggcgccgtccaccagaagggcgtctactacccgtccccggcggcggcgggcgagtcccgcgaccccagggaggtgttcgcgcgggagctccccgagtgcgtccgctccagcacggaagggcagtcggcgctgccgtcgctgcgttcgctgaggtggctggcgcggtcgatcagcggccgcgggagctcgtcgtcgggccggagcatcggctccgtggtgggcgtgccgcacctctggggctccgacggcgaggtcaagcccgacattgccgacgactggaggcgccggagcagcgtcagggaggggaggggaccgccgccgccttcgctggcggcgccgccgccgccgccgcacgtcgacaagggggcggcgccgccgcgggtgatgaagcggcagggggtgaccatcgccaagggccacaagaactacgagctcatgctcaacctgcagctcgggatcaggtgcgtgtgtttctttcccgcgattttctgtctctttgattgcactcgcaatacttcaatttgtttccatgcgaggaatttaaaaatgtgaaattaggaaatctcgcatgaacaatcatgttgtcatctcgtcggtaaacaacgaaatgggaattttgggcgaaatattaggggtgtgcattgaagcatttatctagaatggacaaacattttcagcgacaaaattcatatgcgttggtagtgtggacatcaagaaagaatccgaggccttgcatgtaaagtagtaatgatttgagcacaattcgatgacttggctgaggcatttttgtggactcttatggcattcttatcatcttaacactgcctcactagtccttctatcagtagtttgaaatcctgaaaatgaaatcatatatcatagactccatagacagtactcttacaaagttataaaatgaaattcttatagttcattatcaacgattaatcatgtaaggattatcattgaattttctccattaccaatctttgtgtttacaacatattttactttagaaaccaagattgttattgttttttcagaacttgtagcacttccatatcttttgagaagatgtaattattcgacagtaagattgccatatttctttgtaagctcagaaagtaacttattatcactgagtatgcttattgtacataggcatgcagtaggaaggcaaggccaggttatattagacctgaagtcatcagcatttgacgcaaaagaaaaagtatggactaaattccctccagaaggctcaaaatacacccctccacacaattcttctgatttcagatggaaggattactgcccaaaggtgttccggttggttatcactcccatgatagatacattatagattagtgactgttttatggcttcatccatgtcaacatgcacatttgttctttacaaaatcacaggacattgcgcaagctgtttaaggttgatccagctgactatatgctatccctttgtggagatgatgctctccgtgaactctcgtcccctggtaaaagtggaagcttcttttacttgacaaatgacgaccgctacatgataaagacaatgaagaaatctgaagtaaaggttgtcctttgctgtctttgttcaaatagcaccatttaagcttctatatttagaagttctattctgaatacatggacaaactttgccacacagatgcttctgaagatgcttccagcttactacaatcatgttcgggcattcgaggataccctggtgacaaagttttttggcctacattgtgtaaagttggctggagcaaatcagaagaaggttagaacaatatatgattatccactccgccctcatgaatatgctatttttcaagcataatatgcctgattgtttgctgctgtactactacctaggttcgtttcgtcataatgggaaatcttttctgctctgatcacactattcataggcgatttgatctgaaaggatcatctcttggccgtacaactaacaagccactggcagaaattgatgagtatacaactctgaaagatcttgatcttaatttcatctttcggttgcaaaaacaatggttccaagagttccaaaggtgctaagtgatacccatacaccttagtgcctaatttctgtataaccatgctatctatcccttgtgctaatgaatttttaaatattttgaagcaggcaagtagacaaggactgtgaatttcttgagcatgagaagatcatggattacagtcttttagtgggtgtacattttagaggtaagaaagtgtgcttctgacaatagtttgcacaatcttaaggctgacttatttaccttggttaaaaaggtgccgttgatattgatggtgacatacctgcatcaccacgcctttcaagatgggacagggatcactttctttctgacccaaacaggtaaccgagatatggagtactaaattattcctctctcagctatactgcaatcctagttttagttagttttcctcgttcaaaatcatttagttagtatgtatgtagtggagaaccctactcattgatagtttgattcatgctatagccgtcttagtttggtaactaatgatttttaccagtaattttgttatgaaaaggctttaggtaaccttctgcttatccattttaaatatacaagttcactgtagtattctgttgggggtattcattctccggagtagaaagtattttaggtatattatctcactttctgtaatttcttggtaaattgtatttgttatgtaaatgccaagaaatgtaaatcctccaagtatcaaacagatggtgcaactgttcattgcaattgtccaaatggaattttttatgccctatgtatatttgaaaatgctacattataaagtaattcaacaaatctgacttcaggtggtcgaagattaaacttggggcaaacatgctgtcaagggctgaactgacaatcagaaagaatgacactgatgtcgttggacagccaaccgggcagtactgcgacgtgatattatattttgggataatagacatacttcaagactatgatatcggcaaaaagatcgagcatgcttacaagtcttttcaatacgactcgacatccatctcagcagtagacccaagacagtattccaggcgcttcagagatttcatatacaacgcgttccaagaagatcgagcagagagctgaaagtttatctgacaaaatgtagctccaaagtgaggactttgcaaaggccaaagatcaagcacagcgcaggacagcacggcgctacacaagctcgcatattcgattgcctgcaccaaactggtcatctggaattcggctgtttttgtagaaagtatcagtagttgctggagcaccattcangctgctggttcctcgccttcccagaaatcggattgacttttcctgtaaatatgagtagctacgtacatatacacggagttcactaatatttacaagagtagatgtaacatacagattcaaaattacacatagaaacatgtaaaccacgggtgcacaagccagtcagaggttgtaaaatgtaaatgctcctttgcctgaggagatcattctttcatgtactgaaaacctttgacatattggaaggaatttttttctgttcttgattttgcgcgacattaaatccaaattgtgagtcatcatcccctttcttctaccagtgcctctgtaacaaattgatcacgtccctcttaatttctctcttgatgctacaaaaggcaagatgtgatgaactgtttgctgatggtgtgttcagaatgtgagatgcaattgaaggggcatgatcattctgtctcagtttgatttccagatggaatataatctggtgatgatatattgacagtgacaatgcctgtgctacctgcctaatcccaggcagcttatgcaattgtgagatgaccccactggtggcagcttgggcatcaacatttggtctgcttgcaggtctgtttgtgatgatggcaatctgcttcaagccaaaaaaaacacagaagcaagttgcacagtgtgtacctgactgtggcgatgaaagagacagatcaaacagctatgtccaaggtttcaactgcaggttgttagatcattcaaaggccataataatgtgaagttgtgacctctgagcagggggaagtgagctcaaagcaggtttaatcagcaattttaaagagtatgaactgtttgtagcaaaattctatatgcgagaatttgttggtggggaacaactatactacttccatcgcaaagccaaaatgtcttatattttg

SEQ ID NO: 45462 - DNA, 724 bp, Oryza sativa
gttagaaggtgatgtttattacatgattttaattagattattctggtctcatggtaagcaaaacttttcaatggctagctacaaatgccgaatgattttacctccccctcctgacggggatgtggcaattttacaagaagtcattgtttgcacgtagaggaagcgacgcgttgaaaaattcaacaaaaaattctatgcctaacatgtgcatttgtttattgactcgaagctgaaatggtggcaaattgtgattaattggaattttacgacaagaagaggggattctttttattgaaaaatttaatatgaagtcaagcataataacagcagggcatactgtgggccaaaagcatacttgcatattttcatttaagcagatattatatcttcttacactagaatagtaaaatgcatgtatttgcaacatttcagaatgaatttgtctatgctctaataactttgtctgggcaatagacatgcagtaggaaaacaaggcccgattacgcttgatttgaagtcatcagcttttgacccaaaggagaaagtatggacaaggtttcctccagaaggatcaaagtacacccctcctcacagttcttgcgatttcaaatggaaagattactgcccgcaagtgttccggttggtcatcactccaatgacttatttgtgtgttatgcctgcatttagcttaattcattctcatcagcggtacaacttgtcctgg

SEQ ID NO: 45463 - DNA, 5581 bp, Oryza sativa
actatctgatccgacatcggatactccgatacttagaaaaactcactcgataggattttttcaaatcaagacagagagtgaagttctgtgaaaaatcggatagtctgatgttgctcaagtaaaactgcaataactttttactccgaactccgatttcgaagatcttggactctatggaaagctagtatcatgggctatcaaacccaacataaaacatggtccaaaacctttaagagatgttgaaaaacttgcaaagaaacccggtgtaagtgttgtgacaagtgaaacaactcgggattgaaattttgacttaggtttttcaactcacacaaagatgaagcattttgagcactaatattctaccaataatatgcatgtggtatccctcttaatagtacgacattcctacgacacaatgtaaggtaaaagatacaatataccatttgatcattccacattgcatcgtgatgtcgcattcatggggtatgcatctcattacaacatgtcgaggacataacaaccttcacatttgcttgaataaaagtgttagttctctctaatcgcattgtaatcaatcatcaaaatcattaggggcctagatgcactttcaccggtgatagggatcccacgtactccctccgtcccaaaaagagtcgaactctggaggggggagtttgtcccacaaaaaatcgagtcttgcgcagaaaactagaaacgtcgtctcggtggtggatgggcccacgctctctctctctctccagtctccaccacccgagccttatcccctcccacgcatctttctcgttctctccgtctctctcgcgcgagttcgcacaactcctccagaatccccatcgcatccaccacccagttcccctcctcactccacccatctctcccgctcctccccacaccttcttccccgctccatgccgctcctcctcactcccgtctctcccgcttctccgcgtccacctgcttgcggcggcggcggatagatccgttccgaggcggcggcgaccacgacggcgggtggaggcggctcggatgcttcggagatgtgatgcacaaggcggaggcgattgatggatgcagtgctgttggcggatttgatgcagatttaatttcttttttgttcttgattcttctgtgttttttttgttcttctatgttcttgttcttcctagttcatgcaggtgaattcaaagcatttcgtttggttgtagagatgttatcttttcctttggcaagtgtaaaaattgattggttcttgctcgtgaattcagagcacttattcttctctttttttttcttttcagattggagagatatctcttctttctttctgtagtataaaaatccaaattttctagcctttttgtatacggcagatgcctcctgtatgtactggagtactactaatcgatggataaaaaaacgacaaaaacaacaaacactgataagggtattttggtattttcacattcgtcctaaacttgcatcaggaatccaggagtagactctttaggacggagtgagtaggctgcattgctgagctagagggaaaaatgatggagagttagcgcaagcgggcgactatttatagtcgctgagctacacacgcatttcaagaaaacggggcccactagcagagcggagaggagctggtcggcagtcaacacaaccacagactgacgataaatatattgataaactactactcatcttaactactgtggtagtagctatctattgtacattttacctacaaagttaactcttcatgacatggtaaaagtttatagccagcaacgggctacactattaaacttgctctaatacagtttgaaattgtgttgttattgttgctattaatactctcttcgttttttaatatacgacgttattaattttttaacatatgactattcgtcttattaaaaaaaatttacaaatacataagatataaataatggtgaaagtacttagtgataaaacaactcacagcaaataaatgataattatgtagtttttttaataaggcaaatagttaaacgagtgccaaaaagtcaacgccatttgttagaagatgtatagtagtataaagtataacatggataaatttgtagatggccaaaaggcccgcccggcctggctcggccccggcacggcccagcagccatcggaccggcacggcctgatcggcacttcgtgccggcccatgggctgcacctcccgcctaggcacggctcaccagttgtcgggccgtgccggcccgaaggcacgggtggcggtcttttttaaaataagcctattttcctccctcctcgttggactgttacatatgtatagctaaaataagtctatttttcatccctcctctttgggctaacatgtatagataaaataagtctattttcctttcctcctctttgggttgacatatgtatagataaaataagtctattttatatccctattctttcgtccatggcatataatatatctatttttactcccctatttttttttggtgtatcaggcctggctgccgacccatcgtgtcgtgccaggccggtccaacgtgctggtggaggggcccaggcacggcccggtggtcaagccgagccggcatggaccagacctccgtcgggccgtgctatgcttgggccaggccaaaatgccgtgccatgggccgggctgtcgggcctcggtccttttagccatctatagataaattctctaaaaaagaagaccttacagaagctgcagtctccagaccacatagatatatttacgtgccggccacgatcacatgacaatattccgggcaaactgtggagacaggtaaggaaagcaagaaaaaaaaactcgcaagtacactacgacacggttcaagggaaatgtctcgagcactcactgaacagcagacaacgtcactcgagcaacaaggacgggtctctgctatgtacatcacgaccgcactcctaaaccatatatatcgattaatgctcctgagaaccactgcccatcacttggccacctcaaccccgatcctctctgcaacctgcgtagtttgaaataaccattagatagagagtacactgtacagaagatcattctactggaacctatcggagattcggagttgtggatgaaagggaacaccgaattacagaaaggatgctaaagaaagggacataaaactcccacatgattctagagcttcgatttaaacttcaaacgataaatctcccacatgattctagggctttgaattgaacctcaaatgcagcaggttcttctaaacaatgacaagttgacagctagtagtgtttaatgcgctactctcatgccagacatcactgtgccagtaatgcatgaaagatctgttgtaccttcattaacagtcgtcaaggcaacccctgacaacacaatgcacagttgcacacatagccagtaaacgaacctcacatagtcaaagactttgatgatgcaatttgattattaaataaatgtaagagcaactaacataaatctcctgaatgattgctacaaaccatgcagatggcatagtgttattaaattatttacaagttgtaaagaggatggcaactctgccaggaaacaatttgcaagagaagaaaatgactaatgttggggggtgtacagaagaaatacctccttgaaagagtgaacatcacttccccatagccaggcatcgcagcctgcatctctagctccccatatatcattctacgatcatcgccgacatgcacggcctcttcaggtttgacacctaaagactcacatgccttcagaaatattgttgggtttggcttttctgcagcaacctgttgtagattattaatgggaataagagaattatatataaaactgacttcaacagaatagataagagtatatgacacgagcatggtatgcatggaaaagcatataatgctgaagaaatgacaatataagtcgacatacctcagcagagaccgcaaccgcatcaaaccagtgatcacacttcagaacatgtaacagaggccgtagacgggtatcaaaattggagacaacagcagttttgacacctgcctttcttaaagctttaaatacgttttcagcatcaggatcacaaagcttccaagcctatcaagcaaaaaggattctcattaggcccacaaaatggaagctgaactattttcatacgttgaaggcacagttaatcttaccttctctgtcatatagtactgatatagttcctcaaagtactgcaaatctgaacagccagtagaagaagtgactatatgctgccaaaagggtctaccatcatccacataccttaaccaagttggaaatatacgaagtgagatcaatcttaaagctgtctaactaccgtcaacagaaaatacgcagtagtgcagtacatggaacataacaaacaaaggaaacatcagtcaaattggaattcaactgaaaagaaaacatcatgaacaacagcatgttcttgatctaagcacaagaatgttgaattccccactgtctatacaatttttgaaccaaatatacaacatcccattgtttgtttatccaaaaagggcatttcaggaggcaacagaatggtagttatccacaattttttttatttggtagaaattcagtgtacatcattgttaaggtgcataccatcatatcctttttgtcgttatctgcaaaatctagggatgctaataagaaacaagtaacagctgaactgaaagtagttactactaattaagtgatggggcgcttgctgtccaataagaatgattgtgaattacaatgaatatgtgctgacccttcaacatgttaaggaagaaggttacataggaaagagaactcgaactacatacacagagtcaatgaatacccagtttaaatcttttatcatgattcattatttgtagatagaaagacagtgagttcacacagatcccttaaccttataagctgacatgtgtaaaatgatgtttgtgcttgtgctctggcaaagcatgtaattgccaatttatgcaggtttacgtgaatgaagctgcttccagcttagaaaaattctaaacatttcacaatgacttcaaaagatgcttccagcgtaggttttcatgacattaaaagtcagcagaacaatagtcaataccagcaagttcaacttattgttactcaatcaaggtacagattgcatcaatataataatcaatttgtatgcaatatatataccgcattcaacagaataagatttaaacagattacagttcataaacagcagcaattacacaagtatcagatcagatgatgagatgaatgaattggcactttggcagtcaataatttcgcgtgtatataccacagattcgcacctgagccgtgatccgccccacggttgctcatacgcacgccggtatctcgcaaggatctcatcttcggagtacttcactccatacttctcaccaatgctcttatacacctaaacaaaaggggaaaaaaaccacggttcaaagctcaaacggtcagagatcaattcatcgcaggagcgaca

SEQ ID NO: 45464 - DNA, 2213 bp, Oryza sativa
cgatcacggtgggggatgacgccggctggctccgtcgatggtggtggaaggctctctctctctctctctctctctctctccggagagccgccggggaatgcggggctccggttgtcgtgcgcggtggtggcggagatggggggagagggtggcggccgtgtgctgcactgttgctgctttcgtttcctttcttcttggagatggacttctgttggtatcggaccttctagaacacattcctttaattttttaggaagcctgaaagggtaaaaagaaaaaaaaagtgagtttgtatgaagacagccaagataagtttaatttatcaaaataggaggactccctcaattccataaaacacagactaatatgatatctaaattagtaacattgcaatatggtatatcatatattagatcatttttatagaacggaagaagcatatgtttttataaaagctacgaattctaactgtctgaatatcaagctgtgaaataaaattttgttatcggtatttataaaagcatcaccaatagtctccttattctatccacaatcctatttttttaaggattttggtgaaaaaaatagctccaacagatcttatatttgatttttttttaagtcccttccatgcatcctttgctctcttcatttgagggagagcgacggggcgtttgccgtccccaatctctcattccgcgtgtttttttttctcagggggagtgctaggagagcacgctagagggaggaaaacaggaaaaactgttagagtccactttatttttttaggattttggtaaaaaaaggctccaaccggtctcatatctgatttttttttttgaaatcccttccccgcatccttcgctctcttcatttgagggagaaggacagcgcgtttgccatctccaatctgtcattccgcgtgttttttctgggggggggggggggcaggagagcgtgtgagagggaggaaaacgtgaaaatttattagtttagcagaagagtccacttctaatttagggataaaatttaggctttatcttggcgggatcagttttttggctatctattttcagattaggaaacccaaaaacaacttttttgggagattatacgtaatctcttggtgatgtgatgctaaacctctccgcttttggccttgcaaaattctaaggttaattgctcggtaaattggttaactttaaaatattaaattttactttttaaaatgaaaaataatcaaattccactggcagtcaacggtttttaatttttcttttgaaaaccaagaaataaatatcaataatgccttatttaaatgtggtttggttttgtgaaaatatgtgtgtggtcatattctaagaaaaataaacatgtgtgtgaataataaagagacattgcagcacaatttctagattactccattggaatttggaggatggcaggaaagaaggataatgatagttgcatgctgcatggaattgagttatggttaggattggtttggacatttgctttcctatggcccagtggcccactatgttataatgatagaccacgtcattggttccataggatagcttctagccaggatcatttcttctgataaattttcatatatagtcaccgtatgattgataagtttccatatattgttcatacctaactctattggacgtatgcctaatattgtttaattataagaaaaatatcatttgaaatggtctaagcaacgtttgcaacatattttgggacaaataagatgttaaaaataaagttatgttggaacggcagggatatatgttttttttagaaataaaaaattcaattatgccatgagtctagcaaccttgaagtttgaggcgtcttggtcaaaagtgagcaaaataactttgaagtcacgaatatattgctatagataagaagaaagtagttcatatgagtactatatttgtattagaaacccgtaaaccgaaaacatgtgcgatggtattgacgcttccgatatgattcttaaattaataaggtattgttggaccaaactactatcaaatttgtttagcattgttcgcttgcaaccatgtgtggccattaaaccaatctcgcattattccctttcaaaacaaagggagaacacaaaagcactcacatcaaaaatggttctgtgagacattacgttgttgctcatcatactagaatgtgtcatatctagt

SEQ ID NO: 45465 - DNA, 2956 bp, Oryza sativa
aattcctgcagcccttattccttaatattcgtgttttttaattttgataataataaatgaaataaagtgcaattaaatttaattttccgtccccttctccctcctctctgcccgctcgagctcgccgccgcctccccttcttcggtcacattgtcgacgaggcgtggcccgcccagttcatggtggtgaagagatctccgacgtcgagctccatgtggcagagggcgacgggatcggcggcgcttgagctctctggcgtggatccgacatcatgcttgctggatctagcagagctcgagcgccaaacaggtccacagatctggcatcatgctcgtcggatctagccgagctgccgctgtcgtcggcatcttcccggagatggcgtcgatatgttcagagctgttgtcatcaatgcgaatcgagttggcttcctccttggctaccgccgccgggctccctctcctccctccctggcagcgtgggccacagcgaggtgtgggctggctatggcgacgacaacctctagctcgttgtctcgtcggtagcctccagttcctcctttttctcctctacaacttcccggaccatacaaatcgtcttctctctctcctagaaccaccattcaaccactgttttctctgcatgaacctctgtcaccctgtgagaccactccaaacctttagcgtggtatctgaatctaagtgtaacttaaaaccacgggtgtgagacaccgcattgtaggtgtgtttggttgggtggatgaactcggatgggagatggccacccgatttttttgtggtgtttggttggaggtcagggtggatggggcagcccaaaatagggaatattccctcaatatactggatgagtgcatccggccgatttggctggatgaagccatccagttttggtctgggtgatgtgtcatgttctgattggctgtggttggtttgattttctgttaagcaagctccaaatgactttttctcctaaaccgttttatctaatttatgatttgattacaccattatatttgttacaattaaatctttaaaacaagatctcggatgattatatcttgataaaaaaattatatgataaatgggtctcactaacttttggttgttttcatccatgctatatctctccaaccaaacaagaaattagatcgccatatccatacaaaccaaataaaaaaaataaatcgtcatattcaataaaatatggatggctatatgctatccatacgtgaccgtaaacatagaatggtcttatgggacggagggaccagggagtactcctcgggggtcaggtcatcggcggggtgcgtggattgcgccacttgtagaccgggccccacatgccagacgcatcgatgcttcgctttgtttacgcggcgcgcctctctttttccttagccaccaaggctcagaaaccgcctacaaaacggcgcccggcgtcccacggatcaagcgaccccctaaaaaaccaaccgaaaaagaaaaaaaaaagaagcagagaaaaaagctctcgcggcatggattcgcacgtaggcaagttattcgattcggtgggctcgatcttccgcggcagcgacaccctcccctggtgcgaccgcgacatcatcgctgtaagcttccccaccccatcctcctccccctcctcctcatgaacccttggctccgccctccgggttgatccgtgtttggctctagtatggccatttcttttcccccgcttcgtgagtggatgtttcgttgtggctgcgaattttctgtggaatgtacgcgctctcgcgaattggaggttttaggtgttcggtgaccgctaaatccctagctattgctgtgtttgtgctaccatctgctccgagtttgcgtttgttttagctattgtcgctcggtgatcaaacattttgatatcatgtgctattgtcgacatctgcggttgaatcacaaaattagcccccattttaccctcgagctaccgtggtcgtaggcctaaacgaactatatgttcagttgcaagctgctatatgcctatattcacttgcctcgcgtatcatgttctctgtcctaatctatgtcatgccatgtgcactttttgtcttgttgaccagggttgtgagaacgaggttgcggaggctgcgaatgaagaacagaagaatgagagccttatgaggctttcgtgggcgcttgttcactccagacagcctgaggatgtgaaccgcggcattggaatgcttcaaggtaatgaagccacatacatcctttaattttttttagcatttggaatttgttaatcaattcaaaagctgaatgaatagagtagtagtttactgtttctaacatatgaatgtttaccccatcactttctgaaaatttatacgaccatgataatatgtgtctccccatgtgaactatttatatattatttttggtcatgaaaacatttatcagttctccagaatgcaacttgcttgaccacgaattatctataatgtgtctgtagggccgatattattatggtataatgaaagtactttggggacaaatctacacataatttttgtgtatctaatctaaatatttaaaagacatttctgctcaaagtctcgatgtatgtccaaatgaagatgttttcatgaccaaagggagtatataagtcagatattgttaacctggaatacaaatctatctggaaatcatgattttaattctgacgctgtttcagacttatatatttaagtttcaacagatgagccacacattgtctaacaatttatctagggggacccctttttaatcgaatcaaatagcttttaacatatgttataagtgtcctcccacatgattacccattctgacgctcctattaaacttcctgtatgcactcttctgaacaaactttattaatagtgccgttaatatggcactctaatgctgaatcaaaatgt

SEQ ID NO: 45466 - DNA, 8423 bp, Oryza sativa
gattctaacttttttagattatcgtgaatttgatgttaatgaatgcacatttatcaccttttgcagatcaacctgactggaggcaagctctcactttacaaaggcttgttgaggacaaaaccagaagaggtagggtatattatttaacatccaagccttcttcagactggaaaatgaatttgcactcaattttcatttcatactgttagtataattgtcaaatatattggttaggggaactgtagttatcagcagggcacgcatgaaagttgatattaacaaagggtatcttagttatgtctgcacttcacattataaagaaagaagtatcggagcagctcagcaccctcttgtgtcctttggagatcggaacaaagaaattctagaagatctgtgtaggaaataatctaattccaatgaattttagtaaaatatttccgtactaatctaattcgtaggagtacaatggtttttgcaactcggatcgattgaaggatgggcattactgactgctttttaaatgcagacggtatgattggcatggctattgtcactggtgccttcggacttgtgggacttgttgctggtggaatcatcgctgccgcttcttcttcatcctcatcatctaggaagaaatgaggaacccatatcaagtgaataagatgtcaagatgggcaagaaatcgatgtaaatatgcgcatcttgctgtcatacttgttgcaaccgtatactcacgtctccatttttcagtccttttaccatgagttcaaacaggagacatcacatgcctgcatgttaaacatcatggaagatgaggaggctcctgttatgagttgcaatcaggatttacgtaaccttgtggttatcatggttatcatgtgcagtaattttctcagtttttgaaaccacggtaaacctcgcggtggccgcacggttaccacgataaccatcttaccgtggggtggttgtaaccccgctcaaaatggtttggtaaacctggttgcaatccttcagtacttgaactgatggctactaccttaaattgtggagtaaaattttaattaactagataatgtctcgtgctttgttacaggatatatgttaaatattatagaaatgataaaatgatttgaattgaaatattgtgaaaatgatttgagaacgatgatttagcatgtgtatattgagttttagaatgaaataaattgtagatgtaattactatatgcatacttacatgttgagttttaggtgattacggattatgtatgttgaccttagtgggttgatgtatgttgagttttaggagtttagtgggttataatggtaggtatagatgagaggcatcttttagtttcctcccgaacggtagaaatttaaccgtaagatgacatatagatggtgaactgaatgaacattggtgacaaccgtcagttcaagtgagagaggggatcgggagagatggtttcattttgttcttttttctttgtccacaaaagttatcttgtcattttagaaagagaaccttggtaaacaagaaaaatatgaaattaatgatcctagttaacatggaaaaaataactgcaaaaagactaaaacagattaaagattacgagtcctcattgtttcatgtgaatacaagagttggagttgagagtggagacatgtttttcacggttggttgtattttgattttttttatctatttatgatgtataaatacattaatcatgttgggtttttgaagaattacgcttttgtcgtggcaaattttttagcatgtaatcattgatgaccgatagtgtcagaagtatctagtttggatttaaattgacagcaacatgcatataattagtttttttttctaattcaaacatttgttaaaaacaaccgttaacctccgccggtcatatattagtcacaagtatttataaccttggtttggagtcgatctaaataaaatagttaaaattattttaataatgtactatttcaacaccatatctatatctatacctaattaaaaaatacataagacttctctgaggattttcgttcgtcttagtccgtcgtccgcatcatgcgcacctcctctccacttcatctgccgttcgcccgtgttaacgcgcattcgctctgaagatcccacaaccaatcccaatcattataaatctaaaaaaactaaatcctagtccaattggtatcatcataaatccaatcagaaatcgcaaaataaatcacacaagaaataggaggagaggcggaaatcacacaggagatgagagatgagaggagagggagtggcaagcgggaggctgccgctgctccttgccgcttcgccaccgtggagatcccgagctcaggggccagatcccaatccgccgtgccgggggatgattgagagggagagggaggaggaaggtggcgacgatgaggccgagaaggtggtgtggcttatgaaacttctgtatattttttttcacattggtttatattagtttcaacatcacgcaatactattaaggaggactgatgtacttttatctcaacaaattaaaactatagtgggagccgggaggtctccaaagactcagagaggtagggaaaaaaagtaagagagcatctctgagactcttaccagttttattgtttggagggcatgtttgattactcgtatttccctagcctggctaatctcctttatataagtgagtgtggtatggataagagcatttttaagagcctcttaaatagactctccgagccaaattttggcaattcaaaaaaataaatttcactccaatagccaaatgacttgccaaactccgtccctcatgaggagctgtacgcggtgaggcgagccgaggtggaggagatacggcggccggaggtggagaagaaggagagcgaagaggttgacaggtggggtccacgtcactttccacgcgggcatgccatgatggctcaccacgtaggcaaaataggcaaatagttaagaaatcacctctctccaatgataaattattaagagagaatttattctataccactgagtttgttcgagttcaacgatttaccattgatattgtctctttctacgatatacaggcgacattatcaatgttctacaatacgccattgggctggatattcttttcaagaatacccaaaatacccttatggacatataaagttaacaattgatttatcccattagaagttttcaaaaaaataaaaactttgatgtggcctccttacacaacatgaaagttcgtataaaagtttcaagttttttaatttatatttttaaaaaaaagatgtaacttatctgttatatgctatacaaaacacttttttatttatgttttgaatataaatcatctttcatacactacataagatatttttgtgctattatctctcgtataagcaaattttctctcgtatactacataatttttttttctaacaataaatataccagaaaaaaaacttgaaacatataaacaaactttcacgttgtgtaacgaggccacataaaaatgttcatattttttttggaacttctaattagataaatcaattattaaccttgtatgtccataagggtattttaggtatttttttgaaaagaatgcccaacctaatggcgtattgtagaacaattgataaagtcgccggtatattatagaaagagaatgtcgatggcaaattgttgaactcgaacaaattcagtggcatagaatatattctctcaattattaaatacaaacctcatacgggtatttggataagtgaaaaatctaaaagtggcaaatagttaaattccccgcatctttccgctgcctagcagttggaggagagaggagaaggcggtggcggtaacagagaagggaggcggtgccggcaactgagaaggaaggcggcgccggcaatggcaaggaaggctgatggaaggagagggcggcgtgatgctgcggttggggtctgttagtcatcggtggatctggtgcgttgaagctttatgaagggagtcagcatccggcaaggaagacggcgccgacgacagtgaagagaggaagatgatggcggcgggaaggacaacaccctcaagcttccagatctgcattgtcctctcctacgtcctaaatcgggtgccaagcaaatgagggaaggcggtgacgggacgcgttgacccccctggctagcctcgccgaatccgctcgttcccgcgttagcatgactccgagcaagcgatgccttttggtagagcgagtgataggggcagcggcagcagggccttccttcaccgtgctagggatgagtggtgagctaccggatttcgattcaacttagagtatctcttttacagtttcttattcgaatttcctttttcagagttttggttgtttcttccacggctcaagattgtttgtgttctctagattgaattttcactgaaaaactttgaacgctaggagaccaggagaggattcacactcttccgtagtggatcagagatgagaggaggagcatgtcgtcccatctactccatgccatcccctctcacaatagatggagcatgtcttacatggcttgggaggacgagctccagaaatatattatatatgttcttctttcttatctctctttaatcgattcggttttaacatggcaattgatctgttggcactagtatcgatcaatttgtatcttttttttttgtctaatatctatcaatttttatccctttttatctgatatctgagttagtttcactttctgtttcttgtctcgcttgaggggacgtcacagactcctcttccattgctcactgtctcgctaggttgcctgccgaacaaggctctcttttgtcaactttctctgtcttttattcccgttacaactcacagcctctttgttagcctctttcttaaaagacaagaaaaggatgggagtacatatgtataggagatccgtttggattgcgatctgtgaccgagttgtacttgtacgtggccacggaaactggtaccggtaccgagcttcaacctatataatctgaacgtgcatacctcaatccgtttcaaaattgaatctaaccatatgatatgacataacgtagcctagattgatttatttcagacggagaaagtatatactcctatattacacaattgactacaggaagatcaatctagttgtacttgtacagtcttcggttctatcctctatgggccttcctagctccggcggcccggcccacaacgcgagccttggacctgctcgcacatggacctcctccctcttcgcccgccgcgccggcgacccctccgccgccatcgccggcttccagcgccgcctctacggaggccaccggcgccccgatgtccctctcgccggcggcagtctcgccgatagctacgccgagtgagaaaccccctccgaaaattatatgttagcgaatttatttgattgatcgatctatctgtttatatgtggcattgatgtgatgatcaggccttgatgagattagggcctttatatattaattaatctgtttctgtggcatcgatgccttttcttttttctttttaattattatgttatttgcaggcgtagggttgagattcccaaaagtttcgtcatactagaagatattctgcaacacaccctgtctaatatgcacagtatccaggaaagcatactgttctggcagtccaatgctctggtatttttacgccgcaaaccctttcttttcctagactcccagtatttagatatgattcttgcatttatctatctgccatttacctatacttggaattgtttctcttttcttttcagagaacaaattcgcagaaagcgtattttatgatctttcaaagaggtccaagggcctttgttgcaacaacatgtcaaacgctggctaaacttcagaacaaagggagtccagtccagggccttttggactctgcatcttctatgttctcaacaaaacttgccatcctaacaaggatgcaacactgcttggcttcttttcttgctgaggtttgtttactaaaataccaatattaaaaagcttttttcaaagtcctggtctcttcccaaaaactgaggcatggtcagcttcaaagccagctgttggtatggcatatatgaacttaaattctacctttgcttttttccataggtttacaatgaaactgacaaacgcagaagtgtattaattagaagatcagaacaatcgctgcatagtctcttcgttgctctgaataacatcttctccaatttggaggtagaacttagaaatgctggtgaggtatgaaatgtttttttctttttaacttaattcgagattctaggtgtaaatctttctttgttgttttctaatatggtctcggtttttcttttccagcagggggctgtattagcgaatcatgataataactcattcgaactcttccaaagattgccagaagctgatgttcagagttcagctgctataagtttgatctatgaaaaccttcagaagttagatatttttctttcctctcgggtttgcaactccccccctactacactttcacacgtgatttttttttcacttgtcagcctcgcagttcccagattactgttacctgtattttaattgggacattaaggctgtgttcatttggattaatatgattatttcaagcaactttcctatagttttttttgttgcaaaaagtatattatttaacagtttgagaagcgtgtgtacggaaaataagaaagccaaagttggtaagggggagaaatgaacgcaccctaaggattcaatgttgtacccaagtttttttggctactagtttgtgcttttagtcgaaactcaaaaaagtatttttaggcatatgcaagtaaaccaaaaactgttccatacatgaatggtttcaaatgagaaatcagtgctactgctaattattctaaagtaccaaaaacatttttgggtgattacggaaaatctcccacttgaggcatcaaaatcaactaattaatcatgtggataattgacaaagtgttaaatcttgtacatcaatatcagatttagtagtctagcaatcctttttacataattcacctatttattttattttttatgttagaaaactatatgtgggtcttgtactcttgttcatctacaaaagtagatcttccggtgcagttcttagaagatatctatatgttgcttataatttcattatgccaagaaatgtgttgcttatttatctgaattctgaagcaagtaattttatgcaatgaaggctttcaagccataaaaagccgagaaaaatgaccaaatattggttaccctacacatttggagcattgggcctctctgcatttaccctatggcttttacgccacagtagcttgatgggaagttctgacattgacaactggcttcatggtgctaaaaagttgctggtttggtgttgggatgagaatgttcagaaaccagtaagatactctatctatattctattttttttatttattttgtgcacaatggtagtgcaaattactccctttgtttttaaatattcaaactttcaaaggtttaactggatcttgtccaaaaatcaagtgtttgtgaccggagagagtggttggttggattcgcagtcagttactcccttcgtttttttgataaatgacgatcaaacgtttgtccaaaaatcaatagcgccgtgtattaaaaaacggagggagtaactgattgtgaatccaactactctctccggtaaccaatacttgatgttttttggacaagatctggtcaaaccttgaaaccttttaaaatagtaattagttttaaaacataagattgatttgtgtagatttgtcttcaaaagtattttcacaatcacagttctaaatttctaaaaataaattgtgtctaagtcacacctcgaagaccatgaaagaaaaatgtcaatgtcatgcactttttactgaaagaaaaaaaaagatcattctctagttatctcaaacggttcatttaattttcatgtgtaaccactaaattttggaagtgttgctacaacaagctcgtccaagtttccatatatttatccactatcaagatgaacataatgatctgtctagttgttcgaatttggaaattagtactttctgttgtgtcactgaccgcacgcatgacacgttttttctattatggatctttaggtcagttctataaggtatctcaccaatacactccatcaaagcaaaggtgtaacaggaaaacaatatatccaattccctgaagatacattaagcaaatgcaggaacatatcgtcttctctctgcgaaaggtaatacctggtttacatttgagtttctgattgaaaataaaataataaaatgttcccttaaggg

SEQ ID NO: 45467 - DNA, 1442 bp, Oryza sativa
tggacttgatgtcaatatttgccgaaaatcaattcaaaatcaatctttctttatcgtgcatagcaatttgcagtttcatcttgtagaattcttatttgacattacagttttgagttatttgagaacctgtttgaaccattgagtgtcatggttgctgaatccactttctaataatgtacacaaggcagttaggaatagacctttatagcgtatctcgtatcgtacgtccatgaagctatatgtcaaattttgatccaaataatgtcactatctaatcactaattaggatggcattcaattgcaataccatctgccggagaataattatgatatgtacacgttatttagctattccgaattactctattttgggtgatcctcgaacaattgttctctctatcgtgctcaattgaaaatgtgagtatgtttgatcattcagctatattctatgcatattaagtgcaggtatgagatggaaccaggatctcctgaagaattagcatgtctcatgattaatcaggttattttccttccttgtgtacatatatttgcatttaataaattcaggtcgcttttttctcaccaactttgaaatttcagactaagaagtttttacgggattttaaagagtaagttaaactattcatgtctgacaaatatatattggtaaaaacacacagaaaactcttatctagtataagtattcaccagctgagtttgttggattgttcttgcacagggtaatgccggaattagaacatgttcttagggtacagcaggttactcttgcatttggtcgatggcttcttctgccggtacttctaaagccagcaagggttgtccatgtacgtttattccaatgtttaccttcttctcaatatcacttgcctaagtagtgtattatctccgtcccaaaataaactaacctagacgacgatgtaacatatcatagtctagctatctatatttattgtattaggatgtattatattatctttgagatttgtttattttgagacaggcctcagtatgttctactctattatctgtgtgcctggcatctgttgtgaaaggagtacaagtgttaccaggcttaacatataactgttgacctctggttatctatacaacagggtcaggttacacagagaagagatagaattgcacatcttaagcgatgtcagcttctctctggagtacaggaaatgcttgcagagtttcagtactgtatggacaagggaatggtaatttatctatatctaaaattagtctattaagatccagaatttatattataactacgattattccctgaggatctactttatttcctttacagaaggaagaggcacaatgttcgcttggactattattgtacagcatttatagattttacagaggtgttgagtcgagttcaaaagaaacaggcgagtggatatagt

SEQ ID NO: 45468 - DNA, 14803 bp, Oryza sativa
  unsure (1)..(14803): unsure at all n locations
tttttactcagtgtagtacccactcggagaacgtgagagtatgttcccctgccctcttctagactttatacacttgtaaaaatatattcgacagtggtggatcatagctcaaagaacctattccagtgaacttgactaccattggaaatgtcggtgccgtatttctttttcttgtttggatagcttttgagaattctcttaccgaggaaggcacaaaccttttgaagtagtggaattgccaaccctatcttacttttgttttgggaatgctgattcattttccccttttctatactactcattccattctctttgtcttcaatgagaaggagaacttcgtatttggtaccaccacactagatctagtctactcatatttgttcgacgaggtcgtcccgatcagtcccagcgcacgcaccctgtagttgtcggcctttagaactttttgaaagagatggatgtctgggatcgatttcaactcagagattgcctactggccacgaggcttatgaggcctgcggaggaggtggagggaaacgtatgagatgagggatttggacttgctacacttaccagatgtgaggtagttaaatgctttccttccattgcagatatccatattgctatagtgtctataaattatcatatagaaagaagctaaggggattctacaagatgttctgaagtgtcgatatacgacgaacaggaatctattctacaagatgtttgaatgtgtgagtatccttgtgtggatcagcccgaaggctgtcgattttaaaaggtgaagacaaggaagagccattcttcatacataggagcgagtggtcgaaatggaaagcggacaaccggaattcagtacaactatagggttcggttcctctcatgtttacgctaggggatgattctactcgttcatcgacttcccccgcatggagcagcatagatctaaatttaggaggattatccagatcgtagtactctaaagcacaattcttcttggaggagggttggtttgcccaggtgactgatcctgccataatatactcccgccaattctattgcaccggcaaccgaagttgaacatacatacgacgatcttcatgtgtgaagggacgggaggaaagaaagggcggtagatgataatgcgaaagggcgccgcgtctgggcgggcgggctaaatggataagcgaagaacatgttagagacttgaacttcatcggacaagaaggcgctggttgtggtttgattcccagagctagatgggatatgccactggatatttttccagaaggaaattgtcctgcgaaagcgaagcgacgttggctccatactgggaataaaaaagtatggaactttctttgattgcaaaatcatgaaaatggctcagttcgaggggagtcgtaacaggtataccacgcacaccccctttccaagggtagtagtagataggttgagctaactctttcgctataatcttctatctcgcattgctacgtgctcgaaacaaccaattcgctcgtatagctaatgcaacctatagagtttggagagtgctgctattctttccaaatggtctctgagtgcggtctgtcaattcctgttgtagacatctgaggagaggtggaagaagagtagacttactacttttgcaaatcaaagaaagaatttaaacagacatcgtactcgagcgggacactgcagtctacttcttggttttccaaaggtccggaggagcggaagagtttctagtcgagaagggtcgggcattagcaaatccttcaatcccagattcgagggctaaaccactacttgaatgaacaaagcaagcaacagttttgtttttcaaccgagaagaaaggcgggcaagcgggcgccacactcccctataaccttcttgcactccactccggtatatctttactctacactcctctacaagatagagatctacgtttagctgtggaagggatcacggagatatgtgctctaacgactcaacccttttttgaccagggaacgggagaattcccactaccgctggcaggccagccgggccgtgagcgcggtgggaacgggcttcccaaaaaaagagccccggcccgggtcagcatagaatggggggagggatccttcacaaaaggcgaaatggatatgaaaaaaagattgattgaactttccgacggactcatgggatgagtaaaagattgaatgggattcgtttgggcaacggaatcaagtgctggtccccttttctctcttattgaattaactaattcatttacttttgacttttgttggatttttggatatttttttggtgttgatttggcattattcaacaagaataaaagaaaaatttcgataaattcctttttttaattatgagaaccaatcctactacttctcatcccatcagacgaagacgaacttgcatttgttgaataaagaaaagaagagttcgatgtaggaggagcgagcctcccccagagctttcggcagccatactttcttcacaaaactttatgataaagatggactctctttcaccgcaacttgcccgccctaacagatggaattgattcacgatcagcctccttcggacccggtagctacagcccataagcaaaacaagatttggtctcgtacgcttgctaagcaagtttcctctctttttaatttttaactgatagccctctcgttacttgaaaggaaatggaatgcatcttcggtgcctaagcttgagtgagcgcatcgcaactgtgccgatttctttcttttgttgccgtacttggtaggctccttgtccccttgatttttcaaggaactcatttttttactggctccctttcctccctatgctcccccggcgcaggcccaccacgcttcgcgcctgcggcgttttcgccagacggcacggcgtcggctttcataaagcaaccgaattaaatcctcctttattttgaattctgtttcaaaataagaaagaatcatttcttgttccataactctgtgtacactccgtgttgataatttgagacctaatggacacatcatacataagaacccgttgtcgagattccatcaatatcttgcttggcagcttcataaacttcgtcgtcctcagatcagaaggagttttgtcaaatgaaatgctggacaatctacatgagtgaaaggatgtagcattagactctttcgagcagaaggagaagacggacctttatgtatgactctggtaccggcatgataccaaattatgggctttgtgtaaatggcttcatgctggtatggggtattaccctattttactcaaaatactgtgacttgtagctcagtccaaaagcctgctgcttatggtactgctagtctgttatgtacaagtatcttaccgacgaaaaatgagagataacatgctttagtctggttcctataggccgtggtcaatgaaaacttataatcggggacagataaactggaaaaacagcaatagctatcgatactatattaaaccaaaagcaaatgaactcaaggggcacaaatgagagtgagacattgtattgtgtctatgttgcgattggacaaaaatgctcgactgtggcacaattagttcaataatgcgatgggcgaatgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaataactcagttcattcttgaatttcggcttgtagctttgctacgcaacctcgcattcgaaattagtacttacttggaaagcagggacagtagtatatggtagtcagctttgaattgttctctgtgtagaatgcctattggtttttcacgaaacagtactatatgtggtcagtacataggtatcaagaaagagggctagctctgtttgaatagttaccagccaagaaaagactactcaaaaatctgctacttcgtttccaagcaagcaaagcgccgctacttatttctttctcactcactacttttttctattttcttttgtctatcgaaacagcctaggattcaatttgatttatcctagtggtgacagcttatgcttcatttccttcgaattcttctttcgatatgcctttgttgaaggtcgttcgagcttttcctgggagtatggcatgggttacatacttcagcgccgtagcgcctggtatgagcctcgtggagaagcaatggctagtccacttgatctcaaacctcagatagcgacacaagaagacatcaaaaccatagtagcattgcgaatgataagaagaaaaaaggatgagtttgggattgcagccatgcttcgctttgatgaacgaaagaaagagtctggactcactagaactctctctctggttgcagttctctactagctttcccaaacttcactagcaaaagacttgaagaaggaagcattatgaaggggagtactcttcttctactgaagtcagatattgcactagaaatggaatagaggaggaagaggtgactgctaggtaggcagtagtagcgcatgctggaaagctagtcaagggagctttgattggttaggtcaactattcagaaacaatatcatcgattgagataaattgacctataagaatgtatgtattttttttcataaaaagatcttttaccacctaagaaggtgtgggtacttttttgccggcatacatactcccaactactttcctgaatctcattttttggtagtacgaagggggaattggcccaaaaattggataggggtaaagacgcagctggggggcggcggcttattcaagtgccgcaagctctgatagtgagacaacaaaggaaagaatcttcaggctattcgcttccctctttcagtgtagccggtccattcgagggctattggacccttctccacgaatttgttcgcgaacacgtttgtacctacgtcgggatacatgatcgctagaagagggttatacaaaagagagggacctgagtaattcctttacaggtcatcgctgagaaagcatcatgcatccacataaaccatacagtgaggccttttctttatgaaagttggctagtgaccctatgagtctgttctttcaagcatcaagttttttcttctaatttctactatttcttccaggatcaaaaatattttatttggttgagctttgtcaacagattggcagtgaaatagaaacttttctatggtgaaatattagagaataactatataaaataaaaaatatctctttgagatttcctcgctggcgctcgctcaatccgttcaccagggttcctttcctttcctttacggtcgagctacttctcgttcatcatcaagtggtttcaaaaagaattggaaaagggatgacgcaagagcagcggaaggtgacttagcaacatcagtcatttcttatagaaaggaaggaaatgatctctcttctgtctagacgaaagatctcatttttgctaccgctccccctcttatgagtctctgtcagccgttgtttagtagctttcaacgcgagttcagtcattctcttatatactgaaaagtacgaactgacttaaagcacgaacatgaaggagaattcgaaacatcttgaatcttctcagagagcttgagtgtgaaatgagtgggccggccaaagaagaccactatggaagtgaaaggggagggcaagagcagttcgaaggtcaatgaaatgggttcagttcccttgtcaaataggggccccgacccaagtgatagctctcttggcgaagaatgaatagtagggacagcaggtaaagcagttgggacggcctgtgaagctttcgcccttgcttgtcttgtcccaaagctaactctttcttttaggcatgcaggaaaagaaaggttggaaaagggggaactaagaaaagtgaaaggccaggcttgtagctaagaaatatacttaataacacgacccccttactaagtttgcctcacagttttgttatgataaatcactcgtgggtttgagatatttcataagtagtggccaactaccacacctaattggtgttatgattggttaagatgaatgagaatacaaccaaataaaggttgttaatccaccttcaatagggaaagaatgacaggatataataatattgcggagtccctaaatcgcagggaagcactaagaaacaacatgccatttgaagcactcggatgcccaaccacagctatcacaatcactcgaatccggtgaagaaaagtaccttcatagcgtaggagggagagattgttttcatttcgattttatggcctggcagaaatgcgtgtccctatctagtgacatcgttgagagggaggcagtgttcagcttctcatggggatagaaaaggagattgcgtactccttctaagacatgaactcggaaaagagattgaatggcaagtgaactaattcctgaaagtcgtcgtgattggatcaatcagacttccccacaggaaatgccaaggggcgccctttatcatcgcccatttcttccttgtctgctgctgccttaagtgcgtaaagtaggctcaacttctttggtttctaaatatcttgtagtagtcgaaggtagtccagtccgcttgttagattgaattgaatcttatataacctacgtagctaaagagaaaatcataatagtctaagtggacctctcaaaggtataaataagtatacattagtcttactggttcggtctttttctttttctttttatagcctgcttgtttggtttgctagttcctggaaagataacccttgctttgattgaaggaagtgagcggacaatactgttcctccggtccgtggttcgacctcccgtagtggtccttgcttttctttttgaaagctccgtcaaaagcaaatgcttcgctcttcttttacaagaaaggtactatctccatatttgtgttgatatatgttgatgacatcattgttgctagttcttgtgaaaaagcaacttcggcattacttcaagatttgaaagaagaatttgcccttaaggatcttggtgcgttgcactatttcttgggcatagaagttaataaagttcatgatggaattatcttgactcaagagaagtatgctactgatctgttaaaacgtgttggcatgcatggctgcaaggagatcaatacaccgttatcaacaacagataaattattgatgaaagaaggtgaacccgtgacattttgtacccaaaacaaacgcgctaccaagctgcgctacatcccttttccaaattgttgtacagtgtcattgtacaaaacccctgtcttgttttccacatcataattttatcctccatctatatacaactttcttgtcatttcttctttttggttcctggctggatccggcctgggatagtggcgcccattcctaaccagttctgaaaaggttcgctcatgctggaggtactaaccacttagtgatcggtccgctagttcacgcaaatccgaagaagttatcacggacgagccacatgcctacttctttttgttgtggaaaaaggtctttccaccgagatcctaaagtgcattcatttcctatttatagagcagcctgtaccacgtattcctccctagttttgaagcagggcgagactactttagctaggagcctcttttccttctgcccagctccccgaaaacaannnnnnnnnnnnnnnnnnnnnnnnnnnnnnnnnnnnnnnnnnnnnnnnnnnnnnnnnnnnagattttgactctgattgggccgaacagtggtagaacctggtgaaccaggcctactactaaacattgattctctctcctaaccactcttaaatatgttaaatacactccatcgatcaaaaactacaagcaagggagtcagctcttattgccgtaaaggaaaaataaccccttgattcctttcataaagatgaagggacagaggtgactaattccccatctcatttggggcggaaaacgaatcgacatctcgatgtgatacagccctttccattttcgttgggaaagaacggcgaagtccatccgaaccctccaatgaagaaataagaggagagcaaagcgccaatggcgcgcgaagcgcatgcggaaggggcacggagaaataaagaagtgtggaggagaagcagccgagctcattcccttcgcttcctgggctcaaagcagtgctttgtttcctggccaaatcaaggatttggggctgattgcaaaagatatctgaatatcaagatagatccatccatctatccagatatctaaaaaagaatcgattttgatttcataaaacctttgattcaaagaactgcgcttagcccccccactcatgaaacgcatcagcattcgcaagaaagagaaagaactcggttcaaagaatcgcttcggtctaaaacgagtcttccaagatcatgtctatgtgaagagcttgaaccaagcgttcacacgcatacgccctctgaagatcggcgagaaaaacaaatcgtattctatagaatatggtagtggtaattatataactgctttgaggaggaagagggaaattgtcaaggaaaatgccactggaggtacatgtatgcatccacttccaaattcggatgatccaacacaaaaagtatgatatttctattctctagctctcgtcatatagaaaaggtatctagctcgtccctctagcgctcgtaaaagaaatcctggcaaagggaaagccagtagagtatgccttggtttaagagagagatcccttttgattctaatccgcaatgacagtttcccttgctttgattgaattgacgaatggtaactactaccaggctttccctcgaggaactaatccactgagagtggtgcgttcccgtctgtgatatagacagagacaatcttatccttctctactctcgtaacaaaaactaattcatcgatgagtttataatagttaatacttatttagtcatgtattaataagatatcaggaccgtgctcagttttcggacgaaataaacatatcttgcttttctcattgtttgcttcttattgaatcgcctctctcaccgccatctccaaaaacttttttggcggtttgggagttggcttctgttgacgtgacaagttgatcgtggttgactatatgagttacatgtaggatccacatgtcatcctagctaatatcaccttctttggggttaggattcgaaggaaaggacggctctttgcgattaggatttcgttgactcgtcgttccaacctcgaaaagtagagtgtcattactgtcgagaatgctaacttgagcgctcgcattgccggtgcacacttccggcccacatggcccagcacgcgcgcgtttcttctttttttttcgcagtttgctatcgccgtttcttctctttcttttttcgctttcttttttctgtgatttttctccttttcttttttcgattactttttaaatatttttccatgattttttcttaatcttccaacaacacgtatttttcaaatgttttgtgttgaaagcttttaaatcttaacttaaacattttaaatttggagttgaaagctttcaaatcttgagttaaaaattttcaaatcgtaagttgaaagttttgaaatttttcgaatctcgagtcgaaagttttcaaatttttcaaatctggacttagaaagatttcgaatatcgattctcaagttaaaagttttcgaatctcgagttgaaagttttcaaatctgagttgaaagttttcaaaatttgactttaaaatttgaaacttaaatcgaaagttttcaaatctaacttaaaaaattttcaatctgttagtaaaaaaatatccaaaaatatcttcagaatcttacctaattactatcattagtgttggcatgtttggtacagctccaactcctaaatttagctccaggagttgggtctgaagtggagttgtggagctgcctaaacccagctccacaactctagtttattttgtgagagagctccacccaactccactcccagttttggtggagctgagactgtttggctgagctccagctcccggaggggtggagctggagttgtagctgtgccaaacagccccgcgctagcggcgcgtacgcgctagctaagagcccccattactgtagccatccaatggatcagctcatttttacactacaaatacgaggcataacaacgatcaagtgcatgcacaccagtaaattaagtacaacacccccagtgctgtcagtcactagctagctagagcctagagctgacgacaacgcgccgcacggtccgctttaatttggctctccgcaacgatcgacacgacggtcaccagcgacgtcgcgggccggcggcctcgtcgtcgatcggcctcgaattgtgagtggaagcccaactacgtcgatctcctgaattaggtggggccgtcctcccagctctgctcctgcaacttttctatgccaaccgcgcccctcgatcgccagtcgtcagggacgcggctcgtcggcatcggcgtcgatgactacggcgtctcgcgtgcgcggcgcccgtggtcctacctaccgacttagctagttaacttggtcaacctgtcacattagcggaaaccgcctcccaaaccgttgaggccttgttcagttatgtccggattcaatccgagccgggaataacaagtatagtaaaaaatttatgtatatacaataagagaccgggatttattctgggtcaggaacaaatttacttatgatagggataataagagaccgggaatcaatccactggttaagaggtgttgaactaattcgaatgttttgttgtccctatcatgtaaattggtttccggcccggaataaattccggtctctcattgtatctattataaattttttattatacttgtcattccagtccggattaaatccgggtgtaaccgaataaggcttgaaggagttggtttccatcagttttcagagatgagggaaggaggtgttacacctaattttgcggtttgagactttgaggggatacattattttcgggagcaagacatgaggagctcaaatcagttcctttccgaacacagcacacccctccttgacatgggccggcccaaggcccagcacctgtatctggttacggtatactaagtctgcagttaagtaattaattaattatggtatgtgatacttttctcaatacgtaataatgttcactttgatgttattttcatccatactatttttagataaagttaccaaaaattttaactaccttaagtttattgccaaattttagcaagtaattatgaaatcttgccaaattttggcaaccttgccaaaattttgacaacttagctaaaatttggtaatgccaaaacttgataaggttaaaaatggtagcaaagtgaacaagcccgaaatggtgtgttaaccacttcggttaattaatttcagtactcagttcattaaattaattaaagaaaggccgaatccctagaggtggggaacgggtgggcccgcgcaaacgccacgaggaagaaagagagagaaaaggttagcaactttcacgggacaaaaaccagcagactagtcagatatacatatactcctcctcaacaaaacaaaacaaaaaacgcgagaagagagagagagaagcttttaattcgaattctctctctcatcacggcttcttctgcttctccttctcctcccccctcatccctcctccgccggtagccgccggccgggagcgagcagcgagcgagaccggagcccgccggagccggtctcgctcccccctcctcccttgttcgcgccacccccgaggtacatcccgccgatctctctctttctctctctcgttggtctgctctgtgattttttttttttttgccaaggctgttctttatttggcacagagattgttttttttttccttctttgcgggtgtccggttcgagtccacggggtttgactctgccggaaatggttcgaatgcggcggccggagggcggaggaggggttttggggggcgttcttggtgggttggtttgcgccgagtctttgttaatttgttagggttcttgatctgatgcggcttctcgttgccgggatgcgcttgcctcatggctgaattcaaacaggccggtctctctctccctccctctctcccgtcagccgtgtgctttgaccgagtaagtttttgaacttcgattggttgagctgggggttcttgactttttcttactccacgaatgttcctttttgcacaatggggctactaatgaatggaaagctagagatggtgtgcctaatggtgatgtgccgtcattgtgttagctcggatttgtactgcgaatttgcgagctcacatgctcagctgatgatgtgttgatccagggagtatatataattggttggtagagtacttgctagattgtgctcacgggtctcatttcaaagttcagtatgaaatcttggttgtaaagtagtactagtgttttgttaatcgttagggagtacttctcctgcatttttcttaattttttccctttaaaaactgtaggtggatttgttattagtaaagctgatttgtgccaaatagaaattctgttttatccgcagtaaggtactgtaaacagtacttgcaggcactagggtttattggcaaggttttctatgttacattttaataaatgccacctttttcttcgtcaaaagaagccacggttataaagaaaaagtgaagcattaattgatgtaaatgcacgaactacaaatttccacaaatataaaccttttaataaaatccacaaatgaaagaaaaatgcagttcacacaccaatctctttctcaaaatttacacttttcttataacaggtatgctaaattttcttaatacaaagcatatacaaaacatcacaagcactatagacattcatgacatatctgttgcataggacaatatgcagtatgaagacctggctggtcaaaacttccgatgcacatgtgaggccctatccatgtgctttcttgatttctgctcctttatggccctatctccttcaaagcccttaaacacttcaacagtgtccaatcatactatgagactgtatggatatgggcatatggctatacttttgatgaggcaatgattttttttgttaataatagtgttaataggaagtgttgaattggttttttaaaaggaagtatttaagcattgaatttgtcatttattttgactcactaataacacagatagttctctttcctagcaggaccccttacaatatctagtgtatttatggcctcagttacttatattgatgactccggttctgaggtaattgatcctccaaagactgaggtgctggatgttaccgaacttgctggtgatcctgttccgcattcaccaaaaccaaatgtggtagtttctagcagtgtgcgtgaactgcttgaatgtccagtctgcctgagcgcaatgtatcctcccattcatcaggtgcacatataccacttattgaatcttttttgcacttaaaaaggatattttcttgtatggaagtcacttgggaaacaaaatgcgtgtttcatttaattgcattgcttttactatcttgaatcctgctatcatatttgtagtctggcctgatctatttgaacttatctagatgatttcctggtttaaaacggtcgttctgagctgctttttcacatatgttctgttccactaccaaattgttacccatgtatttaagcaccaaaaaagaagttagctaagatagtatgtacaatatgcacattgttgtactatgttgtaagttgtaaccccaactctttttctgctaatgcagtgctctaatggtcatacattgtgctctggatgcaaacaagggttcacaatcgctgtccaacttgtaggcatgaactgggtaatattagatgtcttgctctcgagaaggtggctgcgtcgcttgaacttccatgcaagtaccagaacttcgggtgtgtaggcatttatccttactactgcaagctgaagcatgagtcacagtgccaatataggccttatagctgtccatatgctggatctgaatgcacagttgctggtgacattccatacttggtgaatcacttgaaagatgaccacaaggttgacatgcataatggctgcaccttcaaccatcgctatgtcaagtcgaatcctcatgaagttgagaatgccacctggatgcttacggtatcccctcgttaactccaccatgttagttattgtgaagtatatcactgatgtttacttatgcaaagattggttcacttgtctgctaagatagtccatatttctgtactgagttttatgagcctttctgtaaaaataaacattggttcacttgtacagtatgattgcactctgtacttttcatgtcaactgaggatgctgatcatgcagcatagttattggtctaaaataatctctcacctatgaagaaactatgcatcagaatatccatctgcttccatttccaaaaaaaaaaaaaaaaactttgtctgctttacagcacaataatagcatttggacagggctcttgatctgcaaccttttcttgctgctttctaagtgcaatataaaattaagaatttccttctaatctgttcttttccattgaacaaaatggactaagtaac

SEQ ID NO: 45469 - DNA, 2431 bp, Oryza sativa
ttaacccttgcatgaacctatgtatcatcacagtgcgagaattatagccattcataggcagtgactctaaaatgaagacttgtaatgttattagcttgttttagctaccatcttctgttagattggtgcctgtggatgactagatgacagtcatgtagaccagagtggcactattgtagaattcctggcaaacttctctttgccttgaactgcttgttgagttgccattctgtggtatagggaaatctaatggcaattcatgagatgaatgtgttgaactctttttcatgtttccagcatatttctagcttctttgttcattctttcagcatatctctagcttgtttgttcattctttcagcatatttctagctatgttaaggcatgatctgaaagttcttaagaatcggatatgctgtaacaaatcatggtgaaatgtcatgtagcatgtaccatttccttttatcttaaatgctgcttttgaattggagggtgaataccagaatgattttgtaagctttttccgaataaagtttcaacttggtgtgcaagattaaatcggggttgagcacccagagtaaatattagtagaagataaaatgaagtgctgattttttttcttaaagaaaaaacaagagttgaagcgctagaatcaataatttgatctgcatcatgtccggagtagtactgtttgtacgctataggagcaataatgttgtgcccgtacgttactgccttcccttcaattgtctgcacctctgcacccgtcgtactactgtgtcgtggacgtggcaccttatctgaaggatttcacaaaatttgctcatggaagtaagggttaagggagtagtttgctttgatgcccagatcaactctaccaaaatttggtattgttaactcaataagtgtttttgatttttttttctttgccccatttttgcaagaggaagtttctagaataaccaaattttgttaatagaggctgttttgggcaatatttggattggctttggtagagtttgttttagcaacaaaccaaaacaaacgctaaaatcacacaagtgacgccaatttgggctcacatgcatcatcgtgattcatatgtcagcgttgcaatagcctgctaattacagtcgtgaatcatgtacatcatatttgatgagagaaacaataagtatggttcattgtacactaatttcgttaggtttaaatcctattaggttttgtacacactagaaatcggatagacacatgtacaatctctactgttctagttatcttgaatgatacctcatctatgccttcgcacaaagcttgtcgagtggagacagatgttgcatggtcaaaggattagcattgtcaaaactggctgaatgccactacatgaagtttccatcaaacaactggaggaactgaactggtattgctgaagatacaatgttccgtgaactgcgcatttgcaaacaacaatgctaccatcttagaagaaggggaaaaggggataacactaccatatgattatacaacggcttagttagaatgaagctattgaatcgcatatcacttcttgccaaaaaaaatgttttaatattaactaggagctaaaaatgtgttaaatcagctcgcattatattgctttgaagcagctatctatctatcatccttgaagttaaaagacaaactagtaggagacatgaactgtattctgaatataccaaacccaactatttacattgatcaaaccagcaggactacgcactgcagaatatttgttacatttgatacatacaaacccatataggctcaaatccatacactataatccccaaacgccgaacactaagcacccaaattggtcataatcacatacaatccataggccaagaaatcaagaagtgttcatcccttcttgcctctatctactactattacctataagctataatccttatattaacatggaagatttattgttgcacaaagctaagcgatcaagagcagcaattggggcagcgtaccaatccgttctcgttgcagtcgccgcagcggcgggcgcatccttcctcctggacaaacaccttgcgggatccgtcgcaggcggggcatggcacgaaccggacgcccccgcagccgccgcagacgaaggccgggtcctgcccggcggcgccctcgaggaggcggcgcagctcgccggcctcgtgcagctgccgcacctcgtcggctccccccacgaggcgggccccgacgaggagctgcgggagggagaaggggcggccccgcgccgcgagcagcgactggagctcccgccgcagcgaggcgtccatggacacgtcccgctcgtccaccgccacccggagcccgcgcagcacggcgcgcaccgcggcgcagtccgcgaacgtgcggcgcaccccgcggagcgacgtcgtgtaca

SEQ ID NO: 45470 - DNA, 2259 bp, Oryza sativa
catataaataataactttataagatttttctacggggattaatccaatcgacgcaaattatagtaatgaagtattctattatgataaaagctgaaaaaattaggtttaaaatgctcttttagaaaattcatgtatgtaaattcatagaaattcgggatgtgtgtcgcattaaaccatcacgaacatgcctgacattactgtcactacacaccatgcgtatgatgcaatacctattgactccattgaattttggactgctatcacgtgattattgtttattttgttatgatttattttatcattacgtgtacttaaaagcatggcttatattgttattatttttaaaaacatatattcaaaagtaaaaacaaactattataacttcttggcttgaaaccctataattatttcttctcttaataacattttaactggagacctctcctacagtggaattggtaaaaataaataaataaatgactacatatatatggtatagtatctctcgagtcacacttgacagtgagctattcacccagtttttagaacttttttttttttcaaattaactgtagttttatcgtgtggcccatgggccaccaagcccgtgttgtatcgggcctgaagcccatgagtccgtgacggctttttcgccaccttcctcccttccatcgttgtggataatgcggggagcaaacgccgcgcagcagggagatacactgcgagtgaccggaggcagcgtctcctcctcctcctcctgcggctgcgtctacgagcgcgtccatggcgtccctctccccttccctccacctcccttggtaactccccctcctcctcctcctcctcctcatcctgcctcctccaccccgtcgatgctgcttcagttttttttttttgcgctgccaagaaccggcattagttgctttcttgttgctccgccaagaaatgggggatttggagatggtgcccatcatccttaattcaatgatttggatgcaattggctttaggagtatgccaataggccgtatttaattcctaggagagtttcgattgagtgcagtaagttgagtctccccgcgcctgcaatttgcagtgatacacgagtcacagacaggtcaggggcttggtcattttgtagctgaaggattgcagttttggatgtgtttggttgagggttcggaaaattttccaatcagttagtgcaatgcggcagcactttggatataatacccctttttttttcttgctttgatcactagttgagaacctggaaaagtatgcaaataccctttcaatatctgaaaccttataacttaacatcagtggtgtggtaatgattaaccatgaaattttacttgctagcattattcttcaaaaacatcatggccatgttaacgggccaataccgagggtctagatttgtttcagaaaatcagctccgaagtgctattaactgaaagatttaacttgccaaaaaactttttaaattaattagttcattatggcattatgctatcactcataaactgaacaccaaacaaagagctatgttgatacaagttcaggcaggagaaattgtaggtttctcatttggtctttgaatcctatctttctagctagtaactacttcatggatttgaattataatgttttactaatctgtcaaactaaaataatgcattggtttttgttgtaaagggcaattatttatttgcaatttaatatgaaagttttgattgagtgtttatttgtcggaattaaatcagcaattcaaggactggctttgctggaaagacacaagggattcgtcttcgtgttatccctgctggcagagttggttttgtcagaacaacagtggagtgcaaagaatctagaataggaaagaagccgatcgaagtgccatcaaatgtgaccctcacgttagaggagcagtttattaaggctaagggtccattaggagaattatcactaaactatccaggtgaagtaaaagtggtgaaagaagaatctggtaagctgagagtttccaagactgtggagaccaaaagggcaaaccagatgcatggccttttcaggtaagacaattttgctttcattttcctctggttcactgttcataatgtactgtactattttattgtttgtgttccatacattttcctggtgtatcttactgtttgtgttccatatattttcctggtgtatctttttgtttgtgttctatatatttttcctggtatttcagaagtcagctact

SEQ ID NO: 45471 - DNA, 28132 bp, Oryza sativa
aggaatgatttagtttaataaaagattgatttgagaaaggactcatattctagaggtggggtaatttttctttgttgcatcgattcttctctcactatactagcttgtacacattttcccataatttcttttcaaatgtgcttataaatgaaatgcggcatcttggagtagacatatttagagatccaatcatattacacttgtatatattttgtatatcttcgggttctttagaactggtagacaaccgagtggcttaatttactgttcatgctcattcatatactagcttgtacacatttttccataatttcttttcaaatgtgcctataaatgaaatccggcatcttggagtagacacatttggagtccaatcatattacacttatatgtattttgtatatgttcggattcttgagaacgggcagacaaccgagtggcttaatttatttgttcatgctcattcatatactttttgcatgcatgtacattatgtggttttgcccgtctgctcacgtctcttacaaacgttttaagatttagagttcatttatttgttttgtttcggtatctctatatgcctctttcttgtaatagtcgggttataatcatcttttcttttgtttaatataatatatgcactgattagatgaaaaaaaaaagttctattgctggtgcctaactgtatatagacttccatgcgtattatgcctaccatgcaagactaggggttgtttggttccctcccaaacattgccaaactttcttgccaaacctagccaaatatgtggcttataaattgatggccacaacttagacatggtttggctaaaaaatggttgtatgacatgtgggcctttgaattaaaaaactgtggcatgtcacaagtttggaagtgaaacaaacatatatcttaaaaaatgtggcaaagtttgctaaagtgagggagtgaaccaaacagaccctagtagccggttgtttttcgtttttctttctcacctgagaatgcataaaccgtgttggctccatgtcaaactaggaaatgtgaatcgcattagctcatgttaaacaatgcagatttatccaggttgacaggctgttcataaagtcaatgtgaggaggctgttttgattggtgtatccagggatttgatattataaatagcaatcatatcgcgctctcgttttttcagagtttgagggtggagagatgttcttctcctaattaagttatgagagtgtttttgatggtcacgctgatattagaggccaactgaaaagtgcagattatgtcgtactgcaatccatccaaaacaagtttgcatagatatttatcacacaatcaaataaacacaacaaaagcttttatagattgccaaaatccatggtgggatgtgtatcacaatatatgctgttaaataatattcccaattgtttaactcacaacaactaaacttggttttggaattccaccaaaactaacaaactcataatttataatttgtgctcatggatggatgaaggaatataattgccaagggtcatcaaaaccgagaaataattaatttataatttgtgcgcatggatggatgaaagagtatacctaccaaaggtcagtatagtgagttcaaacttcatttaaaatattattatttctttacttatatgatgctagctaatttttttcattacctttacagactagaagcaagttgtttgttgtttggcacaaatctacatagcaagagaatgatgtgaaatcaatattcttaacgatgaacgaaagttacttcgttgtatcactaaatgtgttacaactagttaactggttatttgatatatatgtagaatgtgtctagtttggaccgattaatatccacagcaggttaatgaacccatcaacatatagtttgacatcttaatctgaattataattgtatataaacatttttgttgttatttacatcattataaatagttaatacatcagtacatacacatgcatgcgtcacattaaattcattttcccaaaatcacccacggtttgctaaatccgttaatgcatacttttgctaacaatatacctcatgtcttatacttattggaatatatgacactaaaaagtattaagtaaagtgcacagtcggtctctaaacttatgtgattatatcatctaggtcttcatattatttaaataagatttagattctaaaacttgttaaattgcttcatgctatacgcgtttgatgatagggtgctacgagtggattccacctatccattcgtcacggttaaatccacatgcttgtactatgcaagtgtagaccaagctccagtgcaccatggagtatgtatgggacgggacctgagttgaaagcatatgagccaggataaattttcatcgtgatctcgtataacaaaacaaaactaagagcctcctgttatacatgctctaatgcgtgttgcctctcgtgttatattttgaaacgaacagcacaaagacaatatgatgtttgcatgaaccctgaaagatagtagccagaaaaaaaaaacagaaaaacaaatcatcattgtcgacgggggataaccgtagatcggatatagagggtattggggtacgctggtacgaggatctacgtaatacgacatcgagcaggcagaaaacaaagattatactggttcaggccccttgataggtaataaccctaatccagttgatatgggattatatggtgaaaaccacagattacaaagagaatagtggaactcgatgataccgacgagatcatagtcgagttgattcgactagatctcccggcgacttggctcctgtaagctccggcttcgtaggctgtggtggatgtgttggcggtaagattcgatgccttaggtccttccggggggtcccttttataccgcaggtcaactggtctccaagtaggactcggagacattggacccgacacgatacaatgacgacccagttctatccgagtaggactccttacatctgtggactccataatggaattccttaacttatgccgaaaacgtccgtatacgcgcaagcataccatatctatatgtgacgtatatcgaagggtagagggtataccttacccgtaaccctgacagtagcccccgacttctgcttaaatgaactcgtgagaccgatcgcgacttctgatgtcgaagttgtcgtcgttctcgatgtgaggaccgagagacgaggagtgatcgacaacgtcgggtgaagctcaacggtcatgagtgaatttaaattgaagtctgaaaaactgctgcgcgtaacggacccataaatttccggcagccatctctctcctttccttggaattcgcaccgtcggaagtatccaatttgaagtccgcctgttgaaaaaaaactctccagtttccaagcgttcctcgtcctcttcgctcccgcaaaaaccctagctagctcatctcggtcctttttccggcaatctccggtggcaatggatctcgacaagtctacctccaccaacgcatcactgaagaaactgcaggaggatggcgcccttcccggtcgcgggaccgcggagagggaagtaggaggtactgaaccccagcctgtcctgggtcgcatggttgcgatcgaggactttattctctgcggtttttttcctccgccttctgaatttctccttttggtcttgaatttctatggtctttccttgctccatttgaaccccaactccatcgccttcccgagtatttttacgcatctttgtaaggcctacattttggtagagtcgtttcttgacctcttccacttttactatgagttacgctggatggaacctaaaaaggtgtccgggtgtgttggtttccgacttcgggatggcctgaagtcgcgatacatccccttccagtgcccctcatcacgcagcaaatggcgggggaggtggttctatcttcagatagaggattcggatccagtcttcgttgttcctgaggagcaaccagacaagattccatcttgggccaccaaacccacctagaccccatccctccaatctttcatcgatatcgttgacgacctccgagaacaggggttgtcggggtttgaagtcgctgccgacttcatcggtaggcggatccagccgctttaggctcgagcccatccagcctttgattattctgggccagagaacgcaacccgggtttctcctcggggtattttcctttttagttaaattgactcccttatgcgtgtgtccttcccaacttatcggattctggtctcgatctacaggcttggacagcgccaccgtggagcgccgcgtcagccaactgatgatcagtggcccgacaacggcgagcaacgtccccgtccccctttgcgagaaagaggcagccgagcgcgacgctgccatcaatgtaagtgtactcagcggtcttttcgcatttttcttccaagatcacattatgacttcatgaagcgtaggctctccctttgactgatatcatcgggctgctcgtggaccatcaggtggcggtgtcgctgaaggagaaagtcgccaaggaggcgtctgacactgctgccgccgctgccacaacgagtggcggcaacgctccgaaaaaggggaggaaattctcctctgtggtcggacaccgtcggaagacgcccaccccctcggtaagttctcctgccctttgatcgcgtagtcggaaaacttccacctcacatcatatcggttgtactccaggcctcggacgcgtctcccccacctccacgacggcagaggctagtgacgcttggcgagaagtaagtggatgactttgaggtcttgtctcttcgtcaaactgttgcagcctgtttcagttgcggattttcgcagggcggcatgggcgaaggcggcgcaagacgggtctagagggacctcgacggatttcgtggtcgcgcccaggagccgcgaggcgacacctagcggcccaactagcgatcttgcggctggtcggggtctgccggctgccattctcacctgggaggagctccaggttgagatggggcgcctcctcgaggctagtgctcgcgacattggccgcgagattgcggaggcgaggacggcggcggcgttgtcggcgaatgagcgcgccgaccggctggcgcacgatttggcggaggttcgcgaggacctccagaagatgggggaactggtggccggcaatgagcgacaacggcagggactcgagcaccgtatgtcggagctcgagaacaacttgtcggaaatccgtggctcgttgcgggtcacctatactggactgcaccagctcgccggggagtgcggtatcaagtttaccatcccggcgaatcccgatgagttctcgctgacgtcttctcttgcggagctggcggcggcaatggaggagatcccctccaagcatgcggccaggatcggagaggagacgtccaacgggatctataccggggcgtgccacgtccttgcatgtgtgagactggcgcacccaaaactcgatctgcggaagatcttggatcagggggcggctagcgacgcgtgcaaggatgtgatggaagaagtcggcgatctgggggagtctattctcccacttgttgaagagtaggattttgactctcttgtactctttagtcatgctttgtaaaactttcgttggttccaaccacctgtgtgtgtgcagtcagcgccttagctttctttagcattttgatcttgagtactttgttgtcgtttgtagagatgttgatgtcgaggatgtccagcagcgcgggcagcctgagctgccagtggtcgttccgttacttgcgtctgagccacacatgccggagggcgatgtagctcaaaattcgcctgtgggaatgagcatggcaacgactcccttaggttggttatctttgttttcatctcctttattcttccgtctggatcgacttgatttgctgtattctcgggagagaagagcagtctaacttagtcgtttccgtactgagcagacctcgagagtgcgcttgctgaccaggatcgtcgcatccagtattggaggacgaagtttgaggtcgcggaactcgagaggactatgttggaaatgaggaaggatcaggccgtggagacgctctgtggtcgcgaggtgtggttcaactcgtatctgaagagttgttgtacctccatgttaagagtctgtaaagagctccgagtaccccgtggggatcccgaggaatcggcggctggatacatctcgtggctgaatggggcctgcgcccagctcgagggcatcagccagcgtatcgacgaggccctgaagcaggagtgtcgtcggtcgagccgatatgccggggggcatgtattggcttgtatacgagatcatcgtccgtagctgcacctcgagttcctccacgaagggttttctcgtttttggagaactcctacggagatagatggcctggcgaagtcgatggcgccactggcggaaaaggtcttccaatctatggactggcgttggccttcctggtagtcttcgtgtcctgtgacaaatgtcttaggggaaaagtgtaatataattttggatttttatggaattgtaagaagtacttgtgaaatagaaaagaaatctatctaactaagctttcttactctggatgtagcgtgtatgagtgtcttcccagttcgcgacttcgatcagtcgtttgagttatacactctccctagcccccagccttgtcatcggagaattcttctcggaagataaggctcttggacctttgacctgcctcggttgaacaagcactgatcctagcccccagccatgaagttggaaaatttatttctgattacacggcttggttaatacgcacggcgagaactcttacacgactagatcttacatggtctttcgtctctacaggatccgacaaggccttatcggctctgggcgtccccagccgaagttcccttaggttcctcggaggccttgtcaagacgacgtaaagggacatgaggataggtttcaacactatgtgtcatttgggtaagggatcattgggaaggaacactttgatcgtagtctgtacctgaaaaataggctttattgaggctgtaagatgtcttacaagtatggatactattgacttatacatagaatttacgtaattgatcaatgttccaggaatttgccaactcgcgaccattgccgtctgcgattttgaatgcgcctggccgcagaacttgtgtgatcgtgtacggtccttcccatttgggtgagagcttgttgcgccctgcttggctttgaacccgtcggaggacgtagtcaccgatcgaaagcgtgcatgctcggatgcgcttcttgtggtaacagcgaagggcctgttggtagctggctgctcgaacggcaactcgttcgcgatgttcctcgagtagattcacatcgtcgtatcgttgctcctcctgatcctcatcggaatacttatgtactcgtttactttgatgtcgtagctcggtggggagcatggcctccgagatgtaatagactggtcgttgcaccttctctctctcgacaacaatgacagtgctaacggaatatggcgtggcggaaatatagagaaataattctttattaggttgggggcaacaagtacaggtggatttgataggtagcgcttgagtgcaatgaatgcctcttcgacttcctgtgtccatacgaatttgtcttgcttttttagcagagcgaagaaaggttgtcctcgctctcccatcctagcgacgaacctgcttagtgccgccatgcatccgattagcttctgtacttccttgagtcttgtaggcgacttcatgttctcgattgccttgatcttctcgggatttgcttctattcctctgccagagacgaggaagccgagtagcttgcccgatggtactccgaacgtgcacttctctggattgagcatgaggcgatatcgttggaggttgtcgaacgtttcccgcagatcgtcaatcaatgagtcacttgtcttggtcttgacaacaatgttatcgatgtaggcttcgacattatttccgagctggtcgctaagtgcaccttggaccgtgcgctggaaagtgtttcctgcggttattagtccgaacggcatcttaacgtagcagaataccccgaacggcgtgatgaatgttgtcttctcctcgtcctctttcgccatgctgatttggtagtaaccggagtaagcgtcgagaaagctcaacaactcacaaccggctgttgagtccaccagttggtctattcgaggaagagggaagtgatccttgggacacgccttgttgaggtcggtgaaatcgacacacattctccatttcccgttggccttccgcaccatgactaggttggttagccactctagatagagtacctctctgatgaaaccggctttgagaagtttgtcgagttcttctcgtatggcttgttttcgatctggtgcaaatctctgcagtttttgttttactggcttggcatcgggtcgcaccatgagtttgtgctcaatcacctccctgggtaccccgggcatgtcggacggctgccaagcgaacacgtcagcattgtcgcggaggaaggtgatgagcgcgagttcctatttctcgcctagtgatgccccgatcttgacggtcttgttggggttggcactggagagtggaacgatcttgattgcgccgtccatttcggcgtcttgtttgttttgctcactttcttgggtggctcagctgtggcgagtgggctgggtgtgtgctcgagcatgtcaaggctccgcttgtcgcattgcactgccagcttagcattcccttaaatagtgaatgttcccttcggtcccggtatcttgagcacttgatacgcgtagtgagatgcggccatgaacttcgcgagtgcagttctcccaatgatggcattttatgctgtatcgaattcagcgacatcaaaggtgatctgttccgttcggaagttatttgcttggccgaaagtcacaggcaacgtaattttgcccaatggtttagacgatgactgaggagtgattccatggaagggttgattggtgggtgtcaactctcttcgtgggatccccatcgcgtccaaagcgctggcgaagaaaaggttgattgagctgccgtcgtcgatcagaactcgcgtgaccttgatattccgaatagtgggttcgaccacgatcagatattgccctaggatgatggcagtattggggtgttcctcttctgagaatactatcttctgttcggatcacttcatcttgggcgcagccccctgccacatcgaacaaacttcacgtttcaccttcttgtattctcgctctgaggagtatgtcgtggaacctccgaagatgtgcgagacatggagatcggagtctggatatgctgagtctgattcctgagtaaccgcctcagcgtccttctcgaccacacgtattcgcttgcctttttcaaataccatatgttttacgagcgacttattgaagacgaggcaatcttctagagagtgtctatctgacttgtgtatagggcaccatattttcttcgcgtcgctgccttgtgggtctgggcgcttgggagggtccgcgtattctgctgcgagaacttccgcttgagctttccttttcccactcttgcgatttttcttcttgcttgactcgggtgcgtcctttgctggtttcttctctcctccggtcttcggtttgtcgttcttgcgtctcagtgcgtcgtccgcatgagcgcatcgatcgacaatttcgaataatctccgagtagtcatgacgcgcctcgttgccaactcctaagtagtatagcgatctctgacaccggacttgaaagcgcgaattacagaagcgtcggtgatttcagggattgtatttctgcactcgttaaagcgccaaacataatccctcaaggattcacccgggttctgtgtcaacgcatgtaggtcgtcttcgatcgcgtggcgcttgtacgttccttggaagttggcaacgaactgctgccacaggtctgcccacaaagaaatcgagtaagggggagatgcatcagccatgaacgtgcagagcctttcaatgcagttggcaagtaattcgccaatgcgttgtcgtccgctccggcagcgtagagtaccgtggagtagacctgaaggaattcttctaggtcggtgctcccatcgtatttctctattgctcctggttggaacctttcaggccatcggacatcttgaagtgaacgaccgaaagctctacacccagcgctgggggcggtgggttgtcggcgatcgtacgtccttcgcggatgtctatctgatgatgaggatgaggaagatgacgacaatgacgatggatcgcttggttccggcgtgcgattacgaggacgtcggccaggttctcgagaactctgtcgtcgtctctcgttgttgtctcggcgctgatctccatcatcgtcgtcattatggcaacgtcctcgaccagaatcgcccagcacccgccgctcgcgatcgtcgtgatcgcggcggttgtggcggttatctcagtctcggtcttcgctcgaacggcctcctcgttcttcgttatcgtgacgccgtgaagagacgcgatgtcaggaacggttctcgtcgactcgtgtgcgtcgcgcctctcggcggccattcaggtgatcgcggagatcaccggtgccgcgaggtggaggggtggctcgatgaggcgattcccgctgttcagggttttcaccattagcatcgccagttggtggctgtttcgggtgcgctgcagtggcggcctcttcgaacgcgttgctgaggttggtcactgattcccataaccgctttgtccatcgtgcgagatcgtcgttcagaacggggtcgtagggagtttccctcagtattgcgttgacggctctaatgtgctgggccggtgtaatcacttgattctccgcttccgcattggtgcatgctgacgtgccgacatcgtcgatagccaatacctcacgcggcatactcgttgtcgatgaaccatagtcttcgagcaggtgcaagactgatggttcgtggggatcgatgtcgattactccaacaaatcgatctgaaatcggcgtcgctccttgttccttgtcctcatccctgaagggaacgcgtgactgctggaccttaggaggtggcgtcttcatggcgctgagaaagaccttgcagctcgagaggttgtgattctttgtcttgtgaataggacaatagacatcacgagttggagaggtacgctgaattccatgctctttgcaggcacgaatttcagcatggacgttgaggaaaacccagcaggcttgcaaggtgtgttttctggttttgtggataggacaccaggaccttgtcacctcggaagtaatcctcgtcggctcatgattcctgtcgaaaagacaaggcttagccgcactaggatctcgaactcggatgttgtcgatgttccgatctccgcttcggcaggaggatccttcgacatggagtcgccccgggttgtagccactgcgttctcgtttccggtcattggcggactagctgagatcggcactgtggtgtaaaccggaaagacgatttcgccgacttgagtccacaccagtattgttgaagtaggaactctttggttgaggttggtattgacgctattgtcgacgaagctggatgtcatagtagtagaaccttgagcactaagtccccctacctggcgcaccactgtcgacgggggatacccgtagaccggatatagagggtattggggtacgctggtacgaggatctacgtaatacgacatcgagcaggcagaaaacaaagattatactggttcaggccccttgataggtaatagccctaatccagttgatatgggattatatggtgaaaaccacagattacaaagagaatagtggaactcgatgataccgacgagatcgtagtcgagttgatttgactagatctcccggcgacttggctcctgtaagctccggcttcgtaggctgtggtggatgtgttggtggtaagattcgatgccttaggtcctcccggagggtcccttttataccgcaggtcaactggtctccaagtaggactcggagacatcggacccgacacgatacaatgacgacccagttctatccgagtaggactccttacatctgtggactccataatggaattccttaacttatgccgaaaacgtccgtatacgcgcaagcataccatatcgatatgtgacgtatatcgaagggtagagagtataccttacccgtaaccctgacaaccaccaccacacatcgacaacatctacataaaatcaagaaaagagttagcaccagaccagccgttgctagacaaaaaaggagctacagccaaaccgttcaaaatcaaaccctaatagacgagcccctagccttctagatgttgtccggacgaaaaggatatagaaggagagggcaagagagaagaaagatccctctccctcggatagacccaccgatcggctgccatccagcggcttcgcatagactgtctaggaccagttttggcaaaagggggcctcctagatgacgtctccatagagaagagcgacactattgtccctcgtggtctctgtcagggttatgaataaggcataccttctatacttggagtcgagagatatacggatacggtataccttcaagtatacgaaaaggttacttttgggttaaggaagtcggtgggcttctcaggaaataatctctacaaattgaaggggtcagagtcctattcggagaacataaggattttttcatactgtgtgaggtctgttgtctccgagttctacttggatattaaggtgatctgtggtataaatgtaggccccccgagggtacagatcatcacatcttagtgcaatacacccaccatagtaggagcaatccagaggacttgaagccaactcgccgatagatctcatctagttgttctcgatagggatctcgtcagtaatctcaggattctattgttctctattgtactctatggttttttttcataatcccatataaaatggattaaggctattaccttacgagggggcctaaaccagtataatctttgtttcctgtgagcttgatgtcgtatcaacatacctcaatacccttagaatacggtcggcgggtatccccccgtcgatagtttcaaggagatctaagataaggttttcactaggaaagaagatggacatctcgacaactcccccaagagtgaatacgacgcctaaaccgtgtcgttgctgacccgacaagactgggctaggctttcacccacctcctgtcccctgtcgatctactgctaccgctccattgcaccaccaccagtcacccatcataagcgccaccgacacctcccgtcgaccatcctccgcatgcctccacatgctaacatgacacacatgccatcactagcctctcgccgctagtcatgcatgcatcctcgccgttgcccgtgtcaacctcccgtgttgctggtcttcctatcatcgttagagtcaacctccagcattcgtcagcctccctgttgtcacctgcattggccacacatgacctcccgctgttgccacgcgagtggtgtcggtagtgctgtagccactcccagcagcaacctccgggaagaggagcaaccactgccacacctagtaacagctgctcctccacacacaccgtcactagaggccatcaccatgtgcttctccctcaccaccgtcatttgtcatcaccgagagctacctcgtcgggggaagctagagggagctatgctggaggccgctggatttggcagctcccgctgccacctccgagtccacttctcgccaccctctgccatgccgcctagtacccccacccttctccaccatgccgtgcgctaaccttcacctcgccagatccgtgaaaagggctagatatggacagtgccacctccttcttcccggttgcttcagagcccatattaacgcgacgttctcgaggaggaaaagagttcggcatcatcttccttgcaaccacgtggcttgctgacgggttgctccggtggtggcaaggggcagaggtgcgggggtggctgcgtcgctcaattggttgtctcctgtgtcatcccggattatgatcacacgggtcctctacttagtgagccatatgccacttagagggtggtaagtgggctgcgagctagagcgtatattctggtcccgttcatttcttcaagagttggatgaagataaaaatttttgtgacacgtttttcaaaccgctaaatggtacgtttcgtacgaaaattttctatatgaaagttgctttaaaatatcatattaatatatttttaaagtttgtaataattaaaactcaatcaataatacgttaatactatatcattttacgttaataccatatagtagtagtttggcacgagaaaattgttccccgatcgtgcttattcaaatctacggtgagagctaacactacgtggaagaagaaccggacgtcggatgcggcgtcattgcaggatcggcggcgacgccgggggcggcgtgctgtggctgagccgcgccgcagttcgcggaccacacgcccccccaccccccgcctgccgcctggcccggctgccgccaagtgtccgccgccgcgtcgtgtcgcgtcgcgtcgctcggcccgcctcgcctcgcctcgccaccaatatctccccccaacctcgccgcgcaacgcgcaccccccgcgtcgaacacccgaggaccgggagcccgcgatggcgatggcgatggcctgcctcaaccctctcgcgctctccccgcgcctggcctacggcggtagagcggccccgcggcgctgctgctcggtggtggtgcccacatcctccgcgcgcgccgcggcgggtcgctgcagatggcggctcgcggcggtggcggaggagccgcaggccgtgcggcagcaggagcagcagcagcggacggaggggtcgggtgaggccggcgcggaggcggcggccgacgcctcgtccaagctagttctcgtcgtcggcgggaccggcggcgtaggtaaggagacccacatctctagcccttctctccatagcttcagtgtcaccttctctccattggagtgtcactactgtgtgagtatattttttttttcacaaaatatttcgtagcattttactatgccattatctgattatgtcaagctcatcatgctggtaattcttttagttaagcgtacatttgctctgcattttaagtgataaatatatgttctgcagttgtctagatattgattgagcagatctgtcgaaactagatttcggcaataataaaagggggtggctatcaagctcggaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatactggaaggagtccggattacaaaagataatctatattcctaacggaatatgaagatagaggtaaaatacagtcgtaaccgactaagtctcagggtgtttccttgatacacaagttaagaaacaaacccgagatacagataagatattctatctacattaagtatccggtacccagttcgaataccatcgccgtgtagatatgggatacccataatctccacaagatccttgcagggcagttggtggtggcatctttactgagcaggaacatcaagacaaggttgttgctaagagatcctgcaaaggcagtgaccctattcggcgagcaagatgagagcgtatttcaggtgatcttacatccagagagcttgaacattctatttccttctgtgtaaattttgctcatgtaaattgttacttcatggaaggcttacaaggctgacacgagaaatgctgcagaattggatccagaaatatttgaggttcattttcttgtgttttattgttttgaagctgaaatggtagagcgttatgggctttctatttatgcatgattgaataaagcaaaatatagggatctcttttcacagggagttacgcatgtcatctgcactactggaactacagcattcccttcaaagcgctgggatggggataacactcctgaacgtgttggtacgtactgagtaaagttcttcagttcttgttgaaaccatctatttgtttgttctacgtacgtaaatggaacagtgatggttgatcttgggggatggatgatccttgggtaaagtctttcaatcccctatggacaaactaagaattcaactgtggcagtcgcggagtgctaataagctgcttatgatatttccagatcttggcattcccattgacagagtttaatatgtaccttttgttgatcatgatcatgcacactacagttaaattcattccctgtgcattgatgttaatgatatttcttataagttataactgatataacctggtctatctttgtcacgcataatgagctagcaacatcagctatgtgcctatgtcttgttgtgtttttttttttctgaacacacaccattttccctttctagattgggatggcacccgtaatctggtgagcgccatgccacggacaatcaagagactggttctggtgtcatccatcggcgttacaaaatacaatgaactaccatggaggtatactgcagaatttcaacgaaaaactttggtatcttacagttgaacttcctgtcagtcatactagtctccaaagtctaaagttgcatgcattccatgagctatcctgaaattttactagagtttaatgaagaatttatatcctcaatatacttatgagtttaatttagcaatggtttactgtgagacaatgtacttgctgtataagatttgcatgcttatgcttccaaaacccatcttaatcttgaattttagttcattaagtctagtgtctgcttcctcaacttctattgcgtcacaattttaaccttcactcatgctatgcatttttcagtatcatgaatctgtttggtgtgcttaagtacaagaagatggcagaggactttgtccagaactcaggcatacctttcaccatcataaggtattgtgcacataaatccttttcatggctcacaacggatacatttttatgacccaatactagctgcattgcaggcctgggagattaaccgatggaccctacacttcttatgaccttaacacacttcttcaagctactgctggagaaagacgggcagttgtcatgggcgaaggtaacttatactagttgttattaatggatttctgttaagctatcttattcttgcaactcttcatcactacccctattaggtgacaagcttgtgggagaagcaagcagactggtggtggcagaagcctgtatccaagctttggatattgaattcacagaaggacaaatatacgagatcaactcggtgaaggtatttatgcctggtgtttgatatttcctcgtgcgtgtgtgtgtgtgtgttctttttgaaaaatggcctttggttacgttgaaaactaaatatacaaaagctgtctagttacgttcaaactaaattatttatcttttgactgaagtgtcaattatcacttcagggcgaaggacctgggagcgacccagagaaatggaaggagctgttcagagctgttcaatgaaattaatggcattagctcaccctcatcgtgatgtattttgttcatgtatagtgtactttagtggaattccattgaggtagtttagtccattgtagttaactagtagtgtacaattcatatcatcatgtaatgagattttagcaattctaatcccaagaccgcattggtggtaattagatttggtactaccactgtcccaaaaggatttcatttctagccatgcatttgggcaagtattaggtgtatattgggcaggtattaggtgcatagtcaaaagtaaaatcttttacgggcaaaggtaggtagtaaaatgaagtaataactttttggctatgtatcggatatattcttttccagacatatagctaaaagttgcagatggagagaggtgtaattggcattcacttctaaagggtcaagcaaatactccctccatcccataaaaatagctatgatttagatttatttttttatgggacggatggagtacatcattttgttcttagagttgtattttttttcaatttttgggtaacttctggtcggttctaacgggaggatttatgggaaaaaaaaactgaactaaatattataaagctaacaagtaggcataggttaaaagaaaagttatcttagcgatcctaatgttgaaaaataattttcttatagaaattatactttttaatgtaaaactattacaacgttagatttttattcctttcattctaacatgttaatttctaagccttaattaacatctaaagctggaggttccacgaagatggaccagtttggcacaacttcaagtctagctccactttttcgtaatctggagtacagccaaatggcttcagctccaccaaaataaatggtaagagtgaagcatgttgaaatattcttataaaataaactagagaaattaaattgggctttgcgaaattcagagtaaatttttaaagttaaatccttaaaaaacatgccctcaccactacggtctacgggagagggaagagacagaaaccccgaaaccccccaaaggttcccacttcctcccacccgcccaaacccatcctccgccgccaacgcgccgagagcaaaaaaagagaagcaccgggatgctgtacatcgtggggctcggcctcggcgacgagcgcgacatcaccgtgcgggggctcgacgccgtccgccgctgcgccaaggtctacatggaggcctacacctccctcctttccctcggcctcgacccctccgcgctctccaacctcgtgcgttcccccccccccctccccctccccctcaccctccatgcccgccacctgttcgaccaaatgcctgttcccgctcacgcgccatcgccccactgttttcttgcgcaggagaagatgtatgggaaggagatcacggtggcggaccgcgagatggtggaggagcgcgccgaccagatgctccgcgaggccgccgacgcggacgtcgccttcctcgtcgtcggcgaccccttcgggtaatggtttgctctctgagagccttctgggtactgtaaacctttgctcttgtgcgacagcttttcggtttatgtcctgtttgaatgacaaattgcagcgcaactacacacactgatctggtggttcgcgccaagaacatgggggtggaagtgaaggtgatccacaatgcgtccgtcatgaatgcagttggagtttgcggattgcaactttaccgctacggggagaccatctctatacctttcttcacggagacatggaggccggacagtttctatgagaagattcagaacaatcgacggcttggactgcacacactttgcttactaggtttgtcatgcttgcttgatcatttatttcagtgtagtcaaagctcggcattcttaaggagagaggcaattgaacttgaatggctgctagtggctgacttcttttacggttaacacttccttacaaattacaatcatggttatggatcttggttcttatattggcaaatacaattgatattcaaaatgtaataaccaaagtaaacttttaatttatatgacagaccctggattgacaggtaaccactatttcctgtaatttattgatatcaacagctgatcctgaactgtcaaatgaacttgtcaggtgtaattttgtacatgcaacacttcatacgtctagcctaaatttattgacgcttgataatctttatggtttagtactttcttttcaagattaatcttgtgctactttcactttttccctgttactgcaagcgggcttgcttgactgttccttattaaagaaaaactgtggtttgattatccaatgcagatattcgtgttaaggaaccaacgcttgagtctttatgcaggtaaattgcatgatttcctgtctagtgtcagtagtgtgcagtgcagaactacaatttcttcttagaattagctatgtgctagagatgcttcattgctatgttctttcttcaaagaattgatcaatattctgtgcggcacaagcagattcatctgttgaatttttatgttgccatttaggatatatctatcttttgccattatattttatttttatttctttcaggggaaagaaagtgtatgaaccaccaaggttcatgtctgtaaacaccgcaataagtcagcttttggaggtggaggaactgcgtgggggatctggtattctcatggaatctctgaattaatttcccaagttaaaatgctcttgaaaaacagctgttagtctgcctatctaagtttaatgtaccaatctaaaaagggatttcattatgccctgcagggtaactatagctagatttttggacgttgcttacatgttctacttttcataggccagtaggttttacttctagattagcacttaaaaatcacttgtttccagcatatggcgcagattcactatgcataggtgttgctcgccttggaagtgatgatcagaagatcgtcgctggacctatgaagaaactactagatgtcgatttcggcccaccccttcactgccttatcatagtgggagagacgcatcctgtggaagaagagatgatagaattccacatgatcaagtcatgatgaatgaaagtgcttttatgtgagtttcactcctttcttgcaatgaaaaaaaaaaagcaatacttgtatgctttcattcgttacaaagcaatttctacaccttatatcctgtggctaatgttgagtcaatactcatttgcctccacaattttgaatcagggccttgtagctggatacatgatcccaggcttatagctcccttgaaacgatacttcgatgcttccgcccgccgtgaaaggtccaccagtagtagtttactgctccaattgttgctcatttttaagttaaactgggatcagctgttgttctttttttggcctgataccgaatactctcaaaccagtattgaaccttgtttacattgtgtgagctcatatttgaatgtgttcgtgcataaatcaccttgagatcaatgttactcatcaagaaacggttaccggaacattagctacaattgtggagtataaactcgtatgaatgaattgtggtaacccgtagtacgatttcgtgtcgtccgatcttctgtgccgtgtttcagatccatcttttgttgtctcacagctcagtctgagtctgggaagccttccagagttccagttgaagaggatgaacagtcacagaaaaaaaaagcaggatttttttttttttgctttatcgttcgttgcaaattacatgcttgatgatgctaattctcttcaccggataggggtgtactgctccatctgcagctggtgcagcgcggcctcggagccgaagctgtggcgtcccggcgacctccgggaccgggacctcgtcggcgtcatgggccccttcacccgcggcgaccgctgcgccgccgccggccggctggacctcgcgaagacgatgtcgctggcgatggacgggatcggcgacatggaggggatcggcgacaggaggcggtcggcgaacgggaagcactgctccgagtaggcgtccgccgcgccggcgccggagcgctccttgggcgtgctcatggaccggaacttggccttggccgacgccgtcgacgccatgtaccccgggaacgccgccgcgccgccgccgtcgtcgtccctcgccggcgtgcgcctcccggcgcgggtgaatgaccgcctcgccgagtacccgagctgcctgtcggcgtcgtcgtcgtcgccgccgacgcaggcgagcctgtcggccctggacctggaccggagcaccggcggcggcggcgggcgttcgtcgtcgttcatggcggcgccggcggcgtccctgcttggagattggtgcgcgacggggatgtccttatcgaacgggggctgcgacccgacccattcctccagccagctccaccgctggttcagcgtctccatctcctcccggctcatcggctgcctcctgaccccgaccttctcctgcgccaaaaattaacagctctcgatcagtcaccgacgagtgggcccagacagccggatcgcgggggccccgcgctgtcagtggctgggggacgtgacgtcatgggggaggtgaggtgacgtacgctctggtggagcgaggcgtactggagcgcgcggacgcgcttgagggcggcctcctccctgctccggctcatggcgctcatctcctccttcgacagtgtgctgctgtcccaccccttgctcagctgctgttcctgcacaacaacaacaaccaccaatcgcccttcagattcttcagtaaaatgaaatccattcactggctcgcccaccgaaatatgccaagctctctctctctctctctctctctctcttttccctcttctttttactgttactatgagcattggcacttgcaggcatggatcgatggacagacaagtataggaaaagaagagccagattacagcagaaacagcagctgatggtgcaaagcaaaatgttgtgagtagtactactactacagtgctacactggacagtgctacattgggcgcaagaacagaagcaacgaaagaatcggggcatatgcatgtgcatgtgtcctggcgatggccgcgcacgacaccgacgtgacgcggccgggtcgccgtctgccgtgccgccaccccgcaccacatgccgcgcatgtgcccagcaaatcattcgcacgttcctactacctagctatagcagctagctggtgagagtgttcttttactactagtgttacttacgtggacggcggcggcggcggcgtagtacagctcccggcctcgccggagcagcgcgtccatgccgtcgggcgccggcgaattagcggcgttgtggtcgccgccggcggcggcggcggatgaggccctggcgcgctgccgcgcctggatcttcatgagcgactcgaggccgcgcagcgtcgccgccgtctgccgccgcaccgcctgcccccggatcagcgcctgcagccgcaccaaccccttcaacgctcgcaacgccctcctcgcctgtaaaaaaacaaaaagaaaaaaaaaaggattaaagcaacagaaaatgtattgatacgaagacatttttggtgagcgacatcaaattcactgaaaattggacgaattatcaaatcgctacgaaatccattgaaaatgggggctataaattttgaaggtttgaagcaaaaaattttagttgtttgttttacttacgaggtatccacggtagacggattggatcataagggcggcgtgttcgtggccgtacggcgtcggcgtcgtcgtcgtcgccggcgccggagccaatgcggccgtcttcccggtgaggcggaccacctcggcggcggcgtgcgcggcggcgacggcggcctctgcggccgccgcggtggcgagcgcgaccgccatcgcgtgcttgctctgctcgtcctccgcctgcctgatctgctcctcctccaccgccggcgccggcgccggcagcgcgaacgagtgctgcgtcttgagcttgcccgcgaacatccacctcttgctcttcaccttctgatcaataaatcaatcaacaacaccacctcctcgtcagctcaactcatcaatcaatcaaacgaattctcgcaaaaatttcggcaaaatttgtggcaagaatgaatcggtgcaaaccttgtccggcttgggcttctgcttcggctcggagacgaagagcctcttgatgcgctcgagccatcccctcctcttcctctccatgtcgcagctaagcttcgtgcaagcttagctactaactagccttactacacctcgtcagtgtctgaaccgagcaaaatctgaagcaagaaacgcatcgtcattaccagaaatgcagatgaaataatagaaatgaaaaacaagaattgggagtagtagctggcatgtctcaatcgtaagatccaaggaaatgttgactaaagcttcggcaggacgagggcactttgctgccagcacaagctactgttcgtcagtggtgacggtcacagtgtccgagcaaaacgaagaaatcaagaagcggaaaaaataaaattcagagcaggactgctgctgcattggattcggttgatgatttgccgttgcatttgtcagtaatctgaagttttaacagtttttaatcacgcagtgggagccatttagaggctaaagccaagtgagtgattagctgggtgctttcttgtgtcacctgctaaaattccaaatagtagtacaaatcaagcgaaaaacaccaaccggaatgcctagttttgatgcgacaaaccgcagctataagctgtaatgttcagagtgtgacgggtttctatctgaatcatctcatggcaactgaacaaagaaccaaccataacactactagacagctacatgcgtcgcatctgaatttactctgaaatgactgcaccaacgaaagaaggaagaagactgaagaggaaagtgaaaacaatatcgaatgaatcaaccacgagacccaaaagatgaactgaaaatcaagtgatccaagatgagagtaccttgcagagtaatggtagggatgctagctctgagtgatccaagaactctctcactttcagcagctgcttgtggaggaggtggtgatgacacagacaggaggctcatgtaaggcagatcatgctctgcctgccatatgagggaggaagaaccaatttccagtggaaagccagcaggtcatgcctcaccatctcagagagaaccccacatgatgacatgaatcaagagcgctctctctctctctctcaatttatacggagtacaagatgtacatttgcaaagagaccttcagatttggcaaggtgtgaaacgccctgcttcctctgccatgtctgattacctcaagacccctctcaacttaagtactcctacttaacatgtgagcttgccgctaaactgagttgttgacagtgagaaaagataatactccctctgtcccataatatatgtgatgttgaaggaaatagtactagaaaatgtcacatccctctaaaatcttttagattatgagacaggggagtactatcaaagtacatgtgtgatgtgtgtattccttttacattgtatacacaaagaaaccaaaaattaggtgatattttacagaaaccaagggctaaaagatgcactttttttttcagcccgttgatgcagcctgcagcgtgtggtacattggtactagaaaacaacaaacggaacgggatggtggccacttgagaagtaaacaaaaaacgaaattaaaagggggatcaggcaaggcaggctggtccgcagcagccgcagcaacgcatgaatgaaagtcgtttttgtgggcgcactgcactgccgccacagctgagcgctgtctgaatgaagaattgaagatccgatcaaagacccccaaaagccgaaaaacaacacttgcttaaggacacccatcagcagtggacctcccaaccacatgtctctctgcttaagcttaacactagtgcctgtgactgagagagagagagagagagagatttggaggaagtgacatctctccagtccaaacatcttttaaaaagaaattacgagcgtgttagaaattaaacataaaatcttaaagttgaaaccacacactctttgtcattgcactaccaagtgcatcttgtgactgtgatcaaacacacaacagggaatgtcacataaaacattatcacatttgatcagtcttcagaaaaaaaagtttaaaaaataagaggaaattcctactttttaaaagggcccatcgaaattatatatttttataaattatagacaccgttgtgtttcacggggattcgatggtttgccactcttaaaggatgatatggtccacatgttattgacttaaaggatcatacatgacattgtcatgcggtggtgatggtagcaatgtaaagggtgggctgggtggcaaaccatcgaatatgccttttattcgtccgtgtatttaatcgtgacttcgatttacgatcagacggtcgcgatgttggatcatcgcaaaaaggtgttggctacgtgggtgattattactctttatccacaaaagaggggaggatggcctcctggacggtcaggaatctgtgatgaaccctaaaggggggcactttgctcaattgatggcaagaaatagtaccatttgacctgttttccacaggacaaaggttggaccttcagatccaatccaccattggttgcatcttgcattgcatggaaagaaaggcaaggcaataatgccagcaaccatgtgggcaggccatgctcctccactgatgagaggagaggagaagaagaggagaccattagaccattgccagcctttcatgcacacaaagcctagatatctgaacaattattaaagccatcttaacattcagaaaaggaaaaatgctactactactactactacctctcactctctgagatgccatgctagtgatgctgccacaatcaattcaattaaccttccataagctcaactgtagatcttggattatgcagagcaagaggaagtaaagtaaacagtggaattgcataatgtggacagtgttaggtgaatatatgttatgtcctgctttgatcttgcattgctgcagctctgtgtagtgtactgctagtaggccatttaggggtggtcatatgagcttaccctttttgcacttttgtcaaggttaagctgtaacaattgttgcactcatcactcagatggtaacctactgataaacaatacattactgccacttaatgtaatgccagatcattggtaagtataggagtaaatactaattactgttgggtggccagatgaatcatcagcttcttcagaaagcaaagacaggctttactcacttatccctttcactactgcagtagaattcaatcagatcagtaatacttcagtcttcagtcactgtgccctgcacatgtttatgacctgcatctgcatgatatggatcacatatctcatctcacacaaacatccccaggaacatgttgcagtgtttttttttctgcagagatgagttgtttgcatgtgtacaggagtcgaagggaccaagactttttgcaggctccctgccaaagattctgcatatgcatatgcattgccagccaaaatgtgaaattcagccagggcatggaatcaatcgaagtggatagaatagaaatcggtctggttttttaagttggattggctccaagatccatgggaaaacttgggttgacttgggagctaattaagctggaagaagtgtttttacaaatggttaagcttgtattgagatcttaaccagccacagtttttttactgtgcgtctgcacaccctgcaagcaagcatgagtaataatactactaccatgcttgggctagtgatcttagtactaaaatgttgaggtaattacacagcctttgagtcataggcctgtgtattactgattgttaataccatgcttatatattatcctccttattgtgcactttctgttacagtctgcttggacaaactcccaaggattgcatgtaccttcacaatgattgtctgaataatgtaattagggagctactactatacgtaggcagcttagctgcagctcactcgatgtgagagttaatctcttggttaagaccgacctagggttcaaattcctcggcagactgcatggatctttagaaacaaacttgattaatttacttgagcaaatatccggatcttgtcttctcattgtgcccttgatctatcacatcgtttggcatatgttagcttatcagcgacaaaaataatttatggatagaacttctata

SEQ ID NO: 45472 - DNA, 12226 bp, Oryza sativa
  unsure (1)..(12226): unsure at all n locations
tgtgggacagaggggctaaactttagcctatttgaaaaaaaaaaagcaacacgtgtattccttaattactgaatgattggattcagaaccacaagacagcaaagggaatgtatatgtaaaaacacttcctgctgtatgatgtcgaggaatcaggatcctttgcatttgacattaggagaaatgaagaccatccaatcaagatcagaggaaacagtttatgcgctatagtaaatctactacagtgcactgatttattatgctcctcacatgaacaatgcacctccgtattactgcagaggatccggatccgatgttcttaaagctttatatcctctcctatctggtccatcgaaattttggttgttttataagtgtctaaacagtagatagtccctctaatgtaggatgcaaagagacgagtaagttttactggatttatgtaggtgaatcatgtttgatgcagaggagcaaagccaataatataacactggtgtcgctgataaaagccacaagaattcaggaaaagaaaaaggctgaattttggatgcggtgagagcctgagagggccactcacgtcgatcaatcgatcgatggcaatgcatgatatgcagcggcgtggccgttatgttccccaaccacagggtatgcacagggaaataacatcacatggctgcctgtctctgcctcactcgtttctctgtaggacactcatgaatggatgagtcttctaacataaaatcagaggtacattgtcactgatatgtgggatccacaaaggttgagcccacacattaatgacccgtgttcttttgactttacgttagaggagcacgattcctcgtgaacatatgtgtggatcggattgaaatcaaatgcagttgatattgtaactgtacaatggcaactgcacacaatcttaaccattcgttttttaattcaacggctctagatgactgtttaagtaccaaatatacctctgctataatatttcgctacagtaatcactgtgtatcctttccgttctagatcatatgatgcacatataactgcttaatttgcatttaataacaactgcacagcacaggatcctgatcggcctgtatcagttgcaatcacgcagtagcactgttcgatttcagggccgggggcttcagttcttctgaatccctgaaatctggcactggcatgtttgctgttaataagtctgtggctctgtgcactgcacggccagctggttggttggctggttaggtcggtgccatgcaactatgcgagagagaagacgcctgcacaggtaaacgatagggcagctctacagtctttgttacagtaacacatgtagtgtgtgtacgctcactgttcagaccatttggccaattggccctaatacacgccctacctagctatatacagtgagcgagctgcagtggagcaacctgccagtagtgccaggtgcaagccatgaacagatcagcaacaaaaaataaatgttttcaaatctccggctatagctaccgctatttccctctatagttatttgctctcgtatacaatttatctattatagtctcttttagcccattatgaactgtttgagaaaatcagtcgctaaatgctttagccggcgatttaaaacactgcttagtatgttctttttactttttttttattcttttagttgagagagagcaaaaagtgagggtatctattaacttattaaaggaatagaaaaaggagcatccacgttcgctctcacggtctagaaattcttacattaatcggagaaaaagaaaaacagagtccatatagaaatacaatttataaatagttaaaattcggaattaaaaaataagtaatattagaagaggagactagagtccatatagaaatacaattaagaaacaatagaaattcagaattaaaaataaggaatattagaagtagagtatagagtccatatagaaatacaattaagaaataatcgaaattcgaaattaaaaataaggaatattagaagtagagtacagagtccatatagaaatacaattaagaaataatcgaaattcgaaattaaaaataaggaatattagaagtagagtatagagtccatatagaaatataattaagaaatactagaaattcgaaattaaaaataaggaatatttgaagtagagtatagtgtccatatagaaatacaattaagaaatgatataaattcgaaattaaaaataagaaatattagaagtagagcatagagtccatatagaaatacaactaagaaataatataaattcggaattaaaaataagtaatattataaatagagtatagagtccatataggaatttaaaattaactaaaattcggaaaaaacataataaaattaaagtagagtttagagttcatataaaaataactaactaaaattcgaaatttaaaaaaatatgggaagaagaatctaaagtcaatacaggaatacaatttagaagtaactaaaattcaaaattaaaaattaaagaatattaaattaaaaattaaagaatattgaaagatgagtttagagtctacatagaaatacaattagaaataataaaaataaataatatcggaagaagagcctagagtctatatagaaaatacagataacgaaaattcaaaattaaaaaaaaggaaatattgaaagacgagtctacagtccatgtagaaatataatttacaaataactaaaatttgatattaaaaataattagtaactaacatgtatataaaatacaatatgaatattagacattagtagtttcgtaaagttagtacaaaatttaaaattatattgtctattttaatatatatttaaataatacgttgagaaaacatatatgctattatataagagataatataatgatactagccgcgcaatctgcgcgggccaccatctagttatgaagaacaataaatgggccgatcgatgtgtaggcaggagaaggaaaagtgatgcgctgcgcatgtggtggataacatcagaggcgggcccaactgtagcgtttggtgtgctctttgaggcccagtttcgtttggcaagattgtttgggctaaagccagctcatctctgagttgcccaaaattgctcctttagttgagtaaaactatgagatttcaaattaccatgcatacaacttttacattgataacgattcctttttccaattttacggtacaatgaaaatacatttatattttcatggtgcatttgatttactacctaatatctgaagttctgaacaaataatatttgttggattcagatcctctgcattggctactagtattccagagtcgttcatccacaagaaaggattttgatttcttcttcttgctttaatctcttccggtttttcacttgtcttagaactacatattatctctatctcctcctaccttagtccttcatggccttctgttcgtgtttatgccctgaaacatcgtgctcctcgtgcacttgacctctatggcaccatcaataccggctcctcgtcgactcatggttgatagggacatctctcttgtcttttctaccttgcttatccttctattctgaacaatcactagagttagcagcttcgtcctcaaattagtggggccactgatgtgcgatcaccttgcgcttaatgttgatgttggagaggtcgcttgtccaccagagagcttgcgctagactagtggtgctactactcggcccggcccctacgcatgggccaaatcctttggacgatggcggaggtgacacctacaaggttgtgactgcactcgatccatctccttggcaattgggtctggccaatttcctacgaagacctttgagataaatgattaaattttatcatagcatttgaaattcctaagaaatgaacaactctataaagattttggagaaaacctagcaagagctccaaccttttggaaaattcctttgaacatatctttctcatttgattattgtgttttctctacggtccaatcaaatggttattcttgtgtttgttctgcattttacaattctatgttttacgattgaattcctatcaggatcctgtgtttttttattcattcatttttttcattataaaattcaaaggggccctaaaaccagagaagggagagagatgagaaaaaaatggagaatgtgatcggtaaaatagaggaatgagaaagggggtgataagaacggggagtggtaatagaaaaaatagaaaatgggagggatgatagggagtgggaacgacgtgagaaacacgcgccacacatttattaccgccatcgccattttcatcttagagcaagtttaataatggagctatctacaagtttttaactcatattagagttaacatatataagagatgagctataaagttatctctatttctcttatcctctctctacctctcacgtatgcatttaatgttttatttttaaaaaaatatgtgaatagcaagctattgcatgagagattgagagccaaccctatttattttttttaaattctctctcctccatataaagccatgttctttccttcaactccaaacttcaattttctcatttttcgttagcacgtttttcaaactgttacatgatgtattttttcaaaaaaaaattctatatataagttgttttcaaaaattttataaattcatttttcaaattcataatagttactactacacctataatttttaatcatgtgctactaaatatttttctacttttgcgtacgcgaaaattctcccccctcagccttgccagttgcaacgaacgctagcagcagtcgatcagatctccaccgtccgtcgtcgtcgtcctcgccccctccctgatctctcaaatctcttcctcctcaacccctcctcctcctcgccgaccaagtgcgaccccatcgcgcgcgcgcccacgcccacgcctcccgcctcccgccccgccacccaccgccgccgccgcgcgcgcgcgcggagatcgccgagcaaccaccgcaagccggagggcgcgcggccggcgggcgaggcaggctaggctcgccggggcgagatgagcgggcacgactccaagtacttctccaccaccaagaagggggagatccccgagctcaaggaggagctcaactcccagtacaaggtcaaccaacgcaccccctcccccgtctctccggtctccgtagcttgctttccccgtgcctgtggggggtcggttcgttccggatccagatctgggctgggcgcggcgatcgctcgtagatctgcgggttttctgttggttttgtcgcggggttcggagggctcagatttcggtggcgtggcctggccgaagaatgaattgtggtttgcaagttatgccgctggattgggctgcctgtcgttgcttgcagcggcagatgaaaccgtgaatggactgaattccctgatccatttcgtagcttctactggaaggagttgatctgaatggctttgattgtttaatgcgtagtcagatgaacaagctggaccttcataagacagaaggattgccccaatgcgcatatgtttacctcatacgtcactagggaatataattacatgcttttagttgccaatacttatattaacactgaaaacaagaatgttgtggaacttacacatcttgctgtcgaaacatttgcatgggctttatccttcattcatattctgtgtgtgaatgattgtgcacagaacagtattaacattgaaatgcacatttcgcatgtatgtttgaaatgcatattgtttgctaaaaaatgaaagatgaaacgtatccactagatcactgctacaaaccagggagataaataaacatattgctatttgggataaatcatttctgcatgattgtgctaattacaaaagcacacacttatgcttcatgacgatatttttctcgagatcctgtgtggtaagtagtcagtaaggattgagatcctctgcagtcactgcaatgtgccgttgtccccgacatgggagcccattgatntncagacatanattcagtgacacaggcacgatgcagtcgactgtagaggatcctgatccgtctgtagcaggacaaatcggatcatgtgttcagtaattcagtacatttacagtgataccaaaaaaatattgtacttgcatacaggaacaaaattatggttctaaagttttcacaccaagttcttgtttattttgacattcagcaagtaagttgccttttgcaatttccgatatctgatttattgttggaaatatgttctgcaggataagagaaaagatgctgtcaagaaagttatcgctgctatgactgttggaaaagatgtttcatctttgtttaccgacgttgtgaactgcatgcagactgagaacttggagctgaagaaactagtatatttatatctgattaactatgccaaaagtcaacctgaccttgccatacttgctgtaaacacatttgttaaggtaataaactatagccatacttgcaacaaactgttatgcggaaaaaaaatgctgatatggtacgttaaaacatgaccttttcatagaaactaataagatgattcatgaaatgaaacttttgcaggattcacaagatccaaatccactgattcgtgctttagctgtgaggacaatgggttgcatccgtgtggacaaaatcacagagtatctctgtgatcctcttcaaagatgcctcaaggttttttttctttttgttgtttctagaacttttcagtcaagttgacctcttctatctaagtctatatttggctcttgaattgcacacaggatgatgatccgtatgtacggaagactgcagctatttgtgttgctaagctttatgatataaatgctgagctagttgaggacagaggattcctagaggcccttaaagacttaatatctgacaataatcctatggtagttgccaatgctgttgctgcgcttgcagagattcaggacagcagtactcgtccaatctttgaaatcaccagtcatacgctgtcaaagcttctgactgctctgaatgaatgcacagagtacgatgcaacttttgatgtattgagttttgaacctatctggatattaaaaattcagtccacttaacatatttggtgtatttgcagatggggccaggtttttattttggattctctgtcaaggtacaaagcagcagatgccagggaagcagaaaatatagtggaacgggttacaccccgtctgcaacatgcaaattgtgctgttgttctctctgctgtaaaggtaaattattacctgattcgcttgcattagaaaagacagttgttttagacaggtttttgtgcagtctgtacagtttctatgtggtaaccatatatcgtaatatcatcatagtattgagtatttgaatacgtacctgtaaggcttttttagattattattggtattgtgaagtcctcagtacataggtagcagaatggatttatttttttttctgaggagcaaacaaattaaggaattaatgcatggcgaaatcatcagcagcatttactgtttgttttttatttaaatgtgttcttttccattcacgtgatgctttacctattgtagtgttgtctatctccttttacaccagatggaaacttttgttgatgctatactttttcctgtgtgtagataatccttttacaaatggagctcattactagcacagatgttgtccgtaatctctgtaagaaaatggcaccccctcttgttacgcttttgtcagcagaacctgagattcagtatgtagcgttaaggaacattaatctgattgttcagaaaaggcctactatacttgcacatgaaattaaggtgatatattttcttcctcatctgagccactcatttccagtaacgcaaatgtgttactgacccaacaggctgttcttgcaacaggtcttcttttgcaagtataatgacccaatatatgttaagatggaaaagctggagattatgataaagcttgcctctgacagaaacatagatcaggtaaaaaatctgctgttttatattattattgtgtccagcgcatgttagttgcagtgaaagatttccttaactaaatgtttttctgcttttgtatggtctcatgtctaccagaagtgcttttgtattgttggaagaaaggctaaacaattattatatcagtttcaaaaattggattaacttgccaaccatgttgaatgtcttactccttgtggagcagatggtttcttttctgtaaattttgttcaagaagctaacagagctccttctataggttctattggaattcaaagagtatgccacagaggtggatgttgactttgtccgcaaagctgttcgtgctattggaagatgtgcaattaagttggagagagctgctgaaaggtgtatcagtgttttgcttgagctgattaagataaaggttaattatgttgtgcaggaggctataattgttattaaggacatcttcaggcgctaccctaatacgtgagtactgtggcatgacagatcaatgttctatattatgtaacaaaggaactcttcaatttttttattgtttttgctcaagaattgcatctataaaactaactgttttcttgccaaaatgcaggtatgagtcgatcatcgcaacactctgtgaaagcctagacaccttagatgaaccagaggctaaggtattattctatgaaaactgtctaggtaatctattgcatttttgtgcaattacatgtttatttttctccaggcatcaatgatttggattattggagaatatgctgaaaggattgacaatgctgacgaacttcttgagagcttcttggaaacattcccagaagaaccagcattagttcaattgcagttactaacggcaactgttaagttgttccttaaaaagccaactgaggggcctcaacagatgatacaggttgcaattctcatctggttatttgtatgtttgtgcacgtggtaatgcttagaggttgccgagcgcggaatgatttttgtcttggtgtggatttgcctaaaaaatagtggttagactcacggttgtgtgttgatgaaaaggaataatttagacacatgttttgaactgattgatcaatttatgcaatgaacagtttcttcttccaataagcatgattagcctgccattagttctttatttgtttattgtaacaaagaatctgttcactgtctaatttgcaataactttatcatgtaggctgttctcaataatgcaacagttgaaacagacaatcctgatttgcgcgaccgagcttatatatactggcgacttctttctactgatcctgaggtatcatatcataacccctcacccttacccttattcaatgcttggttaaatagcactcttaccatttatatatgtttggcgtcctgcaggcagctaaagatgtagttttggcagagaaacctgtgatcagcgatgattccaaccagcttgattcttctctcctagatgatctgctagccaatatttctaccctttcatcagtttatcacaagcctccagaagcatttgttagccgcgttaaaacagctcctagggctgatgatgaggagtttgctgatacagctgaaacaggatattcggagtcaccatctcagggtgttgatggggcatcaccttcctctagtgctggcacttcttctaatgttccagtgaagcagccagcagcaccagctgctcctgctccaatgccagacctccttggtgatttgatgggtatggataactccattgttcctgttgatgaaccaacagcaccttcagggttagtatatttttgtggtttttgctaaggtgtctcgtggcatattcatttaatcattttgtatgactaggacaggtttttgatcatatcatcttttcttgttcttcccttttgcagccctccactacctgttttgttgccatcaaccactggccaaggactgcagatcagcgcacaactagtgcggcgtgatggccaaatattctatgatatatcttttgataatggcactcaaactgtgctagatggattcatgattcagtttaacaaaaatacctttggccttgcagccggtggtgcacttcaggtaccagctatatattataagtataaaacattctttttgaaattcaattacatgtactgaacgtggtgttattctatgaataaggtctctccactgcaacctgggacctcggccaggacgctgctacctatggtggcattccagaatctctctcctggagcgccaagctcactgctgcaggttgcggtgaagaataatcagcaacctgtgtggtacttcaatgacaaaatccctatgcatgccttctttggtgaagatggcaaaatggaacgaacaagttttcttgaggtaaaaacgctaacatgtattatattgcattattcacaacagtagtcaatttaattaactcaatgaatttctgtttcttggattgccccggattgtttagagtttctgaacaaatctcatgattctcttgcaggcctggaaatctttacctgatgacaacgaattttcgaaagagttcccctcttctgtcgtcagcagcatagatgcgaccgttgagcaccttgcagcatcaaatgtgttctttatcgccaagaggaaaaactcaaacaaggatgttctgtacatgtctgcaaagattccgcgtggaatccccttcctgatagagcttactgctgcagtcggtgttcctggcgtgaagtgtgcggtcaaaactccaaacaaggagatggtggctctcttcttcgaagccatggagtctcttctcaagtgatacaaaattgaaggatcattgttccttccaaattgatcagttcatgagctattgtaggtttggatgcggcgttgtttcacaggagctggtgtgaattgtatttgttgttctttgtattagattactgtatttaaactgctagtttcctggtttcaaagttttttcacgacgaacactcgacatggccattttgtctgcgtaatttgtatatctcggacctgaacctcttttcatgccatagcatatgaaatataagtagcttgcaaactcgtaattgatgaggtacagatatcatttttatcaactacattgttgtttcacttgtctactttaagcaatgatttccttttatctgcttcctaaaagcagcagtgtggtgactgtgtgctctacatccaacctctcatgttcaataaattatcgatgtgctatgtctaatcgatttccatttttttaaagaaagaaaagtttgatcaaagttttgcatgtgtaaatgaattgggtcaattgattgagtatggcttacatttacacatcgaatctttagcactaaataaccttcccttgcttcattatacaaaatatttgaatttgtggtcttgaaaatgcattgcaagcatggtcaatattcgtaatgaacaatgtttggaagcgcttgacatagatttgaattattgaacctgaacaaggcttgcgtatttgcttacaaccaactgaaattcctacaaccaactcaaatatagtagatctgacgaaatcagagctctcgcaatacaatagtagattgactcagcctgacccccaaaaaattgggacagtaacattcaaaaccaaaactagttggcgtcgcatcgctcgcgcctcatcccgggcggtggatcgatcgatcgatcggcgtcagaatcccgtgtgcatccggcgaaccacgccgccgtctcgcgtcgtgttctggcagttctgctgctgctgcggcggctgctggcgcacggactgcagcgcctggtcgagcatcgcggcgagcgattccggcgacacaggcgtgccgccgtcgagcgcccgctggtaggcctcgtcgcgctccacgttcttgcccttcagcgccatgcgcaccaggcggcggatgtcccgcggcgtcagctcgagctggtcgtcgagctccggcccgtcggagcgcgtcgcgaaccccgacagcagcagcgtgccgtcgctcggcccgccctcccgcagcatggcgccgccgtacgggcgcgccgcgaactgcgccccctcgtcgtcatcgtcgtcgctgaggaaggcgtcggcgtcgtcgccgtcgccccagtcgccccttctgccgcacacgtcggtgaaatccatg

SEQ ID NO: 45473 - DNA, 2408 bp, Oryza sativa
ccgccgccctggggacctccgtctcgacctccgggcgcagcgtcgggtgctcgaggccggccaccagctccccgaacgcccgatccgccgccgccgcccgcacagcgccaacatggtcgccgtcgccgccacgcgccatcgtcaggtcgcggagcggcacgcggcaggaaacgtcctccatcgtgtccacgtcgccgccgccgtcgtcgtcgtcgtcgtcaccgtacgacgagcggtaggccatcaggacaagcagccggagcgtgacggccggcgcggcggatgacggcggcgaggccacgatctcggagaagaagaccagcttgtgtgggccaagcgcttgagaatcgtagacgtttgccatgatggctccagagcttttgatgtgaattagagaggtgatgatgacgatgacgacgactcgcgaacctaatataggcggaggcgggtgggggaaggtttgaggcaggggtaatcgcatcggagtcggattaggatttcgaattaaccccgtcccgtacgcaatccttttgcgtattaaaaaaaaaaaaactccgtcccgagtccgacttggagaccgacatccacggctctgtcatcttatgttaatctcatctgatgcagtttttacggaagctttgcccagcagtgggcgacgattttgctccaacacgacaatacctatacctagatagattcatatttcgtgtagaggtcaggtttaatataatccattatctaaaaaaaagataaattcatatttcgtccaaagatataccccctccattctataatataaaggattttagattcgtattaagatatactctctctgtcccataatataagagattttggatggatgttacataactagtataataaatctagtcacatccatccaaaatatattatcagaattatattgcttgaccatacatgactagttgagtattgctagtcggaattgttaagagtggttaacgtaaagaccttgtgagattattatcttgattagaacgtaaatgcatctagcctgttgcaattccaaggattgattccacaagtgtgggaatgtataacctacgtcctgatgtgaagcaatactggcataaaaaaaaaactagggttaattagatccatgccattgtaacttcaaaaccagggatgcaaacccaggacaggggtaatcgcccctaagccgttcgatcgtaaattttctacaacgtcaagtagaagagttacatatgaaacatttcacaggctaagggctatgaggtgctacaactacaagatggcttcatgtagatgctgacaacttctaacaagttaattcagtgcctcagtccagctccatggcattatcttgtgccctgcttctgcaggaccaaatcttgatcgttctatcatgtgacacagtcacaatctgctgtccatctgcacaagatttacacaaaccaccaattagaaattcagatatgacatgtttgaatcttgtggcaagtggatggcatgataatacggcacaatcttgaaaaggaaaatgaagaatgagacaacaacgccacctaatgtaccgatccctagagtttactagggcatctgttaggaataaggatcaaaagctgatacattttgcaagaaacaagttgagggagaatagagatggaaagaacaatcagaacgtacaactggcagataccattttcaacaaaggattaaagaaacaagatgggtatgccattaaggacaaacaaacaaatggtgggaaatgcatgatatgcaattttatacgatgaaagtgcaccatagaatagcatagatctataaggttctaaaagtaatacagacaaataggtttggtttgaaccgtttttagcagcatcactgctctaacaactgcagttagttcagagatgagagtgttgatattggctaagaaaatccaagtgcactatacatgggaatttgttttagcataaccaaatggtggatgtccaacttgatatgaggaatggacagataaaaagggctaaaactattgatctcaattctcacaagaaaaggatatccaaatataatttcacatacagcaaagataaaaggcacttaagcaagtggttacctccactaatatccaaactagtaacctttgactcatgggccaccaaactcttgattggtttgtaatcacgagctgaccacagctgcaaaaggaaggaagaatatcagaaatgagacaataaaagaaataaaataaatggcgcattattattaggcatactgctgctttggtgtcataggacgaagttgccaaataatagccttcctggggttcaaacttgacatgtgagataagactcttatgtgctggtatagaatataacattcttttagtcctcaaatcc

SEQ ID NO: 45474 - DNA, 1693 bp, Oryza sativa
acgacaaggttggcctctgcctcagggtcctcgtcggggtcgtcatggcagcgcttggcccgctctatcctggccttggctcggggcagcgagtactgcgcgatgtcgacgcgcgccttgagaagctcctgcgtgccctcggtgaagaaggggtactggatctgctcctcctcctcttcggcgcccgcggcgccctgctcctcctcctgcgcgcggaggaggcggtcgaggtggccgtcggcctcgaggcggaccatgagagcgcggaggcggtcccggcgctccatctcgcgctcgccgaagagcgtgacgggctcgccgaggcggcggaggcgcgcccgcacggcggagtcgttggtgggcacggccatggcgaaggcgcggcggcgctggagcagctcctgcaccgcgcgctcgtggcgctcccgcgcggcgcggtggtcatcggagacctcgtagtcagcctcaccgccgcccccgccgcctcctcccgccgcggaggtcgaggcgacggcggcggcggcggccggggcgggtgctggggctcgcggaggcggggcagggatgggggcgatgggcgggggcacggggaggggagccatgggaggggtccccgcaggagcctgtggcctggggttctccatggaggagagctcgcgcgaaggcggcgagctagggttagggttttggaggcggaggcggtggtggcgacggagacggaggcggaggcgtcgcgggctgcagcgcgaaggctcttttgatttaattcccctttctatgttggttaattacggtaggagtatatgatttggggtaattgtaatttgccgttttttttgaatcgccattgcaattgcaaaattgccataaaaactgttgttcgaataacactcgtttaaaatgtaaaaactactccagcggaaaatttacaaatgttcatttgaatctagatagaacacaaaagatgcgaacaattcatgacacatgcatttcggtctatttgaaattggggatttttttactttagttgaattaatctctatctctacttatatatacttttaaaaaaaataagagatgcttccttcgtccgtcaaaaaaaataacgaaaaaattaaaaaaaaggtccgactcaaagatagcgaaaaaataataaaaaaaggtccgactcctattcctctcataaaaaaaaagtccgactctatatccgattcccccttaaaaagaaaaaataaaaggcaccattcctctcggtttaagtccgagatcccaaaataagagatgcttccttcgcccatcaaaaaatagcgaaaaaataaaaaaaaagtccgactcaaaaatagagaaaaaataataataaaaaaaggtccgactcctattcctctggcctgactcatattcctctcattaaaaaaaagtccgactctatatccgattcccccttaaaaagaaaaaaaaaggcactattcctctcggtttgagtccgagatcccaggcacgtttcaatctatatcatgatatcctatacatcttggtaaaaaaaattgatgtgccggattgaagatttatttgcaaaaatggaatctacaggtcgagagcattccatttttatataattttaatttttggatttgtacttttgcattcgagtccctgtaatttttatatttacatttgagtccctataatcttt

SEQ ID NO: 45475 - DNA, 3890 bp, Oryza sativa
  unsure (1)..(3890): unsure at all n locations
caaaaaaacacgctaaaaaggttttacatcttccataagacaaaaaaacgcgcgagaataattatttccatcgccggtaaaattttttttttaaaaaaaacatgcgaggaaaaagctgtaaaaaagcgcgccatttctaaaaaaatagtttgaaaaaaccgcgcaagaaaaaaaagcaccatctattaaaaacaaatcgctctgaaaaaactgtcagaaaaaacactaaattgatggacgcttgagtcagatagaatccatcgattttttgccatctactacacggctattatttcgtcacatattgtcatgtattgaaaaaaaaagcaaaaaagaacatttaacaaaaagacaagaaaaaagcgcgcgagaaaatgattgttagaaaaaacatgcaaaaaacacacgagaaaataaaagcaaaaaaaaggggagaaaaatatggttttcatcgtcattaaaaaaagaaaaaaaacatgctaggaaaaaactattagaaagaaatgcgccatttctgaaaaatagtttgagaaaatcgcgcaagaagaaaaacactgtttataaaaaaacaagccgctcatcaaaatacaaacattgtcattaacatgattatgcatgaaaaacgtatattattattagaattttttcacccgttgtaacgcatgggcatttttgctagttcttataatatttctaagattaggttcttacagtataaattatacttttgagaattacacttattgtatcgtttgatttcgtctattcacccaatccattcaatttcattcatatgacatttatccatctagcttttgcttattagacttaaaatgttgctttcggcccatctccacccacacccgtatcgtctctttatctccacaaggaaaacacgatggagtgacgaaacacctcttttagtgagcagatgcagtgcgtctctggttcacgggtgatcgtatatcatgatgcagcagcagcaggccaggagattcccacccccatcttcttgacatgaaactattagtcatccacaatgttgcataaaaaatatgatattaagaaataagccatagtccatattaaaagcatagtgcaccgagtcccggggtcattctcccgttgtgtttgttggtgctagacatcagacgttggatgaagccacgatccgagtcgccatgcaactaacgaatctatgttatctttctcttccaagccccaaactatagatggccaaatggcccacctgtcctagcttggcccggcccgggcacgactaggcttgagcccaagatcagtcgggccggcacggcccaacctacacaccgtgttgggtcgtgcctgcccataggctgcatcaacggtctaggcacgacctaataagactcgggctgaccagaagataagatagtccatcgtgctccttctttgggttgtagtattttatatggttgaaataagtctactttgtatcctcaactgttttgcctcctgatcgttgaaccgtatcgtgccgggccgacccaccttacgtaggcagaggcccagacacaactcaacggtcagacggatcagcacaggcttgacaccagtcgagccgagccgaaaccccgtactgtgggccgggtcatcggccccgcgcctgttttggccatctatacctacaacacgcgagtatcgttcgctcagaagaagtcatatccccggagccttcgaatcaaaaagagaaaaaaagaaaagaaaagaaaagaaaaatcccctccgcctcctcccccaatccttaacctaaactccgatcccctccgccttccatggctgccatgggaagaactgtactaccttcctatgttcttctggatcgcatcgttcgatcggaggaggaagccgtcgaggaggagtcggagtgggcggccatggagtgcgcggactggaagtcgtacgggtgccaccccggtgacgaacgctaccccaggaacgccgctagggtgaagggcatgctgctcctggcgcgcctcgcggagcccccgggtctctccgagctctccatccgcctctccgccgccgccgccgtgcncaggccgccgccggccagcttcccccccggcgccgccgtcccgcccatccccaacttgcccgacgcgtcaccgtacgacgacccgccgctcacctacgtcgaggcggcaggcgacggcctcatcgccctcacctcgtgcttccgggatggctgcagctgctacctcgtctacgacgtcgtcggcaagtcgctctccatgatcccgggcctgcccgagtcctgcctcacctactgcagcatgcggcctctccccctgcgcaccgccgccgccggtggctacgcgctgcgcagcagctactcgctggccatcgtggctaaggacatgcggtttgacatggaagcgggcgagacgtctaccgggatgttctctgcctgtgcccaccgcggccatcatcatcctcaagttccagggggggcatcacgccatggcaattcaaggacgccatcttcccatcacagatgccgggttccttccacggtgacaaggtgttctcgttcggaggccacgcgttctgggccgacctcgcaaagggcgtcctcttctgtaggtgcgacgatgctctctccggccgcaatgatgatgccgtgcaattccgctacatcccgctgcctgtagagtgccatcttaaaatcagtttcgccatgaggggtgacctccagctatgccgcacaatgagctgtgtcgacggctgcggtgactctatcaagttcgtctgcatcagtgacggcggatccagctctgcgcacaccggcgatcgtgcgataacgatgtggacactgaccctcgcaaccggggagtggctgaaagatgcacaactcatggtggcagatctgtgggagctggagggcttcgacaaggcgaggttgcccaaggccataccaattagccctgtcctgaaccctcaggaagatggtgtccttagtttcatgctcaacgatgccgatgcagagctgtacatggtcagccttaacatgcacagcaagaagctcctctcgtccttgaccctctcatcctgccctgatgacattgttcctcctttgggtttggatctttccaaagaccttcagaatctgtctcttcgccctattgctgctgagtctgttccagccaagacacagggacgcccaattgcaaccaagaggaggaggtcgtcattaccgtagtgacatctttgtcaggtaattctaccgctataagcttctgcagtctgtcgatgagatgatgaggtcaggtaattctaccgctataagcttctgcagtctgtcgatgagatgatgatttatttagcttcaactgctgtgatccatgctttactgatttgttgttaattgttataaatatactgctagttgtgccacactgccatttaagatactctgaagaataaggatagatgattaatttagcttcaactggtgtgacccatactctcatttgtttgttaattattataactatattgctagttgtgccatttaagatactctgaggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45476 - DNA, 1128 bp, Oryza sativa
ccagatggatgaaaagcaaggcgagcaagccgatcgaggtgaccatcaaaggacaataagagtgacccatcggtcttccatagtttggcagttttatcagctgaagctgttgctaagcagtcgtcaactggtgaaaacgcaacatcagttgcacgttctgtgtgacctttcagagttgcaattttagttacttgtggcatactccacactttgatcatcccactccatgaactaaaaaacacagaaataaagtcattatttactgacaaggaagcaagaacaagaaaacataagttaaggccaagaacaagagaacataagctaattgaggctcaagattaaggaaaaaggtatccaacaacatgacatcaacaattagtttaccaaaattactaaggctatgttcttttcagctactagcaccagattaacgcgggcacgcttcccaagccgctaaacggtgtgatttttgaaagaaactttctatatagaagtttatttaaaaattcaaataaatctattttcaagtttataataggtaatacttaattaatcatgatctaatcgagtgtcttttcaggttaggaaattggccaatctgatgaaatgttgaagcaaatgcagcctaagcgtgcatgaacttcccttccaaaaacaatgtgtatatgaactcctatgaaattcaattagcatcacaattgaaaatcatcagggatactccactattgtgaagataccctgtatgcgagaaggagccagatgctaccatgccacccacctagtgtattttggaacaccgcaatagttctgttacaggcaatcctgcaaatgtgaagaccagcctgctcaaaatagtgctagccgataagcatgataccatcctccatctgctcaatggaaggaaattctagctgcccaaacatgagccgctagctagttctataaatcatacagccataaaaaaatttgttgattcatccagccgatatcacgccatgatgaactattgtgattgcaattttgaacgagtgctagctgcacctggttcaacgcaaagcaatcatgacagaaatgctgaagcagaacagcatggttctatgcagcagcagtgtaaatgtgaagaaacac

SEQ ID NO: 45477 - DNA, 729 bp, Oryza sativa
  unsure (1)..(729): unsure at all n locations
tcaaacagtgcaaataaaaactcaaaatcccttgtattatggtgtacgnnnagggagtacncnnactttanngttaaagaagggaggtatacnnggtacannnaaatctgcaacataaagggaaaaatacgcagtgcaattaatataggtatagacacatctcttatctcaagttttgcggcgatagtttcttatatactctctccttccctaaatgtttaacgccgttgactttttaaaacatatttgaccattgattttattcaaaaacttttgtgaaatatgtaaaactatatgtatacataaaagtatatttaacaatgaatcaaatgatagaaaaagaattaataattacttaaattttttttagtaaggcgaatggtcaaacatgtttaaaaaaaccaacggcgtcaacggagggaggatttttttaacattgtaaaatcatatggatccatttggtgcatctgtgtgcatgtgctggctgcggctggctgcggctaaaggagaaagtgagctaggagggggtgacgtgggacgccctggaggcggcacgtggcggggggagcaggggaggccatggttgaagcgagcgagcgggcgcgcgagctcggcgtccgcgcggggagcaaaactcccgggtgggaggagagagaagaggaggcggaaaagctttgaagagatccgagtttgcggggggagggggtgctctggatgggggcaccacgt

SEQ ID NO: 45478 - DNA, 9908 bp, Oryza sativa
gattcttattaagcttataaatcaatatgtcatgtctgctcatctgtttgctatattattaccaggttcgtttcgtcatcatgggaaacttgttttgttctgattattccattcatagacgatttgatctgaaaggctcatcacttggacgtacaactgacaagccacaaacagaaattgacgaatacactactttgaaagacctcgatcttaactttatctttcgattgcaaaaacactggcaccaagagttcctaaggtaagtgaggctagtgcaagagtgagtggtcatcacatttttactcgttgtgttaatgtagaagttaaatgtgttcaagcagacaagtcgataaggactgcgactttcttgagcaagagaacatcatggactacagtcttttggtgggtgtacatttcagagacaaaagaaatctattagcaagtgaaggtaagatgaaaaatataatcaatttaagtttttgacatggttgttctataccttacgaagtgcatgggttgaaggttcctttgatagtgatagtagcagagcgtcatcgcctcacctgtctagaggagatactgatccaaacaggtaaaataagatacttgattactcttgctcttgttgtcaatacttttcaggcatacacatgctatacgatcttccatattgagatgccccatatatatgcttccttgatgttcgccttgattctaatgttatgttcaacgggcttcattgcagtagagatatacgatacttgtcatcaagaactaataggcagcattcgttgccaccaccattttacctccttttccttgcacttctatatgataagaaataatttggctgtattgatgtctccaagttctaattttaacatcactaagattcttgggtggacaggttttcgaagataaaactggggtccaacatgccaacaagagctgagctaacagtacgaaagagtgagtgcgagcctcagatcatcggagagcctactggggagttctacgatgttatactatattttgggattatagacatccttcaagactacgatatcagcaaaaagcttgagcatgcatacaagtcctttcagtatgacccaacatctatttcagcagtagatccgaaacagtattccagacgcttcaaagattttgtgtacaaagcgttccaagaagagaagatagacatctgaaaacacattgggactccagagctaccgcagctgccgacatagatgctggtcatatttcagcaggtttgatgcctctacttgtatatgatcaagcagaagccatcaggctgatcaaggccctgcttgcagacccccaaggaattcagatggctccgattgggacaatggtgcttttcaataatctcagattcaacagtcttttcttcccctgaaaaatagacacagcttcctatctacagctactttgttacaatggccagtctagcatagcacatcaatgccaagctatgcctaaatatagctatatacatgcatatagaatccactaatgttagtgtagatgctgacttgaagattcattcttttttttggcacacttgaagattcaacttacagagagaagtttgtagtgacaaagttcagagatgtaaatgttttatgagataacatgtcgctatcctcttgtttatgtgtgttattaacgagggcatattcgccttatgtaactcatatgaatcattctaaagtccataactttaggagattcttcactgttgaagtcaatggcatgcaggaatatctgagactgacaccatttttgctaccacctctgaaatcaatgaaacgtattgctcagggtattttcttagcattcctgaacctgatatcaacggtaagatggtgtattttagctatgtcacttaggtcaaagtaagcacatactgttgtttttgccgggttgtcagatttcttccaagataatggggaaaattaacttaatgatttgccactcggacccatatgtccgacatatgagtgttagaaatataggatcattaggtgcggatctaggggtgatatgctattttttcgcgaatgcgcaaaaggattgcacgtcaatataggggggggggggttgagatgctagctcatagcaataatgggttgatgttcttgaggggtgagcggagggagagagagagagagagaggcgtcggacttggagcttgatgcggccacggcgacggtgtagcggagtggtgtggtgttggtgtagatgacgatggcggcggcagtgagaacgtgagtaatcccctcacttcaacgccttcccagattggagggacttagggtttgtggggagcacatgtgcatgggaaaaactcacttcgcgtgtgccggtgactccccttttattgtggcgctgcgtgagaggggctcacagccatggaacggctagcgcccccgatcagggcgcttacgtgcgtggagtggggaatcgggaaacaatgagggctcacacgtaattgatacataggtgccaaatagttaaacacttaaatgccaaatctaagagtggcaaatagatattggagatgcaacattttgtgagatgcatcttgtttgcgctaaaattgggagcattcttcattcttcggttttcagttacacagaaactcttcccaattcaaatgctattcattgtcaaattatacatgaggaattaccggccagacgctcttgaagtggacgacatttacttagcatgactagctatttatattcacagtaacataacaaatattacttcatgttgacttgcaacaactgactcactaacaacaacaaaaaaaaaagattgtgtttaaaactctacaaaaattcatgctgaactccctaatttcataagaagaaggaaataataaaaaattacatgggattgggatcaccagaatcctctacatgttgacaacaacatctttgctatcaatcgcagcgaaccagcggtcagtgatccgtcgatgccttgccggcagtcgtccgaacagcttgcataccatcaagcaaattaacaatgtcccagaggaccagcatatgccagtcgcggctgctccgtgtcaagggtatagggctcacgcggcgcttcatgatcaagctccgcctaagaccagtcctaacccaagacattagacatagttttcataaactccacatcatcaataaactactactagacactactctttcaatataaacaccattcttccatacttaaatttaattctacttatctctcatgatatgttggatattgtgtagaaactaccccctccatactcgtaaaggaagtcgttttagacagcgacacggtctccaaaatacaactttaacttcttgtttctataaaaatatttattaaaaagtgatatatgtatacttttatgaaagtatttttcaaagacaaatctattcatataatttttacattttcaaattcaacaacttaagagttattcatgatttatattcctaaggcttgacttaagcattgtcctaaacgacttcctttacgagtacagagggagtatgtcttatgcaagatctgattttattctcttttctcatttttttcgcttgccacatcatctttcatcataggtggtagcttatttaatactatggacaccatcctgatcattgagttggaactggcctaaaagccgcgcaacctctcgatccagcgctgtggccggccgccgccgccattgctcacctcccgctctgctggccgaagccgcagagtcgtttcttctctccgtttggatttttcgtcgacatccaacggtaaaaaatatatttttttgccgtaacagtattgagagacccatcatactttcggcccggaacgacactgcggcccacatgaagcctattgtgtttttggtccggaatgggattgccgcccacatgaggcccattaaattctggtccgaaaggaattacggcctacgcgaggtttctttttggaataagttcaccggaggtccctcaacttaacagcgagatttttcgagaactcttaaccacaaaaccagaaatcttcaccccaaaactatacaaaaccgttcactcaaggtccctaggcagtatatatgagtggtttcgctgacgtggcatcctagttagccaaaaaaaaattaaaaaatacgtggggcccacatgtcagctgcacttttttttcctctcttttcttctccttatcttctcttttctctcttctctatttctcttcttcagtgagggaggccggcggcaggcggagcagcgcgcgcagatgcgggtggcgcagcagagggcaagcgccagcggagcggcggcgggcgcaatcgtggcgggccgagcagtggagcgcaagcacggccgcgggcagagaagcggagggcgagcgcggcggcgggtggagcggcggagggcgagcgtggcagtggagcggaggtgggcgagcgcggaggcgcatccagcccaccccaatcgaccaaagcacgccctttgccctcggccataagccccgccgccaagtcgccgtcgccgtcctcctcgtcgtcgtcgagcggcagcgatgacttcgcggtgctcctcgacgcggagctcgagctcaccttcgccgatgactcggcctctgccggagacaacgacttcgaggaagacccctcccagccttccctccttcctcctcgagctccctcacgccggcgccggcgccggcgcctacagggatgggaagccgacagtgctggccgtcgtggtcagctcgcttgccgcggcaacgctggtcccggcgctaaccggctgatgcgtctgcggatcgatgccctggctcatgagcttgcgcttgatgtgctgttccacctgcagaaccaatcaatcagcaccaagaacacaagaagagctaaccggagcagatgacaacacgttgaaatttgttttgcttacttgttgccgagaagggcgtggagcttgatggtgagctcgtcgtcgtcgtcggtgaaagttgctgcacttgaggtcggggataaggtagttcatcgagtggaggcagcagctctttcggcagcggagcagccccatcgccttggggagggagagagggtcgacagggagagcgcgccgctcatcgggcggcggcggggcccgtggtcgagcacccggcacgttcgaacatctccgccgccgagctcgccgtcgcaccggccgccacctctcctccgctcccgccgccgccgtcgcatcgactgcctctctctccctctccgctgccgccgtccccgctccgccgccggccacttctctccccccggtcgccgcgcctgctcgacactcgagagaactcggagagaagagaagagaaaaagaaaaaaaacagagaaatgtggaacccacaccattgtctcacttacatgtgggccacacattaattttatttttttttctggctaggatgccacgtcagcaaaaccacctgtatatactgcctagggaccttgagtgaacggttttatatagtttaggggtggagatttctggttttatggttaagggacctcaaaaaatctcggtgtaaagttaagggacagccggtgaacttattcctttccttttttccggtccatttttctcggtccaagtgagccttacggttcggtttgtccctcgctgtgttctaatttccactacgtacggtacgacacagcatggcatcagaatggacaagggaaaattacttgcaatggtaataaagctaagcttcaaacacagattgtttatgcaccaacagggttctcatttaatcattttctttctcaccttcatcaaaccaagtgttataaaccaaacaaccgtacaaacgcgtaactctattccttccttttgagtagccacacaaaaatacaaatatatactgttatagcgctggaaatttttgttttgaatggcaccccaccttgacacattacatacaggagactataacatcacactcaagttgctaactcgtgcaaagcgatacgataaaacccgtattggagaacaaaaataaatttacattctcaacagcaattcctacaaatgattaacatggatgggaaaagaataactaccaagaatatacaatcgtggaactgaatgaacatcctaccttggactgtcccaaggagagggcggtttgttgtatggaaaaccctgagaagcggatccatgtcctaaatcgagactgtggagttgttccatcagttgcgacctccgctctttgaagaagtctagcctagttgtcagttctaccaaagtggaggaggccaccattggttgcctcccataatcaacaccctgccatacgataaaaataagaacaatcttcctttggaggatattagtagtgctaaatagagtggctgtgatttccctaacctcagtaaactttggggcattgatagccatagcagtgttatctgttggcatgctcgtcgatgcctccatgcctcttgaatcgcttgaagatgcgtccaaagagagcttgcgggtgagtggccttgaagaaccataaggtagcacatgctgcttgatatttctccactgtgatgagtccaccgaactctcctgccatgccaaaatatgatccgatgttagtcagggatacgatgccaatatcagattaaagcgagtgtgtttccttcagtccttctggtggaaactcctaacaatattatcgtgcaagaaattgtttgggtaccacaacccacacatcaaaatagagcaattattatttgtttaggagacatgatcaatagcagtaatatccgtttccaaaactgaaaatgagtaaaaactaataaaacagtataatagagcattcttgttatgctgatgtgcacaggggtcaagttggacctgaaattcaacacacctctgtgttgttattaagctcacaatgtgtagagtaaatagttcttaacaaacctcatttctctgcttctcttggttgcagaaggcaaggttcatgtcgaatcctggctgaacaaagttcctggcaccaataaaatagtcaaaataagatagaaatcattaagctcagtaaagcatatccaatatgtctcgatacattgagctatcaattagtactgcacagattgttttccagtgaaatgttgtccacaatcagatttcaagtaagcaccagttgcagcataattctgtggctgcatacctgcagccactctttacagaaatggggccacttggatgaaacagaacaataaacacaattacagaaaatcaaaaggtgccaaacctactgaactagcaacatccatccgtataaatagcagtagtaaaaaagaaaacaacaaagttgattacttactgctgcgaaaaatggccaggaatacggtggtaacgatcatttgcatctaccatagggccatactggtgttggcgctgttggttgagttggagatgaagctctgcaaccttctgctttaaccttgcaacatcagcttcagcaagagcaatctcctcaagttcagctctcgtcttgagaaaaacaatgagtgaaaatgagactccgtaaagtaattccataaagtagagcggtcactagaggtaccttcgtgtccatagcacgtgaactagaaaactgactggaagacatgctcaatccaacctccaatgcagctctaagatctctctctgcctgtagttgctcttgcaacctagacacctatcaatatcacacttgtagaaattactatctgaatgtttcagtcaccatcaaatatatcacaagtgttcagccaaaaccaaatgtaagggaaagtatcgttttggttcctcagtctatgggctatgggtaaaagtgacttttgtgcaggcattatttcattttagtccctcaattttacagcatttccaatgcaagggatgaaggcaacctcagcaacaaattaatcaaacttatcgagcctctgggtcagggttaaaaaaaactggtggtaagcagtccaggtcctgggactggttaggggatgctcaccaacaggaatgatgttgagattatatttataatttataattattctgacagttatcagtgcagtaaaatccagtaaccagaaggttactgtatttcactgatgaacgataataccaggattactgatattaggaaccctgatctgattcaacgataagcaaggcccaaggagctatcagttcaaatgtcaacgaggggatccaagtctctgcctggacctcattctgaattgctggaaatccaggcaagaaccaggatttctgtgttttgcatgtaactagtgaacagtgaggtttgtgattgctattttcaaggaatatagacagcgctgatgattcaacgtgtagaaaaagaagagacaagcttcaagaaacacacaaaataaaagacaaatgaaaagaacgctagatgcacaatgtcaataaaactaggcattttccagcaaaccagtgggatgttggatttgaaagaattctaagattcagaacctgcctaagggacaaaaaaaaagggtatctttccccaatatactatagtaaaacatatgcacttgacgaccaagcaaatttgatggtacaagggaatgcaacatacatcctgttccagggccaaacgacgttcatgcagtgcttgtttccttctttccaaacttgcctgtagaattgcattacccctagcctgaagccactccttgttagatggcaagcataaaatagaatattcttatgtgcattttcttcacatacctctttggcaattctgttctgcagatcattctttgctatttcgagcctttgaatagcaagcctggaagtttttatttgcaaagcaaaattacaatcaattaatctatggtatgcatattcaacaaatgaacagcagcggcgtacagtagcaatatcagcaaccagggagtgtccttagcaagttattgatcctttaacttctctggattaggttaggcttagttagcaagttatgaatcagcaagttaaaggattaggttaggcttagttaacaaacaagttattgatcgatataggaaggtttgggtgttcaaggtattccattatgacgactactaagacttctgtttcagcctcattcaaaacaatgttagaccctaggttaatccaacgtttctccatttggataggggaattcctattaatctatcgacagcttattagttgggaatattaaattgagttgttaggggcattatcatccttttcagcaggcaactaggcaagaaatgaaaatagaagtccgtagactctcccttctcagccagaggcctcagtgccttggcagcagcaatggagggggtcaaggaagggcaagtgctagagcattggcaaacatttccacagtcaatatagaatggcctaatgcaatacaactgctcagattcacaactattaacaactaaactcaacgaaacagcactgtaaagtgtaaacaaaaatgatttgttggtgctttagtggcaaagggcttactcttcttcaccagatgagtcgactgattcagagtgttgactctttcttgcctgcataaaacatgcatatagaactcagaacagaataaggtttctaataattccagaaacaacttcaggaacaatatggagccaactaaaccataattcgatggagtaggaaggtggaacagcaatgcactattaatacccagtagctccaaaaaaaaggcagaaaagaaataaacatagctaggtttttcttacattattcctcccccaggagttactgcgtttcacatgtgggtgagatccattgattttggctggctgtctgctttctacagaatattcacca

SEQ ID NO: 45479 - DNA, 2166 bp, Oryza sativa
gtgattagctaaagatattccaggatccaaagaagaaagtatttctcccatagacagtggagtctcatggctagatattgggttagaaggattcttttcactcagcaatgtttccatatatgctgaaccgttttcagctgaatgactttttggacctttgcttaactcaatctttacttccgctgccttagcatcttcagaacgttcagcatctgaatcatcagcatgaacaacctgttcaatcaggtgaacataagaaataaagtattaagattgggacattcaaaagtacacagaaataaaattaaaaattgcctctcaacacagtattgaagctagaaagggaaacgcacaaatgagatactcatataacctagaaatacaaccaccaaaacttcaagacatttcttacatggaacaaggtaatattctaaagtggaagatctataggcagaagcatttaacagaagatgacagccttcagggttatattaccatcaatataaccataatagatccatgccgcaagctctaatccataaaatacatggaagtggaaatttacaagcataacccagactggcatgattaaataatactgcaagatgacaaaaacaataagcaagggttctcaaaatattgtttattagtttttctgaacccaggcagtttatcgcttggcgggacattgctgggttctaagtttgcatgcattcaaactcattggctgaccaggtcaaatggttttgagaaaccatatttgttcagacctagcaacaaagatttcacccgagtctttcgtatctgcaatgatatctactggcaggggtcaaaatgggtcatcctatcatatcctttggtcctccaaaaaaactacaataattacatttaaattacatattcacagtttgcagctgaaaatgtactggtgtccaaaaaacaagctcctcatagatgtacaacaactcaacaggaagtcaggaactacttttaatgccctactagtttttatcttcattcttaagaccataaaaaggcatacttatacatgtacaacaataaataacagcagtaataaccagattagagatttaaaaagtaggaagcatatcaaaaccttgtagtcatagaggtcactgccagcgtatccactgctctcactcagttttccactaagtatacgttctgcgccattctcatcatccatttcctgatctacatcattttcagcatcatgaaatccattacccttgacatccaaatttacatcatctgttgatgcctcgctaccgctatcttcaatttgagactctggcgacagggagcatctaaggttgtgttcaccctgtaagatatataaatatgaatgatcaatagattagtgttgtctttatttctagttcacatttcaaaatatgttctacacagaaaagaaaaaggcatagcttccagcagacagattccaatgaaaaagaattagcgcaactgttgatgtgaagtattgttagcttttcgatggataatggtaatatcaacagattgttcacagaaaaggtgaatccacaaaaggagttgagaatcttacatcaaatatactctcgtattcctctaagagagttgtgacaatgccttgagcactgttagcggcatttgcagcagcaagaagctgtgcagaatcatcgccatccatatcaaatacctcatccatttcacattcaccagcaagaagtggacgcaacaacagaggagccatacaggcagcaactgctgatgctgtcattcggttctcggaagtatgagaagcgatagtatacatcattttcaaaattctgcaaataaaatctcaattagaaaaaggagtttttgacatatgattattatccaaattctaattgatcaaacaagacatctagataaagattattgaggtgttgctacttcaaacttaaaattcaaccaaggctaaaataaccaggttagtatatgctctattctgtaagggttccaaaaatcaaattatggaaggtgctcttacgcttcaccctttgagaaccgccacaaagtttgaagcataagtcaagggtggattccaactacttacccttcactagtgcttcaagatttgtgtaacttgtattacaaaacatgaaagcacttgtaacaagg

SEQ ID NO: 45480 - DNA, 3478 bp, Oryza sativa
  unsure (1)..(3478): unsure at all n locations
tgcagagatgtttacatgaacatacagttagtgatagaacggattattcaagctcccagcacaaaaaagaagaggtaccgtgacagagttacctttacacaatcaccaacaatgtgagaatcttcatccggtgcaaactccgtccttcctggtaggggatataaacaggcacaataatggaaccatatgcaaattaatcaataagcgaagacaaaaacaaaacagagctaccaataccatcaaattaacaatactagtcatagaataaactaagaaatggttcaaccttgctcgtattcctgcaatctcctgtcaacctcctctacatctgcagcctggcgtagaattccttccacctttatccctacaagaaaagattaacataactattgtacattgtacagatgctaaactagcagtactccaggttctaaagatggtgctagttaaaaattatttgtgcacccaccatatttctcaagaaaacgcagagctttttctagaaaagaagggcttccatcaatatcctcaagtgcgagaagaattggcctgccaacaactaacgacttgatcggcctcttctctctccctgcaaataattggaaaggcatgagttaacaacaaacaaggttgtaatgagtaggagaagaaaaaaaatgaaatagcataagtagaccaacaatttgggatagctccatcatatgtgtcagtcgtttcattacgaaagatcccattatgtcccatcacaagagctgcatttggagcctgcgcaagagcctcttctaatgctgttttccactcaaataaatcttcagaagtttctgcctgtattaagcaaatatacaacattcagaaaatactaataaggagtaaggagcatgaacatatgtctgatcattcaatctctcatctgtgttgagatgatccaattattaaataggaaaggaaaaaccatcttaccttaagggtgaatgcacgaccatcacggccatctgggaaaaggacagtcaataacttcttgtcttctctgactaccacactgcaaatgataagagcttttaatacagtattatctgtacatcctaaaagggaaaagaaaatctcaagaatgaggtaaatacctcccagaattattcaagtcaattcctcccagagtaacattcacttcaccacctctctggggcaaggtactctacaatgtcaacaaaaggtttatcaagaattaggaaatggttgttgttacacaagttataactgcactagtgggtgggtgggagagagagagaaaggactcattaaataatttaactcaactccctatcgaaaatagaaaaggaaatgcacatcaattgggagaaaacaagttgttcaaaacttaagacaggagagcttatataaccaaagcatgttgtgtaattgatttgttatgagcactagatgttgaaaactcatgcatttcaaagtattgcacacatgcgaaaaatggatcgaaaattgaaactatatactattaactatcaaattatctgtgcatggcaaggtggcaatgaacttttttttccctagtaggacttgtcttacaagcagaacaatttatagcagtttcaacaaataagagtgatggcacttaaagccaaataatcacattctgtggtggttgtgcttttgccggaaaaagttcatatgctatacttcatctataacatcaactaaattcagggctctgagaaacaagttatgcaaaggtacaccaggctaattattgacttctcaagcagaggaaacatataatgatagaaatactaacaggatcactcttgaagaaaaccaatgatgttcgtgtgaggatgaaccaccgttttttccatgatttccacccgattcctgaaaattatatataaaaagagttttctttactgtagaagaatatgatatcatattagaaagttgtagaagacataccaaaaatagacaatgtgatactgactcacaacacatgatttaattcaaatatgaaagggtgattttggtagattaactaaattacaattcgtaggaatcaatctgctcaggaaaatcatgattcagctggcaggagtcatatttggcactctaattgaatttctgaggcataaggcaatccaaactatcatttggtttggattttggagccttccccatggcaacaggtttatctttcccacgtaagttggtgacaaaggcatgatacaagcatatctaactttgagaaaagttattctctagataattcctggattcgtatagttcctttgtgcgtacatgattgctagcaagatacttcaacctgattaacctatgttggaaattacagaacatatgttcctcccccttcgcttataatccaagaaaccaagaaataattaatatcacaaaaaagaagaatattatggcatcctctatataatcatggtgtcggcgttcatcaccaaaaatatgtgagtgcctcaattctttgaagaattcaaacagagacacaagagaaaatgggaatatttggactaactttacatgtttacatcacataaacggcctgaaacaacttatgatacatgtgacagaggtagagagcaagaatgtaccctttgatgaaatgaagagaggtccactcttgaaaacctggttagcacactagttgacatcagaaatgtgaacaggacaataatattaaatatactaagagattgcaatacctagcaagtacgtaatatgtatatagacaaacattcaaaattcatagtagatgaaatggaaaggaattgtatatgtatatccgatacatgaccacgttgttaattaactcttgtgtgttcaactctagtgctaactaaaagcatactgctttatgctcaacatgatgaataaaaacagttccaagaattcccaaattaattttctggagaaaatcactgtgcatggacctaacaaagtgaatatgattaggttttcattactaaaagttgcatcctgtgatggcatgataacaaaattagtgttgaaggtaatgtcatagtagtattggaatttgatcttctaaatatagacgaggtgagcgcagcaagtagaatgtagattgatgctaagatgtctatttctatctagctttatcaagagttagggcttggggaactgaactactgaagtcgatcaatttaccatgtcatctgatctgagtttacatgcatgcttatttacaatttactaatgtaatgggaagccacgcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45481 - DNA, 703 bp, Oryza sativa
ttcaggatttgggagcatacacaactacacaaacacaactacacaagtactcactctggattcagtgtaattggtggttactactactccgtagttggttagtttggttttcacggccagcatatatccacatcgatcccatccctcttccgttgaacacgtacgtcatacttatgatgtttcattaacctaaaccttagtgcatttgctagggtttaaatcttactgcttaacggatcagtgaccggtctatgtgtaaatataagcatgtcttaggctacgttcggttcggctcaacggctgagatgctttcccctttttttatgagaatgtttcctaaaatgttaaatggtgttttttttaaaaaaaaagatctagataaaagttactaaaaagatgaaataaataaaattttcaattaattatatgtttatggcttgttttatttcacgtgttgctgaatctcatattatcctctcattgtcttgtatatgctctaagcggttgcgagggagagggacggtaaaggacggacggtatcttggtgtggttaattggtgagtcgatgatggtaccactaaaacaacattaagggagatggtttgcggcgtggttaatcagtaggatgggtaggttgaaatattacaaagggaaccttgttgagaatatagacatataatgatttaatatgggctgcaggaat

SEQ ID NO: 45482 - DNA, 14028 bp, Oryza sativa
cgataccgacatattgttggaagtcttgtatatcttgctgttactcgaccggatatctcacatgctgttcatgttctcagtcaatttactagtgcccctacatctgtccattatgctcacctattacgagtgctccgctatctacgtgggacaccatctcgtggtatatttttctcccgtgatagctcactagagcttcaagcttattcagattccacttgggcaagtgaccctgttgatcgatgctctattactggttattgtatcttcctgggatcttctcttcttgcttggaagtcaaagaaacagacagctatctctcgttcaagcgctgaggctgaattacgagctcttgcaactacaacagctgaagttatatggctccgttggctacttgcagatcttggtgttgtcctctcacaaccaacttcattgttttgtgataacacaagtgctatccaaatagcctcaaatcctgtcaaacatgaactcagcaaacacatagggactgatgcttcttttacccgatttcattatcaacacaggacaatctgtcttcattacttgccctctgaacttcaagttgctgacttcttcaccaaaccgcaaacacgagaccagcatgattttcttctttccaaactcaaggctgttgatccacctagagtttgacggggggtgttaatgtatacaccatatatatatttctgttttggttcagttggtccacttagcccatttggcccatgtatatgtatataaccttcactaccatctagggtttactgctgaatatatttttcgtgatttcccccaaatgttgaacatgcagatcatttactgacaacctgaggacacggcacgcatttgcacctacctcgaagttataacttttcaaagttgataagtgaagggatcctttgtaatcaacagtccatatatgagttgatgactctcgggtactgatagaagagcacaaagaattgtgagcaattgatattatctggtaaggaaaaacaggttaagagttaaggatttagcggatatataccaaatgctttcagcttggcattgctccatcgcattgacccgtacacttctgcaagacaatgtttgtataattagcaatgagtgtgatccaaaagatatagacagatgaacgagaattacaccttattttattggcatgtaaaagacaacgatgcactctgtgtgtactgtcattttgcgcaaatccatatgctgaacatcgtttgacaatccaagatgggtatgttttgtcaccttttttgctatgatagtttcccttgatcctaccatgcccagacttgtcattttcatcatcagattgtgaatcaatttgagcatcaaagctcaagggaagaaatttatcatcgaatggtgaatggtcatggacttcaccatacaggattcttattatatcacatgctttggaaacacatttgggagttgtgtaagcaataggcacataatctcttctttcatcaatagagctaacagtttcacatgaaactcttttccacctttgcagcattacacggcaatcatctccaagtactatctgttctgtgttgtctggatgaaatgccatcagtgctttgtccagcacatcattgtttcgtgatgtgtcccaaaggtgcagaataatgattgtaacaatcatgtcaagatagtccgcagaagcagacaactcacctattacatacatatagagacttttgcaagcttttctgaagcctgctggcccaaatgcaaatgtagacaaccggcgatggtagttccctgatataggtatatcacttcttgtccgccctgtcgttgttatataatgtgtcggttttgcaacttgttttggatctccaggtggcttcttaataaatctatcactcttttccctctctggcgttgttatataatgtgtcggttttgcaacttcttttggatctccaggtggcttcttaataaattcagcaacaaacccctctgtgataacaccatgtagccaacttgttgaagcattgcctacaaagcacatcacaatcccatctacttggacatactgtagatagtggcccttttggggtgtggtccaacttctggattccggacaatcgaagtcataaacattatctgagtgagatagagtccagaagcgatgattgcctatgcagtccatcatattctcataaagtaaccaaggatcaggttcatccaaattcaggaagtgatagttctgtaaaaagaagcaacaagtataaacgataaggaagaagtgtcattaaattgcactaaaaggttgcaacggatagaaacttactggtggataacggctgcagccttctaattcacttaaggggatgtcatttaacctagtcttaactggagtgtttgccaacttcttcagagcttcaagaaactttggaaggtcagggtaggctttgcaatcaacacgaactgttacagcaggggctctcatgggcataaccttcacacttgtcaatgtagagttcttcttaattaactggtctgaagtaaacacatacacaatgtttccagtgactatgattttctaatccctgtttatgttccatacaattaactgtagtgtatgtggccttgtcaaataagtctctatgaccagggatagaggagcaagaagaaccctcaactaactcccttttatctcctatccaaataagggaactcttaatgcatttgatatacaaatcttttctttcaccaataccatagctgggactcaagaattggacattcattccagatgtgactttcccggagaagacacgtcctaaagcaaaatacctgcctttgcctaatgctagggtcatcttggaacataaagaacaaggggcccttcagcatcacaatttctaacagaggtatggtaaatgttgtcaagatccacccaaaattcccaacacaatgtctttgcgccttcctctggagaggggatgtggtacatcatcatctcagaaagtgcactgcatgctggcagccaagcttggatcagatactttacgagttcaatgccaacaagttccttagctggagaactcacagtgacatgaatcttttctagcataggccacaatttgtgcttgctattcatgcaggcgttcatgatctctctgataggttcatagcaaaactgaacaaagcccctcttgcatgtagctgtgccagtgttcttttttgtccatttctttgtggccaggtcaaagaagttctcaccccataatctgtctatcatcttagattcctcaactttgaatttggaggaatacatcttagcaaaattagaaattgcaactgcccatccgtgcagaccagatgagaacacaacagttcccttagtgggatacacctgagcatctttgtgtgaagacatggtagcattgacactatcaattagactggagagggtctgataagctttctcaccatcaacattctgctcaaggaagaatctgtcgatcttattcagagtaaaaacaggctgaatcttcatattaagagcctcacgaatagaagtcttggtccataaagtaacaccctcaaaactgtccactacaactagagcaccatccattatgcaaagggcaggttggacatcattagacaagttgcaacacacaggagagtcaataagattgatcaagtgtccgttaccagctctcttatccttgtagcttctcagagaatcttcaggcatttcatagtacagagaaattaggctattgctttcagtaacttcctgggaagtaattccagcagttgctaccagggaatccaatattgcagtttttcctttaaaaatggtacaagacaaaatattagtacaaaaaatattttcacaacaaaattacaaatggaagcagcaaaaaaagtacaagagaagtacatcctataacgaatagtagaagaaagacaagatatcaaggttacaaactcaaatactccggacattatgtagtacaacagttccataccaatctcaatatatactagacccaccagaaatcgatatttacatacaggaagataattccagcgatacaaatcattcagattcaatatgttaatggaaagaaatggctgaaaagaataactagaaattctactaagatgccacgtcgtaaatgtgagaattaatgtaatttcataaacaaacaagtaaaacaaccacattttaagaatctcacaccactacatttcaatcttaccatggccagcatcagcaataaccaatacattccgaatgttgttcttattgcacataatgctgtgaagttcttccgctgtgaccaccatcatgtcgatttacttcatgtatccctgcctgtgccaaatgaacaagtttgataagaacagagaaaaattgagaaataagccatcaagtagtaagcaccacaattaattaacaatttgtatttaaaagacagtccagtgacttctcatcccttacatcagggacaaaacaggagttatgagctccggcacaatgacatgctcttgatgtgtgaggagtgaggactacgacgcctaccagcatgcaccaggacctgatccaaacagagtatgcaactcacaagatctctgcaggctgatactaagtgatcagaggcaagatatctgaagcatctcccagcaactcttcacttctcaaaatatcaagtaggaaaccctactaaggttggtagatgagagggcttttgaaccactcctgttggactactctttggtttcttccaccgatgcttagttttcactaaaatccgaccacattttcatatggaattggaagaatcctcctccttccccgtaagacaaaggtcgtttggattggattacgggtatcagcaatagcaaaatgagctcccaacgttcaactgggctccccgtcgctctcccgccgccgcggcgacgcaccccccccccccccccatctcaccccaccccaaccaagcacccagttccgcgacccagctaactcacgagacgcaccgaacccccatatcggccattcgtctggcaccatcgcggcgttctcagttcctaaccccatctgatccagtgagagggtttctagcttggatttcatatgaagaaggaatcctaatcgccatgaaagcgggcttccctctatcctctagtctcaacacaaaaacccaaagtaagcaagcaagtaaccaaatgttcgaggagtacagcgcgtgggggtgtccgaggctgaacctgcggagacgacggcgagcctgcggccgacgccggcgcggcagcgcgtagatgggcgtcggcgaccgatcgtgggcggcgccgcagatgcactgcgacgggggagcccgcgctggcggagaggagaagggggcggccgccgccgggcggcgaggaggaggaggaggggcgtgacggaatcgaggaagaagaagacggccgctgctcccgctttgggaggtggtcgtggtctcgtggacttggttcacgcagctctgaggtggcggcactgtgccacagagctacagtagagagcagcgtgcacctggtccaccggtttctctcctgagcacgtgctcagggaccccacatgtcagtgcctatggtccactgagacggaggcacggagaaaacctgtgctactgtaggagaacgcaggatttctctttccgtgatccactccgatactacgtctagtttcccgccaaaaagttgtagtgatggcccattttgattggcccgcttaggagataaggcccagaaatgagtcagatgaccctgggccgagagagggaactgatgaaaacaaacccaaattctcagtagcacgtttccctcaaaaaaaaaattctcagtagcactagttcattcaacaagaacgaatagtgttgcttatttcttaatgacgatacgcaaaaacttatccctcgaaattgcacgatcaaacatgtcgtcttacaagcgaagatagtttaaatgcttatgagagataagtgtcctgaaaacaaacattgggttcataggagtaccatgcccagcttctacttggagatactcattctacttaaccattcaacaggtatggaagaaaaggaaaaatacgaaaatatgttaacattccccggtgtttgtccaaaacgaaattcaacaagttggaccagcaaagtccaaatgcgcatcaaaacccaaacttctcacagcatcccccaaaaacgagagttcaggtacttcaggaaactgctaccatctaaacaagttctctcgaacatctcttccagtcagtcccaaggaacctacaaagcagatgagtacacatcagtctccctatctcataaacagagaagagaacagaacagatgaaatgaacaattgtcaaattaagttgattcagtctcttcggatacatccgataaaaaaagtagttgattcagtataaccacaaatatactgaaaccagagcatccttttggttttgttcctactctatcagtcaaggatgtggcattgcatgtctaagtgttgactgaagcaaaaattacaacctgtctagtgactactagtagtaaaggagcaggcaacaagctttagtttactcttgatcaacgggttatagaattttcgggaggacagtgaaggcgaaattggttaagacgctgagtaactttaggtttgagatagttcatgtctgctggttctgacagtagtgaccatcctttagcgaagtgacaattctcagcagtcggcagcactaacatctggcacttcagatgtatgaacagagcaagtacttcaccacaatttgagtataagatttaaaaggtaacgccaattttaggaggcagacaaatgtaacaactatcatttaagaacaacaaagaattcaaccaaacaatatgggattacaaacatcaatagcattgagataccccctctagtaaaaaaaatgacgctaggagaacaaaattcagttctccgggagtattaggtaattacgagagactactgaggatgtaacaattagcacactgaacgaattgtttcttaaaagtaaaccattacccattgcattgactacagataatgcatgagtaatccggacagaacaatgaaatacggctaataatggataataaaataagggtacacagacacaagttagacgagaaaaataccaaaagatgaatcgactgatgcagttcagttttaactgcctctatccacacgaaccagtgtgtctgccagagtatttctttcaacatcagtcttcttgctcgaaagggttgctgcaaccatgtgtacaagaactttaacaatagtagcacagagatgatagcgacaggaacgatgtatgtatccaataattgcaaaagacattggcaatgaacattgcatcaaaacactcgggcattaactacacatgaacaacataggtgttacataacagacattccactccaatgacaaaaggatgtgaggttcttctgccaataccaagttctggtgctgatatctgtccatgatcatcactgctatagtcaatttactgtgtaagtgtaagtcttatcagggacgattgactctgcttaacatatcagtagcaccagtgcaccacttaatttgagggcatctacgcagcaccacttcaatggaacatttgaatagtactgcattagactatttgagaagataggaatcaaggaaaaccttgtgaaaaaatcgaaattcgcaaactctgcataaatctaatcccaatattagacatgctgctatagtttgaagcagaaaaactcgactctttctacagtgatgacaaacagatgcactcccttgagaaaccacaatacggatacagcaggtatgtatttatcaacagaaatccataaattgctcaaatctgcaagcacgcgatttcaaaagaaccgtatgtgcaatccaatgattgcagcatagtgaactcctgcacttccaatactcggtgcaatttaacaattacaattgcagtatagtacctcaatactcaaacatatcgaacatacgaggatatacctgcagaggggatctgacatgattcgagccacggtggtaggatgcatggcacaactgaactagagttgacgtcatcaggagaactcctcccaatcacctcgcccttggccatgtccacggcaagaacctcgtggaggaatatcaggtacacaacgttggcgttcagtggatcgatggcgccgatccgcggcttctcgggcaccttgagctcacccttccagcttggggtgatctccatcctgtgctccagcgtccagctgctgccctcatcgtcgagcgagaatgcgctgaccacgaacggcttcttcgcattggacacctcgacgtaccggagcttcccctcgctgacccccatccgccgatacaagccaagaatccgtctccccccaattccggtcaggtccggcagtacgctgcccttgggcagctcgacgaagcgctcctccggccggtcgctgaacgggtcgacggagagggcgccccagctcacgtccacccaccacagccggccgccgaaggccaccacctggtggtccaggtgcatcacccgctcggccgccgccgccctctccgagcccgaggaggaccgcaccgtcgccacatcgtcccactcctcggtctccgacatgaaccggcgcagcacgctgctcccggactcccccctggtgagctccgcgaccacgtacctgtcgggcggcccgtgccgggactcggatcgggtgaggaggccgcgccccgtgctgtacttggtggtctcgatggcgggcgggaggcggtacatctggccgctgagcgggttgcagacgaagtgcgcgacgtccgggtcgaggacgccctcgctcgtcgtcctggacagctggagcgccacggcgaggcggacgttggcgacgacgggggcgtggtagcgggtgtcgtagaacttgaggaggaggagcccgtcgccgctgccgccgatgacccagccgacgaagccgacggcgtccccttcggcgtccgggagggggccggggttgacgaagtgggcggggacggagaggcgggaggagcgcgggggctcgacgaggtccaaggacgcccgcgcgctccgcgacggcgcccctgacctgtccagctccgcctcggttaggatcatgcgccacggagggcgtgacgcggccgtggagagcgcgcggcggagatggcggcccgctgcggcgccggcgaggcggcggagcagcagcgacattttcccaaagccggcgaggaggagtcgaggagagggaggagggtgggaaactatttaacagctcgagtgatgtccacccgtttatttcatctcatctaaatagttatgaaaaaaattaaaaatatatgaataagatagataaatatgtaatatatcaatccacaaacatacaagttaaaattcaacttctatagattgtaacaaaaataacaaacaaaactcaaaatactatatgtatatttacagttaaatttgttatttttgttacaatttgtagaagttgaattttaacttgaatgtttgtggagtgatatattacatattgatctatcttgccaatttttttgaaaatttttcatagccatttagttgacatataataaacgggtggacgtccactcgaactattagaatccatttccggaggagggtttatgtggacccgagtgttatatggggtccacgtgtcagcgagcagtactgcatgtgccgtggattgggatggagatggagttggggttttttcggttcacatggactcggttcgcgcaggtctgacagctggtggcacagctaaagacacggtggacatgtgccacgaaacagtttgggtgatggtccgcggagacgagtattgtcagttactgtaggtctatggaccttgttcacagaggatgggcaacagatgtccaggaggcaggaggtgagtttgaactttgaatgtgctttgactgtttgagctgcctcggctttagttggaatcctgtttataacacattaatgacacaactagccattaatttcccgccaaagggcagcgccgagccgacgagcatggggcttttgccggcttggcaaagcaccactgcaccagtggcgacacgtgattgagccttcgatttgaggcaaatatgccctctatcttaaaatataaaaacataatacgaaataaacatttcttagtattataaatcttaataaaagatccgtcagattcatagcactatgaaatatcatattccatactaagtttatatattttatttttatattttgatataaagatagttaaatttcggggtggcggtagtagacaacaacgagagtgcttcaaaaaatatcctatcccctactaggtttctatattttatttttatattttgagatgaaaaataaattttggggtggaggtcgtagacaacgacgagtgcttcaggcttcatcaatggcgaggcggaggccgtcggcgaacaggtatacggggagccagagccatccatgtcaggtctgagtgtctgaatgatgcataaggtgacacaggttcagattgatggttaaatatatgaactgagatcatgtgcaatttatactagggctgcaacatacagcttcagattgagttctgcgcagtggtgttttgcgatatatcctacagcttcagatagacattcagaagctggctagcataggattgtcactctcctgcattccggtttccaatttcagcgctgtctcaattctcatgcccgcttgagcatgcatagaaatttcccagaaatacataatgcatacaagtataaaacagtatgaatcacaccaaaggtgacgaatactacaatattttatcaacctctcagaaaataaacaggaaatgatgattttttttgtggcataactaataagttcatacaattgagtcactatctcactctaggttatcctttacaagccatttaattgaatagtagtgttcacagacaagctgcagagcttccaaactgctcgacgtcaaacagcaaacaatatagtactaccttgatagcaagatgtcgcattggcatgtgatattccaatgtcattgtctaagacaaggattttcccacatttttcccaaccagagaatctggtaatctgctgttgatgagatcccgcagttcaaactcactagggaacctctgctcagctaattttgagaaaacctgaaaagtgtaagcaattttcgttaaggaagaagtaaggaggttgtttactgctcaagtcatgatcgtaaatcaaagcctctttccatgtagcagttcttagtagaaaggtacaaagaaacatggagaaaaacatacatgctgaaacaaagtattcacatatctctgtacttgcatatcaaggtaaaagtaatttttaattggtttaatcctagaaataaaattagcccgtaatgtaaaaatggcagataaaaagaagttttacaggtgtgtctgacatagaaagcataccaaatctccattgcagtaaacttcaaaggcaccagaactttgtaggaaagattgcgcaaaattgccaaatagccagattgttgccatggttccaaatctattggcacgcagtgagtagtaccatgggggtggaaccattccaagtctggggaaaatatgatcaccagccattattgttgcaatggctccaacctgaagaattggcacaagtttgccaagtacacgtttggggaagggtggagggtaattgtgcaagataacatgaatgcctggaaatgatgtttccagcatgcgcttcatagtcattgcagtccccctacaaaatgttactcaaactatcagtgtaacctgcagatgcaaagcatagaatctattgaattgtcttttggatggacaaaagatatttttataaattagaaagaagaggagaggctatttaggcacacaactttaattgctctttcaactaaaatccattagtaatcaaggtaagacaacaagtaccaaagtccacagattgagaaatatacatatcaaactttaactataataactaattatgttctatgttataaatacaaagtaaattaagtaaatactcatgctttcagcttaggagatctatatccatatataacaattttttatatggtccatatcacattttattgcatgcaatatttcactgtaacctaaaattcaattgtctggtaacagtatacaaataattcaaagagttcttttactgcctattgagcatttttggaatgtcctactactttgtcatagcatgatcttagagcaaacttgtggtatttgtctgagtaatcaaactttccatggaacaaataagcctcctcaggtgcataactaattccatggaacaaaatgtgttttaccaaaaaaatagagagtgtaggaacatcgcaacaagttaagcataaaaagtaaaatctgcaaatatctattgatccacaacgaatccaagctaaaactttctgatcccaaagctataagtagggaaagtgtgatattcagtgaatgcacaaataccggcatttcatactaactgaatcacacatactcggcattggcatgtaacatctgaaattctgaacgcaagctagaggcttatatgtgcaaagcagctgaaagcatggatcagcacatatatgcaatgtatcatcacaaattgtctcatctcaaaatagaaagagctaaatgagatgagtgtcataggcggtgggcagagagatcgaggtcttagggacgggatagagtcggttggataggattagactgggtcctcccctccatccttatataggtgattcacactgtgtatgactgttatcatttacatttttctttctaatatgtccaacagatcattcacactgtgtattaacgataactgcagaacccatatcccatacaaagttccccactactgctaagatgtaatcgtgaatttaagaagcgaactggagtgaggcttacaactaccaagcatggagtgttatgagtgtacatatgaacacaggacgtatggcagtaatcgatcatatgtagcactagagtggagtaccaagcaatcccacctagcaaatctttgtgcggagtagatttttttttagatggttttgtgcaggataaatcgaactgaatattatcaactgtggcaagcacacaactaagccgcttggtgctcgctacaacaatagtatgctcatttaatctgcacagaaataatccaacgaaccaactgcggccactgataccacatgaacgcaaaacacactggactaacgaaactcacttgtacgagcaggaggcgcagaattgcagctcgacggtggtgccatatccagctccatcaacgttagcctgctacaaccgtgccaaaccccccaaaaaaaagaaaatcagcacgccgcttagatcgcagcaacagaaactcgggctagggttcacgacccacccacctgtatggcctccgcggcgggatcggggtgagggtgggggtgatggtgcggcggatgcgggtggtgaggcgggtgggggtgatgcggcggatgcgggtggtgaggcgggtgggggtgatgcggggggtggtggtgaggcggatggggatggtggtgcggcgggtggtggtgggggtgccggagatgcggcggcggcggcgcgaagatgtgggagaggtcggagaggaagaggagggcggggagaccgacgaggaggagctgcacgcggtccatggcttaccactactcacactgctgcgctccgcgtcgcctcctcctcctcccaaccttttgagaggacgcggaacggaaggaggacgacccgcgaccggcgacgcgatgcgatgagggagcgacgaagcttccgcttgggtcactgacaggtgggccgcggatatgcgggtcccagttgtcagtgggagtttat

SEQ ID NO: 45483 - DNA, 7898 bp, Oryza sativa
ttgcctactacctcatttgttgctctcggtcgaatcgcatccctcatcacaaaactggttataacacctccctcagcttctagaactagtgcaaatcaatttattcagagatttagcaagcagtttatgctgatgtggtaggttgacttggtccatctgtgctaatgtggaagcctagtcatcaaatgaattgaaaataaaagtggggccgtaacaaggtaaaaaagaaactatagtgcccacttgtcagccctattcctcccctctcaatctcgacgcaccatgcagacgcaacccgcatctcaacatgtcgccttggcgtcattgccgcaggaggaaggggaggggactgtcacggcagtcggcagcaaaggatgcgcttggcgggcggaagaggacagcaatgatgatgacacgcggggcccacaacaatgactaccaccgctgtagccctctcttcccctcatgttgccatcttcctccacggcaacctcgaggttgacgaccaggaacatgaataggttggtgtggaatcgatcgaggcggagctcacacatgcggtgggggcagagtggtataggaggaaggtgaggttggtgaggagcacaaggaagaggaggagcgggagcgtgcgagtggaggtggacaaggacataaacaaataatagcatcggtggaggatgaggaggcaatggaatgagggagagagatgggtggacgacacatgggggccactatgatattttagtggctgtttggattgtagccaaaataaaccttactaagttttgtcaatgccaaaattttggcataatagtaataattgccaaaattttggcaggatttcttatgtattgaccaaatttagcaacaaactaaatgtagacatttttttggcagctttaccaaaaaatgatatagttaaaaatagcataaaagtgaacgtgcccttaagtttttctgctgactcggcaagtcaaacgtggttagcttaccatgtcaacgtaaaccactttctaaatcatcgaaggaattgatttgcaccgatttctgaagttgagggatgtgttatatccagttttgtggttgaggtatgcgattcgatcaaggtaaaagaagagggaggcaaaatagacttattcccaaatgggtagcaattagcatcggcccaattccataccaccattgtgatcaagtcaagcactattccagcatgactgggcgcttttctggtaaatttcggtgcagctttgggagaacgggagctactacgagtctacgagctacctctaccggcgggaagaaaatgctctactccaaaggcgattcctgtgcaatttcctcgacttacgtcttttgagagagaatcttctctctaccgcctgaatgctacgagaacagcttcaaatatttcctttcttccagcgacacgccataagtgctcaccactcgaactcgtgcggtaaaactttggtggtgtaaggcgaaagtgaaacgtgcaatcattaaccgaactccgaactgtgcactccagtgtccactccaactcgttcagtcatctcggcttatatggtccgacaggcgacaaggcgacattgtggcaccatatcaacagcagcaacagacacgcagcggtcggttttaggcttccctacgattattacgagttgacggctagttcgaaaattgaaactccacatattgaaatatcatattaacattgagtaaaaaagcgatttattacaatatactccatccattccaaaatataaggcacagtcacccttaatccaaagaccaagaatgtagtttgaatcatcctaataaatgtaatgcatgcatccaataggattagataacatgagagtggagaatttgaaaaagtaataatttaatagagaagatgccatggttgattgtatgtttgcatgcatgtcttatattatggaacatctaaaaaaagtggttgtgcattatattatggaatggagtgagtacttagttaggtattaactattataaatttaaaaacatttttttatttaaacacttgtgtaaagaaattcttttttacttaaaacacattgtttatcggtttggaaagcgactaacatacaaaaaaaaaattagagttgaagtttagaaatcatcataagccccacactgccagctaaccggaaccgggtgtgtttgcaatcctgggttcccgacatgcatagtacgtacgaaaaacggaacgatctattagcacgtgattaattaagtattaattattttttaaaaaaatagatcaacatgattttttaagcaactttcgtacaaaaatatttttaaaaacataccgtttagcagtttgaaaaacgtgcgcgtggaatacgatggagaggggttggtaacaggattgcaaacacaaccgtagcgcgaatgcgtgcgtacgtgcgatgtggtcatgtggtgatactgataggagtaggacacgcacacgcggtagctagcgaggcaggctgcccgcgtgactgcggctgagttcggacgggggatatgagaacccaactcctatcgcacgaaaaacggagcagtttattaacgcgtgattaattaagtattagctaaattcttttttaaaaatatattgattttatttttttaatcaactttcgtatagaaactttttgtaaaaacgtaccatttagcagtttgaaaagcgtgcgtgtggaaaactagagaggggatgggaaaagttgcatgcgaacacagttgttcggtagttagacggggagttattattgcgatgagagcaaacagctgttcggtagttagagcaattttaatagtatagccaactactagctccaattcatttatagccaatctaatagctcattcatataatagttacatactcccttcatctacttttgatagtcatatttcatcttgacacacagacaaaaaataagtgattctacttatcatccatttaaatatgctactagtcattcctcgtaaacaagcgattcattaatatttatatttctcgatgctcatgcaaccaatcttatatggaagaatgaagagtcatgtattaaatccaagaaaatcattaagatgataagttgttggattgaaatatgcatatcaaaaataaaattttcagatttggaaatatgactattaaaagtagatggagggagtactacactattaatacttggtctcacatgtcatacacactgcgttttggagtccgtgctacaaatctgtagcccgctgtccttctctcttattatttatcttcttaaaatatatatgcagctagcttatagcctgccattatacccgctcttagacggggagttattattgcgatgggatttgattaagattaaggcaccaatggttaggaggaaggcgccctgctttttggcgggagtggggcacaagggaaggaagggaggaggggaacaccgtgcgcgggccggcgcatgatggcgccctcggcgtggaaagggaggcgtaaagctgggctgaaccggcacggcaaggcccgttttgtttaatccccgggggtttggtacgcgcaccaatggctcttcgatagggataaatctattctatcgaaaatgtaattcagtttttttttattatgcggataacacacacgtacgaacatcacgctcgtacactcgcaatgttaatctgggcttctttttgggtttagcggaatgctgtggaatttgccgttttacgaggagcgatcaatgataacagtaagtataagagcacccgcaatattaaagtaagatgctctctataaaatatgtacatctcagtaatagactagattaatagtaaatcacctcaatagtatgtctacattggtatctatagctctctaatgcattgcctcgtttttctctatagactatcttcagattagtagatagttttgttctctctcttcattcaatctctttcaaataggaaaatatgctgacatggatctcttgcagagaacctatagataaccattgcgggtgccataagagcaggtacaatagcatgctataagccagctacaaatatattttaaaaagataaatggggagagagaagagcagcgggctacagatttgtagctagctatagcacggactccaagacgcggtgtgtatgacaggtgggactagatattaatagtgtagtaagtaactattgtatgaatgagctctaatattatagccaactactagctccaattcatcgttaatagtatagtaagcaactattgtatgaattggctattagatcggctatggatgagttggagctagtagtgggctatactactaggcaaaatttgccatgggacacccaaaaattgtgtaattggttgtgagacactataaaatcgtgtcattgctgatggataccacaaaattcatgtaatttgttataagacacccgagacaatattttatcatttctgattaaaaagatgggagagaaatttcaaaaagacaaaattgccctcagcgtcgctcgccatctgccaccgtcgaagccgctgccgccgcgctcactgaccgtcgtcgatgccgccgctgttgctcactgctgcctggccacagccacctccgtcgccaccaccgccatcgaagccgctgccgctgggctcatcaaccatcgtcgaagtcaccgccgtttcccgctgttgcctccgtcacggccatcactcgccgccgccactgccgttgttgaagccgcttcctgatctcgtcgaccatcgtcgaagtcatcgccgtagcctctaccgccaccgccgctgggctcaccgaacgccatcgaagccaccgccgccgaagcggccgccgggcatatgcgggccgcgggccgagcggcgcgaatgggcgcccaggtgacgccatagggaagcgctcacccacctcctcgtctcaggccgctgccacctccccggcgagcccagctgctagcccgacgccatcaccgccgccggagagatcaaccgacgtgaggctgatgccaccggaggggcacttcttcatcccgcaaccgcacttcatgcacagctactagcttgtaccaggcggcgacgccgaccaccaccaggtctccaacaccggcaacggcgatggatcaatcgatggatcgatggaagcgccgatcagaaggggcaaaactatcattttatgtggtttctttctcatcaattcagtgaatattatattttaatgtgcccagtgtcctgcagcaaattaccacacttttagagtgtcatcgggcaaattcatgtctttcgggtgtcccacaactaattacacaatttttgagtgtcctgtagcaaattttaccctactattaaacttgtgactactagctctaattcatccatagccgatctaatagccaattcatacaatagttgcttactacactattaatatctggttccacctgtcatacaccacactacgtcttgaagtccgtactgcagctggctacagatatatagtctgctgctcttctttctcatcttttacttcattaaaatatgtttataactgactaatagtctgctattgcgcttttttttatctccctcacaatatgtggaatatatatatgtaagggagtactgcattaaacttgttttaatggcatatgtggagccaggaaccggtgcagagtctggcgattggtcttggattcttgggaagagggcatctcgctgtgcttacgttttgtgatttttgtcagccgtccagtctttttttttagaaccgtcagccgtccagtcaaagtgatgatttatgttgttacacaagcgtgacacgccttaactcaggtagtttatgggtgtaaattttatcttgcgaaaaatggctgaaccgagagaattgagtaaatgtgtaggaatagtttaattgcattgtcttggaggagggtgacagcaagaatacccaaagtattcttcggtcttactccaagcaagcaaccacttttgaatgacaaagtataatcgaaaggaggcgtgatacgtttcatcagtcaaaagggaataagtggctctttcgaagttaggccaaaccagagaaacaaaaccaagcagatatgcatttttttaacgagaatgatagctaatggtttttcacaatcatcatcataaatgtgcatttatatatataatattattatcccagatacatggacgtgtccaatttaaatatgacacattcggtggccttttgacttatgagaaaagtcatttacttacaactgaaaagtggtgttcagagatataaagaaggaattggttctcttccttttagctgccctgcccatggtcttctcatcataacaaggtgaccatttaaggttaaacacaacaagacaaagcaaataaggtgatagtacttaatccttcgctgtaaataagaatttgtttcttgatatatcatttgtagaaagaatttatctcttgattatcataataagcaccaaaattcaaagtcagcacttcgttttcttctgctagaatatgtttcacgattaatctcgccggaatgtcttatacagtatttgcatacatggctgtttatcggttatgattgaaaatcttgcggataaactgcccggtataccggccagaataattcaaatttaaatataatatttaatgttttctccttgtatagtaagaacatactacgttttttttatcaaaagaacatactgcataaactagtattttatcttataacatcatgcttctagtatataaatgtaggggaatttaactatttgccactattgcgtttgacaattatccaaatacccctcttgcatttgcacttaactttttttacccttcttaaaaggtggcttcttaactatttgtcacttttactcacgtggcatgcacgtggcaacacagagcgaaaaatgatgtgggacccactagtcaatgtctcccttctcttcatctctccctccgccggccttctcacgacggcggctttttcctcgctaccgtgctttgcacggcctgccgccccgggtggtcgctgccaccgtcgccggtgttagcctaggcgaagtcaaagaagggcggatcgagggagatgaagtggaaggagactgactagtgggtcccacatcgtttttcgctcaatgttgccacgctggcatgccacgtgggcaaaagtggcaaatacttaataagtcatcccttaagaaggaaaaaaaataagtgcaaatgcaagaggggtatttggataattgacaaatacaataatgacaaatagttaaattcccctgtaaatgtaggagtatttatacatcgaaactatgaaaacctacactttagctgtatcaaaagttcaaatccaaagttcaataagttaattcgaaatttgggttcaaactcggttactggtgattgaccagaaagacaagtttttgtttttttaagtatttttctccaaacccggcatccgaaacttgtttgtacgatggtcgaaaaaataatacgaacatccaccaccggtggaatatccaacgatttctgcgagaataatcgctaagaaaattctgcaagaatcttgtgactaaaataaaccttaaacacaaccgtcatcagtcgcttaataatgcgctttccttcaccggattatccgattcctctcgtcacctcacccgcacccccacggtcgtcgtcgtcgtcgtcaccggagccagtcaaaactcgccgatgaccgtgggccccaccacccccgaactccaaccccgggccccacgaggcagcgacccatcggtcgccatggcaacgccacgtgggaatgttcctcgtctcgccgcgctacgcgtaccccgggaca

SEQ ID NO: 45484 - DNA, 4551 bp, Oryza sativa
tgggtaactgctgccggtcgccggcggccgccgcgagggaggatgtgaagacatcgcacttccccgcctctaccggaggcgggaagaaaaagccgcaccaggcgcggaacgggggaggcggaggtggtggtggaggagggggaggctgggagaagaagcggctgtcggtgctcggggaggaagggagcgaggtgaacggcgggatcgaggagaagtacgcgctggacagggagctggggcgcggcgagttcggggtgacgtacctgtgcatggaccggtgctcgcgggagctcctcgcgtgcaagtcgatctcgaagcggaagctgcggacgcccgtggacgtggaggacgtgcggcgggaggtggccatcatgcggcacctgcccaggagcgccagcatcgtgtcgctgcgggaggcgtgcgaggacgacggcgccgtgcacctcgtcatggagctgtgcgagggaggggagctgttcgaccgcatcgtcgccaggggccactacacggagcgcgcggcggcggcggtcacgcgcaccatcgtcgaggtcgtgcagctctgccaccgccacggcgtgatccaccgggacctcaagcccgagaacttcctcttcgccaacaagaaggagaattccccactcaaggccatcgacttcggcctctccatcttcttcaagcctggtgagctccccggcactgagatccatccgcgattcggacaatcggacgaactgttttttttttcgcgcttttggattttttgggggagttttcgcaggattggtgggttggcagccggttgggtggaattctctgtactctgtagtagtgtagtggccgttgctgtagctgattgctagtatgttcttgcttgcgtaatctgacgagaacttgttctcttttggtaggacttctaacttttggaacaaacatatacgcactgcagagtgagctctgagttcagatactggaatcttaagaactaggttgagtcgttgagtggttgctgtttttggaatttgggaaactaccggtgggagcagacgtgacagttgctatttccaaatatagtgtcctggtgctgcccttataccaagtcttgcgtgctgattcctcattccacttcagtttagttgttttgggtaataagattcaggctttcaacacaacaattgtagcaactcttcttataattctatttttatcaactaattaatttggcaccaatgatcttggttgttaatgtacacataacaatatacacttgtcgaaccaggacactaagaatatgctgtaagagacttgaagcagtgctttacaattcttttttatgcttgtttatgcacttttctcaataggtagtattcttctatttcaattccattccccttgtcctctggttgaattctagtaaatagttaactacttggacaacaaatttccagtggctctatgtttgcttctatgcaatctcagattgttgcagaatgtttcacattgtaacagcctgaatcttatagagttctgttatgacaatcatcatcactcttatatcatgtggcattcatgcaattaatttgttcacctcatatccatttccatactggtcctgcttattggtagggggaaaacatattttcgccaggtagataagttccttaaaaataagtggctactggaattttacattaaaacatggaacaactgaacaatgtaaattctggagctacaaaacttgccatagctaaaccttgatgcatttcacagtttttgccaaaaaaagtagtcttcaaaatttgtgttgatttgtttgctgttgattactggagtcataaatgctttaatgtggcatcaacattgggaaaatatcgatcaagcctttttcagaagcactctcgttttcttctcataggattctgttggattagtaatgcctctatatgatatgatcgcctataggtgtggaattattcttattttgatacatattatagaatgaatcattgcattgtttggattttgtttaatgaccaactgttttttgtaagacacctcttcacatttccctgtgaaatgcctgtatgctatatatttaaatatataaaatgtttaatctgatccactatcttgattgttcaggtgaaaaattttctgaaattgtgggaagtccatattacatggctcctgaagtgctgaagagaaactatggacctgaaatagacatatggagtgctggtgtcatcttgtatattttgttatgtggagttcctcctttttgggctggtaccaactttgccttctctttgtgaaaaccttaaatcatttagctttgctcttctgcaaattcttaccaagcaaaattgcagagactgaacaaggagtggcacaagctatacttcgtggaaatatagattttaagcgagaaccatggcccaatgtttctgataatgctaaagatctagttcgtcagatgcttcagcctgacccaaaactcaggctaacagcaaagcaagttcttggtaagtggcacatagtgcttttaaagctggcacattgttaactaagcatgacttgtacttccttttggctatgtgatgcattgattgcactagtaattgttacaaatagttgatgatctagctatgctttattgcattttcctaatgtgatttggaaatcaacagtaagaaactggctgttgatgaatgtcgagaatagtatgagatgtttaattgttgctataaattcaaggtaaatttgagacttggatgaaccatagttcatactggcaagtgccagatggaaacaacttagaagatatgtaagtttgagcaaaagaggtaaaaaaaaagaagcatagttattaccaaagccatggacaacaactgatgcaattttaattatatcttatattgccttctaaacttattgagttgaagcatgccaaatggtgtagtgaattagacaggtttgttttattttgcttcttcatggttatgcgttattttgtacaatcatgggatgcttatcaaactatgaatcatttgcgtcaaaaaaaaaaaactatgaatcatcaaaggaattcgtcgtgttgtccacatgctgaataatgtagacaattaagcaatcatgttttaccacgtatttccttttttctttgatcagactcagacagtgatatacaggcttggtactcaagatagctgtttcacttctgttgtcgcagagcatacctggcttcaaaatgctaagaaagctccaaatgttccacttggagatattgtaaagtcaaggctgaaacagttttcaaggatgaatagattcaaaagaagagctctaagggtttgaatccttctctaattgattatctttttctaagtctaacaaacatatatatttactgaaccgaactgattcttgaccaggttattgctgatcacttatcagccgaagaggttgaggacataaaggacatgttcaaggtgatggatacagataatgatggtatagtctcttatgaagagttaaagagtggaatcgcaaaatttggttcccatcttgcagaatctgaagtgcaaatgcttattgaagctgtaagtaacctggaagtatttcacttgcttgttggagttcaataaaattgagttacaaaagatagttcaatcagattaaatgttcaccatctttggtgatagctgatactgtgtcacatgtttttttttctaagtctgatgtctggtgcaatgtaaaagtgttccttttacaccacatggtggaaacactggccaattttccctttattgcccttttctttttgcaataatggatcaagggcataatcaaactgttacttccatttgtacaattgacctgcctgttcttctcattagtcttgacatgtttatatatttcacggagcgtgctgagacatttactattaacattccttttttgttttgtcattttggtgtctttttggtccatagtatgcaatttgggagtcagacttgaatacatgataattaggtggtctcaatggtttgattagtgtaaatgtgtaatgcccttgagtattaataaaacaaaaagataggtgatttgcatatctgatatttttgtggttggaaaataggtggatacaaatggtaggggagcactagattatggtgaatttttggccgtttcacttcacttacaaaggatggcaaatggcgagcacctccggcgggccttcctatttttcgacaaggatggcaatggctatattgagcccgaggagcttcaggaggctctggtggaggatggggcaactgatatcatggaagtggtgaaggacatattgcaagaggttgacactgacaaggtgatgattcactaatgctggtagcaatgatataacctccagatcttatgcctttacttaacaaacatttcgatcgtttattcaggatggcaaaattagctatgaagaattcgtagcaatgatgaagactggcacagattggagaaaggcgtcacggcattattcaagaggacgttgggccgcaggaa

SEQ ID NO: 45485 - DNA, 3644 bp, Oryza sativa
ccccccccccccccccccccggcgacgccgacgctgccgtgtgggcccccctcccccgcgcggtgcggcgcgggcgcgcgcgcgcgtgtccgttggatcccgtgcggccgcaagcttcttctccttcttcttctccgcttctagtagacttctagtagtagtaaacttggcgtcgcgatctccgcgcgctccgggtgcttcgcttcggaggtttgggaggatggcggaggcgtgaggtgaggtgagggagtgtgagatcgcgggggggcaatgtcggtgctgggcgcggagggggcggcgatgggcttcctcccggccgcggagcacggcttcgcgcgctcggcggcgccgtcgccgctgcgggaggaggaggaggtgctcgacgacgacccgaagctgccgccgttgcggatgcccacctccttcgccgcgttccctgggtccagctccggctccgactccgactccttcctcagcatgagctccacgccatcaggtaaattttgcttcatcaatgcgtgcgaacagtacaaaatctcctccagagagaggaagcgtgtgcctggggcagtatgatctcgatctctccgcgcgtgattgggagacgcgccgcctcaaattgtctgttttttttttgctcgaattctggtccaaaatttgtcaatctgtttggtggtggtggttgctgtttttgggttgatgtcagggctgatgaatccgtacggcgtgtggtcgccgcgcgcgccgccgtcggaggcgtcgtcgtcggagatggagttcggcaccgcgcgcgagtacgacaccaccgatctcttcttcggcgagaattggctctacgacgaccacctcttccacaccaattcggacggcgacgagggcaatggagaggacaagttcatcgttggcgctgactctaccgcccagtggagcgaaacgcgtgagctcgacgattgcggcggccgccaccaagtgcacacgaaatccaaggccgacgctgaagcctgcgcggaagtgtatacctgctcttcagcgccctgcagctgctgctacggagggaggaagaatgatgatgggttgacgagggattcttgctctgctgtctatgggaggtacctgatcatggatgaccagacagaggtgctggatgagtgtggtgcagatgcattcctgttcacacgggatggagatgccatgctcaaaagtgaacagccaattgattccaaaggcggagatatcgagttgctggacatgagtacggtggagaaggagcttcagatgctcagtccgtatttggctgaggcagatgctcttgagagtgagtattttctgacttgtcctcttaattatgttcaatcttgcagttcacgaaatccttgaagctcattaattttgttgttgtactggatccagaatactcagttcatttctcagaatttatttcacttatccttgcaaagttttgttttcttgtggactagttggttttaattgtggttatctcttgcagaggctgagcttgaacacgatttcagcggcaatggggaactagatattaacgttgttacaaacgagaaaactgccgatgacaaagaacttctaaaaaatagttacagcatacattctttacctgagataggtgatcctctagatgtttatgagatggaggactttggacgaacagatacaagtgttcaaaattctacagccaataaaatcgctgaagatgcgagaacagatattgatcttgcactttctagatttcatgaggaatatgaggtatttgagctgagaattttccaccggaagaacaggttcgtcatcagatgctttcttttttttgtttattcttccgccatcatgtaaatatactttccatgctcatgtcataagtgttctttgcaggactggttttgaggaaaacaaagagttccctattgtcatgaattcagttgtaggtggaagatatcgcatcactgagtatcttggctcagctgcattcagcaaggttgtacgggcacaggatctttggacgggaatggatgtctgcctgaaaataataaaaaatgacaaggatttctttgaccagagcttggacgagataaagctccttaaatttgtaaacaaatacgatcctgatgatgaacatcatatattgcgcctttacgattttttctactatcaggtatgtgatgtaaagataaaatgaacacaatcttttggtgtgctttactcaatctcattttgtaccctgtggaatgctgtcatccaaaaaaatgacaggaacatcttttcattgtcactgaattgctacgggcgaatctgtatgaatttcaaaaatataaccaagagtctggtgatgaagtgtacttctcattgcgcagaatacaggtatgcctgactgttattcccttttccctgagagtatctccggttgtgttgttatgaaagcttgtaaccatcattttgtctgttaattttatgaagccttcattactaaagaaatcatggaacgatgcaaaagtgtttacttctgttgttgcaatacacttcagttgtaaagaaatttctcttaagaaaaacagttgtagagaaagatctcttcatccattgatcttccatgattaatatttctctgacattctgttttatggaaggttaaaataaatacttctagcatgattaagttatgctgtaaaaacataaaaaatcctgctgaaatatgatatgttgttgtttttcaggctatagctcgacaatgcttagaagctctggtgtatttgcatcatttaaatatcgttcactgtgaccttaaaccagagaatatcctcatgaagagttacagcagatgtgaaattaaggttattgatcttggaagtagttgcttcttgacagacaacttaagcttatatgtccagtcacgttcttacagagctcctgaagtcattctaggtcttccatatgatcagaagattgacatttggtctctcggatgcatcttggctgaactgtacactggtgaagtaagttttcaactattcatctttacttactaatgtccatttgtcggtactatattacattgtcacgacatgcttacattttgtctagggaaattgatgtatttactcagtcgaaggaaaagaaaagtacaaaccaggatttgtccatggttaaatgaattattgtgccttttaactcatcccgcaattgctgcagtcaaggttttgattgtgggcttgtggctaatgttctttcttgtataactattcagttcatcccaagaaaattaccacctcctcaattgtcatagtcttgaaatattggtagaaccttcattgttatcgcaacactgttattaattttaagaaactgtatgcagaaattggaagagtgattcaagtgcttatggcttatctgcagaacatttaccaaatttaagaaatgatctattagtaactgtaaatataccggggaatccccatcatgtttctttttatctagttccaattgaagatattgtatttagtatttaccacttttgttaaaagtacttgaaacataaaaattgttttgtaactgtaaaccaaataagccaatgctctcttttttttttctcacagaaacaatgtgattgagatctttct

SEQ ID NO: 45486 - DNA, 8276 bp, Oryza sativa
tttaaatgttgaataccaccgacaatatcattgacaattaaatctctcttaggaactgcacttagctcatttggtgccatactgccatgttcctccttactactcagttttaaacggttgcattttttttttgtttctgtagaatcttatatcaagtgaagctttactctaaatcttgttatagaaaatattttgagtcgttaagaaatgatagctgacaactaaaactctagtatatgttatattggtggtagaaagtttagtcagaaactgagagccttatgttcctgtcatcttaatgtttctttgcccaaggtcttctgtgattgggcacccagattgtttctgtactttcgtgtggatctggttcccaactcaggcgttttggctgacactgttgtttgttagcgtgatctttagaacaagaatttcagttgttccccgtcactcagtttggtactgttgccagtgttgttcaagcgatgccattaatttcttgtccaacttgttttaggagacggatcagttggagtacttgatcccagagaagatttccttgcggcgtcgcttgcagtgccccgacaccaaatttgttaaatttctttcctacctgttacaaatcaaccccagaaagagaccaacagccagtgaagcattgcagcatccgtggctctcatatgcctatcagtgagatgtcaaccaaatgtgtttatacgggatggatcgtttttctgaagttccatttgcaccaggatttggcttttccgtttttttcagggcagtccttggttagcatcgaaaccctgttttccgagatgaatgcaaacttgctcgtgcatgtaaatatgagaagaagaaaaggttccttgttgcatatatgtatagctgtcactttgatgtacttcacccaactcatcaatagaaatgtgtttcaagtttcaacatacccgggtctatctttggcgtttgctctgaggcacttcacctaattcaagtttcaacggtcaagtgcgatgtcaatgatcttagtttatgatgttgccactaaatcattcattaacagaaaagcagtaacattgaaaatttgaaatccaaacatgtgaaaaaggatggggggcacaaactaactgaaatctgctggaagcctaaataaagaggggatcaaatacaaggcctgacatatgaaaccaaaaaaatgcacgatgtagctccaaaagaccatcttaaggtcacaggtgccactgaatcatcgctgtagaaccttgatcaaaatttacaagccttcaggaactcacagaccattataactgtcagttagattatcagaactgtcagcaacaaaaggtcactatacaacaataaatttacgctcaggatacaaatagtgatctgcgatctccgtgtcgaacaatggcttcgccatacggaagggcctggatgaataacattatatacaagtgttatctccaagagtataggtggcctttgagcctttgcctaataatccaatgccctggtggcaaaacttatgctgcttgatcaatttgtgggatcccatgtctttggaaccactctggcatgtgaaatgtttcatacaatgccggtctaacatcattttgcagagaaaggtgcttgagaagtggaaatataactcccataagctaaaatgtttgagaatgtcagtggatcagtacaccagaaattgtatgttcagaacaaaaaggagagttatctaaattgtaaccttacctgatcatcaacaggttgtccagccgagaatgtaagacaaggtattccattcaatggttgcagcaggaaactatatggattgttatcaacaaggacaattctgtggaaatctttcgacaaacaagaaagatcttttacatgctctctatattccctggaattcagcacacggcagcgtcaaataagtgaaaagctcagctaacgcagcaggtagcacaatttcttaaagaatatgtgtctttgactctttgtgaaatcaagctggtagcaaaaccaggaagacatgaataagttatgatcaacatgatatgtgaattaccaaaaacatcattacaataattcagtttcacataaaacagctatacattagagattccatgggcatgaatcggtgctacctatgggtgggcacttgcaatatttaagtttgtgcttgcaaaaagcctcccactaaaatcaattgaaatcacatctcaatatttcagtgagcaagacaataattcattaaggcactatggaagtcagaagcaaaataatccattatttacaatccacaaaaatgctaacagtaacttacgtggtaacagttgatggcctgtagagacggtgacagaatctgttgtgagcatctatcctgtcaactaatggttttgcatatcctggagagaaaagcacaggttactaaaatgaggtgaattcaattgagttctagttgaggatcaatatgactattcaggtaacagaccttctaaaccagcagtgaagagaataagatcagcaaattcgctagttctctgcaaaaattcgtgcaaaccaggacgctcaaatacagtaacacggttcaccctctgacttccctcagcatcctttatatcaaggaaaatacaaactctgataagcaacttcctggattttagcagaatatcaataagaaaaggatggcagcttacttgccttttcagcggatatgcactccatgtcaaagcaatgcagtcctgcttcaacagcctcggcacgaagagcagcaggaagacttgatgactcatatgcacaaactagagtttcatccaaatcaagcactacctggagtcgagcaatcccaattatatgattgtaagttacacaggtggatgataagtttattaaaaggggattagggaaatcagtcgatgtagaggataagttcattagaggggattatggaaatcagtcgagtaatcccaaatatacgattagggaaaagataggttcattatgtccttgttcggttaatccctcctcgaggccttgttcgtttaaggattaattccacactcccttaatcccctctaatcccttttctcctcaagaggatcgaattaataccgatattaaccgaacaagacctaaagggaatcgatatgaacacaacaaagatagatagaaactaggtctaatacgctgtcaatggcgactcaatatcagtataattaacctgctatgtgtgaaatgaccacaaattagcaatagtagtttgtacgatcactcaacagtcaacagcaagaaagtgaacacaatacacacagctcgctccaaagatgcaggaatgaactaacacacatctcggtccgtaccgtgagccgcctgagcggcggcggcggccccgtcgacgacgcgtcggcgggagcctcggaggggagccgcacgaaggcgaccgacggcgacggcgacggcgacggctggggcggcgcggcggagaggagagggtggcggagcccgaggaaggagaggaggtgcgcccaggaggaaggcgtgccgcggacgatctggagcaggatctggaggaggaacccgagccaccccaccaccgcccgccacgccgcctcccccggatgctgctgctgccgcaccggccccacccccgccgccgccgccgcctccggcgacaagaactcggccgccgccatctcccccccgcgccggaccacggggctgggcttgctggctcccggagtgcggctgcctgggcggctagggggagagctcggggaggaggagagcaatcatagggtagggagaaggagaggaagaggagggaggagtagggcaggtggccgacggagtgtgggagtggatgtcgtcggtctttgccctgcgtcgtcgtcggacacgagggagggcttcggcttccctcggataaacggtggaattcggtgacaggctgacatgacagcccagccgagattatacaaatcagctgttagacatgttcttttctgcaacgaaaacggtataaaaggacctctttttaaactgctaaacgatgtgtttcgtgtgaaaactttttatatgaaagttattctaaaatataagattaatctattttttaagtttataataattaaaatttaattaatcacgtattattatcatctcgttttacgttaaacacttaatctttattttcatcttcgttcttcaggagatatcaaacaccaccttagtctcaaatctgcattcgcaaaggaataatctttcttttctttaaaaaaacggaaggaataatcacctcataaactcacttcattgggaagtactccctaacagtgaatcaaattagtttcacagtatactttcatattatggcctattcactttgatgaaaaaaaccctaaccaaattttgccaaaattttggcaagttgtcaaggcagaattttttatatagttattaaaatttggcagcaaactaaatgttgccactttttttggtaattttaccaaaatttggtagggttgaaaatgaccctatatttgttttgcgataaaaatattactatattttttaaaaaataacttgattatatttatgtaagtttaacttagaaaaaaaaataaaacgatttataatataataaaacggagtactcaatcacccatatgcactcaatctagattaaacctcggatctcaatgcaaattatacggatgatgagctgtggtgttgccattttttttccagaaaactacctacacctgaactggtaatatactcactacatccatttcaacataaagaatttcttaatcatataattaattatacggacaaaattcattacattttggggacggagccgtgcacgtaaccactcgctccaatttatcttctcacgtccaggtcccagccctttggtcgcgcgagaaaacggaacaatgctgctgtgtgcagcctgcagccaaccaaccaggcacgacacgtggtgcggatcgcgaccgaagcctcacaaaacgcggttcatagccaccgtgccaccgcccaccgctgcccagcaccgtcccaagtacaatgaacgatttttttcaaagaaataatgcagctttaataaaaaaatgaaaatagatatcgatcatctaaaatcataaatttaatacctcgtcaaataaccattgtttaataagttttaaaaacttaaaaacttgagatgtgagtatggctgagtttagttccaaactttttcttcaaaattcgaatttttccatcacatcaaaactttcatacacacataaacttttaactttttcatcacatcattctaattttaaccaaactttcaattttggtgttaactaaacacaccctacatgcatatgagtaggtcgtgggacctatcgaactttggagcttcaatagaccacccatgcttgctactcctatttctttttcttaatcaagctagttaacctatggaatagcctgtcgaacaatgattatcgaacttcagttgtttgagagggtgttaaatttatgatttttatctatcaacatatatttatacattttttcactagagttctattattttttaaaaaattctcaacaaacactcggtctaaattatcccgtcacattacatcacaccacgtcacagtcaactcactaaaatgcagcagcaggagtagcagcgaccgatccaaaccccagccctcgcgccgacggtccgagccgtctcgatcaccacgcagctcatcatcccctgcgccgaagggaacagatcagagccagccgagccagcgcggcgcggtcgcctttgccctgccctgcactgaccgttggagagccaagcaacccaacccaagcgctcttctcttctcctcctcttcctcccaaatcgatcgggatccgatgcgcacggaggaggaaggagcatggtgaggacgcccgagaggagctactcctgctcctccgccaaggaagtcgcctacaggttggttcgcttcgatccccttcccccttctttttccgctgcttggatcaagaacacgggttctaggagaggctaggataggcgaaaccctgggttgaatcattcgtcttgattagtgtacttagaagagtgtttcttgggttgttcaagagtgcagttataaattcgatctgtttgcagctgctgggctcggatggatcttgaaatttcttttaattggttttgactgttagtgattggtgtgcttgctaatggctcaaactggactgatcagaaagcgcaccaacttcgatcagctggactgaaaactgaattagtggcacttttacttcttgtgacagatcatggtcttttgttcaatagaaggaattgaatgtgacattacgtttggcttgctgaaaagtgaaaattacatcctcatacctgaatcgacagtttgacactaacaactctcctatgaaacttaatttttaggattttgattgcgtattgaacacggaattgtcattttcgtgaaaattgtgaaaattttcttttcgtggaaagtggaaacggtagcatggtgatatcagttgtgagaaaggattcagggtcaattctcatggtgtgtgcaactgtatacacgtcttccatgtaatggaaaaaaattatctgatggtgtgtgctattctaacagctgtggttactgtggctatgcattgaacctgagctcctcaacacggaacacagcgaacattggatccaagtatggtaagcagatcaggaaaggtgtaatctcattctttgcgatcgacgagagtcggttcacacaaactgatgaggtgagctgcatgccatacttccattcaaggcgctcctggggtttgttcagaaagaggacaaggttgatctgccgcaaatgtggtggccgtatcggtaatgcttatgaggatgaggattccacattgtatgatggttcagatgatttgcacatgagctccgagggctacagcatgtcgagtggaaagaaatatgttatcaagattaatgcactgcagccttcaaccgatgactctggtgttcccttcaccctgtgatgctgttctgaacttctgcagtatgcacttttcgattcttgccttgcgctatactggactgtcaatcaagtaactgcagaaccaagagattacgtgctagtgtgtaactgtatattttgataggaatgctgaattttgcctacctgtatttataaaatggaagagtttgttgtctatttacatatacattcagagttcagtgggtgtgcaactgtgcatcatggacctggatttggcaatccatatttgggcaaatgtttagttagaaatcaggtttctgatgatgttcagtggtgtgtacttgtgtcttgtactgaaatattgtagtgtcttttgattttttgtgtatctaaagaatgatgtaaatcttcagctattctaaacggcagtttttttttgtttgtgttttgaagctatgccaattaatttctgccactaatgttgatatgatttgaagtgaattcctgtgactctgagcaatgctatgccattttcagaaattgcaattgtgagtaatgtgcaagagccaactgccaagtgcagaaactcattgttaaaattttcctgcggagaaatctattgaatctaaagctcagatgaattttcctgaaactatccagatttcaggctaattcagttgcaagaattaactgaaactaaagcacagatgaatttgctgagggaatacaaatgcaactgcagtaacagaaataactaaagcacagatgaatttggctactgcagtaacagaaatataaagtccaaaatattaaacgaattggatctatcgtcaaattaaagcaactcagacaccgcttgatattctgcaaatccgctgttcttagtattggtcagcgatggtcaaatcaatatatagcacatttcaagatgtatcagcccaatatgcaatgtagatttcaaccagaaacctatatcgaactcagcctaagttcaccaaatcgcactaaccaaaacaaaatttcatcccaaaacggacaaacacaaattgcacatcaacaagaggacagatccacaacattggctctgaaacatgtttcaattcaaatcccagttgcaaacatcatttgcttcacaatttcatgattcaggtaaacactagaaaaactaaacagcgaactgaacaaggtggattccacggctttccatcaaactttttttcttgaccgcaagacttgtgggcacgg

SEQ ID NO: 45487 - DNA, 2785 bp, Oryza sativa
agccccttgcctcccttgccgcgccccgacatggccgccgacgacgacgattccggtggctcgacgcacgagagagagagaaaagcgagtggaattggagaagaggtggtggtgattggagtgggatttggggaagaaaggggagggggttttaaaaggggacgagaggatggagtggggaggcggctgccgttggatgggggagggaatggacggtgaggatctggatcgcggggggaggagcggatcgttgacgtggcgtgaggcgcggatcggtgatttggcgggatagtgggaattttcgtggtctgagaggcggccagctcaaaattttgacctgcaggcgccgccaaatttggcctgcggcgcggccatgggactatgggagtagggacttggcgtttggcctttgagagatttttttcactgtttagtgtttacgaatttccaagggtcagtttttttcttaaaagtcaaagctgattttgaaatttgaaatttaatttttaaaagtgattttagatagatctgtacttgtgattttacagtcatttcaaaataaattgcgcaacaaatgtgacggagaaaccacccaaaattagccctagaaccaattatgagaattcaagatcaattgtagctctttcagtaacacactgggctgcgttctaaaataaggttgagttaggctaatccctcatttatcatgagcatattttccaaactactaaacatatattctataaaaaaatactatatatatataatatcaaataaaattatttttaattttataatagtttatgttagttccgtcctaaaatatacttcatccatttcatattataaaactttctaggattatcctgtctatctagattcgttaacatttatatgaatgtgggcaatgctagaaagtcttataacctgaaacggatgtagtatcatataatatcggatagtatatgtagtattgtatatatggatctcatccggtgttagattactatgttttataatggatgagctactttattaatcatgtgtaatgaataccttgggttccataccagtgactagctaagcccaacccaacagttgtaccaaactcaaccttagaaggttcaatatctacgattgttgacgaaaaatctgcactcgcccaatggtacaggaactgtgttggcgcgaactaagtcgacgaacacaatgacctaggagatctgcttagttctagtgcagacccaaaggttgatgagatgcaggcataccagtcagtttgatcctacagcaagtgataaaatatacaaatagcatatcaatgagccgatcggctgtcaagctgatggagtaatccagccaatgtcgataccagccgatgtcaatagtgtgttgagcaatcggctatatgtctaatgtagataatgatatagagacaatctgtcagggttacgggttaggcataccctttacccttcgatatacgttacatatcggtatggcatacccacgcgcatatggatacttcccgcgtacactaaggaaatccttcacgaagtctacggatgggaagagtcttactcggacaagactgggtcatcaatgtatcgtatagggtctgttatctccgagttctacttggaaaccgcctgacctgcgatataaaagggaccccccggggaggacctgaggcatcgaatctcagagccaacacaaccctcacagcctacgaagtcggagcctgcaaggagccaaatcgccggggatctagtcgaaccaactcgaccacgatctcgccggatccgtcaagttccattgttccctttgtaacctgtgttttctaccatataatcccacatcaactggattagggctattaactaccaaggggcctgaaccagtataatcctcgtcttttgtctgtttgatgtcgtattacgtagattattgtaccaacgtaccccaataccctctatatccggtctacgggtaccacccgtcgacagtggcgcgctaggtagggggccttggtactcaaggttctactactatgtcatccagcctcgtcgacaacagcgtcaacaccaacctcagccaagtattccctgcttcaacaatgctggtgtagactcaagtcggcgaaatcgtcttcccggtttacaccacgacgccgatctcaaccggtccgtcaatgactggaaacgagaacgcagtggctacaaaccaaggtgactccatgtcaaaaaatcctcccgccgaggcggagaacggagcatcgacgacatccgagctcgagaaggattctaatgcggccaaaccttgtcgttccgacatgaaccgcgagccgacgaagatgacttctgaagcgacaaggtcctggtgtcctatccacaaaaccaggaaacacactttgcaagcctgctgggttttcctcaacgtccgcgctgaaattcgcgcctgtaaagagcgtggaattcaacgtatttctccaactcgtgatgtctactgtcctattcacaagacaaagaatcacgacctctcaagctgcaaggtcttttccagcgccatggaagcgccatcccctaaggtccaacaggcacacatccccatcagggataaagacaaggaacgaggagcgatgccaacttcagatcgatttgttggggtaatcaatatcgatcctcacgaactatcagtcttgcaccttcttgaagactatgggtcatcgacaacaagcgcgccgcgggaggtattggctatcgatgatgtcggcatatcagcgtgc

SEQ ID NO: 45488 - DNA, 772 bp, Oryza sativa
gtgataaccgccacaaccaccacgatcacaacgatcacaaacggcgggtgctagacgatactggttgaggacgtcgccataacgacgactatgatggagaccggcaccaagacaacagcgggagacgacgacaggattctcgagatccaggccgacatcctcgtaatcgtacgccagaaccaagcgacccatcgtcatcgtcatcatcctcgtcttcctcatcatcagacagacatccacgaaggacacacgatcgccgacaacccaccgcccccagcgctgggtgtagggctttcagtcgttccctacatgatgtccgatggcctgagagattccgacccagagcaatagagaagtacgatgggagcaccgacccagaagagttccttcaagtctactccacagtactctacgctgccggagcagacgacaacgcattggcgaattatttgccaactgcgttaaaaggctccgcacgttcatggctgatgcatcttccgccctactcaatctcttcgtgggcagacctgtggtagcagttcgtcgccaacttccaaggaacctacaagcgccacgcgatcgaagacgacctacacgcgttgacacagaacccgggtgaatccttgaggaaatatattcggcgcttcaacgagtgcagaaatacaatccttgaaatcaccgacgcttttgtaattcgcgccttcaaatccggtgtcagagatcgctatactacccaggagttggcgacaagacgcatcacaaccactcggag

SEQ ID NO: 45489 - DNA, 24469 bp, Oryza sativa
gagtcaagcaagaagaagaatcgcaaaaatgggaaaaggaaagctcaagcggaagtcctcgcagcagaatacgcgaaccctcccaagcgcccagacccacaaagtagcaacacaaagaaagcttggtgccccatacacaagacgaacagacattctttggaagattgccttgttttcaaaaaatcgctcgagaagcacattgcatctgaaaaaggcaaacgagtacgcgtggtcgaaaaggacgcggaggcggctccctaggaatcggactcagcatatccagactctgacctccacgtttcacacatcttcggaggttccacaacatactcctcgaagcgagagtacaagaaagtggaacgcgaagtctgttcgacatggcagggggctgcacccaagatgaagtggtctgaacagaagatagagttctcggaagaagaccaccccaagaccgccgtcattcctggacgatatccgatcgtggtcgaacccactattcggaacatcaaggtcgcacgggtcctcatcgacggtggcagctcaatcaaccttcttttcgccagcactctggacgcgatgggaattccacaaagcaagttgacaccaaccgatcaaccctttcatggaatcactccccaatcctcgtccagaccattgggcaagattacgttgcctgtgactttcggccaagccaacaacttccgaacagagcagatcacctttgatgtcgctgaattcgatacagcttacaacgccatcatcgggagaactgcacttgcaaagtttatggccgcatctcactacgcgtatcaagtgctcaagatgccgggaccgaagcgaataatcactattcaagggaacgcaaagctggaggtgcaatgcgacaaacggagcctcgacatggtcaagcaaacgcccagcccacccgccacaactgagccacccaagaaagtgagcaaaacaaacaagacgccgaaaccggacggcgcaatcaagattgttccactctccagtgccaaccccgacaagaccgtcaagattggggcgacactaaccgagaaataggaactcgcgctcatcaccttcctccgcgacaatgctgacgtgttcgcttggtagccgtccgacatgccaggggtccccagggaggtaattgagcacaaactcatggtgcaacccgatgccaagccagtaaagcaaagactgcggagatttgcaccagaccgaaaacaagccatacgagaagtacttcatccagaatggctagccaatccagtcatggtgcggaaggccaacggaaaatggagaatgtacgtcgacttcaccgacctcaataaggcgtgccccaaggatcacttccctcttcctcgaatagatcaactggtggactcaatagccgtctgtgagctgttgagctttctcgacgcttactctggctactaccaaatcagcatggcaaaagaggacgaagagaagacatcattcatcatgccgttcggggtattttgctatgttaagatgccgttcggattgataaccgcaggaaataccttccaacgcacggtccagggcgcacttagcgatcagctcggcaacaatgtcgaggcatacgtcgacgacatcgtcgtcaagaccaagacatgcgactcattgattgacgatctgtgggaaacgttcgacaacctccgacgatatcgcctcatgctaaatccagagaagtgcacgttcggagtaccatcgggaaagctgctcggtttcctcgtctctggcagaggaatagaagcaaatcccgagaagatcaaggcaatcgagaacatgaagtcacccacaagactcaaggaagtacagaagctaaccggatgcatggcagcattgagcaggttcgtcgctagtatgggagaacgagggcaacctttcttcgctctgctgaagaagcaagacaaatttgtatggacacaggaagccgaagaggcattcgttgcactcaagcgctacctatcaaccccctgtacttgttgccccccaacctaatgaagaattattcctctatattgccgccacgccatattccgttagcaccatcatcgttgtcgagagagagaaagtacaacgaccaatctactacatcagcgaagctctccacgacgcaaagacaagatatccacagatccaaaagcttatttacgcggtcatcatgacatcaaggaagctacgccactactttcaagcccacagagtcacagttgtctcctccttccctctcggtgaagtcgtgagaaacaaagacgttgtcggccgcattgcgaaatgggtgttcgagctgagccagtttgatgtccactttgcgccacgaacagccatcaagtcccaggtactcgccgactttgtagccgattggactatgcctgataacaaatcagacaaccaagtcgacaacgaaacgtggactatggcgttcgatggtgcactcaacagccaaggagcaggggcaggatttatcttgatgtctccctccggagatcaattcaagcacgcaatccacctcaacttcagggcgaccaataacacagccgaatacgagggactactcgccgggataagagctgcagccgcacttggggtcaagcgactaattgtgaaaggggactccgagctagtcgcgaaccaggtgcacaaagattataaatgctctaaccctgagttatccaagtatcttgcagaagtcaggaaactagagaaaaggtttgatgggatcgaagtcagacacgtctaccgcaaagacaacatcgagccagatgacctagcacgacgtgcatccagacgagaaccgctcaagcccggcacttttctggacatcctgacgaagccatcagtgaaagaggttagcggcgaagttagcccggacaccctgtcgcgaccgagaaaatagattttcccgaatgctagtgtattaatccccgtcccagtaaaagccggggtacaccacacaaacatgatataaaagacacatctttattatatcgataatatttacattattacaaaggcacttaaggcctgacaataaaaaataaacagtagcggactagcgggcctacggctccatcttcacaggcgctcaactggggtataagccaggactccacctaagacttcttctccaaagcttctcttactgaaggggggagggaaagattgagctaagaatgagtataaccacagtactcagcaagccacaccggtagatgcatgattaatgcaagggggtacaaggggtaataatataggggttaagttttgcagtaaacagcatttaaaattcacttagttgcccaaagctattttataaagacgatcctagagctacacaatattattaatcaaggccgtgaaccctcacgaacctgccttaacccaaggcctacgatgattcagaccgaactggcaacccgaccctgggtcccagctcgtcccaagccaacccaggccaaccattccatattttagttgttaagtaggttttaagaattaaaacactaacttgggtacattgctaggcttgcccataatcgagggcgcggctattcgaataggttatactttgatcagaggtgtacatctttacccacaagacacatcttcctcacatgtaaccacgtgccacataccaccacggtatacggacggaagacgtgacatagttcccaacccatcctagccataaacaagagtaccgacccaaccccacctacggccggaacctccgggacaggcaggcaggattgagcccatagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcaccttgagcccagcctaaaaccattttgggggttttgaatagaggtggaggtgtgtgtccaattccaacataagccaaccactccatagtgtccaaatgatatgagaattcccaaagtctaaagttataaaaccacctaatgttgcctaattaaccagcgaagcatctacctaagttcatactagtggaaccataaatagagtacccactagttggggttttattttcctagggtgaacaaggtaataataacaatagaaataataataaggtcataacaaaggtaaataggcatggctaaataaaacagtgataacgcaggaatttaaataaagcgataatgcattaatttaaatcaaaataattttataaactgggattcaatatgctcaaggatgatgtgactttccttgctcagagacaacggccttccgaaccttcggcgacgaccacgaaccatgcttcgggaacctccggaacgatagaagctacgcgaagcacacaagcaaagctacaagcctataaagaagcaataacaatacataaaaagaaagcacacagttctttaggttataacaaacattaggagacttgaacggatcgattcggagctcgtatgaccaagacatggtcatccgaagtttaatgctgttatatggagatttgcggattattataattaggttttacaactataaaacatgtgtaagcgctagcctggaaaagacaggaaggctgcgccgttgacatacggaccccacatgtcaacctaaaggaccgcggtagaccgagtatacagagacggtccacgggtcgatggaagcggaccccgtgtgtcaaccgaggcgagtagctgacaaacggactccactagacaccacgcgggccgcacacgtggaaacaacgcggctaccgagcgggcacactaacacggacaccacacacacaagcgaacgattaccaacaccagtacacgggtaccggcgtcgacaaccgcacaacgggtacggggcgacaccgaaaggacgaggacggggcagcgagaggagagatccttaccaccacgcgacgaggcgagggaacgacaacgacgaacgagcgcggcagagacggccgggaacgacggagacgaaaggcgaggggacgacttcggcggtgatccttggacgaaggcgagacgcggccggcgtaacgcttggcgatgcggaggcgaggacgaagacgacgacggggctgcagcggcacacttgacgtacgcggacaacggacgagaacggcttgacggagggacgaacgccacgacgaccgggaacgacgagaggacgacgaccggaatcggcgaggaggcgacaagggcagccggcagcggctgcacgagacgaggacggcgtggaacgcgctgctgcgatgaggacgagggtggcggcgcagcgagacgacgtgccgggcgaccgacgggacgtcgacgttgaggacgaacggagacgacgacgacggacagcggaggggttcggatggaggggaggcgaggccgagggagaccttgccgctgcgaggccggaggagatgacgacgcgatcgaccggggaaattccggcgaggaggatggagaggtcggcgcggcacgacggtgttccggcgaaatacgggcgacgccgtggcctggccggggaagaggacggcgttccggtgccgggagaggcagcgacgacgaaagccgacgctccggcaatgcggcacaggcggctggaggtggtacagtggcggcaacgccactgtacaccagcgaggacgcgtctccgatggtccccgtgcgaaacggagggcaggccggcgtagaggggacacctgcgaggccgaggaaggtggtggcgacgtcagccgccgcacgggcgaggcggcacaggcggctggagggtggccggcgccgagggaagagaaggaggaggcggggagaggtggtgcggccacgggggagctcgggaaggggctaaaacgatagaacgcacggagggggttccattttataggtgaggggagggagccgggcatgggagagggcggaacggtgacgggaaacacggccggcggccatggaaggcggccgggaatggcgcggccgttccgggcgattgggagcgccattcaagggggaaaacgggggaaatcaaagaggaatcaatggggattaattccccctatttaattttggaatcccatgattaaatcgcacggatttgagggaggaaaggagctagggttcacgggagagggaggaggccgtgcgggaggaggaagacgaccggcgcgtgggccccacgcggtcagcgcgcgtgaggggtgggcggctcgggaggctggggcggctgggtggcgcggcttgtgccaggcggccggcccaggaggagaagagggagaggcggcctaggggagagagggaggaggagggagctgggccgaggggaaggagaggaggcccaagagaaggagggagaggaagagagggagagaaagagagggaggaagagaggactttggccgcgggccgagagagagagagaggggactttgggccagttggcccaaagggaggaaggagaattatttttagctttttctttttaataaactttgttaattgttgttgttgtttaataaatatttccggtgctctgaaaattcaagtaaaatttgagggctccttttagaccaaggagaatttaacaaaaaattctccgggctacattcgaaattttcttgtatgtattttagtgtttgccaatttcttttcgaattttaattaattctattattccttttagaaaatgatttttatttcgggatgaatttatcaggacgtgacaaatccaccccccttacaagaatctcgtccccgagattcgaggaggctagcaagaagataggttgggcggtcttctcttcttgtctgacttcttccatcgcgtcttttataacaaacttgcctagcaaaacttctccactctggactgcttggctcgatctcctgttgcagatggaatcttctcttcacccgacttgtccctggttgcacctttaactgactcagactaggctacggtagttgaggatggggcttcagttccagaacttcttataattcatatctttggcgtcaacctcatacaagttacccacttcacgttatgcgtcgacatcagcttgtcattactaggataccatgcttgtcatcatgagaatatcatgtttgtcatttacttctaacttaccactgaatgctttggactatgatatcacgcttatccagcataccatgtttgacaacttgccactaactgcatcatattagctttcctggtctccgggtgctagatactattgctattcgatgcaagggtcgataacttttgcctttgaattacatttctcaatagaaccgacttatcccattggtcatgcttcgacgacttctcaaatgactttacagctggacttgtaattgtctggttgttatcctgccaaatctgaagattcgttgttagatgtgattttaatctgacctctgtagattatcttcgaacatatcacttggttcataactgggaatagctctcatgaacaagcagctcggattcactttctttacattcagtttacttcccactattatcttcaggttgtcattatttagcattcaacgtattcctttacaccttcgaccttgatgagttccttcccattggatcatctcccaagacatggcattgcctggtaatcggtgcctgcacttttcactccgtgtagcatctgataccgagttgaagatttcactcctcgccttcatggaaacacttttacctaggtcatcttgcttactcatgatttttttttacctcaatgacaaggtgattgttgcggggcaattactatcaggggtcttccttgagcgatgcagagcatgtttttgtttatcctttatcaatcacctttcggcctacttctttcctgctagagaacatctttgccaatctcttttatcaatcatctttcggcctatctctaacaggtggtactctttaatgtgggttgcggacgcttctggggaggatgaggtcctttggcctgctgcctttcagtgaaaccttgaaatggttttgtcaaaaattagacttaacgggtgttgcctttgatccgaagaagacacatctgaaactcttagtccaaacaaaagtcccttttggctttttaatccaacacagtttaattggttttcttttccatcaacaggttggttattaactcgaggttagaatatgattcctctgaaatgagaccctaggtctcctttgacagtaaacaattatacacataatgccatatcagcatcttccaaaagaatcctcatagaacttgtttttattacacatttctcccttattacatgaatacaaggccctaccttaaacaaaaagggaaggtgcttaacatcggtacattgcatcctcaacatgaatcatccataaacatagcaaactcactgtttataaacatgaatatatttatttattacatgattgttgcaaactcccgattacagtgataggtagcgaagtgaaaatcacaaacatggctactcattctgattttggagagatatagctggcattgttctagtgactgcatcatccttgattggttccgtgatgatgtgataggactgcatattgctatcattcacaggagaagcttccttctgattgctggttgaagcggataacggtcttctgcttggtatcgccctcctgaggttgattgccctttgctcggcctggagtaggtcggggagagacacaacttcttccatcgacgacaattctttgctgaggctgtcggtgcagagaatggttggtgctgaaggtattattgctatgatttattgcagagtcaggtggagcaggaggagcattggtgctgtggatgatattgtcaatgttgctgttggagctgactagctgatgagacaatcgtagggttgttcgttggatttctgcggtcttggtcaacaacacactgagttggcaatccttgggcacatggtttgtaccttcgcatagaaaacatgtgaccttacaggtgggacattcccctggtggatggtcttcttcacaatgagggcagagtgtgagacacatgctagcaacgtgtccaatttctccacaacgggtgcatgcttttgattccatctcttcctcgccgagatgtcggggaggctcatcttcatcatccgaggagacttgatctgacccttcactatcagatactctgccaccatggcttaggaggtgctgggtcaactgtcgtgcacctcggaaggtatttcctctttgacgtctaggaatagttatccctgctggaggccattcggtgctggtaatagtcatcttacgtacttcttcttcagttcgcatcggtgcttttctcttctgagtcttactcttcttgcctttggcttgcttagtacgtgaccccacgtggtacgaaaggctaggaggaaagcattttctaggattcaatggattgtctccattgggctctccactttgcacactaggctgcaaacttgacttggtgcaaggtggctggtttagcgatgtctgccctgctgaaccaaaggaagtggcttctttggcatatacccatgggcaattcagggcatagtgtccttgttctctacaatcatgacaaaaggggacatcctcttctggcattggaagctcattgacctggggggcaaatgcttgatcaaacacatactgattttggttttgacttcgaatcaatggtagctgtgaactcagcagcatgcttggaatggaccaagggtgtgcccttgttaactctcttgaggctagtggtggattgagttgaaaacttgagttactggaggcatacccgctgagagggaggaggagggagctgggccgaggggaaggagaggaggcccaagagaaggagggagaggaggagagggagagaaagagagggaggaagagaggactttggccgcgggctgagagagagagagagagagaggactttgggccagttggcccaaagggaggaaggagaattatttttagctttttctttttaataaactttgttaattgttgttgttgtttaataaatatttccggtgctctgaaaattcaagtaaaatttgagggctccttttagaccaaggagaatttaacaaaaattctccgggctacattcgaaattttcttgtacgtattttagtgtttgccaatttcttttcgaattttaattaattctattattccttttagaaaatgatttttatttcgggatgaatttatcaggacgtgacacacccccgacattagctcggaggccacaaaggcagaacgcgccgttgccgatatcgagacccagacgactggcgcatcccactaatcaaattcatcaacagcgaggagctgcccgaggatgatacagaggccgagaaaataacccgtaaagcaaaaatctactgtatggttggcgacgatctatacaagaaagcgccaaacggggtacttctcaaatgcgtctcgtccaacgatggcagacacctcctccttgatatacatgaaggcatttgtgggtcacacgccgctggtcggacattggtcaggaaagcttttcgacaagggtttttctggccaaccgcccttaaagatgcatgtgacatggtccagcgatgtgaagcctgttaattccacagtaaacacacaaagctacccgcgcaagcgctccagactatccctcttacttggccgttctcgtgctgggggctagatatactcgggccattcccacgaggacagagcggctacaggttcctattcgtggcgatcgacaaattcaccaaatggatcgaagcagtacccacgggggaaatcaaggccgacaacgccatcaaattcattaaggggatattttgcagatacggactaccgcaccgcatcataaccgacaacggctcccagttcatcagcgctgatttccaggattattgcatcgggctgggagtcaagatatgcttcgcctcggtctcccaccctcaaagcaacggacaagtcgagagggcaaacggtatagtactacaagggatcaaaacccgcgtctacgacaggctcatgtcacatgacaaaaaatgggtcgaagaactcccatcagtactatgggccatatgcaccacaccgacaacgtccaaccaggaaacacccttcttcctcgtgtacggctcagaggccatgctccccagcgagctacgacatcagagtacacgagtacagaagcattccgatgaggaccaggaggagcagcgaaacatcgatgtaaatctactggaggaacatcgcgaacgagttgccattcgagcagccagctatcaataggccctccgccgttaccacgagaagcgcatccgagcacgcatactttcgatcggcgactacgtcctccgatgggttcaaagccaagcatggcgaaacaaactctcacccaaatgggaaggaccttacacgatcacacaagtcttgcggccaggcgcattcaaaattgtagacggcgagggtcgcgagttagcaaattcttggaacattgaccaactacgtaaattctgtgtatgagtcaataccatccgtacttgtaagacaccttacagtatcaataaagcctattcttaggcccatattacaatcaaagtgtccccgcccgatgatctcttaccctgatgacacctagcgttaaaacctatcctcatgtccctttacgccgtcttgacaaggcctccgaggaacctaagggatcttcggctggggacgcccagagccgataaggccttgttagatcctgtagagacgaaagacaatgtaagatctggtcgtgtaagagttctcgccgtgcgtattaaccaagccgcgaaatcggaaattaactttccaacttcacggctgggagctaggatcagagcttattcaaccaaggcaggtcaaaggtccaagagccttatcctccgagaaaattcctccgacgacaaggctgggggctagggagagtgtacgactcaaacgactgactaaagtcgtgaactgagaacacactcttacacacgacatccggagtaagaaagatctgttaaagatagatttcttttctatttcacaaaatacttcttacagtttttacacaaatccaaagctatattacacctttttcctgagatatctatcacagggtacgaagactaccaagaaggccaacgccaatccatagactggaatatcttctccgccaacggcgccatcgacctcgccaggtggtgtatctccgccggagtcctccgagaacgagcaaaaccctcacggaggaaatcgagatccaggcgcgggcgatgatctcgtagacaagccaacacgtgccctccggcatatcggctcgatcgacgacattcctgcttcaaggcctcgtcgatacgcttgccgacgctatcaagttgagcacaagctccgttcagccacgagatgtacccggccgcggactcctcgggatccccacgaggtactcgaagctctctacaaaccttggctatggatgtgcagcaactcttcaagtacgagttgaactacacctcgcaacctcggagcgtttccacagcctgctttttcttcactgcaagcatagttctcttgagttccgctacttcaaattttgtcttccaatattggatacgacgatcttggccagcaagagcgctctcgagatctgcttagtatgggaatgactaagtcaggctataggcctcttccgagaacataggtgatctagtcgaaggtgcaaaaagggatgaatggatcactaacctaaggaagtggtcgccatgtccgtccccgtggcaagggtttggtctacattgtcgggcgacgcatgtggttcaaacgtgagagccggaataatcgccggtgactcgggttgcccgcgctgctggacatcctcgtcatcaatatctctacaagggacaaaaaactttcaagatcaacatgcaagagtaagctagaataataactgctcgcacaaaggcggttaagatccagttttacacagcatatctagggagtacaagaggccctactcttcaaaaagggagagaacagattcccccaggtcaccgacttcttccatcacctccttacgcgtgttgctagctgccccctgatccaagatctcgcgcagatcgagttcaagatgcgccagctttacacacgcaaggacgtggcacgccccggtgtagatcccgttcgatgtctcctccccgatcctggccacatgcttggaggggatctcctccatcgccgacgccagctccgcaagagaagatgtcagcgagaactcgttgggattcgccgggatagtagacttaatgccacactccctggcgagctggtgcagaccagtataggtgacccgcaacgagccacggatttccgacatattgttcccgagctccgacatgcggtgctcgagcccctggtgttgtcgctcattgccagccaccaactccctcatcttcttgaggtcctcacgagcctccgacatctcgtgtgctagccggtcagcccgctcgtttgccgacgacgccgccgacctcgcctccgcaatctcgcgaccgatgccgcgagcaccagcctcgaggaggcgccccatctcgacctggagctcctcccaggtgaggacggtagccggtggaccacggccagccgcgggatcgctgactgggccgcttggtgtcacctcgcggcccccgggtgcgagcacgacattcgacgaggccgcagcgggcgacgcgccagaggtccctccggactcgttttgcgcagccttcacccgcgccgccctgtgagacggccatggttcagacaacactcgaataaaatcacgaaaacttaagttcgtctacttacttttcgccaaccgtcacaaggcgttgtcgtcgtggaggccggggagatgtgtccgaggcctgaaaaacggtcgatgcgaagtaaggcgaaattcttctggctgtacgatctgacgacaggatagcttaccgagggggttgatgccttgcgatgatgtccgctcacagaggagaacttcctcccctttgtcggaacattgccaccacttgtagtagcagcagcagcatcagacgcctccttggcgaccttctctttcagagacgccgccacctgatggtccgcgagcggcccgatgatgtcagtcagaggaagggcctacgcttaatcaagtcacaatgtgatatcgaaaggaaaatgcagaatgcctttggagtacacttacattgatggcaacatcacgttcggccgcccctttctcacaaaggggaacggggatggtactcgccgttgtcggaccactgatcatcacctggccaacacgacgttccacggcttcgctgttcagacctgtgaatcgagaccaaattttgataaatcaagaggaacgcgaacatgagcatgtcaggataaatgcgagaaagataccccgaggagaaacccgagtcgcgtcctacggtctggaataatcaaaggctggatgggcccgagcctggagcggctggatccgcctaccaacgaagtctgcagcgacttcataccccgacaagcctcgtactcggagatcgtcgataatgtcgataaacgactagagagagggggtcaaagggggctttgcggtccaagacgaaatcttgtccggttgttctttgggaacaacgaagacagggtccgaatctttgatctgaaggtagaaccacctagtccgccatttgctgcgagaagaagggcactggaaggggatataacgcgacttcaggccatctcgaagtcggaacccgacgcaaccagacaccctgttggactccatccaacgcagctcgtagtagaaccgaaagagatcaataaagggctctaccccaatgtaggcctcacaaagatgagaaaagatgctaagaaaggcgatagagttggggttcaaatggaaaagagaaagaccgtagaagttcaaaaccaagagaagaaattcagaaggcggggggagaaaaccgcagagaatatagtcttcgatcgcaaccatgcgacctaagatgggctggggattagtacctcctgcttccctttccatggttccgcgaccgggaagggcgctgtcttcctgaagcttcttcagcgacgcactggtggaggatgatttgccgagatccatcgctgatcagagatcgccggagaaagggctcagatcgatgaactagggtttcttgtggcaacggagaagacgaagagcgcttacaggtgggatgttttcttcacaataggcggacttcaaaatggatccccaaaattcctttaaatagacgcacttacgactgtgcgaattccaaggaaaggggagagatgcccgccggagatttctgggtccgttacgtgcggcagttttttggacttcagtttaaattcactcgtgaccgttgggcttcacacggtgttctcgactacgtcctgtctctatggtcctcacaccgggaatgacaacagtctcgacacgacaagtcgcgaatggttacacgagttcatttaagcagaagtcgggggctactgtcagggttacgggttaggcataccctttacccttcgatatacgttacatatcggtatggcatacccacgcgcatacggatactttccgcgtacactaaggaaatccttcacgaagtctacagatgggaagagtcttactcggacaagactgtgtcatcaatgtatcgtatagggtctgctatctccgagttctacttggaaaccgcctgacttgcgatataaaagggaccccccgaggaggacctgaggcatcgaatctcagagccaacacaaccctcacagcctacgaagtcggagcttgcaaggagccaaatcgccggggatctagtcgaaccaactcgaccacgatctcgccggatccgtcaagttccattgttccctttgtaacctgtgttttccaccatataatcccacatcaactggattagggctattacctaccaaggggcctgaaccagtataatcctcgtcttttgtctgtttgtgtcgtattacgtagatccttgtaccaacgtaccccaataccctctatatctggtctacgggtaccactcgtcgacacaatcgactaatggttatgcaataaaacaatagtaatatccagtagaaaccaatcagctaacagtaatatgatagaataagcactgatccagatccgcggaggagcagcagtgctcatcaacatccagatccgcgaccatctcttccgcgcaccacctccttcgctagggtagcttgtagaaggtggaaatgagggagaggaggagctggcgggggcgcgctatcatcttcctccttcttggccgctccatgttgaagcgcgctgcgcgtggccgctctgactcgagcccacgtcgtcgacgctctgccttgggccacaccggtggctagctcctagcccgccgaagccgtctaccgccgcctcccctcatcccgctcaagcttgtcgtcttcgttgccgtgcgcccgtctgcctagtgcattggataagttggagcggagaggggagtaataaaaaagaaatagtatgcgacactaacgtgcaagtccacactatatgactcagcaggttgcaccacgtcagcgaaatcggccttcaaaaccgttgagagagtcaaattgctctagttttaatagctgaggggtgaagctatagttgagggagtcaaagtggacttattcccattagcaaacaccaaatcgagcccaccaccaccgcgctagctgtagccctgccaccgcgccacctgccccggccaccgcaccaccccaccgtacgcctcgccccgcgcaaaaagagggaaatccaccgtaagccgcgcgccccgcctcctccctcgctcgcgggcgcggctgccatggccatcgcggcatcgccctccggccgccacggtagccgacgcccccgcgaccgcccgcgcgttaaagccggtgtaatttccgcctctctcgcgcgagcgtccatccatcctcccccacccgcccatccgccccccgcgcgcgtcgcgcccagccgcccgccggcttaaccatgcccacgcctcctatttcgcgatgccatcaccaccaccaccaataccccaacctcgccccttctctcctccggccgcctcgccgtctcgccaccaccgcaaccctcgcctcgtgccgtacgggcgcgccgcgggagccaccaccccacgtccgtcgcgtcgcgtcgcgcggcacgcctcgccgagagagcgggtggtggtggtagtagtagtagcagtagaaggagggggggtcgggcggtcgcggcgcggcgcggcgtgaccccggccggctatgcttcagcgcgcggcgagcaacgcctactcctggtggtgggcgtcgcacatccgcaccacccagtccaagtggctcgacaccaccctccacggtactcgtctcgttcaccccccgcatgttcggcgaaatgcgcgtttgcagaatcttccggtcatgttggtgacggtgccgtgtttgggttaatttgtttctctctgtgtgtgtgtatgcagagatggaggacagggtgaaggccatgctcaacctcatcggagcggacggcgactcgttcggcaagaaggcggagctctacttcaagagccggcccgagctcatcaaccacgtcgaggagatgttcaggtcctaccaggcgctggctgaccgctatgaccggatatccagcgagctgcacaaggccaaccacaccattgccacagcgttcccggaccagatccaattctccatgcaagatgccgatggggaaggattccagaaggcgatatccgggatcgatctcagcaacttcaaatttcctgcgctggaaggtttgccaatggggtcacgcggcgctagccggggaaccagcccggtcccgaagaggacccagatgcaccggaggatcacctcccacatgaacaaggaaaatgcacaggaggagatcgacaagctgcaaaagcaaatcctggtgctgcagactgagaaggagttcttgaagacctcttatgacagcgcgctgggcaggtatctggacattgagaagcaggtggtggagttgcaggatgaagtttgcagcttgcaggatgcttttagcactggcgcggccattgaagacaatgaagcccgggcattgatggctgcacgagccattgtgtcttgcgaggatacattggttaatttacaggaccagcaacgtagatcatctgaagaggcaagaactgagtttaaacgattcattgaagcaaagaagaagcttgataccttcaaagctgagtgtgggcagcctcatacgcaaaatgatgaacctgataacagtgacaaagaatacatccatgcaatgccatctggggatgttgatgattctgttcagaatgagatcaggtttgacctgcaggaagtatgccaaaaggtcaaagaactaattgaattgcacccaggggtatcggtcactgatttagcagataaggttgaccgacttgtggagaaggtaatcgacctagagcttgctaccacttcacagaatgctcagatcaatagaatgaagactgagatagacgaccttcacaagtgcctgcaagccttggaggaagagaagtcggctttggttgctgattccagtaagctggtagacagattgaagcaagttgaagaggttttgcaagcagtccaacatcttggaaactccatacaaaatgggacacagaatattcataaagaaatgaatgcagcctgcagtgaacttgctgaatttgtagaaaaattacatgaacctgagccccaaaacagtggtttcatgaattcatcccaagagtcaagttgtcaagaagaagattcagaggtaacaagtcagtatgccaagaaacaaacatccgactcaatagatggttcaaagaatgaagtggagaaacaagataaaggctccgagggtcctttggtgcagcaacatcctgacacaaatggatctgatggtgaggacaagattttattagaggggtatgcatctgtccttcagagctacaagggtacagagcaaaagctgtcagaaattgagaagacaaatcaagagtaccattcaaggtcaatgtcagagctgaaggatctgaagagtgccaatgcaatgaaagatgaggagattcactctcttcggcgcatgctaagttctttgcagagaaagatgaatgcccctgctcctgagaatgtggacaagtctgaagaaacttccaaaataagcaccactcctgtcaccgaagacaaagagattgcagaaatagaggagtacatgaagcaatgccaagttgaagagcaacttgcttcgtcaatttccgaggaaaaatttagagcagagattgacagggtgttggagaataacttggggttttggttgaggtttagcacatcatatcatcaaatacggaatttccaaacatcatttgacaagctaaaaactgagatggataaattgattgatgcacaggcacagtgtggtgcagatggagttcctatcagttatcaggtagcaaagctggagtcagctgttctagaaaaaaaattccgggatttgaacacagatcttcaagtttggatagaaaaaaatgtgctattaaaaggagaactagagaacaggttctcatcactctgtggcatacaagaggagatatcaaagatcgcaactctggataaaagcgatgaagttcacttcacccctttccaagctgcaaaactccaaggagaggtgcttaatatgaaacaagagaataacaaagtcgctaaagagctagaagctgggctggaccatgtaagaggtctccaagtggaggttggcagggtgctcttgaagctccgagaaaatcttgaattatctatagcaagaagcaaccgagctcagcaaaacttccgtaacctgtcaacgaaagctggagttccccttagaactttcctgttcggcacgaagccaaagaaaccatcactcttttcatgcatgggtcctggggtgcataagcatcacagtggctcaagggctggtcgtagatgagaatggttggatcatcaactttcttttgtcaattaatacagaacagagctcagtgtacctgtcaattgatttgtggtatatgcagtttctcatagaccttaaatgtaaagaaccctgcatctcttaatataaatttggttcaccctgtccgctcatttctgcattgttagcttgcttatctgaccttactgccagaaccaaacctgatggaaatgtatcatgttaaattcattataattctcctgttactgggagaacctgtgcttattctagtgccttcaattgccaaattgaggtcaagttgataatgcctatataaaatagtggtacaactattttgctatatcccaagtgtatcatatcatgagttaatgacattgttaatcttctagccatgtttaggaaactatgaaattagtctgtgtattgtgggcatgtggcaaatgaatggaaattcagatcaaatgaaatttcttgctgtgcacaaacttgtagaacttagaattgctgatatgcacaatatccttccaatttaagaaaacataggtaagtgcaatctcaaacatgtgtgaattggaaaatactattgcatgtgagaatgaaacgagggcttgcatgtgaaaatgatgtgtggtcccaggcccacacgcctttctcacatgtttttttttcttcgaactttatgattttttgcatggtaccaagcaaaatggttcatttgtcaaatcttgggtagcaattcctttcttgcatgcatgattcaactagtggcaggttgcctgacaatagtgtccattgacttattgtatttgacagtatggttcatgtcatgattcaatataaatttcatattttgacatgttaacatcacaaaaaggaaactgtaagtttcttgtgctactgaaattctatttagtttcttctgtagcaccttttttttcatggaataatggtggacgctgtttgtttcattagatgctcttgtctcttaatagttttactgcaagtcttaggtctttggtcttaccttgggtggatttgatcaggtatgtctgatattaatgatacaaaatgcattgtatgaagttaaaactaccttggccgttcacttgtctatgaacagtaagattttctaggaggagacaaatgggctgtcaattatcagatgtgaccaatccttttctatccacaatacactcactgtttctagttccatgcatagtgtgctactttgctttatgggggaactgtttagttttccagtctgctcaccagctttctcaaagctcttctgatccttggagtggtattgtggtaagttcctgtttcttactttcttatagtcaaatatctaattatggatagttctacagatatctgaaaatgacaccaaccttagatggaactcttgcaaattgctgcaatagtgatgctttcatgttggctacagaaccaggatctcattgtacagaatcaaagataggactgctgggaaacctctagactctgtttaaggattaaaattgaaacctttggaagttgagaaaggcgggcttgagtttccttgtagcaagcagtatacggatatcaactacagtatgtcttctacacctttctatcccttctccatatgttagttgctagtcctgttgccttggtgattctcgtggaccaaagtatatgtgagctgtgcatttatatttgaaacctgttgcttgttactgtcccaaattctgttcataattggctcactgaactcttttatttttttaaaaaaatatgtgcagtgcaatacataaataaaataattgaagtccactgtttcctagttcttgaaaatgtgctatggaattctttaagtaggtttcttagaaaaaggtaggagcttcttatttctcatgtgtatcagggagggacaagttcaggctgtgactgctgtgagcttgtgatttgattgaagatttcaaaactaccattcctggtaagatcaccggtatatacatgctcgcggtaggtccacgtacaaaaatagcagtagcagatggttttctgtaccttcgttcatctcttaatacagaaggattgatggcaccttttccttttcttaatacatgtatggttggagcatattccttagctatgggtctgacacctgttcattcttcaactcttaaattcagcatgcttcttagtcttttatcaaagcagctagattttgaacatcttttgctttgttggaaaatattctcgtttccaatgtcctttttttcaactacatttccaatgtcttagctatatagaaagggggacaactttgccttgccatacagctcaacagtagatgagcaaacatgatagtgattctcaatggcaaatttgattatcaaataggcctgatattgtttacttggagcacacagtaacacatacatattttattttagagtaaattgcgtccacggtatataaacttggtaggtgggtgcgatctagtgtaacaacttgaaaaatgatcatttttcaatttatcagatgcatgaataaaagattatcatatctaaatagaagatataccatcttaatacaaagatatgcaagtcttatgcgtactccccccaaaaaagatcatttagacatgagtacaattgcatctaaatgatcatttaggtgtacacctaaatgatcattttaggtgtacatgacatggtatatcttctatttagacatgatgatcttttattcatgcatctgataatccttttgacttgatgattgttggctgttattagcttagagctgtaatgttaggaattttatgcccttgttaaaatgagtggccctactgcctttggtgcatagtatacactgcacacacttaactttgtctttttataccaatccccttcacttgcaataagcctcccaacacatcaaagggatccacagttcaaaagccatgttccatccttcttcttcctcgtcgccaccaacctacagtgactcctccatgcaccatgcactgagcttctcttcggctctgcccacagctccaactgaaattcctggcagcggcggcggtttcgtcgacgacaagggcagcatgttctctcttcccaatgttgcgggctcggcgccgcctccctcctactactcttccctcccttccttctacatccacaggagcaccagctcgcactccctccttcaccaccggttgtctgacctcctcaacagtaatgccgcattctcttactcgtctgctccagcttgccaattgcagcccctcccacctgtttcttcctccacttcatcatcctccggcgatctcttggagttcagctccgggaccctgcgccgtgtcttcagcaccggcgacctgcaggtaatgtaaccccaacccaaatctcaagctggaattgtagccattaacaaacacttttggtaaattcactttcttaaccctatgctgatgcacaacaggcgatgaatgtaccgccatcgccaccgccaccgccgccgttttcaggtgacatctgcatccaggaggtcggcggcccgttttcgcagaaggtgggccgttacagcgccgaggaacgcaaggagaggatcgagaggtaccgcgtcaagcgccaacagaggaacttccacaagaagatcactgtactggcctacaaaaccgcatttccatttcccttgcaagcaattgaccatggcagctactgtagctcatcatcatcatcatcccctggccgtttccagtatgcctgcaggaagacgctggcagatagcaggccaagggtgcagggccgcttcgcgaggaacgccgaaaccgaggccgatgccgaggccgatgcggtggccggcctggacaccgaggtgtacggcaatggctatggatactgcgcctacagcggcctcaccaacagtatcagcagcaattgctacgacaaccagagccagagccagtggtggggaacgccagctggcgcggccaattggcagcaccagcagcagaagcagcagcttggtttcgacgtcgccgtcgacggcgacgacgaggactacgagctgtgctgtggccagcatcgctgacatgtgctcagggacctgaccctgagctgatctgacctgtccggccacacacgccggcagcagctg

SEQ ID NO: 45490 - DNA, 16775 bp, Oryza sativa
taagaaaagagaagggtaaaaaaagggaaaagaaatagaccctctcgtgaaccaagccaagaaaaaccagcttgttgtttttgtgtggtcaggattagcaatttagtaggcatttagtactactttgatatctttctccgatagaagtttggccatggttttgctttgtcacacctgaaatttgaagaaagtcttgagtgctgcaacttttgtcttgctcccaatttgctcgttagtggcggctcatgttggtcgcccctgtggttagtgcgtggcatgcttgcttaatctcttctctctctgttttttttttcactgccaaagtggcaatggcaagtagctgaccccaggagctcactgagccaatcagccaaggggtgtgtgtacctgcctgccggaaatttcctgtcttgttacatatggcaaattgcctttcattggtactccatgttctcaaatataagcatttttaagacttaaatttttatccacaatgtaagcagttgtgaacacagaataggagtccaagcattttcaaccgatcaggagaatccaaacaatctaaaatttaaaaaaatttccaaacaattaaaaattaaaaatttaaccaatgagatgtctgaaaggggatatttccttatcattattcttttctaaacaagttacaaggtgccggtcaccgtctgactgtctctgatagcagtaacacaggcgaggcaggtagatatctttcttcttgcaagtgctatacgtccctaattctgaatttgtagacatctgtgattaccaataggagtgctttgacatggcaaccttggcttggctcaatcagtgtggcacctcatttttctgcagatttgccactatggttttctagggaggtttgatcttgtcgattgtcatcctggagatgggagatgcacctggccatctccatcttgagagtgctatatacttcctctgtctaaaaaaaacaaatccttgctacatcatgtttagatatatagcccgagtttgtctttatttagatggagggagtatgtcgtagattctgatatttaacttctcggtactttcacatggaccgtaaaatttattttttgaaaaacaaaggcagaagctgcctaacttcatttagaaaaataaaagtacaaacaccaaacccagagaaggggaacatcgaaaataacatccaccaaagtagatcctgaaattgtatatttattactatcttaatctaccaatacgaattcttcgaggaaaaagtaattctgtttttatttggtacgaatacggtcacacggccggtttggccatcggagatcttggtgcttacactgtctggaataacacggtttaagttacgtagatgcttatatctctttcaactgtcatagaatcaagatagtggaatagctttgctgccttgatgatgcgattggcaaaagcagcgacattttctctatatactatccatgtcttgcaaactatttcagtcatagaatcaacacactgatttcttgaacacggcactacggaagcctgaagctggcagctctaaacatcctactgctatcaagcaaaatttaaccaaatgaacagccagtgcagcattaaccgtgaggaataatcttgaccgatctttctgcaggcacatatcgattcctaagagcccaaatgcagccaatcttcagcagccttcctttttgaccatctgaaaccgttcaaatgcagcaaatgagtatcatcaagaataaagcaggagttgtcctagatatgtagcctataaagaaattttaaaaatggcatgaagagcacccaatgaagcagagttcagctctgcagtgcttgcttctttctgaagaacggcctgaattttgttggatttcggaatcttcagtgaagtaatggacgaccaagaactaccctccaaactgtttgcaactggcaaaggtgcagcaccagaggttgccatgatatcaaaagatcggtcaagagggaatccaagcattgtgactcaatgatgagaagagcaatgagtaagctttttacagtcggcccaatgttgcatgaatgaaaccgatgcctcttgcaactagcatacggctatctcgtctccctacagtcctaagatatttcttattgtcactagtcatgagattccatgaaaagttgcaatgcttctattgttgtatcagcaacttaaacttgtcatagaatgtaccatacgctaatgtatagaaaattttcagtacatgatgcaataaatatcgaaagctctgatgcatgtttgtaatgggtaaacaattcagatgtacctgaagacggactgcgagtctgcaataactctgtcagcacttgcagtggcggatccagaaaatcagtttgttggtgtcataacgtgtctgtcggtgtcatagtatgctaattatacttagaacatagtgttatagtatatggataagcagttttgttataggttttgccgaaagtcatcggtgtcgcttgacactgacgcttatactgtagatccgcccctgagcacttgacccttgcaggaatacaaaggtaagtaaatccaaagaacacaagattccaaaatcaatatagtaggaattagccgaatagattagcaacaaaactacaaaagtgtactacactacttcttactttagggcaaccaggagagccagtggtgagctaatcaaaatggtatgctcttgctgcctctctggaatttctgcttttccatcaaaaggctatgcatgagctgcattgtagagggagaatgaagggatacttgactgtcactcccctcccctagaggtggggagtgtggctggcggattctctgtcggccgctaatgccaagtacgatgcactgataagtgataactttgttaacttcactatgatgacaagtctaactagtagtactgtttagtacaagcttttgtgtagcctaagcctgcatatatataattctgatgaatgtgcctggtacaagattagttggctcctgtgctagtaaatttaactcccaacactgtttcatttatgtgatgtggaaaaaaaaaataaaacaagataatcaataatgctaggagcaaagcatgttgccggtaattaccagcacagtcagcaactcagcaagccggccgatttcaaattacaggaacaatttgctttctcaagtggagggagaagaaaggcatcatgtgaggtgtttcactcacaccttattccattacccagagaagaaatgaagcaagaaccgaagtgatggcaattctcccgtggacaaatcaatcataaggagattgtgagggaagaacacatggcatgaacaaaagtgcctgtggatgctaatgttgactctgataagaaaattaggagctggcctactaacccttcaccaattacaattattagttcttgattgtggacacgataaggatacacaatctttgtgcactcgacagatctctgtcggaaattggaaattcttcatttcaattggtccaattaaagcttaaacagggctgaatgaagttttatttgagaataaggtcagaaagtgttgcggtattcaacggaagtggagagaccatacgtaaaagatgcatggaatattcacctaaaattcaaatataataatgtgcatgatcagaacataaaaggggtccctgtgaccaaatggtaaatcatgcaaggcttgttcatgacacccaattcaggatcccccactgccaagtggctagtctcagataatttattctaggaagaatgttctgctggacaaaaatatatatttaagagtggatgtctttccaatatttgttgggacggtcaaacgaacttcacagtataagtactaggattagtgacttagtgttgtataagtgaagtgtagtgtaggtattgtgctctttctcctgatgccgtcaccatacgacagccaaacgtgcaaatcaaaaatcagaaagtgatttgtagattgtaatgtcagcattggtgcgcctcagagactatgcaatctgatataagctgatgaaaatctgaaatgttgtttgtcagtgccatcgatgtcattaccgtacaaatgctgctacagatttcagaactgtagtgtaatttagtgaatttttcggctcttagaggaaaggagatttcatgcagcaggtatacggtataccttttccccaccaaccggctgcctgcggcgcgcggtgcgccggcccgccggagaaggatgcggccgccggggttggcgcagcagacgtcgacgcccggtgccttccacggccgcagccatgttctcccgcctcccgcaacgcacagggcgtagtacttactgctgcgcgggggcgcctcgatcgacggctcagcggcgcgcttctcgccggcgttccgccgccgtcgccctcccccggcgccaccgcgcgggggccaacgcctccagcttcggcgaagtggtgcggcggcgacggagaagcacggcgatgcggtccccctcgccgccggccgatctggtcgcctgggcccacgaaagcccgcaaatcgattactgtacatggaaagtactcgctctacctacttttccaaaaccgaaaattttatttttgatagttttatttcaatccaacaacctatcatcttaatgattttctcaaatttaatgcatgactcttcattcttacacatatgattggctacatgggttttgagaaatgtaaatactccccccgtcccaaaataagtgcagccatgattttccacgttcaactttgaccattcgtcttatttgaaaattttctaaaaaaattgaaaaacacaagtcacgagtaaagtactactcatgttttatcatcttataacaacaaaaatgctaattatagaaaaatttcaaataagacggacgatcaaagttgggcgcggaaacttatggctgcacttattttgagacggaggtaatattaatgaatcgcttgtttacgatgaatgactagcagcatgcttaaatgaatgataagtaaaactacttatccttggtctgtgtgtcaagatgaaatatgactatcaaaagtacatggagggagtataccatatacgtatatacctatacatacgtaagtgtgtatatacgtatacatatacatacagtacatgagtagggtaagtagcttagtggttgtagtgatatgagtagcactgttaatgtcaaaaaaatttaagtcctagagtcatcagagttagtaagcgtggatttttcgtcaacacatccaaggtgttcaaatctccatagaaacaaattttagattggattatttgagggctatcttccctatttaatatgttaagtttctaatttaaaaaaagctacatatatcatgttagatgtagaggccgggtaaaaaatacccttccaaaaaatgagtatggttctgtacgattcaaaaccggggatcaagcagtaaatcgtacaatagtgcagggccttccatgcaaaataacctccacctctcgtagacgtagctctccatctaaggcgttcaatcctgatcggtcggctggtagttgtccattttggatcgctatcgttggtagcgatccgggatttgaggtcccaaacggtaggactattttagtatagggtcttccgtgcaaaaaatcctccgtttaaccgttactcgggccgactcgatcgatctgggccgcggaaacttgatcgtgtggctgagcctgatggccgccgtccaaacttccttctcgccgttcgcgtcagcggcgggcggccggccgcttctctccaccgccggcgaaggcggcggcatcaaaggtaaagccgtgagccttcctctacttcctctccattagccatcttcttcccttcccgcgcgctccatcatcgtacgatcaccctcttccgccgcggcgttcacataccgccatctgctcggcgaaatgccgcacaggcctcgcgcctctctctgtggctcggaaaagattgtgatagcctgagaggctacgacgagtcgacgattacctgatggatgggcaggcaggcctgagtttctggttgcttaggatgaaatggaaatccgatactttctgttattcccacggtcctacctggagaatgcaagagcaagacgtaagccttgcgaatgctggaattctttttcgttttttttttgtggaaatcgaacggccttatggagattcttgaactccagtagggcttaagtatttcaaaaacgcacaatattctaataaatctcattctctcgtttcttctaagaagcagtctcattgcttgcaaatctgtactatcgaaatctgtacaaatcagagggcaattagcgaggccacgtggcatgactggattcatgggtttggtccctcgcgcacagccgtcagatcacgcatctacggtgatatatcgtgcggtggatcttgttgtaaaatataatctttcgagggagtttaatgcaaaagagtagagtatccatactccagtaaatacttcgttcgtcacccgttcccatccgccgccaaggctccaatctccgctcgttccacaccgcggccgtcgcctcgctgtcaccgggcggctgccgatcccgagccaacagcccgccctgctgccggcacgcggtcgttgaatcgagggcgctgcctcgcccccatgattttctggtgcgtcgccgctctccacgtgttcctcatcagccgcaacgtccactttctccgccaccggcagccgaggcgccgcctccgcccacatcgcagcattgacttctccaggttggctcacctactccatcggctattccaggtcatccaccgtctcacccctctgaattgcaaactactatcccctgctgcactctgcctgttcgttgtaatgcttattagtggaaaatagttcaacaatgtcatctgccaacgattagtagaacctatgatgtgaatccatcatgttgtttgtctgtgaccactgagagtttaataatgcttattaatatgttgccatgcgaatgctcctagaccaaaatgtagtctctgtcagtttcttgggtttctttgtaaccatctgaatttaaatcggtaaattgcctatctgttgtatgtaatttcagaagtttaaaatagcaaacgtcaagatggggctatctcatgataaccttaagtggtaagatgaggttggggatacaattcatatcaagagttttttactgatttggaccaattatcatgtacaattttaaaatgacacaaataaaaaaaaatgacacaaataaaaattatgtagacatgaactgcaaaaacatatatggtgattagatacttagatgaatgagagagaatccttgcttacttggtgcaagattaaagattaaaagaaacggtaaagtttatctacggtaaagttcagctgcatatataagttacaatgtgcaacacgtaagaccaggcttctttgcaatcatttatctactaagaatctactggtacaagaggattaggaggcaccagcatattctgctcatgtttgaggtaaacgctataccaaattattaaacgaataatcaattcctcaggctctttgtgtaaactgaaatgcactcaaaacgtgatctttagagaataagaagtgaaagttattttaaaaaaaggatttccagagttcttatagacatctggagggataaaatgaagacaagtactttcattactttggttcattggactttagaatttgtgcgcacatattcgactttcaactgatgtcgatgaactcattgtcttgcagccttcaattgatctgaataaagcttattccagaaactatgtcatatctgagaacaattagatattagaattaaattaaattcatattacagagagcagaaattggtactagaactgttatgtcgttagcattattatgttactttatattacagattgtttctgcattttctcagcactcaagtggaaaataagctggaaattcatgcatcgttttgtaattttaataaatttgtaaactaataaatagcccatggagatctttctcatacattgtagtgctgtcgaaactcaagtatggttgaattagtaccatgattaatcgtagcttcatgcactttcttttattttggcaatggtctctttgcgtactcttctattcatgcaatgacatgatactgaatactgagcattgaattctaaaactgaactggcattattttgaagaaataaaaaaaaaccaatcatgttattaggcaacaagatcagtgatcatgctcaagttgataaggaaccatattattaaatgtttaattttgattattttcctagcctggtactgaagtactgtctaatttgacctctgaagtacttgacatttgaattttttctaccattgccatgaagattttgtaaggttgctttttattatacctgtacagttagatgcaatatttaaccaatcgaagtaggcgttttttgtgtattcttttaatatataatttttttcttttcaaaaatgcggaagaaaaacaaattggaattgcaaaatttaacgctgacaaagcatccattcaaggcattcctttctttttgagagaatcccttatatgccactagaaattggttagttctcttatatgccactcaaaattggcttctcccttatacaccactagttcaagtttttctatccttttatgctactcccagcactatagcatttgttgactgttagtcaaatattagttttttttcataaatgaccaatatgccatctcaactaaaaaatgtgtaaacttcaaaaaaatcataactaattttttttaaatcctttttgagtgaacaaagttttgtcagaacaagtggaaaatgctctttgtaataaaaatattgttggaaagctgcatgtttcatacttgtattgaaaatttgtttgtgatagtgatggctaaaattgcatgtgattgaaaaacaaaatcaattttcatatgttgtatccagtagatatattagtactaaaatacctatcattggttatataccaactctcaatggtaaatgtgtctttttactatgaagttaacggtcaactgacggtggagtgacggcaatggcataaaagggaggacaaacttgaaccggtggcataaaaaggaagagacaatttgaaggggcatataaaggaaccggttaatttggagtgacacataagggattctcactcttttttcatgttagcaatggtgtaattaatactcacctgtcaaatacataaatcccctgccaatggttctactgagtcctttttcttgctcttgttcaagaacattttattttcctcttctgatctcaagtcccaacgtctattaatttatttctttaggtttttggttcaatatgttaagaaaaaaaaccattgatcctaaacaaggccactgacaaaatagattggcctaatctaaattgggcgcggcaaagccgcacgttgtttctagtacattctaagaaacaatcaaattgctcagaaaatacatgcctttctttttcctccatctataaacggcagcagcactaactaatgcccacgtacctttgtacaccaatgttccagttcttgatggaactttacacagaaagagttgctaaccgatgctaaaatttcttgttctatataagagcgcctgcgattattttggtgtttttttcctggtctggtcttagaagttctccttgtggaaatggaaccgagtcgttgtcgtctggctgaattctagtgaaagatccctcagcattttcgtaagtgttggagacccacagtagaaaacgcctgcagatttatgaaacatctcagcattgctatcctgtaaactaggaaccatcacttgagatttatcacatagaactgacctatacgagagttctggtgggcattggccagatctgagaatacctttctccagttcggccttgcaaaatgtgtccggatctgcataaagcgagaaatattgaatcaaattttgcacatgtgatttagtttttatttttatttttgcaggaggatagaagtgggaaaaaccttgctgccagagacgatatccacaccatttttggcatgttgaagtgattggaccatggcaatcagagctgatcttgcatctccttcttcatacacgcttgtcaggtaattgtgcatctctattacattctgtatagtgagtgattatgttagtatctatttattaatctgaaggagagaacatggaagttgcactgaagcagttagactgagtagtacatcatgatcactttcagcaacatcattcatcacgcctttaaaccattcaaaggaaccttgctctctggtgacccagtagaaataagctcttcctggcccattgctcttaaaggtgcagcctaactcagcatcatgcgtgctttgcacatcctgttgaatccaattcactttagatattatgcacttggtttactgtataagaaagaatttgctatagttaagcagtttactccattggattttatgttgttcaggagatccttcagtatgctgatgaaaggcgttgctccaattccaagcccgataagcaaaagaatgtcatatttcttgtaattttgagctggtgcgccgaaaggaccatctataaagactttgggaaagctaaatgaagagaaccaaagtcaggaagattagtgaaacaattgtatagaaattccttcaaaaagtagatgaatgtagaatatgaaacaaacagggcataattaccaagtctcctctttcagaccatctgctatgatagtggtttcaagtcgtgcaagtgtagccttcttggaacttacttgtgcctcacaagcctgcatgaattagcataaccctttagcaactttgttaatttagcatataaatactgcataagctcccattatgcctgaactattctccttttctttttgtttctgtttgctcaactgaccttcccaaataggtttctaagttctgttgtccagtcacctaatgtacggatatgaacactcaagtagtcatctccaggtgcagaagttatggagaagggatgcctggaagcattgaagaatctattaatccatagcctggataaacactgacatttggacagagacgatcagatggtaccattcaaaaggcgaaacatctgggcattttacaaacatatacatcccacttttgtacttgaaacttgatggtttattcatgtgaatagagagcacatttccagggtaaattgctgcctgcatggcacatttgatagtcaattaatggtattcttgtacacttagaagctagaataaattgaaaatactcatcgtgcaattcatgtgaaatatgttgcttaccttgatgacggtcaccccataactgctctcacgaactcttctgatagttctctcgcaggagtaaaagaggactggaactgccaagaacatccacgtctgtaaacacaagcgtcaatattatgcacaaccactgaattcacaaaagaaatagttgtgccaaacatatgccagagaaataccgttcgattgtaccactgcttggtgagaaatatgaagtaggagtgcagcaccaagaggatatatgcaatcaccagtaggtgatgggcgtaccaaaaggcattgaaaccagcaaggtggtgcagtggtgatggaagcttcacaacgctcctcctgaacgaatgtgtcgcaagtgtgaacgagaatgacattatcaagatcatgaggatgccagtccaccctggagtgcttgcaaccagcgatgagtatgttggttgaacatagttgaagtaaggccccagtgtggcctcgaacttgtcccttggacatgataccaatcttgggaagtcgcaggttacatgagcaagagtatgagtagccgctccaattgcaatcgtcagtgcgataacctgatatggtgatcagaacaaagaggtcaggctgtgtaatcctggaaatggcaaagagttccacacgtgtaccttgtggaagtttatgttatcatcaaatggtacgactttgctgagtgctgttgatcggagccttgttagtgtgtttcggcacaccgggaggagtataacggccatgttcagcttgagtgtttcggcagcaccctttgctatgcagacacagtagcccatcacctgaaatgcatcccgcctactgtactgcacaaacttgtacatgaataatgcaatattgaggatcgcccacaaggagagcacccatatcctcttccaattctcatggatgaagtcaacagtcttgtgaaacgcctctgcattggactccggtgactggaagggaccattgtccttgcaaggcttgctgaagccagcttcaccttctctggaggcccttgggctgtcaccataccacggagtagcgtctccagctgccaaatctgcattgagacaagcatatctgtatgctgctgtttgtcaaaaaaaagggagataatttcatgtcttggtacctcaatgtaaccgcgatgatcaggatccagctcttccatgatcagtgaggcgtaggttgcagcatggcttttcaacttggcaagtttgtttgctgcggcactcaacacaataacctgcatatggaaagagaaaggtaaattcttattgagatcatttccacaagctttgtggaaaaaaggtaaattcagagatgattgggaactgacctctttgacctcgtcctctgtaagctgcccatcaccattcttgtcacacctgattgcaaagcaatctcatcaaggggcaagtcataaggttttttccattgaagacaaggaaggtagacctttacatgtcaaagaatattcgtagtcgtgaatcaaagttctgatcagtcaactcctcccaaaattctttcagctgttcctttgttatcccatcttctggtttgatgctcctccttctcgccaatgccacaaacacctcgcttgcaaactccttagaatccgccatacctttaagttgcagaggcattctaagcttagagcttcaatttatatacagaggatggatttattgctattctgatgtcatttatttacctgactacacttcttttaaaagaaaatgtcgtaagcacgagtactccctccgtttcatattgtaagactttctagcattgcccatattcatatagatgttaatgaatctatacacatatatatatgtctagattcattaacatctatatgaatgtgggcaatgattgaaagtcttacattatgaaacggaggaagtatatcctattcttgctacgtggtaagtattgtctccgagttatatttgggggggccaaagtctgaactttgtgcaacccgtggtcgaccaattatatcctcttaaattttccaattttctttcctccgttttttgttaaaataaaattgtgaataggaatgattatgtatactttatcaaagaagtgctgcaaacatgtatgcatggatggcaggaggaggctggctgcttaaacagttgaaatggctgaaattttggacaaacaccatcgacatacgagctaggaatgatctgtaccaatttctcatctactaactgttcccctttttccatcacatgcacaaaagctttgacaacattttccccttttttttttgcagggaaaacaaagcttgtcaattttcgatgtgttcttgctaacaatgcaatttcaccgtctctcttttcatgctgtggtgaatcactaatcactttggaggatggagaacaccatgggggcatgtgcaggagcactcaccgatgcatttggcgaagctctcctggggcaggcgtccgtcggcgctcatctcgtcgaaccgcttctcgacgttcttccacccgtccttccccgccgacgtcttgtcgaggaagcgcaggccgcgcagcgccggctgcgcgctggagtgcgtccgcttcagcttcatcgtgtcgggcaccatggacgccagccgcttcatcccggacgccagccgcgacggctgcttcttcagcggcgccaccggcggcagcgtgctctgcccgccgccgcccagcggcacgtccacgtagtcccccgccatcctgatccgaactaggtagcccgctgctgctgctggtggtggtggtgggtgccctcaccgcaggaggagcgtggccccgggcgccatggcgtacgtggtcgtcgtcgttccaggccaatgaagaaatggcgcggtgtaaatttgggctactggctaagggaggaaaggcagaaggcgagaggacacgccgcgggatgcgggggggagggggagggagaggccgtgccaattttagattggtgctcgcgcgccgcccggccgggaattctcccgtgggtgcgagtgcgcccgtgcgggcgcgggtgggctagcttggctatagccatgggtgggcgcagaggcgcgcgtgctgcgtgcaggtgcaggtgcaggtgcagtgtagccgcgccgcgcgtggacaaggtgacgggtgacggggcgtgcagggggtcacaggtggcgcgaggcggaggtggatggaggcctggaggggatttgtcgggcggcgagccgctctttcgcctcttcctctgtttctgcagaggtttggtcggcgtggcttcgtgggcccgtggtctgcctgctttgaacaaggacaataccaacccacagtatctataagtagtatttatggtgccatgtcaataaaactttacgatagaaactacactctataacccatggttttttaaagtggtccattaataaattcatcatctctcttctctaccgattatatttattcttcatctattatgaagacactattatctcccaattaaaaacttgatagtgtctagtgcataagttctcgtgttgaaactgtgtcttgtatgagactcagtttcttcctctcttcactctctctctctcttaattaatatagtgccacataagctaaaagtcctacatagcaatgtagttaatgccataaacaccatcctaggtggagggttgggactgtcctaaggtcactttagagcaggtacagcaatagactataagctataaacatattttaaaaagataagagcaaatttaatagtataatccactactagctctaatttatctatagccgatctaatagccaatttatacaatagttgcttactatactattaatatatgttctcacatgtcatacatatattgcgttttgaaatccgtgctgcagctggctacagatctgtagcctgctacttttctctctcatcttttatcttattaaaatatgtttatagttggctaatagtctgccattgtacctgctctaaaagataagagagaagagcagcgggctatagatttgtagccagctgaagcacggacttcaagatacatgtgcgtatgacaagtgggactaggtattaattgtgtactatgttaggctattcccagctcaatgattaggatgatgtccatagcattaaataagctgccacctaaattaaaaaataatgtaacaagtgaataaagaaggaaagagaaggaaaccaagagtttgtacacaacatccaagacatcatgtgagataagtatcattaaatttaagtatggaatagtggtgtttgcattgaaagggtagtgtctggtactagtttcttgatgatgtagagtttatggaaactatatttagtgttttgggttgggactggccttataagtatctattatatgaattggctattaaggcagcgttcgagagggtgagagagtgaatttgtttgtttcgttttccgcacgtacgtttctcaaactactaaacggtgcattttttgcaaaaattttctataggaaagttgctttaaaaaatcatattaatccattttttaaatttaaaatagttaatacccaattaatcatgagctaatagctcacctcgttttgcgtatcttcccaatctctcaatccccttatcctcaaacacaccctaaattgattatagatggtttggagcttgtagctggctatactattaaacttactcttaggtccctagattttttgactggtcaaaaattcatccctaaaccacaataccagatataataggactcacatgtagtgactaatttttacctcctcatctccccacttctctgccattgcggtatcaggatgtaaactgaactcaacgtcaagttgaaggacctaaagtgaacttattcctgccttcttaccttgtgtccttgtgcttcggctcgtgctgggtttgtttgggcctgaatttcccgcagtgtaatggatatgaaacgggacgcggtttgtttgagtttttgatagttcaaagcaaaaattattaaggagagaaaatgaccttaatatctctcactaaatgtgaatgattgagagtggatctgtagttaaggggggtaagaatggaaaaaaaataaatgggaggtaattggagaaaaagaattatactatgcgtacaaagcttatatgctgtaatggcactcatatggtacggagagagtagcctataatatagaaatctagaattgaatgtgacataacatagtacaagaggtatatttagatttatggtactatgttatatctaatctggttttagatctatattatatggggcggaggagtaacttctttcatataaactacagcacctctagtttct

SEQ ID NO: 45491 - DNA, 4159 bp, Oryza sativa
tgtaaattttggtggtggctacaccagcaccaaaaataaagatctacaccataaaactaccagcaagcatgctcgaaacatgaagtttacaatgaaatcccgttcacagccaatgttggaaatataaataaaatattttccccatgattttaatatgtttcaaaagggtcttgatatagcggatagtggatagcatgtaaagcgtgtcttgttctaaatatgtttagtaccgatagcgtgtgtttctagcaagcggacccatgaggatgagtcctctatatcacttacctatgtttttctgactttacgttctaggtgctccttactgtggaagaggcgaaggacatgaaccgcttgattggtttagtaggccaggtagtaatagggctagtcatgtactcgtttacatatgtaaacttctcctctcaaaacattattccgttgtagtctagctggttaggatactcggctctcacccgaaagacccgggttcgagtcccggcaacggaattttttttgtttgcaaaaggtagtcgttttttgtcggcaaaaggtagtgatgttttttttggtcttgagaaaacgatagcacatctaactgcttattgtattcttcatcctcttccatttgttttaaatatataaactggtataatcgttctctaaataattgctcccttattattttgtctcggtcattgtcaagtctcaaggatagtgtaaggggttgtttactctactactactattttcaaccatactattttttgacaaaattgtaaaaaaaaataatatctacgtttaatttgtggctaaatcttggtaaatacataagaaatcataccaaaattttggcaatattaccatcttgccaaaatctaaagtagcatatcgtcctctaaacatctgattgcttactattttgtctccgtcattgtccaggcttgattgttgcaagagtccagttccctgatagaccattacagacattatatgtgatcaaacgaaaaacaaaaactggatgagttcattactaactttgatagaaagaaaaaggaagaagtggtcaaaatagaagttaccaatctgccattcttggcatgcaatagcaacagggtttataaaaagcgatgaaaaccggtttgtatttcgtaaaatccggatttcccgaaccgaattgaaaacaccaaccacttgtttttttatcaagttcagaaatatttcaaactaagttttaattttttggcaagatttttcctggttttattggtatttttttcgattcatcaatggtttccgtaaaatccgaagataccgctcgtgagctgtttttatccggtatcagagttgtgaatattgaatatcagtactatgcatgcatttccccgctaacaatggccatgttcatacatggtacatccagctaattaatccaagattaaagagcggtttttatctgatatcagagttgtgaacactgaataatagtactatgcatgcatttccccgctaacaatggccatgttcatacatggtacatccagctaattaatccaacagcaaaaatattgcagatttcaacagcagctggaattagtatatcctgtatatccaaatatccaaatgttccaccctgtatagagcacaacatatggcaaaaccaaaatgcagaggaaaaatttgggaaacggcatgcatcgaggcctatatttattggctctcccctctgttcaccaagttaccccgctcagttggaggctctcacccccacattgcaaatgatttcattgaggtaaacgggaagcaaaagaggcggcaaaaattaatcgagttcatcctttcttggctcgtttcttcctcgtcccatctttttttctttcttgcgtgagtttaattcgctttgtttctccccaaaacctccatttgatttggaaccattttctgcaacaccatggattgcttcgatccaaatggcatcccagataccgattttctttgtttggaatgctggaattttctgcagattcctgcaagatttgaattgtttggtgtaaaattctgccatgccatggatgtgctaattaacttggacatggtttgattattatccccagggtctccaattgaggcgggcggtggcaggtcaaggtggcgattgacaaggcgggaggggatccatcggttggccggccggtcgtcgacgccatggcggtgagccagagcgcgcagctcggcatggccaccgcgttcttcggcgcgctgtccttcctcctcgcgatcctcggcgagctcaacaaggtaattaacggcggcgatgtcgccgccgcgcgcgccgatgctttccgttttttttcctccggcgaatacgcgagctgaaacgggaagctatgggcggtgcagccgccgcacgggacgccgatcaggggcaggggcgtggtggtgtgcaagttcccggcggacccgacggtggcgctgggcgcgctctcggcggtggccgccgcgtgcggcgccggcgtcggcgcgctcgccgtgttcttcccctacaacggcaagcccgtcccgaggaaggccctcttcgactacaccctcctctacgtcttcttccatctcgccatgtaattaatcaatcaagaaacgcgtgatcgatcaagaactccattaactctcgccgcgccgtacgtgttctgagctgagatcagcctcttctcgtgtggcagaggcatcacggtggcagggatagccacgacggcgtgggtgacggcgagcgaggccatgcaccgcgtccggaacgtgcacggcgtcgacccggagtatgcctgcccgacggccaagaccggggtgctcggcggagtggcgttcctcaacctcgacgcgtcactcttctggctcctctgcctcatgctcgccggcaacgtcaaggaggagtacttcgacgacggcggcggcggcggcgaggtcggcgacggcgtcgcggggctcgaggagaaatagccagttagccaccctggcttgtacatgactcgcgcggggaaatcgccaccgcagatttgcatcaagattcggacatatacaactcaggtggggaaaaacaacgtcacgagggagaaatacagcacgcatcacggaaacgatcgaacggcagatgggctaggtgcagaaaaaccgcgtcccatatgcgtgtgaatatgcatggcaacatgacatgtgtgtacatattatgcctggtcgttctaccgagactctcctttcgttgtacataaatttgtctgatccgtattggctgccgctgaagtgcattgttcagtactccctcagactcataatatggcaatctagaattagatgagatatttcaatgaatctgaatagaagggtgttcagacgttatactataaaatgacatatccgattctagattgctattattatgggatggagggagtatcttgtaaccgtgaaatgtgacacgtgtgtaacaccgcaacccgtttatcacctgtaggctaatagggattggtgaggttcgtgtgatctagaggtagagtaataggtggtttagtttcattctgaaaatatagacggatgaatgtggttagtttgacgatacaactcttatatctgagttaatcctttactcaaaagtgaagacgaaattataattaagtaggtatcgtgcatacgtagatccactctacgtgagagtgtactaatgtatattttagaggtagtgttatattcaccaatttacgaaattttagcataagagcagggttatatttggccactttagagattccaaccctaagccctaaaggtttgccggaataaaagggttaacccaattatacagtgtaagattaaaactgtataagtgtctagtgaggtggtatgtcggtcagctttaggtgagagcataccaatttggattttaaagggcagagtattacaatgtggtaccatgcattcaacaatttgtgggatttcaaattggatctttaaccttcaccgagatcccaaataaaatttagagattccatacaaaaattgaaagtttgataaaattggaacgatgtgacggaaaaattggaagtttgtgtgtgtaggaaagttcgatgtgatggaaaagttaaaagtttaaagaaaaaaagttgaaaacttg

SEQ ID NO: 45492 - DNA, 4312 bp, Oryza sativa
actctatagaccatctacatgaacgaaaaaaaaaagaagtaaacatcgagttgagatttatggaggaaaccaatgcaaaaattaaatcagtgtgtttatatttgtgcattgtcgatgacctacactacatatctacatatgactaatatagtgctctctcacttttttaaggtatattataaagtcaagaagtcaaaattagtgatttgaccatctcaaattatattgttttaacttttatattttttaatacactttattaaaacagagtgagtatataatacattagtatcttgagaaaaagaggtaattaagtggttccagtgaattgaacatgccgataccatttttagcttggaaactatatacggtatgcggccttgctttgctagcgaggctgtgttcgcatgcaccttttcccatcccctccctccttttctgcgcgcacgctttttaaactgctaaacggtgtgttttttttaaaaaagtttctatacgaaagttgcttaaaaaaattaaattaatttattttttttaaaaaatagctaatacttaattaaccacgtgttaatagatcgctccgttttccgcgcttaccgttcttgataggaacgagccactgcgaacacagccgacatgttcttcattagacgtatcagagcaactgaaaaatgtaagggaaaataaaaaaaaaagtaccactacaaagatactgacatgtaggtcgtagatccacatgtcaatgtgtcacgccccgaattagtaccgaccggaactagcccgtgacgctccaatttaacctgttaatcgataccagtcccaagacacagtgctggtatcacaggaagacagattatcacagcaacagatgtctctttattatagagtagatgtacagtcatgttgggctgcggacagatcccgagctcacaactgcattacaaaagggaaacggaagccgggacttggaccaaacaacacaggcgcgacttgggaactaggccgaaaccctaaaactcatcgtagtcggcttgctcctggaagaactcctcatcagcaggatccgcttcgtcttcttcagcgactgggggggattatttatatagagcaagggtgagtacggggagtactcagcaagccaagggaaaataggtgtttaatgcaggcttcaaggaaaggctgttgtttttgcagttgattttatttgaactcctttttctaaaaacaactaagtgagtgcttctcaaacgacacggttgagacggtgcgtctcgtccggtcggagtatgtgcaatgtatcagtctttaaaatttaaaacaaggttggcacccggccaacagcttttcaaacggccacccgggccaacaactttcaaacggccacccaggcctagctgatcccatcagctgcagatttttcaaacagcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcattttcaaagccgatacaggtttaccatatgccgacgagaggggtcccagaccaacaacaggttaggtcccagaccatactatgccaggaagcccaggggtcctccccgacaccaccccgacgaatccacatgtctctcgacatcaaggctcccctgataagctagttactcagccaagggtgtcatattccacccatgtggtcgtacttgtcttatgtttggatgaaattcctaggaatcggtccttaagtgcgagagcgggaaaaccgtacacccggtacgttccccggtccacggttttggaaattcatttagttcacaagcaccgacccaagtgtcgggttttccaagtcttttgtaaaactcaagttttacccaagaagttgctcagattttaaatttgaaggcgcccttcggtactcgcacagattgcacgatttccgaggcgcaactgggtggttacaagggaatatggtataacaattaacaaaggaaggatcaaatgcaacaaactaggtagatccgccaatctgccttgctgacgggacagcagattaagtgcgatcctatcaatgcaaaatattttgcaagtaacataattaaatttcaaatataggctcaagatgttcaaaggtggcttgccttgctcgagatctggagcttgatcctcgaaatcctcgcactgcgggtcttcgggctccggaactacacgcgaaacgggacaactcaacaaacggcgaaaatgaagccctaatattgacctctaagcgtgccattagatagatctcgagatttgaggaattttggaagttgaacggagtcaaacggatctacggttgggaagatattgaatttctaagattattggatttttggtctaaaggaaaaggatttaattaaatcctttttggaaaagaaaaagaaaagaaaagggaaagagggagggattatagacttctcctcgggcggctagggcgcggcccaagggaaaaggagcgaaccagccgagctaaatgggccggccggcccaaggcggcccaagtgcgcgcgcgcgggaggggaggagagagagggccggtggaccgggctcaccgtgcgcggtcccgggtgggacccgcttgtcagcggctcggctcaccgtgcggagggagcacgcggcgcacgcgcgcgggcgggggagggacgcggtgcacgcgcgcggtctgcggaggaacggaggcggcgggcccacgcgcagcctcacggctcgcggtggaacgcgcgcacgggaggggctgaccggggtcggcccgtcccgacctcggctgagctggcgccgacgtggcgcctacgtggctgccacgcgggccggcgggaggtagacgacgacgccggccggaacggacggcggacaacagcggcgagcggcggagcgaaccacggcgataccggcgaaagcgagcacaccgggtggttgcacgagacgaggggagacgagccaacggctcggattcgccggaggaagcttgacggtggcgaatcgcggcggcggcaaccggcggggagggaagagggaaacagcgacgaggtcacgaggggccgattcccggcggtgagagcatctacgcggccacgggaatccgatgctagcgtcggattgggcggagctacgccgagcgaggctggcgacgagcgggtgctacggagctcgagcggcgacggcggcgagcacacggcgggcgacggcaacggtcggggcggcgccggctagctacggggaggccactcgtgctaccaccgaaaactaaggggggggagatggagcgaggaggaagaacggagggaggcatcaccgaggtgaggaggggcgctgtgacgagaggccgacggcgcgggagggatctctccggcctcgggccggggaagaggaggaagacgagcgcccggagtccctttccgcgtcctagtgcgcaccggctcctccggcacacacgcgacggctgcggtcggcgagagggacggcaatggtgcgggcgagaaacagggaagaatgggagaaaagggaagggagggcgcctgggtttatagggggcggcaatgtcggtttggaaaccgactttggcggtcaaggcgcgagctggcgctctggctagcggccaaaacggtgacaggagggagggaggatgacgccggcgggaggaaaaggggaaaaaggagggagagaaaggggggctcgcccctttcttctttgggaaaagggggaggggagcgggggcgtcgcggcagagggaggagggctcggcctccgtcccttggcggcttgcgcgcggagtggcggggccgaggcgatgacgacggcgatgacggcggggcggtttggagcggcgcgacgacacgggtgacaggcgcgggctggcgcggcagagggtgacgcggcggcggcgaccagacggtcggccactcggcacgcgcgcgcggcttgcaacgggagggcgcggcggatggagaggcgcggctcgagcacgcgcgctggctgcggggccgagcggctgcaggcgcggcaggcagcgggccgggcggcgcaaacgcgacgcgggcgaggaccacgcgggcgcgcgcgctaacgacgcgcggggagcggcagcgaaggggcggaaaggagggctcggctcggcgcgggcggctct

SEQ ID NO: 45493 - DNA, 9724 bp, Oryza sativa
agtctagtcagcctcccccggggtagatgggccgagagggaatcggcccatcgaccccgggggaggcaaaatagacttttgcggagggatttgatttggaaggatttggattcggatttggactcgacgatagatcggggattgagatccgggatggcacggacactagacaacaagcaaggaaacaaatttcgcaattagggtttttaagagataattttcccgctaggcgccacgacggaatgggcgctacacaatgacacatacgcctgctggagctagcttaaaaaaaatctcaagttctgtcaggatggtgatggttgaattttttagagataatattattttaataaaaaattgcaaaaaatagatgtcagttaactaaaatcacaaaaataacatcatttcgaacctctctgacaagtcacatatcgtactaccatgatacagttaggtaggagatatctaaggccctcatcagtaagccaatagctttggctgatcagccaaagttggctttttcccttaagctaaagaaaaaccattgattggcttgattggcttatttggcttatttgatgaagattttttgtggccggtgctcatcagcccaataagcaattcaatgggctttggctgaaaagcctcagcccaaacatctatccgatgaggccttaaatcggatggcttatcaaacaatgaaagttcgacatgcgccgaagatctacaattgtaatacaacatatagtttgaagctagacgtacaacttacgaaacaaatagacatgtttgatttaccccttacagttttgccctaaatatgatacttcttccgtttcatattataaatcgtttgatttttttgttaaaattttttaagattgaccatgtttgtaaaaaaatatactaacgtctttaatacaaaacaaacatattatcaaaatatattcaatgctaaaattaatgaaaataatttggtattattgtcggtgatataggcccgggggtatcaggtttagagggaggaggctgccccccgatgccacgtagccctcccccgaggggagtcaagcccaaggtggggtggcggccactccttccccaaagactagtcggaggaggctgccccccgatgccacgtggccctctcccgaggggagtcaggcccgaggtagggcggcggccactccttcccaaagactggatggaggaggctgccctccaatgccacgtggccctcccccgaggggggtcgggcccgaggtagggcggcggccactccctggccgagactagagggagaaggccgccccaggcgccatgtggctcccccccaagggggggatcgggcccgaggtcgggcggcggccgccccctcccgtgactaggggtcgggctcccccgacctcctctctaggtcaccacgtacggtgggttaggtgtccgcctccaggtgcccacctacccgcatttatggcgtcccgagcggtcgcgccacgccgcatttaatgcggtgtgcagtgcactcaaccggtctgtgaccggtcgaatgactgatgggacccaagatgtcaggcgcaccatcgcgtgtgtcaggcgacgtgcagcccgacatatcccatcaaataatgatggtgagaggttctcatcctcttatcccagccggaatcggtcctcccgctctggtcaaggcaaggctcccgttttccggtgtaataggagcccagaagtcttcacccattaaatggtgactgacaggggcaccccccgtgtcaggcggcaagatttgacaggccccatcatcaagacgacgtgtgcttggcttcccaagtcaagagacaagacatgcatttaatgcaaagattataatacttctccaccggagctaggttaggttgttgggcccatgtggtaacccattgaggtataaaaggagatccaggcctagtggtggaggaggggacttcggggcgaactggcgcttgggtctcgcaaccccaagcacttgtgttctacattcaatcaatcatgcacaggagtagggtattacgcttcatagcggcccgaacctgtacaaacctcttttgtctcatcgtcttgaaggggcctaaccccctcaagatcacacagctccgctcaccaaaccctcgaatctcacccgctgcccccggccgaactcacaaagcggggcctcacggttccctggtggaggagttcattctctgacatctggcgcgctaggtagggggcgcgttcgtgatttttgaggttctttcgagcgccggcgtggtgagtgtcgcgccgccgctacgggggaaggcacagcatcctcaggagtgtcgcgccaccccaggcaggaggcaaggcccccacatccccaccaggtaagcttggctaccaggtctttgtggcgagtcttcggaatgtccgagggcccccaaagctccagccctgcctcaccgagaagtacgatgatggcgtcgacccctccgagtccctccagatctgcacagcgatcatagaggcggcgaggggtggcgaccgggtcatggcgaacgtcttccccatggccctcaggggccaagcgctgggttggcccatgaacctgcagccgcctcggttcactcctgggaggactcttgcagttttgagctccgggtgccttcaaagcccgggaccccctgtgctggctcttctgtagcggctggctttggtcccgccggctggctacggtgctcggcctggctcaactgatcgtcctttcaaacttcaagtattttcaattttgcaattcattagcttgaaatcttatatttatttcccccattctattctcatggccctgcgacgcccgcgtgttgcgcatttgtttgctccctcggtggtaagagcccaacctctctcccatctacatgaatgattcttcgctaagtgtgggggctaagttttctagccttatcctagccttaagttgagccccgggtgccgtcgacgcccgggaccccctgtgctagctcttccgtagcggctggctttggtcccaccggctggctatggtacccggcctagctcaactgtggacggggattgctggctctagagttttcggctctcacactcatgcgaaagtaatcgtccatgtagaaggaaaagagattggaaggaggccaccgaaaggaaagagcaaacagaatgtgtagcgtggggacacaggctcgtgggaacctgacctcgtttgctaagtggtcacaggcttcccaagatggttcggaacccatggtggggggccctcttcgagctaaaggtttgtgtttgcttcattcatacaagcaattctttgctataagtgtgggggctacgattcctagctctatcctagccctgcgtcgagctctgggtaccgtcgacgcctggggccccctgtgctagctcttccgtagctgctggctttggcctcgtcggctggttacgatgctcagcttcgcttgatcgcaggcgaagattgctagctatagaaagttcagtcctcacactcacgcgaagataatcgtttgcataaaattattattgcttatatttatctctcgcctatctctttgttgacgaaaaaatcgaatacaccggcctgggagatctgcttaactccagtgcaggtccaaagattggtgagatgcgagcgtaccagtcagtttgatcctacaactgacaagatatacaaatagtagatcaaaacagtcgatcggctgacaagccgatggagtagttccagccaatagcgataatagccgatgccgataccagccgatagcgatagggtttaagaaatcggctatatgtccaatgtaaataatgatatgaaggcaatcggctgatgatgatgtaataaaataacaatataatccagtagaaaccaatcggctagaaacaaaatacaataagcactgatccgaaggttaaagcatacatcggctggaggtccgatgtcatgaaatccacaagattggattaaacagtgaaacctttgtcgtcatcggctaaatccaacttatatgtatatgcaatccttatgagccgatgcaacgtccagataactcaccggctgaaaccccgatgaaacccttattggcagtcaaaaagccggctagagattatggttctaagcatgacttagtagatcaaacttaactgatgtagcactaagtatgaaaagaaacataatatctagacaatcaagccgttgactgagttttcagggtggtagatgtctaagctaatctaatctagcaacacgatttagccgataccggtagaaaccctaaaacgagatgcagccgatagagctaaattgatatgctaagactagattaacagagacatatgataaataggtaggcaaatatatcatccaaaccggagcaatccaagaggtcgaatgtactgatgcagccttgaatgacgccgacgtagacgatacaattgcctgggccgacggaacattggacttaccccttcgccggagatcgaacaccggtgcagccccgcgtcaggtgccaagtcccgctagacgataaaataaagtacaaaaggtaaaaggtggcgatgcaccgaattgtattgatcgtagagattgattacatagaccccggtttacatatttatacccatgggttgatacaagtccttgtcggacaagaaagaaactaacctaaagataaaaggaaaatataaagtccttatcgaacactaaacacactttcctaaagataaaaggaaactaacaaactattcctaattaatagataaactgccatgccgcatcctcattaaactcggtcacttagggataagcttcctttagtagattgatttccttaaccgaatatagcaggaatccgactattggcgacttgataactcccatcggctgattccgagatgttgcagccgataatgattctaagccgatgatgactttggccttaccaaatttcactatcaacaccgccgccctacctcgggcccgacccccctcgggggagggccacgtggcattggagggtagcctcctccatccagtctctgggaaggagtggccgccgtcctacctcaggcctgactcccctcgggagagggccacgtggcatcggggggcagcctcctccctctaaacctgataccccgggcccatatcaccgacaattataaatgttgctgttttttctataaatttgatcaaatttaaagaactttgattaaaaaaaatttaaatgacttataatatgaaacggatagagtattaatgtatagtagctatatccaccaaatatgatacgacatcagtccaatatggatagatcgaacacgtcccctgaaatataaaagtccaaacgtgggagcacttcattccaacatttccatcagcatgcactctagttagctcaatgtaaacaaacaaaaactgtcggccggtttggtgaactatcagtgtacttaacaacccctctttaaaaaccaaagcgcacgcaccacgcccgcaacaaactccccaccctcaacctctatacaaaagtaatccaccttcaagtctaaacaaagactaccaaccccaatatttactcatcagttgacccctgtcaatttagtgtgactatgtgagctgtaactagcatttaggcagcacttgaatagcagtttggctgagctagctagtgacatggaaactaacatgttaattagcacataagtaattaagtattacaaattttataaattgatctttttataaaaacttatatattgtttctttaaatacaatatttagcaactggaaacacatattcatgataaatgagtaaagcccataaaaccgtaggtacggctgtgttcgttatgtatggttgagaactttttttctcccacgaaaaacgagataactcattaccatttgatcaattaagtattaacttacaaaaaattaaaaatagattaatatgattttttaccacaacttttctatgaaaattttttaccccattacaccggcagtttcttaaatcaaaagagaaaaatattagagaagcaagcagtaaatgcagcaacgcgtagcgtcagccagacgaaccagagtctactgtaggagatcaagcgagatagccatagcccaaccgcagcgcagaaaaacacggggtggcgcaccgcgcgcgacactgcgctcccgtgcacgccgcacggaggagatcggggatctcggtctccctctctctctctctcggcgcgtcggtcgcggaggacacaggtcacacgagtcacggagccccgtactactcgccttcctcctcctcaacccaaaccccatcccgtcctcctcgcgtgtcaggcaacgcagagacgaaacccacgagacgtgttcgttcctgctcggtctctgatcagtttgctttgggcgtggtcttcctcgagtcccccacatttcttcctcccctccgtacggatacacacactctttctctctcgtgactgatccgactccgccgccgccgccgccgccgccgccgccgccgccgtctgctgctgctgcggggggtgggaggagatgaagccgagagcctcccgttcatcgccttcgagcacaagcggtgcgtttcctctctccccgggtggggggggggggggggcgtgtttcgagttttgccgtctccttcctcgttgcgccgcgtgggtttcggccggttgctgtacgtcgcgtcggtttctcctcggcgagccgcgacgaggggatctcactttttttttcttgctgaggttttcgggtaatgcggcgagggattggctgtgcgcgggagcggcgagggctggatctcctccgcgcgaaggagtgtagggttgaagcataggatggatttgccggtggaattgcacgagttgagagctccgtgatgtttgctttttttttttttttgaagagatctgggtttcgacgtccgcatcctgctgcacgacagtaggagcaagcagtttccactgttgattcaggcattgagttgataggattaaacctgacgaaatttgatctctggtttgaatctaggagagggcacaaccgcacaagtctagaatcatcgaagttctatgcggtagttagttgccgttttggagaaatgttccctttctgatgctgtgtgattgaagcagggatgcctatggcttcgcagttcggccccaacacttgcagcgttacaaggagtatgcaggcatctacaaggtagaagacacgcgccccctgactttttttaatctgcattgtctggtgtggacaagctacatgccttctggtgctgtgtttgcaggaggaggaagaggagagatccgatagatggaagaattttctggagaggcagtcagaaccatcgggacaggaagagaagggtgaagctgccgggcgtgttgtggatagcagtggaattggcggttcttcgttgctgcaggagaagattgtgcaaggaccacacaagatcgagatatggaagccaatcagaccatccctgggcaacatagagcagatcatgagtgtacgtgtcgaggagaagcaatcacctgcttctggcaatcaggacacgaaggatgtcatccatccggtgaaggttcaagagggcaagttatctgaggattcagatgatgagttctatgatgtagacaaggttgagactagtcaagaaatgcattcaagtgatagtgcgaatactggcattgacaacaggggtcaagaggaaaattttccttcgatggaagagttggagtgtctagtccatggtggactgccaatggctttgagaggagaggtgcagcttgtttcatggaacctttttgctttgtttccttttctaactttagaattcttcagttcattcagcagactcttgcttttgtggtgacagctatggcaagcttttgttggcattggagtgcgtagggtaaaagggtactatgatagtctccttgtggcagaaggtgaactagaagataccagtggttcgcgttcttcaacctcggatgttgccggggaaaatactgaagtatcttctgaaaagtggaaagggcaaatagagaaggtaggtcactgagtccaaatttccttttttttttaatataaaaagctagttttattggaggctaggatttttcttatttagcgtttttatctggaaaatctgacaagaagccgtatctgccatttctgggctccttacaggacttgcctagaacttttccaggtcatcctgctttagacgaggatggaagaaatgctttgagacgtttgcttctagcttatgctagacacaatccagcagttggttactgccaggtaaatgtgccgttactggtgatccgcattgtgtcctttatcttgatggaagtcagcttctttgtaactctgtagcaacaattgattccaagtgttatgataaaatagtttgagtaacaattgtacttggatattggtgaactgtaggcaatgaacttctttgctggtctcttacttctattgatgccagaagagaatgcattttggtacaccctcatgccaagtgttgtactatttgtgtgttttcactgatataaaatattgtgatagttgaattaaataatattttaaagctgttgatggtgtaacaggacattggtaggaattatcgacgactattttgatggatacttttctgaagaaatgattgagtcgcaggtattgtgatgtttccatatccaggtttctgttggttgcatgtttgagtgcttggaagatggaactgcatgtttgattcaatcttatgtgaaatgaaccttgggttgtttccaggtggatcagcttgttttagaggagttggtacgagaaaaattcccaaaactaggttcgcaacttattgcaaatatgatatattggtgtggcgtgcctcatttagctagtaacttcaaaaatataataattaaaagctgatttccttttttgtgcagcaaatcacctggattaccttggtcttcaagttgcatgggttactggaccatggttcctatccattttcaccaatgtgcttccttgggagagtggttagatttttacctttgttgttctttcatgtttgtttcttgtaggaaaccccatttttaatttataccttagctaagccattggtggagatataacaactggatatgtgcaagttgaaattttgtgtttctcttaaatacttgtggaacttgttgtgtatctttccaaaatggtgtgaaactattgtaattgattgattgtggctttgtgtatcttagatgcggtggccagtttataattatctaagaaaagcctacatagttacctccacaaagcacattgatactacattatcttactagtatttattattccattctgacttgctggatatgtgaactagtctagtcaactataacccccttgggggtcagaggtagatgatgcagatccaagttatctttgtaagtagggagaagtagtaagacgagcccttggtccccacaaaaagttcgaaagtattaccatgttttccttttgtctcggatgatggctgtggcattgctcggaattgttgaaaatgtctacactactatcagttaaatttattatttgttacatctattatctatgtaagcataaccttgtttggtgtaacagcctcgtacatattctgcttgg

SEQ ID NO: 45494 - DNA, 2603 bp, Oryza sativa
gaaagagcaaaaggtctaggtgccttggacaccaacggtcttgcatcaaagctctataatttcaaacatgatcctgaaccactggtgtcaataagtgattcgcaagatcagatgagtgatgtgggagatgggaatgccaaccaaagtgattctggaaatatggatgatatgtatggcggtctgacagtcagttctgagattgaagctttaccggacccaaaggaccaggtagccatctcatcatagtaattagatttagtaaattgttctctatacctgaagtggctactgtagtttctagtttgaatccctgcagatcttctgatacgaaccagtttcattactgcatatcctttatctgaattatttttattacttcatatcttctatgggaatcagttttactacagcagatcttcttgtctgatttactcttcttacattagatctcttggctgaagtttgaattatgccgattgctagaggagagaaggtcagctgttctcaggtatgttttacatttcataatttgatattgtcataatttgctggaaagtcgtttttcattatttcaaaatgagaaatatacatgcattctgtcataggttgctggaaccatcttatgcgactttgcttttaaatagatttatggctaatttacccgtatcagtccttgagtcctgatctggttgtctaccagtctgaagtattaattccaattttcttctttttgatatccagagctgatgaactagagacggcattgatggaaatggtcaagcaagataataggcggcaattaagtgcaaaggtatagccagataactaaacttttgtataaggaggtgttcctttgtgccaatagtcagattgcaagttcagagatggcgtttacaatgcaactatgccacagaaataaatttcaccatgttctttatttcaagtatatataacagtgttttagaaataatcattctaccaaattataaatggtgcaagatttatctagtagaggcactttattttgaaatatccaaatcataaccaacaccagtatatcataattcatcctatgagctaaagatatctaattttctaacataagtgtgtttgaatgtccctcttctcttttaggttgagcagtcggaacaagaattgtctgaactaagacaaaccctattggataagcaggaacaagagcaagcaatgtgtcaggtacagttgacccattagtttttatagatgtatctttctaccatggcatgtccactcaccagaaattatattgaaggtactgttgcgagtggaacaagaactgaaaattgcagaggaagcacgcatctctgctgagcaggatgccgcagctcagagatacgctgttaatgtgctgcaggttagtcagtcaacaagctcggtccatccttctgagatcatattttctctcttaaaatcacttactccttccggtcctaaatatttgacactcaggacaaggttcagtcaaacttataaattccaacaatcaattttatattagaataagtttataaaatccaataagcttatgatattatgatagtactttttgaagcaaatatacgtgtatcatttttttgttttaaaactaagtatttaagaaatttcatggtcggaattttaaaagtttgatcaaaatcttgtcctaagcatcaaatatctataactggagggagtatttttatctgaactaaccaaaacggtagtcacgtacatttacatgcacacatgcaaatactgtgacatatacatatgttgtgcccttaaaacatatttgtatacttattttctatatttttgtatattgggctctcatcggatcctgacacatatgcaggaaaagtatgaggaagctatggcttcactcgcgaaaatggagaacagggctgtaatggcagagacaatgttggaggccacactgcagtatcaaactagccagcagaaagctcttctttcccccttgccttctccaaggtatcccaatttgcatcttggaatgttattagtaccaactgtgtgctactcaactgcttgagagttcagatcgcaactctcatttgcttatgaatttctgtactgttagaattttgaaaatatttttggctagcttttagagcatgtctaagtttctaatgagcaactgtcagttcggattgctcaattattcgtgaaaattagtaggctttcatgacaatgcattcatgttaaattatgttccaagttattcatgttatttagtgttccaacattgacatttgcttgactctgtttcccctccagaacatccatgatagacgcatcccctggtcgagcaaaccatgattcatcacaggagttccagcccaaaaaaataaacttgctctcaccattttcactgagttggcgcgataagaacaaggttattcttctgacctaatagatacattactgacacacgaggcatcctgtatgtggccgcaccaattttggcttagttaaatgggctttcaattcggtagataatgttctgtctgatactctccatccttgagttagaagatgacaagatgttatattataaattatat

SEQ ID NO: 45495 - DNA, 3711 bp, Oryza sativa
  unsure (1)..(3711): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaatggtaacaccatcataaggaggcagacagatgtaactagtatcattcataaacaccaaagaattcaaacaaaaaatacaagattagtaacatcaatagcatccaagtattagtcaaccacgagagacttatccacatggtagaattggactgaacagactatgagcgagttgtttcttaaaagtaacctattgaatgactgcaactaatatatgagagatccggaaggactgatgaaatatgacaagtagtggatataacaagggtacacaagcacatgagttaggaagagaaaaataccaaaagatgaattagcaagtacgcttcatttttaacagcctctatctacacgaaccagcatgtctcccaaactcttactttcagcattggtcttcttgctcgaaagggttcctgcaatcatgtatacaagaatttaatcaagagacaataatagcatagccatgatagtgacaagaacaatgtatgtatccaataattgaaaaaaacgtggcaatgaacattgcatcaaaacacttgggcattaactacatgaacaaataataactgttactacctaagttttcaggttataagactttctagcattgcccatattcatatatatgttaatgaatcaagacatatacgtgtgcctagtttcattaacatctatatgaatgtggacaatgctagaaagtcttataacctgaaacggaggaagtgctacataacaggcattcctctccaatgacagcaacatgtgagattcttctgggaaatactaagttctggtgctgatatttgtcgatgattatcactgctatagtcaatttactagaagtgtaagtcctatcagggaggatttactcagcttaacatagcagtggcaccactttgagggcagctacgcggcaccatttcaaagtaacatttcaatagtactgcattagactagtagagacatagaaattaaggaaaacttgatgcagaatatggagttcagaaacataatccgaattaagttagaaaactgcaaagcaaatattagacatcaaacatcatttttattgcattgcaactccgaattacaaaacgatggaagcaaatgtagaacattgtaaatctgaattcacaaaatatacctataataacatttaagcctatggatgaaaatgagctataacctgtagcaacttacaacaggaggcttagaagaactaaccaacccctgccaaagcccaaatgcattactcgaacattcacgcgagttagcagcaaacagcaaaaatagttacgacgcccatttttagcaaaaatcaggcagtgataaacatggatgcactaacatagtaacaagagccactgaaaaaaaaacacacacacacatacagagagaaggaaaaatgcttagtagatcaaacacctgtagaagggatccggcttgtttcaagccatggcgggagcacgcagggtgtcagcccgatgggatgctccagcatacagctcccgatcatcacccccttctgcaagtccaccccgacaacgtgcctaccatcctcgccgatcatgaggtacaccacactagctttcagcggatcgagagcaccgatccgcggtgtctcctgcaatggctccgaccagagccggccgagcgccactctgtgctccagagtccagccgctgccgccttcgtcgtcgagcgtgaagcagctgagcacgaacggcgacgcctcggacacctcgacgtagcgcagcctcccctcgctgaccccgacgcgccggtacctgctcagcggcgcctcctgcagccgccgcctctcgaagcttatcgcgtcggcggcgggcagcacgctgccgctcggcagctcgacgaagcggaagtccggctcggccgcgaacgggtcgacggagacggcgccccaggccaggtcgatccaccacatccggcctccgaagctcaccaccggatggtccgcggtgatcgctggacgcgccgcggggatcgcggacgagaagcccggcgtcgcgtcccacctccccgtctccgagaggaatcggtgcatgatggaatcctcgcctctgatctccgccaccgcgtatcgatcaggcggcccgtcgccgcggtcggcttgggtgaggaagccgggcttgacaaagcgccaagtaccgcccgtgtcgccggtgtcagggtcctcctccgggagggggagcagctcgccgccggtgagagggttgcagacgacgcggacgactttggtgtcggacttgaggccagggagcggcggccaggtgtcatccttgggcctggggatgaagacggggtttccgccatgggcaggaacttggactagctcgagcgcggtgcggacgaggaagaggccgccgctgttcgccgcgcagatggtgccgcgggagatgacctcccccttgctgccgtcgtcgacggggacagcgagggacacgatgaagcggatggggacgacgagctgggagacgcgcggtggcgaggcgaggcagaaggtcgcggtcgtgattggctccggcggttcttgctccgtgtggaccaaccccatgtcggccatcatggcccacgcgggtcgcgaggcggccgtcgagtgggagcggcggaggcggccagagacctcgccggagagaccaaggaggtgccggagctgcatcatggccgccacggcgtcttgtcgtctagtggtgctgtggtgatggggaaaaattgcgagagagagagaaagagagagaaagggaggatgagaaattgagaggagacacggttcatgtggactcggtgcacgcagcgatggtcatctgttggttgcgtggtggacttgttgtacgggggtgcagtgagaacagcttttctgggtcccacttgtcagttatagtagtccatgggtggagttggttcacgaggtccgggctttcgaaaaaattcctctatttggaacgatcgtacgagtagagcgaaaagcgaagcgattgttttgaacgggaggggaaaccggtggaaagcgaagcgattgttttgaacgtttgaagttttttgagcgaacctgaacgtttgaagttgaactgactatcgcctgtgcctgcgctgccgacgagccgatcgtacgtcacaaagtttcccgccaaaaatattcttgggctccgcttggtcatatgggcctacagcccacaagttgccgtgggttcacggcccagctgaatagcttaaggcgtccacatcaaagatatcgggttggtttggtttgtggcctaaataggccttaccaaattttatcaatgccaaattttggcaagttttgatatggctaattttggtaaggtaaagttatgtttggattgaagtcaaaatagcctaagttcactattgaaataccctattttcttaggcatgtcaaaatttggcttcaaaccaaataaacactaagcactatt

SEQ ID NO: 45496 - DNA, 3297 bp, Oryza sativa
aaccagcccatcatctctctctctctctctctctctcactcactgcccctaagctgattagacaagacgattacaaatcgggcgtctgatttttaaagaaaatcggacattgtttcaccataacaaatatttgaccactataatatttgtgaaacatagttgaaataccattgaaacatttcattttcatggatgaaacatcaaacttcaacccgttgaaacatcccaaatatgcaagaaatatgaaacaccatcaaagtatccattgcaatacttcgattcaacacgaagaaaaatccaaatatattggctggaacataaaaaaattgcgaaaatgtatcaatccagatctagtttattcctcctctccggtggtcgtcgactgttccaaatccacgccgggatggtgcaattcctttctactccaccaaggcgggtaactgctgctgcccaagccttcatcacccatagtcactgatgaacaggagtaacgccacttccagatccacgtaggggccattgcctttctgcaacttccacccgtgtcgatgttcacaatatcttgttaggagctacacaggaaggacgccccctccccccacccccaccggccaccaccgacccctgtcggccccatcccctctgcatggccataaactcagtcatcgactaggggatgaacctcctcttcatcgcttctccgctggccttttgcagggccgccgatgctagggggatggctccctacatccatcttcatcggtgctgcctctcctccaccgctgttcgccgccacgccggccctctatctccgtcgttaaggacgtgcgtgggagagagatgagagagggagggggcggggggtcatgggatatgtggaatgagcggttgggaggagcccaatattttcttatccatcggaggctcgataggtagcgttttcattaacttttattttatttttataaagcccattctattaaaaaaatgataagcattttcaaactgaggaattttgcacacaaattgacgcaggaacttgaaaaaggttcatcataaggccaccgattttgacacagctaatgaatttctcaagcaatttcctgacctgggtccttgtgagaccattgaaaggaacaacatgtacacagaagcacataagcaatctccaattactacttcagatctgagtcgagtataacacgtgcataaggatatccatttgctgatggtaattctgttgtttattccaagcaaataggcaattggcagctggcaatatactcccttctactccctccatgcatttttaagtgcagccatggttttccgcgtccaacttttattgtctgtcttatttaatttttttttaaaaaaattaaaaacataagtcacgaataaaatactatttatgttttatcatctcataacaacaaaaatactaattataaaatttttttaaataagacgaacgatcaaatttgggcgtgaaaacttatggttgcacttaaaatgggacggagggagtagtacttttttttgtttgccatcagaaagcaatcacgcatcaatctatcagatggcctgacaaaaaattacattgataatgagaccatataacagaggacaaagcttagataagtcataattaaggtctaaggagcacatgcatgagaaattttgcagcaaagagaagcaaaatgagttgaacgtagacattgtttctagactgccatttgtcgatcgaatcaagtcattatactgaataaaacagggttcacaacttcatgcacacagcacagcaaagagaggttgaaacatattccccatagttttcaaaatgagcgccacaatcagtgataaagcccaacaagctcaaatttctcatagcgttccccaaaaatgacgtgtagtcaccattcgcttcctaattctctcgaacatctgtcaatgtgagtaacctgcaatgcaaatagtaaacatcaaacttcgtaataacggatgatgaccaagaataaacagttaaacactagggtcatctgaacattcatttgaataaatgggtaatacagttaacattaagagtaatttgctgtagtttctttcaagtaaatgccggaatgaatttcattgtctaataaagaagtagtagaaagaacatcgttcagtttaatcaagatcactttctgacatatatagtccactatacactgtgaatcggtgattacatgaaagaagacaattgttgaattcacagcacagtacaacagttgtgtcaagtggtcaccttgtatccggcttgatgcaagccacggagggagcacgaaaggcgtaaacacggtgggctcgtcgagcagaaaactcgcaatcaccatgcgcctttccatgtcgacgccgatgacgtgcttgccgtcgtcgccgccaaccacgaggtacacgacgctggcgttgagcggatcgatggcgccgatctgcaagggccccgccggcgagagcgggccgagcgccacgcggtgcgccagcgtccagcggccgccgccgtcgtcgtcgagcacgaaggagctgagcacgaacggcttggcaccggacacctcgacgtaccgcagcctcccttcgctgaccccgatgcgccgccaccttctcagccccaccttcccccgccgcatctcgatgctcgccgcgtcggcgggcagcacgctgccgctaggcaggaggacgtagcggacgtccggctggtcggggaacgggtcgacggagacggcgccccaggccaggtcgatccaccacatcctgccgccgaaggacaccaccggctggtcgatgagaatctggcgcgtgaacgacagcgaggacaagctcatcgtcgcctcccacctccccttctccgagagaaaccggtgcatgacgcaatccgcgcctctgatttcggctaccgcgaacctgtcgggtggcccgtccgcgcggtcggcttgggtgaggaagccgtggagaagattgtgccaactcttgctctcgccgacggtgtccgggtcctccgggaggcggagcagctcggcggtgagagggttgcagacgacgcgggagacctccgtgtgggacttgaggccggggagcggaggccaggtggtgtcgtccttggagatggggatggggaacttgacatggtcgggcacctgggcgagatcgaacacggtgcggaggaggaggaggccgccgctgctcgccgtgcagatgttgatgcggcaggcgacgttgccttcggtgcccggtgtagcggggcacaggaggcagtggagg

SEQ ID NO: 45497 - DNA, 6288 bp, Oryza sativa
ccctgagagagaggagaggaggagaaactgagaggaagcttttgcaattgtcacgcccggttcgtgtggactcggtgcacgcagtgatgttccgttggtttcctggagaaatcgggttgttctacgcctgcggggtgtagggaaaactgtcgggtccagttgtcagtgagtatttgggcccatttgtcagtgtcagtggcctactaccactactacattgctggcccgcctccgtgcgaagtagtattccctccgtcgaaaaaagcaaacccagaattagatgtgatatcaattttttgttcaaatttactgaacaaaaacggatgagtatttggaacgtagcagtgcagcagcgaaaaaggagatggctttgaacgtttgagctgcccccccgaccgtgcctgctgccctgatctgctattccacgtcactagtttcccgtaaaagtgttttgggcctgacgcctgagctgcttgggccgtagaagcatcagtgaccatgggcccacggtccacggcccagctgagaaaaccactagcctacatgaacacctcaaattaaagggaaaatcatctctcactcaaaaaaatgaggggctggtttgatttgaggcctaaattaggcttaccaatatttggcaatttcaatagtgtttagtgtctatttggtttgaagccaaattttggcatgcctaagaaaataggccatttcaatagtgaacttaggctattttggcttcaatctaaacacaactttaccttaccaaaattagtcatgccaaaacttgccaaaatttggcattgacaaaatttggtaaggcctatttaggccacaaaccaaaccaacccgaggctatcgaagtgctactccggcatttccctcttctgactcctcagccctgattatgcagtaagccctcatatcactttcgaactgaagaaatttcacatcaaacatcccacaattgaatttgcccccaaaaaattggctttgtcaaaatttggcaaggaaaacaaacaagagtctacaaatctaccagctcatactgttggaaacaacaatctcatttggaatacaacaacttcgcaaggaacaattcaattccataaaaaagagctggggaaaagtctcaaggtcaagtgtttgcacataaacatcacgctttccatagccataataataagatctctcacaaattcactagttacataactgaatttctgtacgcatgcattgacttgtgcataggagcactgcagacaagcatagcaagcaagttgtttttgtgataaccattagtacatgctgatggaatccaatcgttctactggaatgaccaacaagtctgcagcaaagccccaaaatgacaactcccagaatttcatcagtaaagaccaaccaacaaaacttctccaaaccccaccaaaaagagttcggcaattaccaccatcagcatcctaattcatcagaacacttgcatgtgttaggttaacaaaacctgaaaagtaaatgcgcaacattaaaaacctgaataaccataggaacaaaaatgagtgttttgggaaaatggcaagtttagcaaggttagtttgaacacaaacaaacatagagatgtattttattagagcttagtctggatgaaaagtgaacagaatctatgactactgtaacaagtacaaaacattttttctgcattcctttgggattgaaatggaaaaggagttatcgattattgtcctctggatgatatgcattgattaagaaggaaacaagagcaatactctctctgtcccataaaaaatcaacctagtactcaatacgacacatcctagtactatgaatctggacatacctcagtccagattcattgtactagaatgtatcacatccagtactaggttcattttttgtgggatggagggagtacttgctaagaagtaacaaccatcatttccggcttcatcagtttgtgacagtataaagtattgtaaggcaaaaagccaaaaatacataatgaatatattttatagtaaggctgggaaccataagctcttatgaataataacttaataagataggcccagtattaagtttgcactcaatcatgcttgttcagaaaacaatactgagcctgaatgacatacaagtagaagcaaatcaaaccagaatcaccagtaaatttataatacagttagtagtagctggttacctgataaattaactacttcttgtcactgcctgaacgaaccagaatgtcacccaacgtcttatttttcgcattgtccttgcctgaatgatttttcgttgaatttaatcacaagaacttgagcaacaaccatacattacaattctaagtaacacaatcttactacaatagctaaggaattaaattgacatgtattcgaacaatacaacacaacatacatatgttgatgttaatgagagaaaatagcagtatttggacatagataactcagaatagtatgttggtcagaaaagcaacaaaaacataacagtccctttaccaataagcttgtttgctaataattgattaatgattacattgttaacaactgatgtatgttcgagtagcaggtcaaataaacaggtcttaaggcacaattaaatggaaacaacatccctaatgctaacctttaaacactgtattgcacaaaaaggagacaaaaaaaaaagcagattacacagtgtacatttgagattcaacacgcagtataaatccagtgatgttctacacaagaacactaaattgcaaatgagctacattttgtactagcaaattcccagagaggctgctattagcttgtggctcactagtgtggtttagctgagagttactgaccaattcctttcaatgcccagatgcattccatgaacatcattacacacaagtgacttaaatttaaccaaccaaacaagtgactgaacttataaaacaagacaagtgaaatagtgctaataaagtgataattgcatcttgaaaagagacatgctaattaagcgatgaaatgataacctgaaggtgggatctggcatgacccaagccacgaagggagaacgcaaggcatgagctcggagggatcttccactagactactcccaatcaccacccctctctccatgtcgacgccgatgacgtgatcgccgaccgtgggataggcgacatgggcgttcagcgggtcgaggaaaccaacgcacggcttggtgccccggaatggcagccacgggtagcctccgtcgccccagatctggctgagctccacgcgatgctccagcgtccacttccagccgctgccctcgacggtgtcaccgtcgagcgcgaaggagctgagcacgaacggctcgtcccaggacagctcggtgtaacgcagccgcccctcactgacccccattctccggtagtcgcccagcctcagcttgtgtcgccactcggggtttgtcgcctcgggattgagcagcacgctgccgatcggcagctcgaggaagcggaagtctgggtcatggctgaacgggtcgacgtggacggcgccccaggtcatgtcgagccaccacagccggccgccggcggcgaccaccgggtggtcgactataaccttgcgcggcctcgtgagcccgcacccgaacaggtagtccggcagcgcgtcccatctccccgtctccgagaggaagcgatgaatggggaggtccttgccgatgaactcgaccacggcgaatcgatcaggcggcccgcccccgctgtccgattgggtgaggaagccggcgtacgcctgccgagccagaccgccgtcggggagacggagaacctcgccgctgagagggttgcacacgacgcgggcgacgaccttgtcgaagtcgtacctgatgccggactgcacaaaccaagaaggatcgccgcggttgtcgaacatgttcgtcgcggcttggccggtcagcttggctacctcgtcgacgacgcggagcaggaggaggccgtcgctgttcgcggtgtacctcgggccgtaccgccggatctctccctccaggccggctgcaggcccgctggggcggcgccagagggcgccgtaggggacgacgagctcggaggcgagcgggggctcggcgaggcggaacgtcgcgcgcgtctccagcggcacgttcggcttggggagcggcgtcacggtgttcaccatcgcccactgagggcgcgaggggcccgtggagagggagcggcggaggcggccggagacctcaccggagaggccaaggaggcggcgccggagctgcatcgcggcggcgcggcgcggcgcggcgtctcgtctcgccttgtcgaggggatgagaaaattgagaaaacgggaggaggcttttgcaattactactcctcagagaggcgcagaggcgcagagcctggtgcatgtggactcggcgcacgcggcgaggatacgtttggttgcgtggagaaatggccgtggggttggtcttcctgggagcggtgagagggagctctactcgggcccatttgtcagtcacaatggtctatgggtgttggttcacggagaggcttttcgccgttgctccatttggaacggccgtacgatacgagtacagtctactacggcctgtcggcgaaatgaaaaattttgggtcatatcacgtttgaccggatgtcggaagtggttttcgaacatgaatgaaaaaaataatttcataactcgcatgaaaaccgcgagacgaatcttttaaacctaattaatccgtcatcagcaaatgtgagttactatagcacttatggttaatcatggactaattaagctcaaaagattcgtctcgcaatttatatgcaaactgtgcaattagtttgtctttttatctatatttgatgctctatacatgtgtccaaagattcgatgtgatgtttttggaaaaaaaatttggggactaaacaggcccaaagtttgcttgcttttttggtgcgaaaagcgaagggatttttttttgaacgtttgaattgcctcgattggctgtggcgactgtggcaggtctgcacatgacccgatccacgtcacctgtttcccgccaaaaatattttaggtcttagtagctgattgggcctgcgggtcatatcatatcatagcccacaagtggccacggcccatgggctcacggctcagctggaggcatctactacatcgaaggcatcgacaagacgacaagcgaccggagataatagataatctctcttttgaacggaagaattttacccaaaaaattaacagagaaaattaaatcttgaaagattcatcataaggccagggatttctagagaagtactgaatagctcaagcaagttatggacttgggtccttgtgagtcttcaaaggaacaacctgtacagagaagcaatctccaattcctacttcatattgtacggggtagaacataacatgcacataaggatatgaatttgctgaactgatctttgaaagtctatcctacgccattggtacctcatctgttttataatacaatactttctaacattgcccatatttatatagatattaataaatctatatatatatatatattcattaacatttatattgatgtaggcaatgttagaaagtcttataatatgaaacggagggagtagtttggaatgtaatgttggggggttctattttttaccgtcagatagctagcaagcaaagcaccagtgtcagaattcaaaagaccccgaaaaaacatattccattgatgaatgatgaacacataacatcgaagaaaacttagatataaggagcatatgcatgatgcaaaaatgtaatcgttgtatgtgttgttctagactgcggttcaaagctcaactggcgatggaatcaagtcatttcactgaaataataataaacatggctcgtgcatagctaagagaagttgcaaaatgtttcccagaatttgtcaaaatgaggggccacaaagttcatcaggaaagccccaaaacccaaacttttcacagcattcccacaaggtgtgtcagaaaccatcaccattcgcctcctaattctccagaaaaacctcgtctgtcaattttgagaaaccctgcaaatcaaataataaacatgagactcccttgtctctactatctttgtaataattctgacaaagaagtaaacactaggggcatatgaacacacatgaagaagagctacatttatctgtttttaattcagtgaaaataaacaagtaaatagaaacgccactacataatgagatgccgtctagctttatagtt

SEQ ID NO: 45498 - DNA, 1825 bp, Oryza sativa
ttttagggtccatgggagtatgttctagtgttaatcatgactcatgggtttgtatactgaacctctccatagtcaatactcccaaggagtcaagggcactccaagaactcattcaatttatataacacagaattctaacatgatcaatagttaaggagcaacacaacaacaacagcattcagtctaggcaagatcagttggtaataatatgtgccatatacttacagccccatgttttccaataagtcataatgaactagagggcagcaatagtccctattggcagtcagcacacttacagttgagcattatacatttatacttgtgtctgccaagtctcttattgcaaattaattcaaaatacacaactattctacatcttccgcaaaagaaaaatgacattgcaaatacatgtaaataaacaaaccatcctgaacttggaaagcaatcagataccgccactaattgataaaacagtgaaagttagttaacagaaagtaccatgagatcaaaagctgataaaattcacttcttcagttctatgtctacatgaaccgacatgtctgagtatgacggagtattgcttttcatcttggccttcttgctccaatggatccctttattcacaaagataagaaactaaacaatcagtatatgcttctctacaatgtatccaagatataaaacagcaaacgaaataagacactgaacaggggcatcacatagatatacgtttacacccaatttttagataatggaaatggattacatctccggcgtttacactaaattagatgaatggaatgcataataataaacatactatattcaaattagccgagagagagagagagagagagagagagagagagagagagagagagagagagagagagagagagaaatcagcatcctttggctttacatctactcctaaatgcttcctgtttcaaccttggctacaaaagtatccaagttccactctttctccccaaattcaccatttcgccacaactattcccgatttgccccaaaattctagtacaattggtaaaataaggattttaaagacatgttaaaacgaaatatactaactccaactaacatttacatagtgcacttcagcaattggataactcaaacaagcatcatagaagaagcgtgactacaaataaaagtatgaatcttgtttcaaaagtaaacaaataccttcaggaatctggcttgattcaagccacggtgggagtacacaaggcaggaggggaaagtcagcacaacccaaacgagaactgtcaatcgccctctccttaatcatgtctatgctgagcatctgatcaccaactatgaggtgcacgatgttggcgttcagtggatcaatggccccaatccttggcatgccacccaagggaaccgacgcgtggtgctcatccttccagatcgggccgaaggccacctcgtgctccagcgtccaggagtcgccgccctcgtcgtcgtcggcgagcgagaacgacctgatcaagaactgcttccccaaagacacctcgacatagcggagcttgccctcgctgacccccatgcgcctgtacttgccaagctcccttagcatcaccacgtcgtcaaggtcaggcagcacgctctccttgggcagctcgacgaaccggagctccggccggtcgctgaaggggtcgatggtgacggcgccccagctcgcatcgacccaccatagccggtcgccgaaggccaccacctcctggtcgatgtcgaccgtcctcctggctggcaatggggacggcatgcccaccagcttgtcccactccccggaatc

SEQ ID NO: 45499 - DNA, 7668 bp, Oryza sativa
  unsure (1)..(7668): unsure at all n locations
aggtggttgcgggagtcgtagaagcggacggggacgaggccgtcgccgctcgtggcgcggacgtccgtggagaccgtgccgaacatctcggactcggcgtcgtggcggaggcgggggtcgacgaagctggcggcgaaggtgaggtaggagacgcacggcgggtagtcggcgtggagcgacgcgcccggctgcgacgacgccccggaccggtccatcttcgacagctggagcagcgcccacgggggccgcgccggcgacgcggcgcgcgtggagaggtagcgggcgaggccgccggagacggcgccggtgaggcggcggaggcggagcatcgcgcgcggaggcgtggaggtggaggtcgcggtgatttggtgtagtagtagtagtagtagtagcctgtagtgtactactggtagcagagaaggggagaagagggttttgtgtttgtgggagaaaccgagagaaggggatgcggaatgaacatgaactcgctctacggaccaaggaaaagcagcgtggtcaaaagaagaagggaagactcttcagactttactatcaagctgtactcggatatttttttttctttaattacaagctgcatttaattactttggatattttaactacaaagctgcatttaatggtatttcagtaggaattaatttttagaaatccaaataatttagaaattttctcaaactgaacgcgcccctaatgctttctcaggtgacaaaatcgaagggcctaataaaacctttatagttaagataactgttgggcctgtagcccatctacagtaatttatctatgagactccgactacaaaccttcccgagttgtagaattttttttttaaaaaggagaaaagcaaagttggagaaaaaaaatttcctttaaaaaaaaaagaaaagccggtctccttcatcttcccgtccgtaaaccctaactgacttatactcatcaatcgtcctcctcgattgctcctcccctgattccgatccactccgaggcctcatggcggcgaccgattctcgtcgccttgcagacctagatgtcgacgagctggaccgcctcctcccgttgatcaaggtcacccccttcgccgcgcaccgcacttctgcccccagaggatgtggttgtccttgtgcggcgccgaggcggatggaggagtctcagggtaaatagtttttttccccatatttctcttgtgttggttttaggactatctgcatgatttatctgatcatgcagcctcgtcggagaggactccaaatcccccccacaatcgctcagtcgcctttggacaattccaagaaagactccgagaaagctttacgcagtaagtacatgattttatcatacaagaaaagaaaagcaagcaaataataaagccaataattgtgggaagttaatttactcacttatgggggtggcatgtattacccgacccatcattaataaaatggttataaggtagagtatatctaccttccagcataaaaaaaaacttatgggggtgccattgtacaaagaatgagatatggggtagaagaattacgattgtttgtctgtttttttttctgtaaacaaatgtagtctgcttcctagattgctttgctggactcgtcatcttgccggcagagcaagaacaacttgtggtgctcaaagccatccttgattccttctccgaggccactgggctaaaaattaattttcacaagagcaccttcctccctatcaatgtcctgcatgatgaggcggttcggctggctgggactctcggttgcccgatagcttccttcccccaaccttatttaggcctccctctctctgttaccaagctatgcctcgcggacttccaaccgctcatcgctaggattgacgaacgtcttgccggttggcgcggtcaccttctgtcttctgatggacggctcactctcatcaattcggtgctctccgccctcccttcctatatgatgggagccatccttctccctaagggtgtgttgccgccattgacaaatgccgaagagctttcttctggacaggggatgaacactgccatggtgacaactgcaaaattgcgtgggacattgtttgttctccgaaggaaaaaaggtggtgctgggataaaaaatcttgaagtccagaacaatgacgaggattctgcgtcgtggattgactgttttcaaactgaacgggtctatagtgctttctcaggtgacaaaatcgaagggcctaatgaaacctttatagttaactgttgggcctgtagcccatctacagtaatttatctcagactacaaacctttccaagttggagatttttttttaaaaaaaggagaaaagcaaaagttgaagaaaaaaaatttccttaaaaaaaaaaagaatagccggtctccttcgtcttcccgaccgtaaacatcgagattctagagagacgaggcgcgggaccagtgaaaccctaaccgagctactcatctctcgtcctcctcgattgctcctccacccgattccgatccactccgaggcctcatggcggcgaccgattctcgtcgcctcgcagacctagatgacgacgagctagaccgcctcctcccgttgatcaaggtcacccacttcgccgcgcaccgcacttccgcccccggaggatgtggctgtccttgtgcggcgacgaggcggatggaagagggtcagggtaagttggtttttcccccttgtttctcttcgtatttgtttttccctccttcccgtgttactgggtaaccccctatctcacacaatatttatctgatcatgcagcctcatcggagaggactccaaatccccccacagtcgctcagtcgtcgttggacaattccaagaaagattcagagaaagctttacggagtaagcacatgattgattttattgtacaagaaaagaagagcaagcaaataatgaagtcttatttggggaagtttattcacttatgaagtcttatttggggaagtttattcacttatgggggtgccattgtacaaagaatgagatatggggtagaagaattagggtagcttctctgaggtagaagaattacggtagtttctctgattttttttaactgtaaaacaatgtagtctgcttcctaaattgctttgctggacccatgtcgcaagttcgcaacttgtgatattatttgagctacgggcattgtgtacagttagattttatttgccaatggtctgagcttacttctactttcagaacgcagtataaagatggcaatgaagattatcaattactctgaagactgtatgagaaagattgtagagttgaatgccactctccctctggatcagcatttcttccctgcctgcatctggccacgggaccttgaggacttgcgtttttccaagattgggttttacgttgactatcgcttgaatgacacttctccaagtaaatgcttctacagtttattattaaaacaagttgcttttcttagcttcttcattattgaaggttccagtatcagtggatttgaaataactctagatttttcatgtactgtctgtcccatgcaccccaagggatctcaaatagtttagcaaacaatcatggagtagtgtcagtgttatatgtttatatcagttctaactcatttgatctaggattataaggatcaacgttttatatatttaagggtgttattataatatctatatgtgattatgtcataaacattggagtctgaagtaaaatgtactcttgcctgacacgagtacaagctgcttctaatatcgatttcaaatcttttacagtcaaccatagcaggactctgcaacttatgtcctttcttagatctgcaatagttcaggggcactgtcgtattatctttgttgttttttgatttcttgttttcccagagtcgtaacgtttcattttgatctattgcttatgccactcacagccacttgggggtgtaagcgctttgcacatgaagacaagtatgttgcatcaactatgctgcggatcaatggactagtgtttactggagatttcccacatggccggtccatgcatgtttatggttttgtggctgtgagggatgataaagagccattgaggaactatatcttcaatgtcagcagggagaaggcttgtcaattgaacctggttagtacatctatactcaaagactttttctacagttgattgtattttgattggtatataatgagcgtccatagctagcgcttatttttttagtgtctataactttggaggatttattgattagtagcatattgcccatgcattgcaacaggattttaattaaagaaaattatcattaacccattattaccatcattttctgcacatattacctcttaattgctgtgtatatttgatactgccatatgacctctttggccctacactatccatttcctttctcgcaaaaagtagagagttggttttggggggggtgggtggggttgatatgtggggcctctagcccaactgtncttttnttcctttccgaaaaaagggaagggtggctgaaccaccaccactattcccttttaaaggatatagaatctcctaaatgcacaacattcccttccctcccattttccctcttaaatggccatatgccttttcctttcccatccatattgtagagcatgctttgtagaaaacacccacctgaaagtaggaggaataagtggtaggtccggcttaagacttctgtagcagaacaagcacttctacatattagtaaatatgtctaaagaatggcgccatgaatgtgctaggaatatatatgtgtgtgctaggaaaacgaagagaaagcacttctctttgttttttggcccaataaatcttatattcagtccaatactccagttgtacgctaaactctttggattgcactgtgttcagtaatatcatgatttggttcaattttgaagtgaaaagaacacacctgactgggttgtacagagggaactatatatatgactgaaaactttaaaaaacacggttgaatatgctatgagagtcctatatttaacatggaaaatgatgttattgcttcagactatttgcagcatttagcttgccgtagctaaatatagcattcctctaagcctcaatcagtcatttttgtcatttgacttagcatagaatgtagttctttgttcactgatatctatataatcatatcacaaaaactgcactaaattatatgtgtaggatgaatctcattgtaccaatctcatgtagtcaatcctttattttgatatattgatggtaaaagctgggaaaaattgagcatgaagtgctagctacttataatattggaagggagtgtctctagttcaaatgtgcaaattatacttgcatagaatcacatgaggtaggtctagcccattatttcttgttaagatcttggtaacatcttgacattggtagcggcttaccatgtttattttggaattcctaataatctgattcaaaccagtgatatgtgtggagtaacataaccatattttgaccttatccttttctctttggtcaaaatgcaggattcgccttcattggagattagtccccccatgcgtggcatctccgtatgggacagtgctttaatcgagtttcacttgaaggttaagggcagtgacatgatagtagttcagatgatgacatactcattaacgcctgtatggagttcgactatgagaccattgagcatgacaaaaagttgatatcaagaattgatggcccgttcggtccacttgatatgcgttatatcttcttaaagaatgggattgaggccactatcgatattgatctgggcagcacatctgaagcttatgatattttgcttgtagcattttcaggcgaggattccatgacgctttacaaggaccgtgttggacagcataccaagtttacagccgttgtaattgttcctttagacgagttgttacatatcaaagcatttggcacgtatggttcgtctcattttgatggcaatattgctgtgcctgtattaaagcatggaagctgtaagaaaccgttttggtttcagttggcagagaagaagtcggggcataagaatctgcctagagcttgcctggaggtcacgttttctacgatgggttactataacacgggagagatgtagaacaaatgactgcaagaactgctattttgctctagagcatttcgttttcctgggctgtgaaatgtttaagagttgtgatttgatactgaaatccgtaagttgtattttaactgaaatcgataatgatgttttatcgatcgtcagtttctttcgctgtgatatggatgcttgtatgttttccaaagtttgagtcacccgttgaagtagggactgaccacagacgggcagtcaaatcttgtttgtcatgaattcacaactgagctgatctagcacttgctgccatggattttttatagtatgtaggttgatgatatcttcatagtacgtaggcaaattaattgcgtcgattaatcaatacaagcgtttttatgcaatcagaatacctactgtaattttttttaaaaaatacaaaatccatacagtgcttagaaatacatgttctcataacatgcgattaatactaaactatcatagcatcaccaaaagatatctacaccaactagtgaagagcaagaaggatagaaaagaggattctaattttaggaaggtaattaaagaatagaaaagaggattctggtttttataggaaggtaattagggaaactgttcgaggcaactttcaaaagaaaaagcctaaaattttgggattaggatccattcggtgatgctcttatatattttctttaaaaaaaatatcttcagtgagatttaaaggcatgaaaaatatcttaccctcaaacagatggcctaattaactttctaaaacaagaaaagtaggctacgacaaaaactatcaacagaattaatcctttcccctacacgctcaattccttatcccggtgcagcgcttcccgtgtacagggaagcttcgagtggcggatcgtgagcctcctaatttacaaggacatttacaatagtctctatatctctctattatcatgcaagtaaatttgataacatagatgaaagataaatgaggaaagaaaaatatggttgttatgcatggcaacggctcagagtcgactcttagcatttattagagcaaattttgttgcatggtggtgaaagaaaggaaagaatagtaaaaaaaaaatattttaatacattaatgattagagcttatattgtctctaactattgtaggatctctaaataacgtagagctcatacctgacacctttatacatgccctaagactgaaattaactctccaattcttaggtactctctccgtcttattttaagtgcagtcatggattttcgtgcctaacgtttgaccattcatcttatttgaaaaacttataaaattaaaaataagtcacacataaagtactatttatgttttatcatctaataacaataaaaatatgagtcatattttttaaaattaaaacggacggttaaacattagacattaaaaccataactgcatctaaaatgagacggataggtggttaagggatctgttggagtgatgcttttacctctaaaagtct

SEQ ID NO: 45500 - DNA, 5802 bp, Oryza sativa
ttaaatggataataggttctattaccaaacagtattgttggaatttgcaaggcagtcatcaaaggaactggttaagctgcaacaaaacaaaggatttattcgccaatggaactgattaatatgcataaaagaaattgttaaccgtcattactgaattgcatatatacactttcaaatgctattttctttttctttttgatattggactttcagtagatattattattactctagagaaaacagttcggaattagacaaaagaaagggaacaatttttttgtcgggtcggccgaagaggtggctgaccaatttcattaagaattggaagaaaattaaagtgcacaagtgtgttacatcgataggaggatgtcgatcaggtccaatgcaagacgcctcagtcccgtgaacagaaaaagcctaaagactggacagaaactgtatactcaattaattacccgggcgaaaaattcatgcctctgtccagatgataatttcctctttgatgtcattcaccaagtgctctatcgtcctgagacattggtcgaaaattctcccgtttctttccttccaaatcagccagcataccagtatgaagaggcagtcaaaggacgctctgtagctcatccggcaacgtgctctgttctgcagccaccagtccgccagagcatatccttcatctcctggaactgcgaagaaaggtaacaattcggaattctttacttttgagtcttaaggtcataatattaccactatggcatagcttcttccttaaacacgaaaccacaatgggtaagtgagtgccatctggtaagtctaatatacctgcatttggttgtcattcttgatgtaaacatagaaaatcaacaattgacatacgtgaaaaaactacaaactattaatagaaactagattgtaagagaatatatgggatttaagttttggaaggaaattagcccactggcattataaagatcaaatgatagaaaataacatctcaactagatgaaagtatgagaccaggtagtagtaacatcctagagagagaaatctatctacacctaactagttacctcaggaaaattcccacataaaacttcagaattagtaaatattaaatataaatttcatttgtatataaataggtttcgaaaaagaaggttactaaacatctgtttacatataatttcaatttaataactagtatagttaggcagatatacttaatatcaatagcccatgcaaatgcgtggtttaacaactagtgcacctttgttaggttctgttatttaccagttcagtttagttgcagtggcatgttgctaaaatgcaatcttactgatacaacttacgtagttacctcagagttgtgggcagaccaataattgagacttcctgagttcaaaactccaatgtttgaggtacaacttctcccttcggcctaaatcaagagaaactcacagattcagtgttactttctgtttgtttatgaagagaaaataagtaatgcacttgactaaccccgtgccaacgccacacattcctttcatacagaaatcttgtgctggacaagtcttccaaaagtgctttagcaaatctgaacaacagaataccagcatgctgtgatgcctacatgggaacagacaaccgtgaaaacaaatatggaatgtgtaacccttcgctaaaaaaagaaactaaatgctgtgataggtgcaccccaaagatcataggtaccaccatttatccatctgtcacgcgaccatcaataatatagtaccatgatcatttgtatacacatcaggggcatttcaaaaaaaaatacaaacaccattttaaatttcaaattgttgagcagcaatgcaacaaagttacactagaacatgatgttgatatctggtcagcacataaagtgataagggaaacatgaagtatgggtcaatttatcaaataaatgtacctaaaactcacaaattcatggttgcatacatgctgcacagatttttttggaacacatcaatggccaattgctggttcatgtgaaaccaatttcccaaaaattccatatatagaattgaggacagtatgaaggaatgcagtgttaatgtatacaccatatatatatttctgttttggttcagttggcccacttagcccatttggcccatgtatatgtatataaccttcactaccatctagggtttactgctgaatatatttttcgtgatttcccccaaatgttgaacatggtatcagagcttgcctgggattcgccggagctgcgtcctggacgtcgcatcagcgatctgctctgctgctaataatctcttctcctccgccggcaagtttcccctgtcctcaatcttctttgctgctgcctaccgaatctgctaggaagcaataggtttcccttgtctctacacccacggctgctgctggttactgctgctacatggttggactgcctcttactacggggaagttaaagcgggtccatttgcagccggtaatggacaaaatcagagcaaggatggggggctaaaaaaacaagctagtttatcaaagcgggcggaaggttcttgtgcaattagttctcagtgccattccaacctacttgctgaccattcttaaaccaccaaaaggattcctaaatgatgttgacaaagcgcgacgaaaatttctttgggccagagaccaagaaagcttgggcggaaaatgtaaagtgaattggcagcaagtatgttctccgactatacatggtggattgggcataccttgtttggagaagttctcacaatcgctgaggctacgttggctctggtatgagtggacaagcccggaaaaaccatggataggaaccccgccgccctgtgatgacaccgatcgtgctttgtttgctgctgccaccaaagtatcggtcggagatggacgaaaggcaaaattttgggaatccaactagataggagatcagccgctgaaatacctagccccaaacctcttcaagcactccaaaaggaaaaacaggtcggttcttgaggcaataaccaatgatgcttggatcgaagacatccgcggaggggtgacaatacagctgcttcaggaatatatatgcgtatgggaagtgctccacaacgcaggagaggtgatccatgaaggggctgaggacacaatcctctggaggtggtcggccagtggcttgtatacggcaaaatcagcatatgtcatgcagttcatgggcaaaacgttttcggattctactgagcttgtatgggaaacttgggcaccggggaaacacaaattcttcgcgtggttgctggcgcaaaatagaatatggacggcagatcatttgcaatgcaggggctggccaaataactatttctgccaactctgtttcagaaatctcgaaacggtacaacacctcttcatggagtgccccttcacgcagcaggtatggcgggacattggtcgcaaattcagaccgcaacgtttcctacatgtgaccacagacaacactctcctcaattggtggcgcgagcaaacagatgaggcagaaaagttgcaacagaaagggctacgttcagcagtcttgaccacgctttgggagatttggatggaaaggaacgatcgcatcttcagagggaaagaatctacaccatcggcacttgctagcaagatcatagatgagcttcgtttgtgggaaatggtaggtgccaagggagtgaagtgtattatgttaagagattaggcttttgtttttttagggagtgcaggcaggaagaattcctccgggaacgtctcccctgccttctgttctgtacagtttctctcacttcttctataatataaaaccagcttgctgggttctttcaaaaaaaaactgctgctacatggtgtttgatttggtctgtagcttggttcatgtgtgttacagaggctgctagtactgaagtattattgtggatttgtcacttctgtccattatgatttcttcagtagggattcttcctttacccccagtgagctctatttctccacctacttggctgaaacaatgccattcctgtttgaactggggtcatattcaaagaaattgcaatcagtatcgttgtcatctccagtcaaataaaccacatattcatgataaggatgctaagtctgaatttgccacattcttgaaccagcttgcacacacccctttgaaaacagatccatcctcatgtattgctgatgttagtatggatattacgggctgttcactttcagcaaatgttacagactcttgttggatattggactcaggggcatcctttcacatgacaccggacatttcacagctccagtcatgctctttgacaaaagcatcaagtgttcagacagctgatggcaccattctaccggtttctcttcaaggcactctccaaactaaagaatacacaattccagatgtcttttatgtgcccaatctatctatgaaacttatatctgttggtcagcttaccgatatgaagtgccatgtggtttttgatgaggctgcttgttatgtactggatcgtgctacaggcaatcttgttggagctggtcatcgactcaatgtcctaggggactttatgtgcttgatcatttgcatcttcccacttctacttcctctggttttcctggaaactctgcttctgccacctctataacttccaattcctctgtttattcctctttgtcagcctcttttcctcagtggcatcatagacttggtcatttatgtggttctcgcttgtctactcttgttcaacagggtgtcctaggaaatgtctctattgagactgatttcgtgtgcaagggttgcaagctcggtaaacaagtacaacttccttatcgttctagcatgtctcggtctacctctccttttgcattagttcattcagatgtatggggtcctgccccatttcattctaaaggaggtcaccgatattatgtcatttttgtcgatgatttctctcgatacacttggatctatttcatgaaacatcgcagtgagctctatcaagtttacaaatcctttgcttccatggttcatacacagttttctacatctataaaaaattttcgttccgactccgggggagagtacttgtctaatgccttccgccagcttttaagtgaccatggaactcttccacaactttcatgtcccggtgctcatgcacaaaatggcgtcgctgaacgaaaacaccgccatatcatagagactgctcgtactcttctaattgcgtctcatgttccaccacatttttgggctgaggctgtatccacctctgtttatctaattaatcttcagccttcatcaatccttcaaggccgcagtgctggtgagtgtctttattcctctcctccaaggtatgaccatcttcgagtctttggttgtacatgctatgttcttcttccacaacatgaacgcaccaaattatctgctcaatcagttgaatgtgtttttctgggttatagtcttgagcataaaggatatcgttgttatgatccttctaatcgtagaatgcgtatttctagggatgtttcttttgtagagaaccgtcctttctattattcgccctcctctacacgctcttcttctcctactgaggatgtgtcttttctgtttcttccaccaattgagttgtctcctgttcaaacccctacagatcctactgttccatccactacttctgttcctcctacatctactactattgttcctcctgttactccctcttccccagtgactagtactcctcctgctacttcatctttgcctcccat

SEQ ID NO: 45501 - DNA, 744 bp, Oryza sativa
agctgatggtgttcaggagcctcgcacatatcaagaggctgttacaattaatgaatggaattggctatgaatgaggaactttctgccttagagcacacgggtacatgggatgttgttcctcttccccatcatgctgttccaattacttgcaagtgggtgtttaaggtgaaaactcgctctaatggatctattgaacggtataaggcccgcttggttgctcgtggttttcagcaggaatatggtcgagattatgatgagacttttgccccagttgctcacataactactgtccgtacccttatagctgtagctgcaactcgtcaatgggagatctcacagatggacgtgaagaatgcatttcttcatggtgatttgcaagaggaagtctacatgcagcctccaccaggtttgacatgtccatctggtcatgtgttgcgcctacgccgtgctttatatggtcttaagcaatctccacgagcttggtttgagcgctttagctcagttgttctaaaagctggatttgttgctagtgagcatgattctgccctatttatccacacttcttctcgaggtcgtacaattctcttgctctatgttgatgatatgatcataacgggtgatgacgcttctcatgttgccttcgtgaagcaacgtctaagtgagcaattcatgatgactgatcttggaccactaaagtattttctgggcattgaggttgcttcaacaccgaatggtttcatttgt

SEQ ID NO: 45502 - DNA, 1521 bp, Oryza sativa
ctggcattcatcctctgcttgttcacaagaattctctgatgggacaatgttatgatcgcttccaacagtctggtgaagcaaactaagttagtgagccattcaacaagaagaaagtaattacaaaccatgaaataagcaaagattgaggagcattgttaaaaagaactcagttgtaaacaagaggcaagtggtgctaaaccatacagaaagcaaaggtagaaggagcatgttaaaaagaaggaactcagttccagggtgatggtaaagactaaagataaaacatttacaatttacatgttctgaatggcaaggaattgagaagtgagataaaacaaacagaactttttattgacggtcaagcaaaacagcagaatgatactaaataaaggcctgtgcattaacaattactcgtatgaatttcatacagttggcctgatcggctgccttgtttgcatttcagtcagccgctacagggagttgtatgcacttgcatggctgcggtagttgattaggccaagtgagaacaacttcctcagagtgagcatgaaaactgttataaaaccttccagaaataactatcagacaattaagggatctaggcagtgaggtaatttctctcatagaaactgtacgttatatcctgatctatcaaacaacaaacacagagacaatcggaatataaagagagtcaatagtcaatggtgtgcaaatcttatgcgtattcccaaaaaataaagaaaaagccaatggtatacctttgaacatgccattgcaaggtacatgtccatccaaagtccttccagctcatcaactgggctgctgttgtcatattgatcaaaatttccattggttggtgactgactgcgcataacttcacaagctagttcatcagaagcaacagagatgatctctttctttaagttcccttttatctggacattttcagcttgtgcttcctcttcccctatctcctcatgaccactctgttgaaatgcaagagtgacatcaaataaataattttcagccattcaatagtataaacttaaatgttgaaacaacacattttgtcatactagcataagtttagacaaacatcataattttaaggctggtatatgctatacgctggtcatggaaactaaggatgattagtttccacctctcttataagttactccctgtagttgaagatataagttattctgggtattgttacgatctccgatccacacacatttggccattactttttatagctctctgtttgcaaaatttatagaatatttctttttgaagaggagagagggatgccctctcccgttctgctaatagaaacgataacaagctcattacaagccaaaatgtcatcaggggaacggaaaacaaaaaaaatctactgggagcctgctaactggatgctccaaacttgaaggagacagccacacaaaactactagttttccttgcacagccattacaatcagcttaaggaacctggacagttttggagaacgaaaaaaaa

SEQ ID NO: 45503 - DNA, 17095 bp, Oryza sativa
agctatcagaatccatctagaacacaaaggaagacttgttagtgttttagaaggtgcattgtgcatttgtgcatggatgattgcaataataaaatgttagtacattgcaataacaaaaaagataatgtatcatcatgaacagaactatcactgatgcaaataaaacatgcggttgttctgaaaattgaagaaaaacaaagcaatacttcgatcatggatttactaccaacaaaaacccatctttctgtctgaatcaaatccatctattctaatctgagcttgctcgcaactcccagacagccgcttgcagtgaccaataccacagtccacaagggaccctaaaaaaaatcgacttcacgggaaaaaaaatttgcaatcagaactcggttattcgatgcttgtttcacaatccccatgtgtagagtctagacagttcaattggacccaacttgcaattagtttgccaggaccataaaccttggggaaaaaaccccaaaacccaagaaacgcacaaagctagggatagaaaggaaatgcccaatctgaccgcaaaaatgcctaaccagataactgaaacaacagacgtgcatgcaaatgggagagggcaaggaaaaacatgatgagagaaagaaagaacttctatttaggaattagggaaaacaagaactgaataacacagtgagaaatgcggaagaaactcacctagcttccttctgggttgagtgatcgatctctcctcctccccctcggagggacagaggaatctgaagaaccttgcgagaatcgctatgagggggaagaaatcaattcaccaaaacttcatgtgagcactggaagttggaacgcatgatgtgctgtgctcttcgttatgattcttgtgaaacacaccactgaacttccaaaatgtgaagtagtactccaggctccagtacatatacactgaactttcttagactgtgcagctgggacccacgtgagtgggccatgcatgtcatagaggaattgacatgggttttccctgacatttgggaggatccgaacggttcaccttccagggtgctttcgagaggatatggcgaccggctggtggtccaacttcgccgcctctctctccgactcctcgtcggcaggagacaccgccgatgccggccgcgccggcgagagagccaggcactctccggcggagtcgcgtgaaaagcttctcgagcgtctcgccggttcagatggcatagaagcaatatgcggcaagcaacgcggccttcaaaatcttcacatttctcatttttgtgtacggaaagctaaggtcatgtacagatgtgccctcaatcttctcacatctcaaatctcattcaataagccaatacatacttatatactcactctgtttcacaatgaaagtcattataacatttcacatatttatattgatattaatgaatctagataaatgtgataaatgctataatgacttacgttgtgaaacggagatactacatatgatccagttgtacaactcaaataaatatacaactataaatcaatttagagaacatgtataatgcactgcgactgtttataatcgtcgatcaaattcaattgtacgtgagtccaactgttgggacgtatgcataacaattttgttttcaacttcatgcgcgtgaaagtattgtgttcgtggtggtcaagttcctgcctcttgtgttctcggtcgtcttgggcctcggccaccttacgtttgttcgccatggcctcctgctgctgcagctcctgctgcgcggccacctgtttcgcctgcgcctcctccatggcctgctgccgtagccgctgctgcgcgtccacctgtttcgcatgcgcctcctccacctacctccggtaccacgcacgccacctcggcgtcacggccttgttcttgtgcatcgcgacgaacctctccaccagcatatccccgccgtcctcgagggcctcccgcccgatctctctcgcccgagcgatgaagaaatccaggatcacgtcgaagaatttcttgtaggagggggagttgtccatcaccccgtggtagattttgcgcaggaattcggagtacttctcgtcgtacttgtcgccgccggcgacgaggccgcagtgggagcccggcgacgaggtggccgcgcacagcctgaggaactccagctccacggcgtggaacgccgggcggaagttgtcgccggcgccgcggtggccgccgccgcggaacgcgaggtcgaggcggtcgtgcgccagcgccgccgcgtgctcgtccgggaaggcgcccacgaggcggtgcttggtcgggttggacgggtcgaccacgcatgccgcccatttgcccgtgcccttgtctcgctgcacgccgacgtagtatctctgtgtcgacggctgagcggtggcttgcgccggcggccgctgcagtggcgtcgcggcggcgggaggagtggaggtcgcggcctgagaggatggcggtggcatggtgcgtgctggtggtggtgctccttctcccccggtgttcggcagtggcgcgtgaggctccgtgggctggatgggggctccgattgcacgagagctcgtcggagcggggtacctcgccattgctgctctctgttgctgcgacacgtgaggattcccggtcggagtcgggatggtcggaacgcccggcgacattgccattgacggagctccctgagcgttcgacaatggcgcgtggggcctcacggtggacagtactgctgtatgagagctcctcggaaccatggcctgcgccattgcagctcgcgctccccgcatccgcttgtgttgcaacggtgcggccgggatgccggtcacagctatgtgggagctctgacctgccggcaccatcccagccggcgaagctccctgcattggtggcgccgcccagggagccctgatagcgcctctcatcgacggagcgttctgcacgggcagtgatggcgaaggacccctagcggtggtagcggcagcgccggaagctccaaagctcgccggccgcggcacgccggtcatcggtgtcgcgttctgcctctgcattgtcggagaaggcgagggagcccttgcggccgtaccacgagcaacgggagccccaaggttcaccggccgcggcccgccggtcatctgtggcgcgttctgcgtggaaggggaaggagatgaaaccctcgcggccgcggcgccaaagctcgccgggcgcggcacggcggtcatctgtggcgcgttctgcacgggcggggaaggcgtcgcggccgtagcagcgccaaggctcgccggccgcgccgcgccggtcatcggcggcgcgttgtgcgcttgggaggaaagcggtggaggcttcgcggccgttggagcaccggcgccgggagcagagagcgccgccatgttcgcctccgtgatcgtggtgaagtggaaggaagcatttgtgttgtgtcaaaaaacgtagaggctgtgttggctagtaaacagcccccctctagaaaccgagttgatctcgctatgctccgagtcggattccagcttggcacacggaagccgcgaacgaaagcgtattttgtgattacgtttagggtggctctattttgatttctacggaatacgtattccttgtttgaacacggctttagttagtaacactcaccaattgggacgaacacctcgactcctcgagtcaccaatggcgattccccgtcgcctcgccgccgccgcggccgccgaaaccaccaaacgctcggcggcaggtctcgccgccgccctcggtggaagcggagggaagcccgcaacagccgacctggccgctgccgcgacggccgcggcggccgccggtcgcgcctccgaatgccagtccctcctcctccgcatgtcgcgccgccgcggcgcctgccgtcgcgagatcgtctcctccctcctcggctcctcccccaccccgcagccgcgggtgtttgacctcctaatccgcacctacacccagtcccgcaagccccgcgaggccttcgaggcattccgcctcatcctcgaccaccgcgtccccatccccgccgccgcctccaacgccctgctcgccgccctctcccgcgccggatggccccatctcgccgcggacgcctaccgccttgtcttctcctccaactccgaggtaaacacgtacacgcttaacataatggtccacaactactgcaaagccctggagttcgacaaggttgacgctgtcatctccgagatggagaagagatgtgtctttcctgatgtggttacacataatgtgatggttgatgctagatttcgcgctggggacgcggaggcagcaatggcgttggttgactcaatggttagtaaagggctaaagcctgggattgtgacgtataattcggttctgaaagggttatgtaggagtgggatgtgggataaagcatgggaagtgttcaaagaaatggatgattttggtgttgcgcctgatgttcggagttttaccattttgattgggggattttgtagagttggggagattgaggaggcgttgaagatttacaaggagatgcggcaccgtggtattaaaccagatttggtgagctttagttgcttaattggattgtttgcaaggagggggaagatggaccatgcgatggcgtacttgagggagatgaggtgctttggattggtacccgatggtgtgatttacacaatggtaataggcggattttgtagggctgggttaatgtcagatgctctgagagttagggatgagatggttggctgtggatgtttgccagatgtggtaacttacaatactttgttgaatgggctctgtaaagagcgcaggttgttagatgcagaagggcttttgaatgagatgagggagagaggggttccaccagatttatgtaccttcacaactttgattcacgggtattgcatagagggtaaactagacaaggcgctgcaactgtttgacacaatgttgaaccagcgtttgaggccagacatagtaacatataatactttgatcgacggaatgtgcagacaaggtgatcttgacaaagccaatgatctatgggatgatatgcattctcgtgaaatcttccccaatcatgttacgtacagtatcctaatcgacagtcactgtgagaagggacaagtggaagatgcatttggttttttggatgaaatgataaataagggcattttgccaaacatcatgacatataattccatcattaagggctattgccggtctggaaatgtttcaaaggggcagaagttcttgcaaaagatgatggtcaacaaggtgtcacctgatttaattacttacaacaccctaatccatggttatatcaaagaagataagatgcacgatgcttttaagttgcttaacatgatggagaaggaaaaggttcaaccagatgttgtcacatataatatgctcataaatgggttttctgtacatggtaatgtgcaagaagctggttggatttttgagaaaatgtgtgctaaaggaattgaaccagatagatatacatacatgtctatgataaatggtcatgtcacagctggcaactcgaaggaggcattccagcttcatgatgagatgcttcaaagagggtttgctcctgacgataaattctgagggtcctcattttcttctttattggattccgtagagccattggataatttaggaaagagaaacgcagggctgcaggcactgtgcagtttgtgaatattcagaattctgctgaaagtctgaaacaaatgcctatggatttgaaggtgagaaattttaatattctgcagttggcactataacatcttctagtctcttcatgccactcttctacttattgacctagtggaaccaaccatgataaatgataccaagttactattttgagtatgacttggtaagatgtaatgctatccattttctgaccagcaagaagctaaacatctactgagtattatttttctcttgacaacagtggtgcttggttgagttacttttttccttttctttttttttgcattccatccctcaataattttgtttgagatttggtaccatcacactgaggctgtgtttagttccatgctaaaattggaagtttgaagaaattggagcgatgtgatggaaaagttggaagtttgtgtgtgtagaaaagttcgatgtgacggaaaagttggaagtttgaagaaaaaagttggaatctaaacagggcgtgactgtaatttccataggctgctggttaattttgtggaagtctctcccatcaggtaacatgttccatatacttcttcgccaagacccaggaatttgctatccggggttgtgcttttgttttcggggcactggagaaatcaagtacacctttaaattttcaggtactcttcaaaccaaactcgtctctctctctctctcacacacacacacacacaccaaaaaaaaaaaactgtgcttcctcccttctatgttttgtcaagacattgtgtagtggtagtacattgtgtagtcccacagtgatctgaaccaccgtttgagatcaggaaaaggattcaatttggcaatgactgtacagtttattctcacttgtattaattacttatcttcacttcagttgtttgttcctgttcagggaaccagaagtttggaagatcactggaaaatcctagttggtgagagatattagtacacaaagcatcgtgatgtctgagatatctacatataacatacagattccataatgatctgcgaggttatttgctattactggatcttccttacgtcaaagatgtttcttttagtcatgccatgatacagacagacgagtactgcttgctaaggagtcacaatcaacagaacgtgattgatcagaaggaaacggcaagtgagttcaggaaaaggtaacattcaaaacaattataaaaaagatgtcatattgaaaacaactctgcacaaatcagggcaatcaaaacttctgtacaaaaagaacaaatgaattggctgtggagggttaaaagggctccttaagaataacctctagaagaacaggaaaagaacagaaaagaaagaaaaaaaaaatgaatattgtacatgtacatgtttcaaagctctcatggtgtttggcatcttcttccaggattgttaggatcattggtgcatccagatgcacctggctttgctgaagttaagaacaccgtgcttccctgtcgtggctgcgatctcgctcccagcaatctggatgcatgactgatggtgattgtggtgctgaagatcagcatgaaaatgagagctagaggcagaacttgctgtcttctgatcggcatagttgagcagctgacctcctggtatgttctgaattcttgtggaaggcgagttacgaaggctgaaaaactggggtgaatataaagactgtgtcaacacgtatatgttcatatgttgtataaatttataatgctcttgagcgcgtttggttccttgtgtgtcaagcttcgatgtgcctacccgagggctcgacgcgttgtcgcggtcagctacgacttgcaaaaccattcatcacgtggttttcatgtaattgtaaaccttgaccttcgcataagagagcttgacctttggcataagagagtcttcgtgtagaattcatacgaaatccctttcacagtttcaacattccagagttttaagtgcatgatcattcaatactattccgtactctccaaggctcagtaaggaatgctaaatctctcgttttcttcatgttaaagaggatgcagcttgaatggtcgaattcacaattgacggctccaccccaaaaaagttcaggatgactcgaagtcgaatccgcgtaatacgctggcgaaaattgaatgggccaaatgtagcccatatccattttattcatgggtctttgaacaattgagctcgaaagcccagctctctctcgtgaaaagcttaaccgacctagctctcgagggcgcgctcagaaccaaaaatttcgaaaaggtaaggccgaaatcgccgcctcctccctccggtttctccccctcccagagcgtagcctgcgcctcctctcgcgatgcaccacggcggcggcggcggcgcgatccgcgtgctgaatgtggcggagaagccgtcggtggcgaagtccgtcgcggagatcctgtcgcggccgtcgggcgggatgcggtcgcgggaggggcggtcacggtacaaccgcgtcttcgagttcgattactccatcggcggccgcgcctgccacatgctcgtcacctccgtcacggggcacctcatggagctcgagttcgacgaccggttccgccgctggcactcgtgcgaccccgctgatctcttccacgcccccgttcgcaagtccgtaccccaggtacggctctctgtttcctgctacccatttctccgaacagttggtgcgcaacgcgcggtgtcctgtgaattgtgccctcaccagtcacgtgtcgttttttgcatggtgtggtctcttagtgtcttgcgtccatggagttggctgtgtttaactcacggtgaaatgtgcggcactgaaatttcgttgactagtttatgttcgtgcgtttggtggtgtactgtacctggattccagttcgtgggggcctgagggtctaataatgagtacctgatttgtactatcaatggatgcgtctgctgattttgtttagggtactgcacttaaggaactctattctagggttcttcaggagcttgatcgggggacatcgcatgattgctactcgtttttgaattgggaaccactagtgctgctggtcatttgcactgttgcgcagcagcaatctggttccagtcatatacgtctgtgtgttgtactatacatgtgatacattaagttattgttattgtgataggaagagggatacagtaatgcataaactgtcctatttggttattttgaaaaactgaaggctatacttgctattgctggtataagagggtagttgtatgccgggctggccgacctagtatgattatatgaacaccctggcagatactattctcaggcctcaggaagtcgggcttttgttctgaaattaaagtttatcctacaacatcatttatcttgcagaaaaattagtaaactagaggcagaagttaaacagatatacaagtttcctctcattcttccgttcttccagcatcaggagaacaagatgctactctttttgtcggttgcactgccacaaccatgctggagcttgcttgttgtatgtgatttggtgtagcagtatgttttctccatagtcatcattgatctgatagattgcctatgtatcttttccttttgtctttttagaatctcctatcttagatggatttattgggtaacatgcaggcatgccttaaattgctgagaatgaccatgctcatttgtctatttgcccaaacacgtgatctgtttttgtgttttgatgctagtggtatggtctgatggtaatgaagttataattactgctccagtttctttttttttcagctgaggtatattcatttttttaattaattgcaggataagcaagacataaaaagaacattggaagaggaagccaggaagtgtcagtggcttgtgctttggcttgattgtgatagagagggtgagaatatcgcatatgaagtgattgatatatgcgcaggtgccaacagccgcctcaacatttggagagctcgtttctcagctttgattgacaggtatttgttgctactgatgactttctcttcttgattgcaaagatggcatatccatctcctgcatcgcacgggtatccccattcacttcacatccggcccgattggtgttactttgagttagttgtatggagatgaactatggtgttcaagttgactggataaacccgacccacagtcccacactcatcccaaatctcctgttaatgtcttaaagaaatgaaactgcagggaaatccatgaagctgtgcaacatcttgacagacccaacaagctctttgctgatgctgttgatgcaagacaggtaattaaattatcattccaacctttgttgatgttgcattctcttgcatcacatctactgagaagtactacagcaactctagcaaactaaggtcctcgaagagcctctgccacatgttctgactataatattatagcttttgtactggtataggaatggaatgggacgacggtatattttctccttcttatattattcttctcaaatgaaaagcattttcttgcaccttcttagtgtcttgaagatctccgatgattattaagaattttgtacaggaaattgaccttcgcatcggtgcctccttcacaaggttccagacaatgctgctgaaagatgcatttgttcttgatgacactggtgatgataggaatataattctgagttatggtccttgccaggtacttcactatagagtatgaacagaagatactaaatgatgcctactttcatcttggtgtaacatgttctttgcattgcagtttccaaccctaggatttattgttgagcgtttctgggagattcaagctcatgaacctgaagagttctggacaataaattgttcccacacttcagatgaaggcactgcatcttttggttggatgtaagatgcactcgacatgttgtactgattctttcattacaaacgtcatctgagattatttcttgtttggcagacgtggtcatttgtttgattactcatctgctgttgtgatctatgaaatgtgtgttgaagaaccaatggcgacagtgagccttgacatcttttatttcaacaccaatgttcacgaaataataacgataagtatctttgatgacagaacaaaagtaccagtttagttgtattttttccctgcaggtgcaaaatgtaaggaatcaagagaaactaaaataccccccatatccactaagtaccatagagcttcagaaacgtgcctctaggtacttcagaatgagttccgagcacacaatgaaggtgttaaaaataattctattttggtaaccttgtatacctagaacagttttgctagccaattatggccacatatcactgaactgattgttttgctgagtgctctcttgtcctgtctatatcaggtggctgaggaactttatcaagctggatttattagttatcccaggacagagactgataacttctctccaaacactgacctacatgtatgttttcaaatttactagttcctcttgtccattcttatttcatggtttgatgattcggattacatgttattgaatatttgcacctataactttcatttttacataatttacatgataaagaatatgttctcaaagtcaaatactccctctgttcctaaatataagcatttatagcaattcaaactttgtacacaaatataagcattatcttggacacagttttcaaagtaggggaatctaagcaatttcagccagtcagatgattgggagggaatccaagcaagggcatttgagtttcgcctaaacccttaatcttttctaaacaacctataaatacttatatctgggaacagagagagtaattggtttgttacttttttttttggtaattggttccccttttcattttgtgtggatatgctaacacatgatgatccccgtcacgtttaaatatttgatttataaaattctaatcatatgtcattcatgaaatgccactagaaaatattaaaagcgttttctacactctgataaatacctgcgatggttataccattttaaccttcccttgtttgtttgttttttcaaaaagaatatatctattttttccgacatgtttgggtacttttgatgtagtccatcgtacatgaacaagtggctcatccaaattggggaacatatgctcagcgtcttttggatcctgaagcaagactttggagaaaccccagcaatggtggtcacgatgacaaggcacatcctcctattcatccaacaaaattttcagctggggaaacaaattggactgataatcacaaagtatgtgtctttcctatatagcagatactatagcatttttaatattttttaaaggcagtatttcttatgttctacaagtgtgtaataaaactcttcatatttgtcttcttgtgtccagaaattgtatgagcttgttgttcgccatttccttgcttgttgctcccaacctgcagttggagctgaaacaactgtggaaattgacattgctggtgaacagttcaatgcatcagggcgcgttgttcttgctgtgagcatcctcaaaccttgctggaatcgtctattgtttcataggtgttgcaaacgtgtaaataggcagtatccatacaggacatgtaaatatgttacatatcctatacctctaattctgcttgttctttagttctttaaacactttgctccactaataaatctggtaaacaagagtaggagaaagtgtatttcaatcagtaatagaaacaacttgatcttatgtacagaggtgacatagtcttaacttttaagctctgagaagcgtcttctttgtgttgaagcttcaatgtgagtcttgggttgccattcctcctttagtttacattaattggttctttaatagcattgttctgaaaaaaaaatcataaaacaattaactgtgccagttgtggtgcactgcaattaatatttattgggaagggaaacataaaggatgataaaatgtttagtcagtaaacaagaatgaaatgctaggagaactcatgaaaaatttaactttgccaattttgatgtactttaactgctttgatatttattggaagggaaagaaaggaggagcatttaaatagaaagtgaattacacagccaatatgcttaactgtttacattgccaggtatttaggtagcatatttaggaaatggaccttctgctggtacaggtggaaatgctgtgcccaggagttcaggaatgcagtgtctttaatttaatactccagaatacattttcctttctaacgttagttctagtgcaataggattatttcatttctgggttacttatggcaaaattccttttctgcatgtcctataaaatatgttatatactctcttctagaaaaattatttggacgtatatcggtttgactcatggggcggtacattacttccgacatacatcattggacaacaggtttgcttcatttgtaccaacactttctcattcattttatagtgtcttctgtgctatgtgggtaaaaatacctgtgtggaatgttcttataaaagcctgcaatttaaggatgactgtaaatttatattcccaattaaaaaattgatccttctgatatgttgtaacagttggtgatttatagggaaactgtgcaattctgtatagcagtgtattagtcgctacaatttgtatgcattgcttgctcaatatttagtaactgcagtatatatgaatcagttgttcattttttttgaaagaatattctggttgctttttagttgtttaccatgaggagttgatgaccttgcagtttgttccaacaactttaacgcttgattctggaatgactcgcccacctcctctgcttgctgaagctgacctccttggttgtatggataaagtacacttcttgtcaatctgcaacataatattttcttgtggcaatatcatatgtatattgagttgtgccactaaaatatttgactgattgactcctttcgcttccaggcaggaattggcactgatgcaacgatgcatgatcacataaaaaagttacttgaccgttgttatgcaaccaaagatgcaaatacacggttctccccaacaaatctagtatgtttcatcacaactaagttttcattagatcattgcatgtagcacaatattcattgtttgcaattatttacatgttagtgttattatgacatggcatctaacagaacttcagctatctaatctcatcttatgataatacaatttgtttgattacctggctagaatattctgaatataagtttttgcccgcattgagagaattatattaaggccctctttgtttaggcttaggcttattggcttagacttttaagtcagcttattggcttatacgatttataagccggtgaatttaatgtcttaaatttaatggtggagtcatacatctacctcatataagccaaaaaagcttctccaacctagcttttggcttaatagtgttagagtggcttatggcttcaaaaaagccaaacgaaaaagctgcatctttgtttaggtttagacttttcggcttataagttggcttataagcctaaacaaagagggcctaagcctgtgtgcagattgtcataccttaagtcataacataagataaataaacagaattcccatttcaaatataatactctgtagtagcatgttgcccagatgatttttttaccacaacaactccattgcttttctgaagaaatctcttattatcatgtgggcactgctgtttggtatgaaagtaaggattctattgagaaccagggctaccaaccagggcttgaaccttggttctcacagaaaaaaaatgccccttgttgttgtgttcccctaaagtacaggttaagacacgggctgtgtcaacgagttcccgtacgagtaagacctggcttttggggcattttctcgaccttaaatgcaatgcgtttgggacgtctcttcccttgtgttgagcttttcttttgaatgtcagattcatcaacatttttcatgcttatagtcatacgtaatgcatccacacttttggacaaaatagctgaaagtattacttctaatgacatattctatttatttccgttacatataccttctgtgatttctattggactagtcctgataagacagtttaggggtttgtgctgacccggcaaaagtttagtgggttttttagccaggccggcctaagataggctgaccaaatttacttaagaaaaggagtatttacacacatacaagtttcagacttcgacaagaagctgtcgaagtgaaaggatgttgccacagcggcaacttcctaaaaagaaaaaatacaagttacagaaggttgttactctcctaaaacattgaaaaccccagcttctttccagatcgctgcttcgtctttaattgcgccaaaaaggaaccccgctgttcggctctgattctggaatactcgcgtgtttctctccttccaaatcatccaacagaccagcagcaccaaagtgtcaaatgcgctaaaagtttagtgggttgtaaaatatatttatctggttcacaggaaatactgttctctgtaatatattttttctccagtgcagatagtacttgtccatgagatactttttctccattgtactgaaaatgaagctcatctgctaatttcacacgtgtcttttgtttcttttttctctaaatgcagggcgaggcattggtgatgggttacgatgaaatggggtaagttgattcttaaacctcacttactgaacccatgtaatatgtttggtttcttgaaataatttaagtcattttaggtatgagctttggaaaccttatttaagatcaatgatggaagctgatatgaaatcagttagcattggtacaaagagtaaatcagaagtacttgagaattgtttgcagcaaatgaaggcttgttttcttgatgtaagttcttttttatgtatgtataaaagtaacaatatggcgcaggaagtgaagcatagaaactgttcatcatctattgaattgctctgacctctgagtttatatctagtagttaaccacttatcattggtataatgcaggcaagggcaaacaaggtgaaactctttgatgcaatgggaacattctttgcaaggtttgattggatccatttggctttcttctttcattgctacaaatttctagcttcactttgacttttgatctaggtcaagtagaccggtcaatgagacacagaactccatagaaactgtgagaccatgtgctgcatgcaatgaatctgaaatgtttctgaagcaaaggccggtaaaattatcttcccatacatcttttctttcttgaaatggttctgaagcttaggcatattggaagtgtcgcactatgtccatgcttgagctttgcttttctttcctcagactggcgaatttatggttgggtgtcggggcttccctcaagtgagtaacatgtgtgctttgcttagttaccagacctcttgttagtaaaaaaggaaataagaaacaattcattaatcttgccagaaaagagcatatggaactaataatgcagccaaaataattgaactccgacgaaaattttgatattaatagtcttcctgaactttcagtgtagaaatgtagtttggctcccacgatctctttcaggggctgctgtgactgatcaagtttgtcctacctgtgctccaggtgaataatttagttccccaattattgaaattgtaccactagtatgatcaatgattttcactgatggactgttcctttgctgattctcctttgaatattgataatctgttaaatttacaggtccggtttataagattcaatttaagtttcggcgaagggatattccaccaaattttgatgtcgatcacctcggtatactctcctatttcaattgaagttccatactcactttagtttttcagttaaaacttatatgaccaaaaaacaaatccttctttcctctcaacacgtacacatcttttgtttggttacatactaaggtgattcggacatatttcatgctgttataggttgtattggtggatgtgatgacatactcaaagagctcatggaattaagtagatttggaagtcatagccagactgcaacaccaggtatccgcaaaatgttgagttcatctttttaaccgctacaagtcaagttgtagagaattagattcattaggggtaatcgcaatcttatgcttattgcaactcaaaatatatagaatctaaaacaggcttgttttgtggattcaccttattttgtctcccatgttttgcttactacttcctccgtcttttaatagatgacgc

SEQ ID NO: 45504 - DNA, 51917 bp, Oryza sativa
ggcgtcatctattaaaaaagggaggtagtatatcgaaagtaggccttgttgtcatttgttaaaaaacatgtatattttatgatcatatttgttgtttcacagcaagaaatcagagccagactgcaagtggtgtaaggcaggggtcttcaaggcaagatttacatactagctttcatccagccgtgcaatttactaacggacaaacacctgttgtgaatcctcaaggttttcgttcaacccatacccaaagctcaggaaatgcatcaggtgactgtactactcagtaatgtctacaaattgttatgcaagccaatcttcagctggcctggcaacgaaaaagaagaggtaatgcaagctcatgaattgatcttgagctattttcacacgcaggtcaagtacagtgcacatcatgtcgagaaccctgcgtattgcgaactgctaatacagaggctaacagggggaggaagttctataaatgccagaatcttgcatgcggctttttcgcgtatgtgaatccttttagtaacagtgttattttatcacacgatattgatctgcagggtgcatttgcatctgatctatccacttgaaactatctaagcatgcagagtatcactagttatgcagctatctcagttatgtttttcataaatcttatgtgcacatactcctattccgaactaggcaataaacagatttatcttagctttccccctggtgtgatattttgctctaatctctatcaagttaaatagctaaaaacataataaggaatatgatgcgaaaagagaagctgtcaattataggggtttgttttagctatctatgcattgcgttgcctgatgtctctgtgtgcaacgcagatgggaagacgatgtggagaactctgcgcccaggggccgtggcgggcgtgggcggggcgggcgcagtagcagcaggcaatcatctgcatctgcatctgcagggcggagaggcggcacccaagggcgaggcaggaggggcagaggacggaatgctgatggcatgatgttcgttgcggcgacgggcgagcccgtttacggcagctgcttcatctgcggcgaccctacccacttcgctaatgtctgccccaacctcgggagatagatctcaggccaattggtccgcgatgcccgtacagattggcagcgtaacggcgttggcacggtaagttgaccccccccccctcttatgcattagtaataatcatgatgactagtttatggtaaacttgttaatggttttctggaaattgggaaaaaaaattgagtatttatactgccgccgattcagaacatatgtgaaggtactgctcggaactgtcatgtggctatacagggcacatagccacaatggcagaaggcaatgtcaaccaggacctgtacctagacttgcaaacacgtgatgcgagagggaaaggcacttgcccacgcttcaaagttgaaaaatgctgcaaaccaaaagctgtatgagatgatcaaatgatggtatcttcgaaatgtacccacggtgggctgcgatgcacgtacgcagccttgtaaagtctttccaagcagtacccaatcccctcattgctcctgagaaatttcgtcactcaccaaaactttttagtcaaaagttcagcggaaaaaatggatcatgccgtcactcttttccttgccctattaccatcaacccgctgtttgtttcgtcttgtcactttcttgatatatgacgagttgtttctctaaatgatatgtttatcaactctttgttactgtaggtcacatcgttgtcataacacggccctcttttttctcagatcacacgtacaagcatgaagcatcactcgcaggaataaagccaatgctaaaaaaagcactgggttgatgagatcgttcagatgctggttgaacggttagatcaaggtaattgattagcatatcttttttcttttgtgttgaatctttctggtgtgaccaatctcagtttgaactccttgaataatcaactaagcctcctttttttcaacctttgctcttaaaactaagtattttctttagctagctaattagagagaagagagcataaaagaggaatgattgcatacgtgaggggctttgcatgctttggtgcttcggctccacctaacggtgtcggcaacggcatggctttgcagagatgcttcagttgtcacacatgcatgtagtctagttactctagtagtctactgaaaatcttggaagcgatctttccatgatcggaaagattcgtaacgaggacgacacgaaccgatcaagccctttgtttaccatcattgcccacacgcccacctagcagctgatagcatatatgctgctgcactggccgtaactttgtttgctactactatcagctgctatgattataggtgccaaaaggggctttaagttgcttatcatgtcctagttaatctctcttccctctccagcctctcttccctctatccacatagaggcttaattagcaaataatgagggatcggatagactatctagtgaagcttcattaattccttaacgggtgaacaacttcccaattaatgtatatacactgggaacaccaatacgctgagtttctgaacctttttcaaactccaagcaaccaagaacttaaccaccagaaattagtctaccaagacgaagatgacggaaggccatgagacaattcactggtactcaaacacaaccatggaacaacatcaactggcactacacataagttgatcgcttggtctcggtgcatatgtacacatccaaccgagtctgggatagagttataggaaatggagagcacttaccagtgagcgagatggaagatatatatcgatgcatggtgatggtggatggagcacggacggctggctgcacggccaaacatcgtcctacctgcagaagcttcacgctggcagtgtcgcccgccgatttgtgccgaagccgaagaactaaacagttgagttggggggaatgaagcctggtccgaaaccccccacctagcttgcttagctgcagctgaatccgccattccgcccggtgttaggtctcggaccagacaacattcccctcaactgccataaaaatgaatgaatgagagggagacagagagatatatatagagagattttcatgtataagctaggagcttgtatatatatggaggggcagcttgttagctcacggcagatgactctgctttgagcagctttatgtcatacaagtccacatgcttcttttggcaccttgttgctttcacatttacagcttggatgaacaacggttcatccaacctaaactgtactggctacttagtcttaaccactggctagtgcactcagtctgacaatgctatgtaatccaagtcaaacttgcaagacgtgacatagccatctattccaacatgaacacgtcagcaaatcatgagctcatgaccacttgctagcagctaagggcagccactgaattagtcatctagattcacaggatcatctcagacaagagatcagcattcagcaagctatatgagtattatgattaaccaagtggatgcaatgcatacatgaatatataagctaagctgttgaaattaattcacaacgcacagctgttgctgtgacatttgcatgcgtagtacatgattttattcgcaagcaaaggatttcttttgctttgcatgtaccgtgttgcatagccaagttgttttgattccaatcttagcacttaagaaactgtccaccccgggcaacctgcagctctgcaacaacaaagagaactttttatgtggggatgtgaaagagatctagcttgagcaaatggatttgatggggagattgtgaaaaaagacccaggtgactgaatccaatagttaattgggattgtgcaggtgtaacccgtactgaactactaatccttttttctcttagctcatcatgaaggtcaaagatggccgtgtgaatcatggaatagtaatgccaggttctggcagtttggctggctctttttatgacagaggctcatgggagagtttcttgattgatgtagggtaggaatttctattggaagattgtagagaggaacatgttacatatgctatattccttatgggcacggtgatctgtcgcatacctatgtctgcgaagaataagctgattggtttgcaactaaccggaccacacaaggtggaggtcctggaacactggtctccatgcctgattactagttctattatttaaggattttcttttctaaaataatagcacctgtagctcttacattttcagaattgcagaatctgattatcaaactttagtgtctttggttcattgcctcaaattttcagggaattatttgaaaataaaatgaaccagtcattatttcttcagtagttcagttcttctggctccttatcagctttgatggttttctttaccataacgtgaggctatgcttaaatctctcagcctcacatcacatgcaaaggattgtgttttgggaagagatggaggacatctgttcccctcttctctctcctctccaatcgtacagtgtgaggggagaatcgttttgcctcctgtgcaaccaagaaccattttttttccaaatttcatttggggatttttttttttcatttctgggccttttggttgatctttactacacggatttgttctgttcctctccaatatgctccagatttggtgattatgggaatcgcagcttcttggttgaagatctgctgcattggtacgttccagatatactcttttattctgaacaattttgtttgtacatgacaccctgcatgttcatctgtgcaattatttgcagggaagattggatccttgctccaattggtaaaaagattaggttattgcgatctatccgtatgatcattggcatatgaagaaaaaatgtcccgttcttggcttagcgcagctgaaggtactgctgcattgtagcattgtgaacttttctaggtgaaaggcctcatcttctggaaccacacgttggtatgggtgaccatgattttacaagcgcttcctcctcaacaatgtggtttgatctgattatctttgtgccacattaataggaattttgtggaaaggatttgatttttaatcaacctacatgcaaatcagcggtgcattgatcttcgatggcagcgaaggctcgtgcaaggtcgccggactttgcacggcaattctggcctgtgctgtgccatgccttcagcgaatgcagcctgatcataatgctctttgtgaccgccgtggtgtcattcacggccacaaggtttgcacgcatctggagcctacgaccaccgtgcatcctgtgctcaaggttggatcgcctcctgcatggaaacacctggttctctgaagatctgatctgtgctgcacacaagttggaaatctcgcaattggagtattgccagagtcacaacaagctcgcacactctgatgatctgtgtgaaaggtgcctactttcatgtgctggtttggatggtaagcccaataaactgaagagcatgagaaataaggacaaggtgaattctcaaccgaggtccaggcatacacatttatgctcttgttgttcagagacgtttaagaagacacggcatacacacaagctacctgagcttgcaaatggcatagttccagatgatgtgagcacagtgaaggagagaagcatagacatgactagtgtagggcattcttcagatgaaggttctgaggacttgtcttatggaggctacagtaagctgaatgtccgccatgattcagagtctgagaaccgcatctcggatgatgatgaagatgaagatggtaattcaatgattcacaaagctacgcagagaagcagagacttcttatttcatgattcgcaactacaacctatgatcagtgacaccaacagcttgtccatgcatccttctgagaatgttgttcttgcagagccgatgaataccgctcctgtgccagtgagtactgcagcaaaaactgacaatgtggccactggcaccaaccttgttagtgcagcgaaatcttcagagcatattgcgcaaggttcaagggaaattagcttgagcaatgtcaatgtaagtggaaacaatcatgacgtgcaaccgaagattgtgcctgaacaagtttgcgcagagcttccgaaagagaaaagtatgtatctttatccaaaatgctgcaatccttatataatttgaatttatctgagtatgtcaaatttgttctgtagcttttctggttggtattgaggaagttgacgattcagcgggtatttcaggaagccctgacgaggaagttgctaagggttttgttgcttctgcaaatgcaggaatgagttcagttttagatgcctgtatcaaccgcaaaaacagtatgaagagtgcttctcgtcgtagaagcaaccttcaatctcctcgatggtctgaaatatctctgctaaggataacagttcaagaactaaccaagaagtcaagacattcctgtcccagatgtcttctgcgcgaggctttgatggtccttggagtgaggtggccgctagtcctagaatcacacagattgatgataaacaatatggtgccgctgggagcaacaatttcttgagactaactactcaaatatggaaccatttgatgtccatgctactagtgaagatgaaggtgatacctcactcgaaggcctgaagcagaaggttgagcttggcaagaaaaaaatgagtatcctttataaggagtttgaggcagagcggagtgcttcagcggtggctgcgagtgaagcaatggctatgatcaatagattgcaggaagaaaaggcttcaatgcacatggaggcacttcagtacctcaggatgatggaagagcaggctgatcatgaccaagaagcaattgaaaggctaaatgacttgcttacagaaagggagaaagaaatgcttgacctggaagctgaacttgacaattatcggaggcttcatgaaccatttggttgcaagtttgattttactgatggagatatggcatctggagtcttggatagctcagatttcatgagggataccatgtttgattttgaggatgaaaaggcaaatattttgaaatccttgagcaaattggaggaaacactgggcatgtcttccacagataggcataattttggtggcacatatgatagtctacagaacatgtcagtattgcatccggaacactggagcggtgagccggtttcttctcaacaaattgatgaaaatcaaagtgttgattccggctcatgttctcacctagatgatggcagaatcagttctatgacgagcgttaaacatgagatttcacttctaaatactagattcacggcacttgaaacagatcaaaagtttctcaaacagatattaagctctctaaaatgtagtgatgatggcgtacaatgtgttcaagagataactgcacatttgagagagttgcgaagaatcatgactgagcaaagagagagggcagttttatgatctcataattaatctctgaaggtaacaatagaccatagtagtagttaatatgaacattgcttccatgatgtacatgcaataggttactcttatactccctccgtcccacaaaaagctaacctattattgaataggtttttcctggtacaaactcctgtctagattcgttaggaaacatttcattgaatactaggttggttttttatgggatggagggagtatattgcaaatatctgctttgaactgtgccatcagagtttttattgacgatcctctactttcgtcaaaattccttagaatgcatggttaactaaaaggacactaaagtgtcttttgaatctgcattttcagcgctagctactctatcaacttcattgacttagtattatttaatcttcatatttccccttcttttagagaaatacttttccttgtatgcatagaatcacgctagttatgaaatgttaggccttgttctttgttcacttatatcaccttttgtaatcaagagatcctgattcggtctcttttgcagatctgaagttgctgccactgattgttacagcaccatgatgccttcatggtggcatctcgctcggagatttgacagggtcatttgtgacctgatctccctgaacataacatgggagaacacagattatatacacaccgatcttgttggatgagatctttcttgtacaaattgaaacggttgttattaggatttaggagtaaagctcttcgctgtaattatagtttccggcttctgccgagatgaggaaggaattcacttagtaagccagctactgttcatgtcagataagttcataccgtcttgaatttatccaaccacttctggagacaatctataggctatagcctagatgaacttgaaaatttttaaagtctagcggttgcaggagtgctggtcacaggttacctctgatgctcggagactcggacgtgtacagacacttgccattgatcagcacaattttgcagtaacgagcaagggttcaaaactacacacgaaagtaaaccttgcaaagtgttgtcttggctacagtcaacatcggcaaaattttccgttatcataataaactcgttgatacttcagaacaaaaacaagtttggttcaagaaccagaacagatggctccagaaaggggcaaaatatcattggcgcaaacagatgatcagtcgaagataacttggttagttaaagggacaccatgttccaacaaatagtgcaaaagttagggtaaaatacgatgtttctaggcgagaccactactgcacatttactaatagcttccaaaacatctttccaacaaatagctttccctggtggccagcctccaactatcactcgtcacatgaaatcagtgtgacggtctggcaaaagaagaatctatatgaatgatttaatggcaaaaaagggcccccatataccattcaagatgggattaagcctgaactgtgcttcgctccgacactgcctcaagcatagaaaggaggttggaaaccacattgcaagtaggaacatgcacaaggcggtcactgaaactattaactgctgtcttagacagcactgaaacttcagaacagaatgaacttgcttcaatcaactcgctccacggcgtatcgtcctcattgatattggattctctcaagagttgtaatactttatccaggtgagcaacattccgacctgccccacagccagtggcagttgcagcacccactgcatttgctagtgtcagtgtgctaactgctggcaagttgtggaggaacccaaaagctatagcagcagtaaagctatctccacatccaacggtgtccacaacgtcaatctaatgaaagtacagcacagtgaatattgacaaatgcagtaattacacaaagatcctttatcagcagaataaacataccttaaatgaaggtgcactggagacagcactcttcgtaaccatgattgatccctttgagcccatttttatgacaacccactttgtgcgaatccccctcttcagcaactcttgccctgcctggattgggtttctgatgttcgtcagggactcagcctgtcaaaccaataaacagatttatgagtgaaatgaagcaagaatacaacactaaatacaccacattgggttcactgttctctaaacaggccagattcagcaaacaggttttttttacaaaagcatattagtgttaggctgtaccctttaatcttattttggcataaatggtttatggttgaattgttaagtttggagaaaaggcaaagctgcagatgtgaagtcaagatcagccagctcaaatatcattataaaaaaacatgccatttatggttcgcttggcttttactaattacaattgaagctcacaaagcaaaaataaaactgtaaggcatctaacctcgtctgatgttaaaagcagaacatcactgagcctcagagaatgctcaagtgccctctgttcatcaagggtaccatgtaagagagattttcctcgaggaccaggatcaaaaaatactgctgttcccgcatcaattgcgcaatcaatagcggacgagatcacatcagggaaaagttcatcaaaagcatagccattacagaacaatattttggagtgatgaatagctgtcttggtttcagctgggagtttacgtatccaactgaaagctggctcatcactaaagtctgctcggctggcgtagatgaaaattgcaatgcaaagcacaacaagaatattagctcatgagaatttgaagctgaagttgacaatattcatgatgaaaataataagagcagtaaggcatgcatgagaacatgaagttctaacctgcaaaatccatgtctctgaaatgggtctacaagaacccagcaaagaagggtctcataggcatttcggcatgcaccagaatcagagttatcaagcatcccaacaacactaatgccctcctcctcaagcacatcaagaagaaacttcccataaatttcctctcctacatgccccagtgtggaacagcgaagcccaagcctagctgcagcaaaggccaagttgcagtttccaccagcctcccaaaatttctgttccaagtgacgaaagataaaatgttcagaatagctaataaccactgattgattgatcataatgttgttcaatttataactgggtttcttttctgggttctccatcttcccaagcagataaagtgcagcagaataagtaatactaaataactaaattgtcataaaaacattctcattttcaacacaaacagaacaaatgcaaacattcatgagatgtgtacatctaaaaccttccgttactcatcgaaagcctccacatttcttccaatccccaaatttatcagtagatacaattacgatacgctcgcttgaatccttcctatcacaacacaagcattttgaaccaaaccaaagtgactagagctataaatctcccaaaataaatccggctttgcggcatctaatgctgaattcacctgatgaataaccgagcccctagatttccaatcccaacaggcgaaagctctcggccccttacctggtcaggcggcgacgcggcgaggcgctccatgtaagcctcccgctcctcgcgcggcgccggcgggagctggggcacgctgagcacgacgtcgacgcagaggttcccgagcgtggcgaggtccgtctccttcccctcctcccctcccccctccgccggcggccaccgcctcctcgcctcgttgacagccaccgccacggcccgcggccgcgccgccccctcgagcctccgtcgcggaggcggcgggcggtggagcacgcggggccgcggcgcgcgccgccgaggcagcggcagcggcagcacgtgccgcgggtttagggtttggagcgccatgggagagcgagcgagagagaatggatggatcgcgaattcgagatgggtttgcataataatataattttatcattatttctcggaatagattcgattagagaagaaaaaggagggtttattattattttattccacgagatttggaatatgttgggaactttttgaagtttgtggttaggatttggaagtattttgctacaagtcgtcaaaagtaaaactgtgctcttgctaaaagcagtgaccgaaagaagggaggaatcgcactcaaactcaaggtctcaatgacaggttcaaatcctcctttttgtgagagaatggatggcatctgatctgactccacggtgcaaatcagacgatttggtggtggggaagcatcaaagaaggcccatgggccatcatggccttccacaacaaggaaaaagtacaccgaaggtccctcaacttgtcatcgagatacaaaatcatccttgaaccacgaaaacggatacaacgcatcctccaacttacaaaaccagtgcaaactaggtccctcgacggttttgaccgacgtggcagctgactcggcgtgggacccacgtgggccccacacgtcaatctgtccacgtcatcacccatctcttttccttcttctcttcgttccttctctcttctctccctgcgacgatgcggggcgcggccttgcggcggcgttgctctgcggtggccggcgggggataggtggcgccatcgacgctgtctttccccgttcccctttttttctcttttatttttggcttgtttctctccccgatgccgccgctttccatggtagctggcatggaggttcgcgctggcgcggccgagctcatggcgcggcggctggatgtggccgaatgcgaccggaggctaggacgacaccgctcgcagccgtcaagcccccacaccgtcaagcggctcgttggggatgtccctcgcggatgagcaagggcaagaaggacaacggcggctggggcggcggcgacagtgcgttggccgaccaactccctcctcgctgcctcgtcgactggggggacttcgacagtgcacgccgcgtcgtggacgccgtgctcgccgctgtagaccctttgggtgagcagacaaggaagtccatggcggcgcccgaccgcgatgtgctcctctacatgagtcgcgggggagcccggtgcggcatggcgccatccacggtggagacgtccgcgacgcgaagacggcctcggacgcaacgaccgctgacgtcgcacgcctcttcgccctctacccgccggcgcttacctatggcatccacaccaacctcctcctccgcctccccttctcccgcgtcgccgccgccgacctcatcctctcccgcctcgcgcccaccagctagctgcccagactggacagagaggacgaagggagagaaatgggaaggagagatgatgtggacaaactgacatgtggggcccacgtgggtcccacgctgagtcagctgccacgtagaccaaaaccggagtcaaaaccgccaaaggatttcaggtgaccggttttgtatagttaagggacctcgcatatctagttttgtggttcgaggatgtttttgtatccgatgacaagttgagagaccttcggtgtactttttccccacaacaacggggaagcctccgggacacgcggcccagccaccgaaaggcatcagcacacaagcccaattacctcctgggctttgcccagcaacgccggagtcacacgcagaattcgatcaaatcgaccagtccacgcgaccaaatcgatgggcagaacgagaccgaccaaattcgcaaacaccagcgtcacgtcatgcgctcgtgtgagaacagatacgactcattgttattgcacaagtatacacgataacggtttcagagtactagtaaattggtcgaactgtcgaagtagtcgcagccgttacgatcgaggaatgaattcatgtggtcgatttgatcgaaacgaacgaacgaacgtataggtacgtatatcaattcaagatttcaaggccgcacggtcggagtcaagatcgagttgctacatggactaatcagagtttcacacacacgatggacgcagtcagtaagctcatatagtgatatataggccgcatgactggcaatgtctgtacttacactgctactgcacctaactaattaattataatcattcaaccttaattaggatgcatggatcgaccgagctgaaaaccgcgtagtactagtacgtaggagtacgtacttaacgctgaaccggaaaaaaaaaaccccacgaattagttaatcgtagtaaacactaacgaatagacaatagacccggtccttaataatttgcttttctgatttctactccatacatacgcagttgaacgtacgtgttggccaacgtgagtatatacaacgagttggtataaaaggaagcccttcatgtcccatcacccccaacacaaaccaatatccttcctttaattaagatcattccacgtacttaattaattgtctgctgcattcagctcacgtacgtactcatcgatcgagcttaaattagctagctagctagctaaagttgaagagctagagatctctcacatacatggcgtcggcgaagttggtcatggcgttggtggcggcggccgtgctgatgcagtgctgcggcgtgctcctcgcggcgaggccgttggaaggggacgtcgccggaggcggcgggtggcggccaatgcagaccgccggcggcggcggcggaaagatgccggtcatgcagatcctacaagctgtcccaatacagccggggaacgggtgcaagcaagcccccagccctcccggcgcaccatgcttcggcagccgccggtagcttaattaattaactaattactgcttatataatattccatccgtttcaaaatatttgacaccgttgactttttagcacatgtttgaccgttcatcttatcaaaaaaaattttctgaaatatctaaaactacatgtgtacatgaaagtatatttaacaatgaatcaaatgatatgaaaagagtaaataattatttaaattttttaaataagacgaatggttaaacacgtactaaaaagtcaatggtgtcaaatattttgaaacggagggagtagtattaatcaatctcctttctcgcgaacacggtcgtccttgatcaagctgggttccgatcgagaccggttttacttaattgcgtagatgttggcatgcgtgtgtgtctggagattgtacttcgatttattcgttattattttggtttggtcgttttcatgatctgcagttaggatgatcgagcttctaatattaattccgtgcaaaattggagtgccggaagatgaatgtatagctgatcaaagttagctagaagtagtctataatcagtgcatgtcgtaatgcatggggtattgtaagttgtaatgttgtaagcaagtgaaaattgtttaattaattagctactaggctgttctggcctgtgcaatatggtcccaaaaatatggtttatccctgtcgcagtgccgctgcaggtaaaataaagagaaaaatccaagaaatatcattacaagtacctaaattcaagaaataccattggcgaatgcaagttttctaaaataccatcatacaaacgattttgttcaaaaaatgtcatcacagttatggtccgttcatcctacgccgttaaatacaccgttcatgcatcctatagaacttaacggaaggttgctaacgtaaccctaatggcgattgcgtttctgggacagccgttaaatacaccgttcatgcatcctatagaacttaacggaaggttgctaacgtaaccctaatggcgatggcgtttctgggacaaaatcacttgtacgataacatttcatgtaacttgtattcgtcgatggcattttttggatttgagtgtttgtcaatgtcatttcttgaattttctctaaaataattgacataagttccatttgactaaaatttaaaaatcgtattgcggtttctgtgttgctgtatgcctttatccattgtttgtgtcatatatataaaaacaaaaacgcgcgcgtctatgttctcattttttttaaaaaaaaatctacttcctgataatatgcaatctatacaccaaacatctttcacaccattttgtttgtactggcctatatttgttatacaacagtgcgtaggctaatcatagttaggttctttgtgtgatacatatccacccgaattcaggtccccgacgatgtgctcgttgacagtgagacatctcaagatatgttgactagtctttagaagatgtttataggagatgcatgagcgtgcacgcgcgggtatatgagaatctactacatttagtctgtgttcgttagctaaggttgtgaatctttcctcctaatacgtgaaacggagaggcacatgattaattaagtattagtcttaaaaattgaaatgaattaatataatttttcaaaataactttttatagattttttttaaaaaagacacaccgtttaacaatttaggaagcgtacgagtagaaaatgagtgaatgaaacttgggaaagtgttaaaaaaacacagccttaagaaaaaaaaatgttactgtgcaaaactggagctcaaaaaagaataagaaaacatcgagggccccttacgctgaaaatggaaagatcgaggttttcagcggtgagctaaacatattattgcacaagtgtgccttgccagtttcagagggaactactagtaaattggtcaagtcccagccgtttgcgaatcgaggaattcatcggccgatcgatcgaaacgaatgtgtcaattcaagatttcaaggctagctagctgcacggtcgactgtcggagtcaagatcgagttgcacatacatggactaatcagatagtcatacgcacgcagtcagtaaagcttggtcattattattgttgacacatatgagtatgaacatatatacgaggtttaatttctacatggcacatgtatatatgcggctttcatatatacatccatctgtacaatgaggatatgcatggaccgcgctgaaaatcgcatactaattagctattagtcatgagctcttttctcatctttaataaggtactatgaggtgtaatgaggtaccaggtactataaggtaacaatcaaatctagccattgattttgcaggggtacgatcggaaagaaattggtaagagactaattgggccttccggtcggcgccgcccaagcagccaatagcgaggcaatctgacaagggcgactcatccgcaaaattcgatttctctccgccagttccgccgccgtcgcccatgcgtggtgggaagtaattcctgcgccctcccccgccggcagagcagcggtggaggccgccgctggtagagctacggtggaggccgccgccgaccacacccgcccaatagccgccggcagagcagcgcaggaggccgcctgcttccatagccgcccaccgccgcaggcagagcagcgcaggaggccgccgccgagcaccggcgaccaccgcagacgaccgccgcccaccgccccaggcagagaagcgcaatcccctaccgctgcccaccgccgtccaccaccgcctttcttcgatccgtcgccacgccctcgcctgtgtcgccgtaagtccctgacccgactcgcattatagcatttagcccgcaccagtcgtatatcgatgagaagatttttttagttttgttttagcaattaggccgatacagtatgaacgtgcataattatttttattcttgatatgtgtttgacaggttgttcttgatataaaaaatgattggtgatggttcaagatttgaggatcaggatgagtattgtaagtttatggctatgaaattcagtagtgaggatgaaggttttgctttctataaccagtatgcgaaagagaaaggttttagtgtaaggaaggattatagtaggcgtgatcgttttagtggattgatatttcataagcgcttcacatgctcaagggaaggatttaggaaggaggtgtatatggattattctggcagaactagggaacccagagcactaactcattgtggatgcaatgctcattttgagattaaactcgatgagataaaaggccattggtatgtaacaaggtttgtggcagatcataatcatcctttgtgtaaagctgatgaagtggcatttctccgttcacatcgtagaattactccagcacaacaggcaaaattggtggaattgagagatttaggtttacatcagcaccaagtgatggatgtaatagagagagaccatggtggttttgaaggtgcaggatttgttacaagggatttgtacaatttttttgtgaaaatgaagaagaaacggattgatggtggagatgctgaccgtgttattaagtacatgcaagctcgtcagaaagatgatatggatttctattatgagtatgagaccgacgaagcaggatgcttgaagaggttattttgggcagatccacaatcaagaatagattatgatgcatttggtgatgttgtcgtgtttgacagcacctatcgagtgaacaaatacaatctccctttcattccttttgttggggtgaaccaccatgggtcgactgtgatttttggttgtgctgtagtttccgatgagagggttggtacttatgaatgggtacttaagcagtttttaagttgcatgtgtcagaaacatcccaagtctgttatcacagatggagacaatgcaatgcgtagagctatcttacttgtgtttccaaattctgaccatcggttgtgcacatggcatattgagcagaatatggcacgtaaccttagtccaactatgctttcagattttagggtccttgtgcatgctccacttgaagaagatgagtttgagagaaaatgggttgagttcaaggttaagcataaagtatcagatgagaacaggtggttgaataggatgtataatctaaggaaaaagtgggcagcagcatacactaaagggagggtttttcttggcatgaagagcaatcaaagaagtgaaagtcttaactcaaaactgcataggttgttggacagaaaaatgagccttgtcattttgattgagcactatgaacattgcttgtcacgtatgcgtcatcaagaggcagagttggatgcaaaagcatctcagtcagtaccatttacaagcaatgactctactctaatagagaaggatgcagctcgtgtttttacacctaaaattttcaagaaggttaaggtggagttatacatgggcatgaattgggaggtaatagatactatagaggaggacaattgtgtcaggtatgtattgcaaatgattggcaaggatggtgttgtcattttgaccggcatgtttgaggaagcattgttggttagcatctgctgcccttgtagaaaaatggagtgcgaatacattccatgcaatcatttatttgcagttctgaaattatttaaagttagacaccattccgaccttctgcatagcacgtagatggactatgaaagcaaagaatgcatttccttctgataggtatggttcaatttacacttggtcagaccaaatggaacgctatcggctgttgcgttgtttgggtagtgaagcttttttcaaatcatccatgacagaagagagcacggtgaaagtaatgaagatgttagagaatctaatgcttgaagaggatagtagtgaaaattatgaaaattttgacattgagtttggttatgtggttgggcaaagtagccggaatgatattgaaagtggtgacatggtgcttgatccgacacaaattgtccctaaaggagctccgacaaagagaatgaggggtttcttggagaaacgtaagaaaagatgtggtttttgccgcatcccagggcacagtattcgatcgtgccctatatacctaaggcaagttttaccaagtaatctttttttttttgttctgtggtgtactttacaaatatatatgaggttttttttattttttttacaggaaagtgaacgaagatgtgtgattttgctgtcccagagggtggagtacaggatggctgtggtgaacatggatgtttgtatggtccaacatgaagtatattgatgttgtgtgcgtacagtttatattgtttgaacatgttccaaaattgtaatggacctgaagtacttttttatatttgggttggatgattagcatcttaatatgttttgcaattgagtcaaactgctgatgatgttactcagtacttggaaaggttgcatgttggcttcaagtcgagtggatgctgatattgatagcatcatgtctccaggtttagtggatgtgctactgttactcagtactttggataattgtagtgcataccgaagaagtgtcgcaattgagtaatctgaagaataacatcgaagcatccagtgactgacacaacaacacatagatagttcctccatcttgacaagcatccattaacagatagttgacccacataatcaagtcttaactagcacataataagattgtactggaaaggtcaaccacataataaggtcttaactagctttacatcatacgaatttggatggcattacatattgccagacaaaatggtgattttcatccaccacactacttgagaacatgaaccttcagaacaagaacgtcgtcaacctccttgaaatggaaaagacaaacatcaccctcatcgaatgcttttgcatcaatcagttggttccatccagtggtcagcattgccctactgtccttggacctcttcagcctcatttgatatgactgtgttgttccagccatagacaccatcagatcatcaattggactcccaatgtacttgtttatgtaccgctcgctaaactggactgcaaaggtctgcaagaaaagttgattagccatagtacaaactacatgaagcaacaaagtcattttacataccattttcgcattggtcataagggttctcttgacagcggcaaatttactgcggcaacgtgagcaatttgaagatgcatactttttgttaatgtgacatcatttccataccagcagtacttgtcgaatccagagaaagtacgaggtccatattgtcctgttttttagagttcacatacacaagttcatatgacttttgtaatcattgaaagctaaaactgaaattaatgagaattaataaacacctgttgtaatagttgaacggcgcacgctttgataaatcttgtttatctcaatttgtacttgttctgctcgtgtttaatccaaacttgttagtaggtgtaatgctacgaaaaaaggataaaatcggaagataggcatcaccatcgtcactatctgatgaaatgtcaatgacctcatttccgtcccccattgctacttgtgtttcactctaagtgacaagataggcatcacgatacgcatcaaaaatggaatataatgggaggaagcagaacctgatatatggtgtcgtctccgaaatcggctcttaccacagctcacctcggcgactctagtcggcacactgcactgctcggagctggccgtcccaccgcgagctcgcctgcagccgtgcaaccggccgcagcgcctgcagtgccgaggacagcctggccgcctccagtgccaaaggaagaagaaagagcagaagaagaagaagaaagaggaagcagtaggaggagaatggttgaagaaataaggggacgaactgagttggctgctcaccttccatggttaatgcacaggggagtgggtggatggataagtattagtaattgtttggtggacagtgtaagtgcgtattggtaaccgtgtgcgcatgcaggaattaagtactgctgtctcaatttagtaacgtgacacaaatcttgtacatctgggcatgttatacacacttttgtacatctcgacacgtatagtaacgcgtaactttcgtgtaccagtactgaacagttgattttatagtccgatgacaagtaatagacttaggaaaacacctgcagagtctctatgtgttgcgcataggacacccggcatggtccgaaccaccgctcctagtctcgacgtctctagttaattataatttcattttatatgatttttttgtcaattccgttaattataatttcatttttttataatgccaggtcggatagtagtaaattcttgtattgatggttggactagcgaaccaaccaactacctcatttagtactcgtccatatatgctgcttcggttgtagctagttgctggtcacactagtgcatccatcaacctcatcctcactccacagataacagccatggtaacaagcaagaaggtacagaacaacgaagctgcaatggcggacggcgctgttaaggtaaatgaaaatacaagtacctttcaacgatttttcaatttttttttcttcaccgatctcgtgtttgtaggaatatcgccatggtctgtgcatggatgtcccgatgtacattgaagattcggagtattgtggagaggagcttggcaccagactaacttgcaggcatggcctcacgccgaaacggaggacagcttgggaaggacctgacacaggaagaaggttcttaggttgtccgctggaggtgagctcaaaagtccttgaaaacaaaagaaaattcattcggttggtttttacgaactgttattcgtttcaggaagaggatcagtgcgataaatttttttgggtcgacgaaccatggcacccaagagttcagaagacacttgagcagatgtggcatgcagtggaacgtgctaccaagctaaccggttcgaaacaatatgactggtgttgtttcgttcggaatacaaaggccgaggaagaaaaaatgaagttagagttagatacggctgaccatatctctgaactagaattggcgtataaaaaaaattaatgaaaaagaaaaaagagctcgacgatactcgtgcgtggttaatgggatcgtttgtagtaattgtcattatgttagtgaaaattagtgatctcatgtacaacaagtgattacattggatgtaatattttctttaaacttccaacttttccatcaaaattatcctacacaccctaatgttaatttttcgacggaactgcattcatacttaaaccgtgtaaatgcatagttttgttgactgctttcatacttgactgcagtgccgttcttgactgctttattataccgagtggaatgcacgcatgtatatcagttttatgtgtggtgtaccgaggaggccatgcaacaaaagcagcccatattcgctttggaaacagaatagactataatggcattgattgctacacggctgcatgcacctgacacagtggattgacgtataatatatgccgatgcacagtgagatgtgtacatttaaaaatcaaacgacacaaaacctgtacttaagttcaatacaagattattccggtgtcattaactcgtttttttgctacacacatataagtagagagtttcagttcaaatttcctacgcacatatctgttctaaacatttctatggcagacaacaacacttccactgctcgtcgccgcaaccctggcaaaagagggcgtcatggtaggaaactacctattctctccgtggtatgtatgttattttaaaatttatttgcttcttctcaacatactttttgctcttcacttcttgtacggtgatttacttgcatgcacttttctcattcttagaaaccaagggaactgaccattgctagctccccacataaatttgtaacaatggtgagaagtttgaatccactccagacagcggccatggaaaaaattggatttggaggcttgttagcaatgccagagattaacatcaaccgggtaatttgtatttggttagctgatcggtacgacgtcaaaagccaaacaatattgatccaagacaagagtttaccgatcacactttgggatgtccagtgtatattggatattccagccgaaggaccggtgatttccaaactgccgccattgatcacggaggattacaagatttattctaggcacaaggatggcgagagcaagaatatttcactcatatcattgcaagaagcaattttagaagaatcgaaacaatctgaaatcaacgaggaagatttcattagaaggatgatgtttttcaccattgggtacatcctttgtcctactacaaaggcccatgtcagctccagctatctacctttactgagagatgtaacaaaaattcacactatcaattgggcaagcttaacaagggaacatctctgcgattgcttgaaggaattcaagggaggactaaaaaatattgaaggcaatcttccattactgcaggtactatacaaacctatcacatgctgaatttattttcttattgtactcaaaatgcttattttttacattgcattcagtgttggtattgggaacatgtgaaggcagtaaactctgagttctgcaacatcaattacaatggacgtcagattcccctgatttcattctggaatgcagccaatgtcaggttgagaaacaaatatgactgcagaacagctgaaggggggggattggtaagttactgcacatacagaaatactagttgcagtagtagatcatatgctaattgctgccatatgttatacagattattgaacagatagaacatccagactttttgaatgatgaacagaggtatgagcatgacacgcatggctttgaagacagagaaaatgacttttatatcaatgaacagagaattgaggaagacactgcctttgaggaactagaaaatgactatcccatactttctgacaacgaagaaatagatgcacaacaatcttttgcatatgctaatgatcacatgccgtacggtactgacaatgagaaggaaaaagatgatgacagagagctaaatcagtgtgaggatgaccatgaaacgaaaatcaaatctccagcaaaaattgcagccgtagaggtaatacattcttagctcagtttttttgagtgcacattatcaacaaaaaattacttcctacacataatgtcataaccaactgcttctttcttgtagcattcaggtcacatcaaagtacttgttgacatgctccaacagttagaaaggtccattcagttcatggagaacaaattgacaaacaagttactttccgtggaacaaatatgccggaaaaacacactagccatcgaggtaagcataaagcagcactggctaaatgaactgcataatatatagcttttgttcataatatatagctaaatgaactgcaactcttacaggacatcaaaaacaccctgtccaaaaaaaggaagtcagtccctatacaagccgatgcatttagacccaaacaagaagctgatgtcaacaaagtcgaggataatcgaacattcgatttaggcaatgaaaggatgcctaccatactgaagagatgcatgaagataatacggtgagttgtactgaactaatttacaaaactattgttcgagcattcaattttttatgtcttcttctctaggatgagacaaatttagccaaagagattgatggtaatggaacagaggaagctccgttcataatcactggggatgaagcaactgagacagatgacaataacaaaaccattgcagaaagactaagaggtcagttcggaaggacagtcaagccatcatatcaaactcaaagtgatttcatattctacaaacataacaaaaaaacattcgagcccaaaattcaaatatccaattcaggatcagcgaaccttggtttgacattgaaagataaaataacaatcaattacatcctccagtcagaaaaaactaaggttcttgccagtatacaagacatagagctatcacgtgcacatctactgccacttgtaacgccgcttgatagttcatcaaaatcaaaatggttgaacacctcgttaagattatttttatctgttataataatttctacctttcccatacatttctatatttttttttattttgcaacaggtcattgaagcttacacagaactcataaacgacaatcaacaaggccacaccaggcagtacggttctgctctaattgagaaagaaacgcaagtccaggtttggtgtgccgttggtaagacaagaggaaagccaagtaaaagatacattgaatccagatcaacgtttgcccaaagatacatggtccatgatatggtactaaatcaggtcatcatttatttttatgcctttccaaaaactactttaacttatgctatttcctgaaggtcttcctaccaataaatagggacaaatcgcattggtacgtaattgttattaatgcaagatgccaagaaattcaaattcttgactcaatgcagatgcagccacaatggtacaatgcaagcgaagatattaaaaacctagtaagctccatcgcaataacagttcctatatgctataataacatatgttctaagtaattttaacacataacagatcaatggcgtggccaagtatattgattacacggtgaaagaacgtcctgttccaacatcctggactgacacaaatgttgcaaaatggccactgtgcccaaagagtgtacctcaacagaaagacaggtgaaatatcatcaatacgcttttaactaacaattattgctaactgacattctcaatttctatggttagttggtcatgtgggttaaatgctttgaagttcatggagacctgggatggaaaggaattaacgagcgacttcttaaatatggtactgctccgaaaagtactaagctactatgactcacattttattagtgttacacatctcttacacatatttttcactccctcttgacttcaggaaccgaatgaagttttcagactaaaggtcgccgccaacctaatcaacactactctaaatatagtgcttgctgtccacgacgacatcagacgtctacattcagaaaattcgtccacatctgaagttacaatgaagctttgaagccaattagtggcatctttgaaacactgtatttccatctaagtgtatctatctaaacttttatattatgcaacactgtttttccatctaggttatttccaatcaattatcagccatgtattcaaaactactatctctattttccaagctccagtcaattgcaacatttctttcaaactgaaaggaagaacaagtgcttgatgttaccttacccggcttagctttttccatctgcgcgaaaggaaatacgcccgcaacacctctaccttcgcagggactcaactcttcgcagtgtagcacattgatcttccggttcttctccgttttcctacgccacgacacccgcagcaccttatgcagccgcatctccccgccggtgcttggttctgaacaccacacccatccttccctccgcctaccacctccattgctccaaggggatcattgcgccggcggaaacaacggcacgcgccgatcgaccggacgagcggatggaggcgcgctcgttccagatctgagcgccatccccccatcccctgcgccggcggcagcaaaggcacgacgcatgcgccgatcgaccggacccatctttccttcccctgcgctggttctagagggggaaatccctatgcgtgggccaagaaatcgtcgagaatcagaacaaaacagggagaaaaggaaagagatggcgctcagagagaaagggaagagaagccccggtctgatcccggcaggaaatcacggacccctacctcgttacgcgaaaatacggttttaccccagcggtaccgccccaatctgcgcgtgcggtaccacgcggtaccatccaatctcagccgtccgatgaagctagatcgacggttcagatttggtaccgccccctttcaaggacagtaaaaactctcattagtcatagtaaatacttacgaatagacaatagacccggtcctttgtttgtttttctgatttttctgcatactccatatgcagttgaacgtgtggccaacgtacgtatacctgtacgatcgagttatctataaaaggaaacccatcctgtcccatgtcgttcaattaagacagtacgtccacgtacttaattaattggctgctacattcagatcatcacttactcatcgatcgatcggcactagtactctattaggaatactctagctgattacattgtataggcctgagattaattgtggatctctatattcctaatagtttcataacaatcagcttgatcgatcttacagcttaatatagctagctagctaaagttcaagatcagagatctcacaaacatggcatcgtcggcgtcggcgaagttggtgagggcgttggtggtggcggccgtgctgatgcagtgctgcggcgtgctcctcgcggcgaggccgttggccgcagccggcggcggcggcggggaggagatgttcgtcgtcacgccggagatcctgaagaccaccggcggtggcgccacaacgacgcctacgggcaatacgtgcaaggaaggcccgacccctcccagcagccccagcccaccatgcatcggcagtactcccggccgccggtagctagctagcttagcttgttacttagttttaattaattttctttgtcgcgaacacgacgacctcgatcgatcaagctgattccggccggtttttaattgttttccgtacgtagattttttttttcagttaatacaataaaatttctgtctttgctgcttagtattaatcagtagtgcatgtaattaacgatattggtaatggatatgacatattctattatcacaaatatgaatagatgttagttttttatgggacggagtgagtatgtattggtatatattgtcttgaaataaaaaaaaaacactgagactatcactctagagagaataagaatgcatttttcaaatacaatttgttaatcaccatgttacggagtactcctatgtagcaagggcttacggctcattgatttaaatgtttaccatcgttggtaggccgaaatgttttaaccatatccaacagtccagcttacacgtgagacgtgacttgccttgcggaggttcacagccagcccattaactttcggagtgggctaaataacctaataaatcgttcaaggacatggaccgtgtacttacacggctggaccgggggaaaaaaacaaattatttactagtagtgcctgcttacgaatggaatagaaaatagacttgttccttaattttttttagtttccaatgcatgcagttgaacgtggctaatatacgagttcgagcgtttttaacagtcttttcaattgattttgtaaaccaaattttaataattttagaaaaaaaaaatcctcctctaacacctctccatccagatgaccaagataatccacctgccaaagttctcccctcattggccaaattggctaatcatgggccccacgtcatagatgctcatttcccttctctctatccccgccctctctacatccaagggagggagggcgccattgctagggcggctcgacggcgagagaggagtgagggaggaaggctcgatggcttgtcagtcgagcctgccttgtgcacacggttgttgaggacgatgaggccaataggaggggacccgccattcgccttgccctcacggatccattgtcgcgtgcatgagtccgcctcgcacatccggatatgttgtcgctgttgtctcctgctgtcaccgtctcccttgcaaagcgacactgtgcgggaacgccgtcccctagcagagggagaaagcgaggagaaaaggatgagggggagaaagctaacacattctttatcattttggagatgtttcataaccgtattggattgatcaactagtttgactacctaaatcaattaaagagctaggtatacacatatttaaaaagtctagattttaggcaggtacctatgaaaagaaaccagtcatgtgttcagtggcggatccagaaagaaatagcactagagtctgagcaaactagatagagttaccgttccccctcccatttacatatggtaaaaaattttagtaaagtcttcgtgggggcgttttcacctaatagtggaggctcgaaaccctgtcgccttcgtgctggatctgcccctcatgcccccatctcctcgtccttaaaaaaaaagggtaatttaaattataatgagatggtttcaattttcccttaaaaaaatcccccagccgcggccccaaattctcagcccagttccctatccgcactggacgaccggcctggccgagcagacgcagagccttgtgccacggcctgctctaacgcatgcgcagcatcagtctgatccctgcaccacgcgcgcgcgcgcgcacgcacgcagaattcggcgaaaactgcagcatttacacatgaattcaaccagtcgtccacgcgccgcgactagctagcggcaggcatcaacttaattaaaccgctgaattagtaatccctcatactcgtaaagaaagacgtttagaatagcgacacggtcttcaaaacataaatttgacttcttttttctataaaaatatttattaaaaagtgatatatgtattatttttcaagacaaatctattcatataatttttatattttcaaactcaacaacttgagagttattcatgatttatattcctaaggtttgacttaaacgttgtcctaaacgatttttttatgtgtacgaaggtagtacgtagctgaacagagccgaccaaatcgcgttcgatcgatcgatgggcgataccgagccgtgcgtatgtacacaactcgtatatcattcttttcttgaaacccacgcaatcgtatcatgaaaacgtctacacaactcgtcgtatactcgtatgtgtgtaagtaacggtccggtctttcggcgaggcgtatagtacgtgcgtgtgcgtgtgtatgtacgagcttactagtagtagctactgatcgatcgagttaagttgcttgtttcagagggaactaattaattaactggtcgaacccggccgttacgatcgaggaagattcactggtcggtcggtccaaacgaatgtgtcaattcaagggcatggacgctcgatcgatcggggtcaaggtcgagttacacacggattaatcagaacgtccgtacggtcctacataggcacatgactagtacttcgtatgttttaactttgatcaaaattaaactgctttaactctgatcaagtttgtagagaaaagtagtagtaacatttttaacttaagacaaatttattatgaaatatattcaattattgattcgatgcaactaatttagtattataaatattactatatttatctagaaactcagttaaacttaaaataatttgactttgaccaaagtcaaaatatcttataacttgaaacggaaggagtatcatacacacactacctctatctcaaaataaatgcaaccgtggagattcatgtccaacggttgactatctgtcttatttaaaaaatttagtcacacataaagtaatattcatattttatcacctaataaaaataaaagtactaatcataaactttttttttcagataagacgaacagtcaaacgttgaatataaataatgtaaaactacattaattttgggacggaggggctactaggtctttgtaggagtgtaactgtatatacatgactgattaactttgccttaggagctgtttggttcgttgccatattttgtcacgccacactttagtcataccatagttttttaggcatgtgtttggttcgctgccgcaattatgttatgccacactttgggacccacgtgtcatgctctcaaatttagagctaagcatgccacacttgtggccaactatttctaagccatatttgtgccactatgccacaactagcctaaacttagttatggcaaagttaggcatcaaccaaacatccccttagcttccatagtaatactcacgcgtagcagcactacaactgctgctgcacgtcttcttgaacctaactagctattcgtgttcaaccttggacatggactgcgctgaaaaccgcgtacagtggcatgttatgttgttaattaattagtagtactactggtaaactcgtacgattagacccgttcatctgttaagatttttactagtacatgcagttcaacgtgtggtcaagtcacgaacatatatgaactgtactactataaaaggaagcccaggttgtctgatttcctccaacaaattaaacaagctattactcttttctttaatcaagctagctacccattcgacgtacagcaaacgcactttctgtctgctatattcaattcactcgtcgtctcactgagctttacaccattgccgagcacctagctagctagcttaattaagaattcatcaagaaatcatataattaatggcgtcagcgtcggcgaagacgatggtgagggcggtgatggtggcggccgtgttgctgcagtgctgcggcgtgctcctcgcggcgaggccgttgaagggcgacgtcgtcgccgccgccggcggtggcggaggcggtggcggcgagatgttcgtcatgcagatactgaagaccagcaccccaaccacgccggtaggcaatgggtgcaaacaaggcgagaccggcggcaacggcgcaccatgccacggcagcggctagctagcttaattatactactcgatcgccatctgctgcatgcggcgatctgacaccggctgcttctctgtttagttgtatgtagatgtcgacatgtatgcatgtaaatatatactagatgatctgtagagattgtttcattcattatttggtttttaatgatatatgcagtaattaggagcttccatatatgtaaagatggagtgtacgttggaagaagtcgaatgatgtatatatagttcatattattcataatcagtgtagtagtcaataattagagcatatcatgcatgcaagtagtatctctgtttttaaatataagactccattggcttcttgatatacacttaactattcatcttatttaataattttgtacaaatataaagaacatcggatgataaatcaaatcacgataaaataaataataattacataattttttaataaaacaaatgatcaatctatcttaaaaaattaacggatcatatattaaaaaacggagggagtatataggagagaaaatagtcagacaattgtaattaaattgtgtaaagtagttttcgccagatgataaagatatatagttttatttggattaattcaattaattttggtatttgatgatgatctatatatgcatttatattagttgaccgtttcaactttgaacactaataattattaaattgttagactacaatgaatgaaagtacatatatgtattgtgtaggacgtaatatatatatatatatatatatatatactttgatacgtatttatatatttatttaaaaaacaatttacaaagtgattgcaaacagaatgtaacagcaaggagaagaacaaaaggatatggattttcatctctcaagaggatatcctcttacatgtcatctaaatagttataaaaaaataaaaaaaaagttaacaacatagattaaatataatatacatcactctacaaacatgcgaaaccaaattcaacttttacaagttgcaaaaaaaaaactgaaagttatcattcattcacggttatatttgttatctttattaaacttgtagtagtttgaattttaacttttatgtttgtgaagtgatatattttatattaacctattttattaatttttataattttttataactatttaagtgacatacataaaacgaggggatggtgagatctatataatatatcctcttatgagatgaaaacaatacaacatgaggttgtctggcatgtaacgtgcatgcatatataatatatattaattgttcttacatatagcaaaacatgcctgctacatcttacacaatttgacttaactatagttagacttggtcaacattgaaatatataaaggtcaacatatatatgtactcaagacatagcatttgaccgtcaggacatgtgagacgagatcgagctaggtagtaactaaacaagcaactatagcatgcgtcaaatgggaaaaattttctaaactctcaagggacgtccccatgttatttacatatcacttaaatagttaatttttttaataaaatagattaatatatgatagatcactttgcaacctgcacagtaacttcaacatgttgcaatgaaaaaaatatatttgacttaaccagatatagtttaatttatctttttataacttgcaaaagttaaattttaacttgtatgttgtagagtgataacatgttaacacttcttctatttttctactatttttttataactatttgagtacaataaaacaacgaaaggacatcttccagagagtttaaaatccactctctctgcgttagattaagatctcgatatgtgcaacgtagagagtttaaaatccactctctctgcgtttgattaagatctcgatatgtgcaacgtagcaggctagctaattcagtttttttagatcgatcgatcaattgagtcggtggtgaattggtgatgagtctgcagcaggtgactcatcgatcgatcgatgcgcgtaaaataaacctgcccatgaaaccaaaccaatactaatataatcaaaatcaccgccactttctcggaagtcataaggactaatttagagcagatacaatagcaggctctaagctatttataaacatattttaaaaagataaaggaagagagaagagaagtgggctacagatctatagctagctgcagcatggactccaaaacgtaatatgtatatgacaggtgggaccaagtattaatagtatagtaagcaactattgtataaattggctattacattggctatagatgatttggagcgagcagtagactatattattaaacttgctcggcaaggcagccagcaagtctgatagagcaacatggactgacgacagcggccgggctagcttgcttcaccattcatatagtcatgcatatgcatgcaccaagtaagttcgctcgtaactgcgtacatagctagtaattaatactgtagattatgtaaagtactacgtagtaatcagtcagtcagttatttggtcatattatatcgcgatatccacggtagactagctcgtcgaatacgactagtagctaactagttcatctcttcatcgatcgatcgtacgtgtcgtctcggcaaaattgtgtgtagttacgagatcgacgtaagttatatgcaagccgggaagtatacggccggggtcgatcggtggattggtccaacaacgagagctatagctcgcgcaggcaaagttactattttattaaactcattaaattacatctagatgatatatttgttctacatataactgagatgcacacaattaaaaaaaaagattactaacgagtacgtacgtatacatgcgtacgaacatggacacacatggttttattttgatcgtacgtatgaatattatcttgaatgaatggtatttgtacttgtcaatgtcaaacatacgacgattgaattaaacgtgaccgcggctcgctcgctagctcaaaaaaaccgcgtttttccgcgaggcgaggatgacaataaaaaaaggcttaaaagtagcgccttttacatagcgccgacgaatagacccggtcccttttgtacgttacgttgcacaccaaactctcttccctcgctctctatatatagccagcccatcctgtctctcttccaacaaaccgcactatacactagctactaccttctccaattcatccattttcacgtagtaatatatacgcagcaaaattaagaggatttaattcttgtctgccatatctctgaaacaaattaaatctagtagttagtacacagtagtaattaactgcagctgaattcgatcatggcgtcgtcgtcggcgatggtggtgagggtggtggtggtgggcgtgctgctgatgcaatgctgcaacgcgatcatggcggcgaggctgctggaaggcgacttgtttggcagcagctggctgcagggcgaggacggcgtcgccgccggcgagctcatcttgcaggtgctcaaggtagtgccatcgggaccaccaggcaatgattgccaccaaggtggcgccggctccggaggccagtgctaccagccgcctaagtagccgcgccggccaccggcgcaccggccggcgccgccatggacgatatggatcgtggcccggttttgctcgtagagtagatcgatcgatcaactgttcatttgatacgatttatttgttctatatatacgcctgcacacgtagagctagttagcttccatgcatatgcagaaaatggagctttgcaaagctgttcatagttgtagttaggttagtcaatttaggcgtattgatttgtgtaatagcgtactagtccgtgacatatagctagctaggttgatcctcaatgtatatatgaatcatacacacttgtcaatacaagaagagatttacacagtgatcgtttcacacatgctgattaatttataaataaactatataagctgcaaattactcatcaacaacccaaaaaacaatttgtcaataaaaacttttgtatatgtgttcttaagcaatttagaagcaaaggctaaaaaataaactataataaaagaaccctttaatcaactccaaaattaagttttcaaattcaaatttgtgttgctgcttataagctggaatgtaccttactttccttttggttttcccttttaacacaatatatatatatatatatatattgtggtattgttggaagaaatgctatcttgacatggtactaagggaaggtatatatggaaactttgtggtattatttgatacctgtgaattttttataatatcaccgaagtttaatcttaaatgaggatggattgagaaaaggcgtaagattagttgaaaaataaatgagaggtgattgtatagtagcattgctaccgttgttccaaatagtttataaggcaacaaggtggcaaagagttccctccctacaagagagaaccgaagcttgaagacataggagaggagatgagttgggtgggacaggaaaagagggcaagttgagtcggctgactcgtgatagaaaatgagagggcaaggaaagacaggcgagcacggcctggtggatgttgaactcaattcctagatctagcatggcaaaacctatgcaccaaagaacgtggcgctaacatgttggacccaaggtttacaaaaccgtatggttaccacacgattatcacgtgcagtaatcttctcagtttttgaaaccacggtacatcttacggtaaccgcacgtttaccgtggccagtaacggccaaaccgtggggtggcggtaaccacggccaaaccgtggggtggcggtaaccaccgcaaaaacggtttgggggaaccctggttggacctgcgccatactcgatgaaaccaatgtcgcgtgtttttggttgaagatatattttggcatgatctattcttgttataataagtttttgcaactagctaaatggtcaaaaatgctataattacacgtagttatatgcaaaccgtgaagacgccggtcggtagtccagtaacgggagctatcgcaggcaaggaccggagtccggaggtcatatatttggttgatgggaatgtagctgggcacggtacgtagctaacaagcaacaacgtatgtgcgtacgagcctggctttggttgatcgtatcaatgatcttgaatacttactagacttgtcaatgtcaaacgtaggaaattgaattaattaagcgtacgtgaccgcggcccgctcgctcaaacaaaccgcgtttttccgcgcgcgagctgagacaaatatcaatcaaattaaagcctaaaagtagcactagttcgttgttttacatggcgctgaagaatagaccgacctggacagtcacttctgttgcacgtatatacacagccaccaaaactctatatataaccagccaatcgatcctgcctccccacaaccacacaaacaactatagtttcagttcttcagccattttctcgtacgtacgtacgcagccagcttggattcttgtctgccactccgaattaattaatttaaacaatctagccgattgatcgaatcaacagccgaattaatcaagctctagttaggttgctactactagtacagtagtacgtacgtactgcagctgaatatatatacatggcgtggtcgtcgtcgtcgtcggcgacggtgagggtggtggtggtggccgtgctgctgatgcagtgctgcaacgcgatcatggcggcgaggctgctggaaggtgacttatttggtagcagcagctggctgcagggccaggtcggcgccgccggcgagctcatcttgcaggtccttgacaatggagggtcgccgccgggaggcaatgattgccaccaaggtcccaatccaggcggctccggatccggaaaatgctggacgccgtaactagcctcgccgcgccggcggccggccggcgagcggcagcttatgtgcgcgccggtcggccgccatggatggattcccggaccggttttgctcgttcgctgcaggcgcgcgggacgttaattaacatgtacatgaagatctaattaagttcgacatatatatatactcagctcctgcatacgtagagattgttcatctgattcagttcttgcattctttttttccctgtaactgtaagagcttccatgtaaaagtggagctttgcaaagctgttcatagttgtagacagtagacttgtagtttagtctagtcaatttaggcgtactgatttggaacaaggtaagtcagggacatatatagctagctgggtcctgaaagtgtgtaatctgaggatcatgtgcatggatactgtccgacacattagaagaaatttactttccttttggttttccctttaatacaatagcgtgattcgcttttatatttgtgaagtttgcggtattgttggaagaaattaatgctgtcatgatgttgtagtgaagggtaaattttatggtattatatatggctgcaccgcaggcatattgttggaagttacgttagtcggaaatggttagtatgatatcattattttattatttttcggaaactggcaaaaatgattggaaaatttttatatttatgaattgaactatttagtgtcaacttcaatgccacgcttatagaaattgggaaaaataaaatttgaaaatggtaaccgtcgataaaaatattattagtttttcggaatatggtatcggtactgtcggaaaacttccataccacacatataaaacacacacacacacacacactacccttactattgactttatttgtcttaaaatacaaaagatttaggagctaataagcactactatggcatgtgtcatattaaaagtctgtgcaatgaacaatagctttgggcatgtttagattcccgggtaaaaatttttagcatgtcacattgaatgtttagacacatgcatgaagtattaaacataggaaaaaaactaattacacagatcacgtgtaaattgcgagacaaatattttaatcctaattgctccatgatctgacaatgtggtgctacaataaatatttgctaatgacggattaattaggcttaataagttcgtctcacagtttatcggcggaatctgtaatttgttttgttattagtctatatttaatacttcaaatatgtatccatatatccgatgtgacacgctaaaacttttcacccctaaatctaaacacagcctttatcggttggctaagaaccaattatatatcaaagcgacttatcaaggaaaagattatggctaaagcttttatatgttgttaacaacttaaaagacgatcttaaaaaatatatcctaaaatgaactctataattaaagtttaaagtttaaaatttagcatcagttgaagcgtacgatgaggccctaattcaatttgagatcgatgggtgagtctggtggtgaattggtgatgtggattgaagtcagcaggtgactgatgcatgcgcgtaaactaattaaacctgccggtactatacgcacgcactgcacgtccggccgtagacggtgtgatcgatttgatcgaatgaacatatgaatttcacagacgatatcgatcgatcaaagtcgccgtcactttctcggaaagttattataaacgacctaggtttcaggtaggttggccaatgcagcggccgggccggcaacggcagtcagagagcaacacctgaagtttgctaagagcaagggtaataatatagccagctgcttacttatagcctatctatcagctcactcatatagtggttaactcttcactgtaaacatatggtccacctgtctgtctcacagattttcttggttcctgtgcctaagccggctgtaaacttatagtccgcttctcatctctctcctctcctctctcatccacctcagtattcagccttcttatagctctctattatacttgctctaactctagctcacaattcatgcatatacaacaactagatcagaggcggatcaagagcatgagtacaatggggactcgagcattcactactcacaataacaccatggaattcttcatgaagttttcactacaaattttgtatatacatatgaaagaaagctatagatttatcttagtttattcagacctttactgttttttttttggagccagtccagtcggtccgatcgatcatatcgattggcggctgactaagtgactagctagctcgttgaatacgacgccctcttgctcatctgtcgattgaaaccgtctcgatcagccaaaacgtgtagttgattacatgcaagccgtgaagtacgccggtcggttggtccgacaacgtacatgagctgacgcagaaaaggaggtcaaacaacgatcgagttgattatcgtgaattcgtgatgatatttgaactactccttcatgggaatgtagtaggcaagtgaacaacgtactgtatctcaaaatcccttgaaatggcacgagctactactacagttcttgtcaatgtcaaacgtaggaaattgaattaaacgagaccgcggcccgctcgcacgctagctcaaaaaattgaaaccgcgtttttctttttgttccgcgaggcgatcgagactgacaaatcaaaagcttaatagtagtattataattagttggttgttttacatggcgccgaagaatagatccggtcacttttgttgcacatacctttttactttcaacgtacgtatgtatacacagccaccaaactctatatatataaccaacccaatcctgtctctcttccaacaaccttactactagcttcaattcttcagccattttaattcacgtaggcagcagccagcttgaattcttgtctgccatctctgaaacaaatctagttagtacagtattgtagtaactgcatctgaattatattcatggcgtcgtcgtcggcaatggtgagggtggtgttggtgtccgtgctgctgatgcagtgctgcaacgcgatcatggcggcgaggctgctggaaggtgatctgggcagctggctgcagggtcagggcggcgtcgccggcgagctcatcttgcaggtgctcaagggagggtcgccgccgggaggcaatggttgtcaccaaggtcccggaggcggctccggaggcaactgctaccaaccgtaactagcctcgccggccggccaacgcgcatctgtcgcatccatgggtggatcgcggccggttttgctcgatcgctagctgcagctggcgtgcgagccgttaacatgtagtagtgatgaagattggagatctgcgtagagattgatcaactgttcatttggttgaattcctttaattctttttttttcttctatgagagcttcatccatgcaaaaatgctggaaagcctcgcaaagctagctgctgttcatccatgtagaaatgagtagtttaattagtcaatttaggattgatttggaataattaaggtgatcctgacatctaggtcctgaaagtatgtaattagtcatgtttaatgcttgatacttgtataggtcatgaagtcacaatgaaacaagagatgctatactttgagaaacgtccacggccgggttttccagctagcttcacaagatggtgggctagctaacctggatttaaagcctcatctcttttatttatctgatattagattattctctaatattcgtgtttttttaaacaagagatgctactcctttgtattttatctttcctgttggtctccaacacactactactccacatgcatacacccaggcagatttactgccactatcaatataattaccaatgtatgcatttatgccatattacagatgaacagatttaatttgcaatcaaaagtaatatttatatccaaaactcataagcattatcttaaaaatttcttcgaacatttcctgatatgatggaaatcattgaggataatatcaatatcaatctcatctaataatttctttttattaaaaacatttatcaatttctcgaaagttataaattaacgacctataggcgcttcatgtaggttggcggttggccaaacgcactgcaatggggaaggggggggggtgctgacaaaccctgataacgtgtgaaccgggactaaagatgatcatctttagtcccggttggtgttaccaatcggcactaataattaaatagtgatgttgctcttataaatttggatttaaaaattatttttagtcccggtttttaataatggtttctccagtagtgagcagacagaccggcaacggcaggcatgaactaacctgaagtacagttctagctaactctagctcacaatataattcaagtatatgtagcagctagccagctaactctatatcgattggatgatcagtgatgagattgtgtgcgtaattatttaacttcgtcgtatacaacagctagctagatcagtcagtccagttcggctgactatagctctcgttgaatacccccctctcttgctcatcgatcgattgaaatcgtctcgatcagccaaaacgtgtagttagttactccctccgtttcgaaatgtttgacgccgttgactttttagcacatgtttgaccgtttgtcttattcaaaaaatttaagtaattattaattattttcttatcatttgattcattgttaaatatatttttatgtaggcatataattttatatatttcacaaaagtaagtttttgaataggatgaacggtcaaatatgtgctaaaaagtcaacggtgttaaatattttgaaacggagggagtacatgcaagtcgggaagtacgggtcgaacgtacgccggtcggttggtccgacaacgaacgggagctgacgcaggcaaggaggttaaacaatcgagttcatgatgatactattttaactaactactccttcatgagaatgtagttagcaaacgaacaacgtactgtaacctggctttgttggttgatcgtatctcaaaatcccttgaaatggccatacgtacagtacttgtagtcaatgtcaaacgtaggaaattgaattaaacgagaccgcggcccgctcgcacgctagctcaaaaaaaccgcgtttttctttttgttccgcgaggcgaaactgacaaatcaaaagcttaataatagtagtattagttcgttgttttacatggcgccgaagaaatgaagaatagacccggtcacttttgttgcacaccgcctttttaccaccaaactctatatataaccaacccccgtcctgtctctcttccaacaaacctagctagctaagcttcaatattaatttcttcatccattttcacgtacgtaggcagccagcttgaattcttgtctgccatctctgaaacaaatctagttagtaacttagtacagtagtaactgcagctgaattcgatcatggcgtcgtcgtcggcgatggtgagggtggtggtggtggccgtgctgctgatgcaatgctgcaacgcgatcatggcggcgaggctgctggaaggtgacttgtttggcagcagctggctgcagggcctgcagggcggcgtcgccaccggcgagctcatcttgcaggtccttgacaagggcacgtcggattcggaaggcaatggttgtcaccaaggtcccggaggcggctccggagccagctgccaccaaccgtaactagccgcgccggcgcgccgccggccggccaacgcgcatcgtcccgtccatgggtggatcgcggccggttttgctcgatcgctagctgcagctgccgtgcgagctgttaacatgtagacatgaagattggagatcttcatagacattgatcaactgttcattattggttaaatttattctttttcttcttcttcttttatctgtgagagagcttcatccatgcaaaaatgctggaaagcctcgcaaagctagctgttcatccatgtagaaatggagtagtttagtcagtttaggattgatttggaataattaaggtgatcctgacagctactagctagctacctctaggtcctaaaaatctgtaattagtcatgttggatgcttgatatatacttgtacgtacgtatagatcgatcatggagtcacaatgaaacaagatgctactcctatatattttacctttcctgttgattcttaatacaacagcgcaattcccttttatgcatggtttactccttgattctcactccttcaacacacaattttctctttttttaaatcagaagaaaaacaacgcactattatgtactccactgcatacacgtacacccacgcagatttactgccactatcaatatcttcttataaaagagtgtttactaaggtcacgaatttattttttgcaaataccctcatcgtgccaccttacctacccatttgtattttattaattattccttaaaatttttaatatcaagaaacaaacaaatcttaatgtatagccgcatgtaaaattaaataagacgaatattccccgtaacaaaaagataggcagtacatatttcgtaagaaatatatttttatgtattttagataatattataatatattttcttttagtatgcagtaaagtatggatattcaactagtttatatgaaaagtatactcacgcatgtttatatcaaaactaatgtattatcaataccgatcgtaacaccaaccgagattaaagatcataaagtcccgttgaagtttttaactgggactacaaatgatctttagtcccggttcttatttgaaacggaactaacgtgatttttgcatgacccggtaaagatcacttctccagtagggctagctaactctctaatatcgattggatgatcagtgatgagattgcgtgcgtaattaattaacttcgtcgtatacaaagctagctagatcagtcagtccagtcggtccgatcgatcataacaatcggcggctgactatagctcgttgaatacgaccctctcttgctcatcgatccattgaaatcgtctcgatcagccaaaacgtgtagttagttaattaagtacatatttacatgcaagccgggaagtacgggtcgaacgtacgggagctgacgcaggcaaggaggtcaaacaatcgagttcatgatgatactattttaaactacttgatgagaatgtagttagctaacgaacagcgtactgtacgtacgaattgaacctggctttaattaatttgttggttgatcgtatctcaaaatcccttgaaatggcactactacagtagtatacttgtcaatgtcaaacgtaggaaattgaattaaacgagaccgcggcccgctcgcacgctatcgctaaaaaaaaaaccgcgtttttctttttgttccgcgcgcgaggcgagactgacaaatcaaaagcttaataatagtagtattagttggttgttttacatggcaccgaagaatagacccggtcacttttgttgcacaccctttttactttcaaacgtatgtacacagtcaccaaactctccatatataaccagcccatcctgtctctcttccaacaatcctagcttagcttcaattcttcagccacttcaattcaaggaggcagccagctcttgaataattcttgtctgccatctctgaaacaaatctagttagtacagtattatagtaactgcagctgaattcgatcatggcttcgtcgtcggcggcgatggtgagggtggtgctggtggccgtgctgctgatgcagtgctgcaatgcgatcatggcggcgaggctgctggaaggcgacttgggcagctggttgcagggccagggcggcgtcgccggcgagctcatcttgcaggtgctcaagggagggtcgccaccggtaggcaatgattgccaccaaggtcccggaggcggctccggagccacctgctacccgccgtaactagcctcgccggccaccggcgcaccggcgcgccgccggccggccggccaacgcgcatccatgggtggatcgcggccggttttgcttgttcgcgtgcgagccgttaacatgtagacatggagatttggagagccgagtagagatccactgttcattttggttcaattcctttattcttttttttttcttccctgatgtgtgagtgcttcgtctgtccatgcaaaaatgctggagcctctcaaaggtagctgttcatccatgtagaaatggagtagtttagtcgatttaggcgcattgatttggaataattaagggtgatcctgacatctactaggagtctaggtgaaagtctgtgtaattagtcatgttgaatgcttgataattgtatataagaatcatggagtcacaatgaaacaagagatacactcctatatattttacctttcctgttggtttcctttaatacaacagcagatttcgcttttatgcatggtttactccgttgattctcacttaaacacacaattttctctttttataatcacaagaaaaacacacacactactactccacatgcacacacccctacacaaatttactgccaccatcaatatcttcttctagcagagtgtttactaagatcacgaatttattttttgcaaaaacccacattgtgccaccttacctgaaaaacttttttacaaacattaattggtggtgtattagcaaacgatatatatatcggtttacgatgcattgccactcgaaatttactccttaaaccttttaatattaaaaaaacaaatcttaatgtacagccacatataaggtgaatattggcctataactaaaagatagataacatatttcataagaaatatatattttttattttaaataatattataatatattttcttttttatatgtagtaaattacaagtattcaactagtttatatgaaaagtacacttgcgtgcgcgtgaacgtaggcataaaaaattagaaacttggtgaatggagccatacactcgcatcacaagtccatcacgtacgacatccgagatgctttacaaaactacaaatagtatgactaaactattgaaaagctacagataaatttattgagcttatcacgaaactatagatttaagacatactatcccaaaattacatatttagcactaaatctatcataaaactatagttttgcgatactctattctaaatctatgtaatttcgtcataaattttgtattaataaatttataattcagttattaagaatgtatctttactgttgatcaaaatatattgttttgtgaaatttactcattttttatcataaaatgttggatgaacttaaataatttcaatataatataatcgttttgatattatcattctattgctattgtgccattctataattctcaccccaaaaatttatatatatgtggattattaattgtacggtgtgatatattaatcaaaactagttgacgtggtaggcgacatacccgtcgacagcgaggcgcctatgataacttcgtcaatctccaggatttgccgtcccaatctttgaagatgctcataggggtagaatttgcatgcgtgcgtttataggggtgagtgtgcatgtgttgtaagtgtctgcgttgtactgtgtaattataatagaaaatattaatcaaaactagttaacctattagtttatccgtgtgcatctaacatgcaaatatcacgcagccagcaagctggccgtctagtctttatgttaacgtaatggcttgacgttggacttgatcaacaatatcaaaaaggtcagcatatacgagccgtggccacagaatgcattatataatttgaattgtttcagtacggtacattatataaatgaattaattaattattagaaatttgatgaattaatttgaaaaaaaataagaaattccaacgaagaatttttttgataaaattgtattatttcaggagtttcggaaccatactttcaacaatccataatccataagctataaacaacgcacccttaattcacagcagattatcccgcacataagtactcgatcctactgtaaaaccataccgtaaaacttcttcacattaaaagaattgggtaacgatacagtaccgttgcccaatcatcgttagccaattatctctcaatcatcgttagccaattcttttatttcacttttagatgacgtagtaacaaccaatgtcgtgcttaaatgtatgtgattttggattttttttttcagttgaaacttttctagagggagttaaggggtttctcccatcacttatgtctctatttttttatcagaactcaatagttgtgtgtctaatggctgtggccggagatgtaaacaatttttattatctaaaataatgaataaacataatgagaaaaagatcaatgtataaaattaaagattgtacatcgatctttttgcgagtcatatgtctatttcacccgttgccccgtaggcttgttaattaatttggctggtcaggcattttgactctccagccgagccaaaatgttcagaccaggaaagaattgacttcagacgtacatgctttgaataaaataaaataaactttgatttgaaagattcaatatgcagtctttggaattagaccgactattcacatactcctactacgtactctgtacttacgttgaggaatctaaattcagacaaaaacagtgaccggccagtatgtaagtactactacactatttgttcatttttcatctagtgatgattgagagatgtgtcaaacaaatgaccgtgatcaagagaagtacttgcagtcaggtgaaaatttaatggacctaatccaagtcattacaaatcctagctagctaggcacacaaagcaaccttatgcttggaaattgaagcagtacatgatagttgatggtggcagagtcttggcatgcctactaatcctttcggtaaaatttgacggctgcaggcagcagaccattgaagcacaactgggatgaaaacggtacggaaacgaagtgaaaccatctttatcgttttcgttttcatatttttttcggaatcagaatcgaaaaccccggatacgaaaacggaatcaaatattatcgaaaccgaaaacgaagcaaaaatgaatcggcgcgaatacggtgactaaaatttatcgaaataaaaaacccctcaaactgataaatccaattctcaagtctcaacggtcaacaattcatcataaaacataatcatataagtttaattgttaagtctcaaacagtacatcacaaaacacaatctatgaaataaattatctatatttaagagagtaatgttgttgataaatcctaatgcagaaaaaaaattcttatgcaacttcatatttgcataacaaatatttttttaaaaaaaataaaagccaaacaccatggtattcactattcagtacttaaaaaaagaatccagggtatttcagtcacaaaattttcggaaattccgaggaaatttctggaaagtttccgaccgattccgagttccgacagaaactgcccttatcattttcgattcattttccgagaaaatatttccaaattaatttccgtttctgaaaaaaaaaccaaccgtcagattccgttttcgaaaataggtctggaatccggaaagtttccgtactattttcacccctgcaactgagtgaactgactactgtactaaggtttgtaaattgtgatactgcatccgttccaaaattgtgtatacagtagtaccttttggatatttatgctatacactatacagtttctaatacacgcacctgatcattaatccctacattttgattatttactatgtactagtatatcgcttggttaaaaaaaaatagagaaataattttcaagtgttctgatcaagtcaaagtaaaattagcttggttcgttcgcatgaaattgtaaagtatggctgcagtcgagactcgcgagagtacgaatgcatgactaccgtgtagaagcagtagcacaggcttgagtagtcacaggtttttggtgtttgttggtgatcgatgcactctacacgtacgacgagtcactgccgctgcgtgaattgaaattttgaatcgcggtggcctatcgagcagggcacgactgcttctacctctacttgtgctccctatagttcctcaccggcaagaacggaacgagagacaaaacgaaacgacttcaaaagttcaaaccaaactctgccaattctgaggcgacatacgtgcggagaagatgggcatcaagcaccgcagcttcaccggaattagccgggatgattgcaaagcgacgtgtttcggctacgttcttggaacaaacgggtgctcgtgtgttgattaatttggttcgaggagtagcagatcgcaagtacgcacggcacggcacgaccactactcctgctcgctctgtcccattaagaaaaatactttttttttagtttttactccctcctccgtcctaaaataaaataaatgcagttttgcactattcacgtacaacgtttgaccgttcgtcctatttaatttttttttctatgattagtatttttattgctattagatgataaaatatgaatagtactttatgtgtgactaaatatttttaattttttcacaaaaatttcaaataagacgggcggtcaaacgttgggcacgaatatctatggttgcacttattttgggacagatgtagtatataatgttttgacactgtcttatttgaaaatttttatgattagtatttttattattattaaatgataaaacatgaaaatgtttgatttatcttcttcaatttttccatattttttaaaataaggtggtcagtcaaacggtgcaatgcatataaacgtttctttgtgggatggaagagtatagtgcaacgaatggccaagggacctgaaaaccgaaacgatcaaggtcgcagggttgaaacttgaaaggagaggctgaaatttggagtacacctggcagatccaccacggcgtatttgtttcagcggtccattcagacgtccaacaccaacagcacgttggccgcttaccaggactccaggagattttgcagatgtcaacactttgttacagcatgattagaattctatggaatcccatgttcttgatgcaggttagcaggcttttacgttaagcagcacagaaatactagtaacatgatctttatgtcactttggaagatgcatttgagacaaaagaaaaaaaaagaagaaaatatcaagtcaggttatcaaatttaaaaagattgacggtggcatataaaacctgttattgacacctgtgctgtaggtgttcgaccagaagaagaacacgactggaaaatagcaattcaaactatagtactaatcaagactgaagattaaaaacttgacctattcatatgtctgtttagaaattgaggtggaaggtctgacactggcagtttccaaaggacattttcagcagcgcaatgacaatttatttacaaaggcaaacattcctaaccttaatcagctaaaatccttcagccttctcttcagaacatccatggacctcttgcgagcatcctgcttgttgcggtttgaaaggcttccaaacaacccatctgcaaaatccttgtacttgtcacaaacgatggcaaccttcttgtagtctaatgacccatagttcctcccccttatcactggattcatgaaattctctggctggctgctaaggaggagattgactagctgcctatttcaaccaaacaatcggcgaatgttgtttccttacccaaatccaccaaa

SEQ ID NO: 45505 - DNA, 11715 bp, Oryza sativa
  unsure (1)..(11715): unsure at all n locations
atagagtccgagatgtggctcattgcaccagaaaccatcttgtatagagcttctagcggtaaaatctcctgcgctgttgatactagcgtttcaagatagataaggacctcattcatatattcatttggattatctggggcttcctccactatccagttgacatcgtccaagagcaccataaattcatcaatcttgaaattggccaaatttatcaaagagttatatgctgcattctgggaggcttttaagacagcttttgcagtcaaaccggaatgagatctctgcgcaatacgctttggaatgccacacagttgagcagaatacaagaggaacatatcgcaggattgctcaagaacagaaatatttcctgcaagttgcatcatctgtgacatggctaacgagcgagcataaaccatgttcagaagactatcatttaacacctcaatcaatagcctgtctaggtaacccttcacaatttcatagatgtttgtgcgagcactgtaagaaaaatagctgacagaatccccaatgaaggaccggacgatacgacaaatatctggaacaccagaggaaaatggagccacatatggaaactccgggactacatcatcaggttcaaaatggaatgccgtgacattcatgttatactcatattccttctttataatcatctgctcatatgagtcattagcaaggatatcatctatctgctttcgactctcaataagaagcaactggtggtatttgtctttgtatttcgcaatgacttgaatcaattgtgcgatttgatagccatacttactaacagttgtgcctaacaaagtgacataatctttaacgaggaggaggtggctggctatactcatgcgagcaaattgatcctccagtatagatgtgatcttagcaatagcagtctcccatgttgattcaacttggctttcagacaacaaaccatcagcacttcgaagtacacgttgttctacaatgaaaaatccagctacctgagcaagtaagggttgatgggactcaaggaagggttgagaggtggagatttgcatgtccaagttgagctgcattagcctattcttgtagtaataatctcgaaacttctccccaataccaaggcatatgtgcatgtgatgtgcccggtacactggcgtgagatcaaaatttagtgttgattcctcatctgtattctccacatccaaggtgtacacatgctcatcagatctagcatcactatgtgcttcagcctctctcttccgggcacgcatttcctcatctttttgtcgagccatagaggcctgacttattgagacctgtccaatctgcttagccatccttctgatatgaacaagccaatcattaaactcactgcaaactttcttctcaatgtgcatctttatcaatggtatatgttttgcaactaccttcttcagaagtttcaaaggaatatttttcaagtagcccttctcgatcgtgtcgagagtcttaagcgcaggatgaaacttagcttctgcaatataaccattgcatgccatgcataaactgatgactttcacacatatcttcaacgttgttatggcttctcctatgtttttcttaatcgaatataactcaaaaagctcatcaagattcaacaatgtggcactagaaaccttttgcaggtgtatgttctcaccagttagcatgccctttagctcatcagcatcaaccaacacaccacgtagttcatcgacggccaggatgaaatcctcgtaatgaagtctacaaagctcttcgatctcaacttcctttttctttacaatactcctgaggttttgcatgagagcttcaggtttaccagaatcaaatccatgccgaatgatagggcccaaatcttcaccatttgagataaataaagcaaggccaagaccaagacctccatctccactttctattacactcctcttctttggctgagcagtcatgattcaactgtaaaatgaaagcaacataggtaataaagttcagtagaggttggaaattaaaggtcatatgataagtactatcaattataatgtgtagcatgttcagacaaaataaagcaacggtcaggccagcagaagagcctatttgttacttccttcttttaacaacattgtcatgcttttttttttaaggttaacattgtcatgctcatcacgcagacagatcatgttgagttcagcattactttgaactaaacaagcatgaagatcactatacagtcactaaactagtatggaggtcgtcctacagatggtgatattcttgtcatatgaaatcctaaatatgagtacataatatgtacagtccacattacagaaatagatacggatcagcactaatttcgtgcatcctcccttccttggcatttggcagtaaggagcttggcaccttaacattgccccaggaaattttggaaagatctccatcatggcgctgcaactaattggcaacgaaaatggatgcaacaggagaatttcatagagaaacgcaagaattgaatttaaaaaatcacttcccaaaagtatggaagagaggacattgtacaaacagaatatacagggagatgaatagagaatctggagaggggtgggactaaaactaaactcaatgtgattatgcatggctaatttaaaccattattgctattactgtaacatgacagcatgtaaatcattgtcactatcatcaatggtcaatccccataccaattaagaaaataccatacactcaacaccaccaatcaattgaaatgacaccgcatatcaaagtaaccatgaagtatcatcttcgaaattgaacgtaacttgatttattcagattatataggttcgaattaacaagagaagacaggagggattacaaattacctgcttgtgacacgggaatcgtgcagaggttctcaacgagcaagcgatcaaacccaaacagaaaagaacagagagaaaagagtggtgtggggaatatcaaacgacgatgaaagaaagaatcacagggcaatagaaagagatccttgttatcacccaaggcgcagagggaagcaaaaccaatgcaagaacagagagctatcctatgaaattggctgtggctctctctctctctctctctcgctctgcatgcatgaaatggaatacaaaaatagtgagttagccgtgcctctctccgcggcagatcttgactccttaatagcaggaactaagggtgagtttgagagataggggattgagaagattgggaagatacgcaaaatgagataagccattagcgcatatattttactatagaaaatttttaaaaaaacgcatcgtttagtagtttggggagtgtgcgcggaaaacgtgttttctcaccctatctcacacaaacgaacacagcctaaataacgttgtcagatgcagttttttttttttttttgactaacctgtgatgtcgccacctatctagctgatgacgcggatctcaaaaaaccgccatccccatccgttccaccatccatgggtgagggtgaggtcgccgctgctcaccggactaccctggggctcgcgcccactcgccggggcgccgctcctctgcggtcgcaggcgtgaggacccaaaccatggcgccgctgctcctcgctcgcccgcggcacatcgcgctcgctggaccaaaacacgccacctgccgccgccgccgcccgcggccggcgcttcctcagatctccgagcgcaccggatgccgccgccgctcccccgagcgctccggctcgtcgtctgctggtaaactcggcgtcggcgtgcctctctaggatttaccgcagttgagcgttagattaaatctcagccacaaatccaagttgggacggctgtgattctccggatatttctttgcataaggcgtggcgtaggaagggtaattttatcatcctactccgattcctagtagtctcctagtgcaagttaaatcgagaaactgtaagaacccaacggcccatattaatgcccaccgatccctctgtctcgatcccacctccttcgtctccgccgccttttacttgctcgtcgcgtctctctcaacgttcatctgctcgaggtgcatacatgtgatttgctttgctcctttttcttttattgcccctgattctgattctcatatgaagacttgtcgatctaagctcatattttttagataataaaaataatttacatctccgatctctgctataagacacacaaccaataaattttagtacttgaaaataaagccgtaaagtgatgggataaaacccccagctccctttaaacaagtttaactaaaaacatcccaaaatcatagactactagtagattctagcacgtcatacagtaggtactacctcatccaaaatagaataaaaaccccttggctaccgattctaaaaatatagcaccactacacaatactaggatgatttaagttcatgtaggtgcatacatgctattgggaatggatttggctataagttgtaggcgtgggattgtggtggattggttctttttccgcaattagttttgtcgggtattatgcttttccgatttaaggtagaggtaggattggagatggattaatccttattttaccgctcatcgtatgctttttccggtttaagttggaccatgaaagaggaattgaatctttttgtgacttggtttcgaatttcagggtggttggagcattatgttggggtggaagggaaactacttccccaacgaaaagcggcgacacctttatcttgtacttgatgactggtcacggggatacagcattcgcaagatcgatttgtcggttggcaatgacggtgatggggagcacagcatgccaccggccatattcagtttcgaggcaccccgtgctggtcccaagtactttgctggtgcctttgactccaagattttggcaatgcagcccgtggatccccagttcagcttcaatcccatggctggtatccctatctatgacgttcgcatgcggagcctggtggttggccctcggcaaaggccggatccagttgaccccatctacatccctgttggtggaaggctctttgctctctctgtcggttcatttcagctgctctacccgccgccagatgacgagtctgatgatcaagaggaggaggaggactttgtatgggggtggcacgctcttcctaatcctccattccagcatgagcatgtcacctcctacgctgtgcacagggatgggcgaactatctttgtcagcattggcggtgagtcctctgccacctttagctttgacacagcggagtctgtgaggaatggttgtatgtggaagaaccatggccagtggcagctgccgttctccggtcgtgcttacttcatcgctgagttggacgcctgggttgggctcagcagaaaacctggcaccaccaccagttggcgcatatgctcaatggatgtgatatctgacgattgcgagaatggccaggcggtgaaatacaccagggaggaactagctactactgtgtctgatcatgagttggtcacgggtgtcaccctcgttagcatgggtggtggaagcaaattctgcgtcgtggagtgctgcctggatcactcagtctcggtgccgtttattcaattggtgacattttctatgatgtatggtaagaatggagaacttacgactggcaatagccgccaatttcgagagtacaaaaacattcctcaaggagttagtagtgaaatgcttgagaatcctgtggcattctggatgtagagaccttgataatgttttatactggtaccctagcgtgtctggaactctgaatccatgctactttataagagcaagtttaatagtgtagccaaatactagctccaaatcatttatagtcaatttaatagccaatagttacgtataaacatatactacactattgatatctggtctcacctgtcatacacacattgcgtcttgcagttcgtgctgcagatggctataaatatgtagcccgttgctcttctctctattcttttatcttctcgatatatgtatatagctaagttataatcagctattgtacttgctctaaatctgaggaaatttaactatttgccactcttgtgacatggcaattaacgatttgccacaccgtgtttatgacatgtgggccctcatgtgtctatgacatgtaggtctagtggcaaatcgttaagcaccactcgtaagagtggcaaatagttaaaagccccctaaatctgcatctctatctctactttatttagttaaaaaatgaaacatgtttgcatcatccgccaccgtatgcttgagtcatttgattttgcttcgtgttcaccttgcgcgtccacaacctccatccgattcttatcaatcaaaaagaaaacaggcataatcgcacccctaatcgcaccatcgagtagagaggggacggcacaagctggtggactcgcacccctaatcgccagtaacttccagcaaacgggcatatcatcatacagacagaaaataactcaaaaagaaatatgcatcttttgctgcaaaatttcaacatattaggaaatgctagcacagatatgatgtaaaattcagattaggctgagttgtactaccaaaataatatttcttttttttcttacaaaatttccaggctgtggtactcacatggtgcagcacttatttcaaccaagagaaggaaaacagcagctaatagtgtatcaccgtgttcaagctacaatagatgcaaaaaggggatcagagaatgccagtcagcgctatgatacaagtttgctggcttcctgtcatgggtttcctttccgtggataccgctacaaaaaaaaattgtccgcccagtgtaaatcagctgctcggaagtagagaagtccctctgagaatgcctgcaacataagctagataagagattatgatgacgctgaaccaatgcacattccgtggatgcttacaatgaaagatatctgaatacagatttgaacttatgtgattctgcctaacaaagcaaataaatataggtccgaaatatcctcccacattaacaacaaaatattcagtattcaaacaagtagatagaattccagcaaaaagagggggagagaggggatagaagccattcaattagtcaaagatgtcacttgactgaattttgctacatcttggcatgtgaaacaaccataaatcaacactacatttgaactatactgggcagtgggaacaagatattattgtgaagtaaacaagttatggacaatactatcattgctccacgatcaaatgtgcattgcaaagaccaagagcaagtgccagtgtaaatggactgtacttacctcctatctgtactagttctgagtaacaaccttatctttagattctacctggaatgcagaagggataacatgtaagcacaatataaacaaatagctacaggcaattctagttgaaaatggatagttttaagaaaatactatcattgtttaaagggtattatcctgcacctcatctgttgtgcttctccgaacttttctagttgcatttctcattgtgacaaattcctctgcagatgttgggtgaatgccaatagtggcatcaaaatcttgctttgtcagcccagctttaacagcaattgcaactccctgtcaaaatgtagtaaattcatcagcagtatgtcaggaataaagctgaaatggagagtaagaatataaaacaatgcagacctgaattatctcaggtgcgtcttcaccacacatgtgtactcctacaactttgtttgttgtagcacacacaatgagtttcatgaaaatgcgatcaggtaatccagagagagttgccctaagtggcctgaagtttgctgtatagatatcaacatctccatactcctcaatagcctgcacaaaatacaaatttaattgactttcttttgtgcatcactttatatagatgcgcgtcgtatgctatacctgctcttcagtaagaccaacttgtccgatgggtggttgggagaaaacggcagatggtacagctctgtcaaatttgtgcaattcacaatcaaggagcatccaatggaacaacaataaccaaaaccaaataaaatttaactgataaacagtgaaatactgaaatgaatcaataatttcagtacaaagtcagtcatggcctcctaggagcttcaaggactactagaacacatcacaaaaacaagaacatcacgacaaatgatcaataacaagataattctagataagcaagaaatcatccaaactaatctgtattagcatatcaaacatggaagtggaagaatggggtatttactcctcaaaatgttccactagagattactgcaagcataaaaatacacaggaatactagcatgtttaaacaaggaaatagaggttatatctgcaatcaagctattcaagcccatctcctgcaaattatacattaggatgtgaccaagtaacaaagttctctaatgaaatgcaacagagatacccgttcactgtcaaaaatatgcagctcaagtgtacactgtacagcaacaacaaacattccctcaaacatgcgatgtaactgaggtattcttgatagggatatcctacatacctgtaatctggtttggtaggttcatcaccaaacactgtttttgcaaatgcaccaccttccataagtgcaactggtgtcaggttgaccctatcagtaacatctcccactgcccaaattgaatcaactgaggttcgagaatactcatcaacctagcaaacataaatacagtgcagaagctcaacatgttaaagagtcgcaaagctgagaaactcgaagtcaagtatcacttgattgattgcttaacctaccattattgctccgttcttgtccaatttcaccccaacctcctctagtccaaggttctacaagttaaagaacaacatcagcaacaaaggatggatgcatcaacaaatggagatgcaagatctaacaaagtgaaaacaaaaggcgcatatggtgcagacctttgtgtttggtttacgacctgttgcgaacataacatgtgagaacccaccaatagtttctttgtttgtcttcagagatagcaaaccatcatttgatttggttatagcttgaggactctgttcagtatgaaatgtgatgccccttagagacatctgttcagcgatgaaatctctgacctgcaaatccacaaccgacaaaaataactccagtgaacagatcacttcatctactgtgaatatgattttgttgttcccaatatttgctcacctcttcatcaaaccctcttaaaactttcttctgccgaataaacacatgtacctcactttttaagccattgaaaattccagcaaactccagagcaatatatccacctcccactattgcaattttctcaggttttgaaggtagatccagtgcagcatcagaatctataacatgctctattcctgggatatttggcatcgatggtcgcccaccaacagctataagtatgttcctagcagtgtagagctttccatctacacttacagtatgtggatcaactatctgtactaagtaaacaaagttacatcaacagctgcaccttaccatagtatttgtttagggaaacagtctattcaaagtttaacttgatttacgaacatcacccaacctttccacggccttcaattagagtaactcctgagttgtttaaaatattcttgtaaatgccaacaaggcgctgcagctctgtatttttgttggcaatcagagtgttccagtcatgctttggatcagtttcatacacccacccaaagccatgagactcttcaaactcatgagagtacttggatccatacactaataatttctttggaacacacccacgaagcacacatctgtgacaaaaacaaataacagttcttatgcatatgcatatccttctaggcactggtattacagcaaggtggtagctattaaaagcatgcccatcttttaggcttcatatgctggtatgttatgccaaactgcttacatattattggaaatctattgtctaatattgtacagggtcattaaaacgcatgggtttagctctggtattcataatgattcaaattgtaaatcccagtaaatactgaaataagccacattatgccggtatagcagcgcaaatcgtgcattggagtcattgcgttgtatacattcaaacaatttcttcaataatactgaataagaaaccatataaaaccttgaaacttggtgagagcggtaaaggcaacaaatggtgcaaatgtaaattacttaaaagtactaataataacaaacaagtgcatatcactggaaacacacattccccaccagatttgtgcctctaacccctaaaatgagcaaacaccactgagataacagcccgtgaggatgttctcactcaaaagtaccccgttcaaatgcagtatatgatagtgagtaacaatgtacccaaccacaaaaattctctagaatgtagtaacaaaaatgagttagcgaagccattcctatcacaaaaacatcacagaacaaaacatcagcaaagatggaacccgcgacaaaattggaaatgattcctggctagtcattcacaaatcacaaggaagcgctccaattacggtgcatgcaaaaaagtaaagccaaaagccaacgatgctaagttgctaaccttcctacgaatcaaggggaaaatgtgatgaactaatagactagtctatatagtagcaagagaagcgtccacttacgtgccgccgactccaccgaggtcgtccgaggcgacggtggcgaagggcatctcgcagacggcggcgcgggcgccgtagagcgtggaggcgaagcgcgaggcccggaccccgccgctcccggcgccgatggtgaagaggtcgtagtcgtactccccctcggaggacgcgccgttgggcgccgcggacgccgagacgtggcggcgcgcgtgggggaggaggggaggtcgcgggagcgggagcctcgggagggcagcgagggaggggaggtggtggaggaagcggcggcggtggaggcggaggcggagggggatggtgcgggttagggtttggagggtggaggagcaggagaaggggagggtcgcggtcgtcgccatgcctctctcgcgcggtgccgccgctttgcttccgacttccgacagtgtggggcggagagaggagaagcgaaggcgatgatgtgtggagagtggagacgatgagcttgtttgattcctttttccgatcgaaggcgtatttgccactttacgtattcgaagagtggagctgtaaagcctgtatgactgaaggcgtcattccggacgatggtgaatagtttgaggctttgggcctgtttgcggaggttctgctgctggaaattctcctattagctgctactgctagaagcttcctaaacagtaaagattttcacttataagctgttactgctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45506 - DNA, 19858 bp, Oryza sativa
  unsure (1)..(19858): unsure at all n locations
ctactgtttacataaggacatttctgctcgatcagctatgtactactggcagcattcagctacctccatctgattactccatgctctcaaatcgtaacctccaacagattataggactcaaacagctcagtgactacagatgattcgaccgaagtcgcatacaaatgggtgtgagattgtgagagaatggtcaaatttacttggtatacgagtaaaataatctgaactccgaagcatgttttgaggagggaagaagtgagattagcaccgagaagagtgagcttttgcagagcaaggagtagtaggtaggacaagtggtgacggggagatgagcccactgtctcagagctcacatctcacaggctcacagggtcgcagtgatgagctgccatctttgtactgttccagtgtttctactcctcttgcccccacacgggcacactctttttcaactcctctctttctctctctacgagcaactactacggggttgagagagagagagagagagagagagagagagagagagaatggccattataatagagccataggccaaaagctcaactgcactgagagcagcatcagcagcagttcactgtcactcttcccaagaacgggtgccaaggaatcctagaatccaagaaaggcagcagctgctgcagcaagaacagcacagggggagaggtggtggtggtggtggtggggaagaagaccacacacattcggctgggtggtggtcttcttcttctgctgctgctgccgctgttgccgcttgttggagtgaggagagtgggtgagtgatggggagggggtgcctggctgcgctgctcggcggcgcggtggcggtggccgtgctggtcgccgtcgtccactgcgcggtgacgtacgacaagaaggcggtgctcgtcgacggccagaggaggattctcttctccggatccatacattacccgaggagcacacccgaagtatgtagtagtagtaacagcattcttcaagaatgtgtggttttttttgggacatttcgtggaggggagtttctttttgggggttgttcgtggcgtgggctggcggtttcttggtggaaatgccatggaaagcgaggagctttgttctagctttgttggaggtttttcctttcggcatcagattattcgccaaccatttttttttctgaacgaaatgagggggttcttgaggtttttcttgaaaatgctgctcttttggtctgctcctgcaaccattttgggatttttgttgctctgcaatggtgatatgttcatgttccaagctataattttttgggggtaaaaagagatgagcttgtttggtctcgaatcttttggtgctgtactgatttttcttcgtgtaaatatttgtcagatgtgggacgggctaattgagaaggctaaagatggaggcttggatgtgatccagacctatgtcttttggaatgggcatgaaccaactcctggaaatgtactgtctctttcattattaaccccattttttaacagtgtaatggcacatcagggatttcaatggtttttgctggcttcgtgcagtacaattttgaagggaggtacgatctggtcaggttcatcaagactgtccagaaggctggcatgtttgttcatctccgcatcggtccctacatttgtggagagtggaattttgggtattcctcaagccttaatttgaccgtagtaaaaacacacaaatgttcttttttttcaccattttctgttccttgtatgtccatattttactttcgtttcatgacttctgttgccatgtaaatttgcagtggatttccagtttggttgaagtatgtaccaggcatcagcttcaggacggacaatgaacctttcaaggtttgtggaagtatttcagcatttctggatcttaccagaggtgtaaatcttgttcatatgtgtttctgacttgagttttgctttgcagaatgcaatgcaggggttcacagagaaaattgtgggcatgatgaagagtgaaaacctctttgcttcacaaggcggtcctattatcctctctcaggcaagtgcaaaactttgcttcccatgtcatgtatattttttttagagagagggcctcaaccatgtcatgtatatggatgcaagcacattgtataacattgggttagtacgtagtagtggttgagtaatgtgttgtttgcacgattcatcttagcctgcacattttcctgggttgctcatggtgcggtgggtgttattgtttggacacagattgagaacgagtatgggccagaaggtaaagagtttggggctgccggcaaggcatatatcaactgggcggcaaagatggccgtgggattggacaccggtgtgccgtgggtgatgtgcaaggaggatgacgcacctgacccagtggtatgatgatcttatcctctgtcaaatactaccaccatcaggtgtaaattgtgaaactataccgaacatgttaatacaattatacaacgatacaggacatgctgattcgtatttttgcgagttcagtgggttatctccataagaggtcatgattggtgttctaggtttctagcatatgtatgagcatatttgtcgcctactcatatatcaaacatatattagaagaagaaaaattgacgccaaccacattgattttgatcttgtgaaatttcagtcgtggaatatacaaatatctcatgacttctgtacgaacaaattattgaaattacatttaacctctgttctttaaacagatcaatgcatgcaatggtttctattgtgacacattttctcctaacaagccttacaagcctacgatgtggactgaagcttggagtggatggtaattttttttccccgaggaaccaatatctagtgttgcaagcacaatcccagtacttccattgatgtggttcatgtttatataattgattctgttgattcatagtggtagtataattgctccaatatgcaaaataattcaggtttactgaattcggaggaaccatccgtcaacgaccagttgaagatctcgcatttggtgttgctcgcttcgtacagaagggtggttcttttatcaactactacatggtatgacagatagaggctcacttatgttttctttaagcttcctaaagggtgatactcattcttgttggttaattgattttccctcaactgtaaaagtatcatggaggaacgaattttggtcgcacggctggaggtccctttatcaccacgagctatgattatgatgctccacttgatgaatatggtgagttacaaggaatatgcttagagacgttttctgtattgagcatgatttataagtgcccttatcaatattatcatcttctgctgctgttatttctctacactatgagcatatttgcagcttttcaagcattaagagtggatcttttttaaaaaaataaaattcagctacaccactatattcttcttactcaatccttttcttgtggggctaatacacaggacttgcaagggaaccaaagtttgggcaccttaaagaactccatagagctgttaagttatgtgagcagcctttggtttctgccgatccaactgtgactacccttggaagtatgcaagaggtctgttgtgattaccctttcctctcagtgaagtatatatatcttaaccagcttgatgtttcatttacatattgaatttatacttcaggcccatgtgttccgatcttcctctggctgtgcagctttccttgcaaactacaattctaactcgtatgccaaagttatcttcaacaatgaaaattacagccttccaccttggtcaatcagcatccttcctgattgcaaaaatgttgtttttaacactgcaacagtaagtttggcatatgcttatcccattatagcatggtttcaattctgtatcccttttacctggatcaagtatatgatgactttgcttacctgattcaaactgttgtaatctccacaggttggtgttcagacaaatcaaatgcaaatgtgggcagacggggcttcttcaatgatgtgggagaagtatgatgaggaggttgattcattggcagctgctccattgctcacgtcaactggtctacttgagcagcttaatgtcacaagagacaccagtgattacctctggtacattacgaggtaatgccagtcgataagttgcactttgcacgtaaaaattgcaatgtacataacgatgaatctgggaaatggtgactattagaaccccttgttcgctgaactttgcattgattttctgattatggcaattgagaaggtgtcctttgttctaaattttagttttcacagaagtaacgattttctaaaattatttcatcaccattgacagtgtggaggtagacccatctgagaagtttctacaaggtggcacgcctctgtcactcactgtgcagtctgctggccatgcgctgcatgtcttcatcaatgggcaactccaaggtttctacttgaaaatgctccccagtctatagagtattaatgtagtaaaaacttagtgaacaaaataacccgcaaaagaagtaatgaataaaatgattataattcccttttgtaggttctgcctatggaaccagggaagatcggaaaatctcatatagtggcaatgctaaccttcgtgctggtacaaacaaagttgcactgttgagtgttgcttgtggactgccggttcgtgctctcatctctgcatgaatttgtacatgtttacagcaaatgatcaattgtatgagttggatttttcttgtcctgctatatagaatgtcggagtgcattatgagacgtggaacactggtgttgttggtcctgttgtgattcacgggttggacgaaggttcaagagatctgacttggcagacttggtcctatcaggtatattcagcatactggtagcctggtgcgagttaacgtaagaatgaataaacatgtgacttcttccattccaggttggcctgaaaggtgaacagatgaatctaaactccttagaaggctcaggctcagttgaatggatgcaaggatcattggtagcacaaaaccaacaaccgttggcatggtatagggtatggacaattaaccttgccataatcatttgatgattacttgcctcccattcttacgatagtttgtttttgtaggcatactttgatactcccagtggtgacgagccactggctctggatatgggcagcatgggtaagggtcaaatatggataaatgggcaaagcattggacggtactggacagcatatgcggaaggtgactgcaaaggttgccattacactgggtcatacagggcacccaagtgtcaggcaggttgtggtcagcctacacagcgctggtaagaacattcacaacaatatttgaattttctggcacctcttgccttctcttttgctgtacacaaaaccatcatgtactacttgatatttggttccttttcccttgtccattaaaactggagtgctccatcacatccctttttggttctattgtctagtcagtggagtactatattaacaataaaaattgaactcttgcattcaggtatcatgtgccaagatcctggttgcaaccaactagaaatctgctagtggtttttgaggaacttggcggtgattcttcaaagattgcccttgcgaagcggacagtctcaggtgtctgtgctgatgtatctgaatatcatccaaatatcaagaactggcagatcgagagctatggggaaccagagttccacacggcaaaggtgcatttaaaatgtgcacctgggcagaccatttctgcaatcaaatttgctagctttgggacacctcttggaacttgcggaacattccagcaaggggagtgccattcaattaactcaaactctgttcttgaaaaggtgagaacgctgtttggtcattttggtctacctgaaatttttttcttaaaataatgtggactacctgcacctggacagaaagacccttcgcagcaaattaaccctgttcaaaccacttgaattttttatcattttgcaaagaaactataatcactgcaattagtccatgaacttaccacacatatcactgattttttctggtgcttatttgaatagaaatgcattggactacaaagatgtgtcgtcgcaatctctcccagcaactttggtggagatccctgcccggaggtgatgaaaagggtggcggttgaggcggtatgctctaccgctgcatagggcaatttctttgccgagacgaatttagagatggcaccaaacaggtgggcttgtgcttgatcaaagcacacagaaagcgatgcagagtagagttcaactgtaaagtatcgacgccacatagctgtggctggaggattagagatcgattctagcattcactcagtcgaatttcagattagaggattctaactctactgcatctccatgaattgttcagagtgaccaactgctaattgaagttggtcctgggatggagtgcagggagagtaaaggcaaaagattggtgcattcttttgctcgcgttagtgtgcgtgttgtgttgtttcatctttcttgaaaggaagaaagatgccgatgaattgtgcatgtatcccatatgaggaatcgttgattgtgcagtgagcatgatatgctgcagaacaattgctcgtgtcatattctgaagttcagaaaagaggttgtcaatttatcttcttcagataaaccatataattcttgtgatgaggcctgagggagatttatgccacagacatatgccgcactagaaaacaatttaatcgttttaaggtaggaaagataccattgttgttttttcctccccaaagtattttttgtctgaaagtatgaaatgtggatgatgtattcagatagcatagggtaccttgtcaccaactgagctcaataattgaacttgcatttctggcaatgaaaatgggggagttttccctttcacaacagtaaaaaaaacggagaacaattgagctcaatctggccggcagcgtgctaggcatgatgcttgcggctcaatgactgacaaaacattatcctgaatgaaattgtggaccttgccccttccggaactgatgaccacatgaattattaacagttgagaacataggggcatgaatgcagcaatagctcccaacagtaatgaaacaagtagtaataattttgcatctcatatatgggacaccccccggtgcacattcagaaacgaacaaatgattgtgctaaagaaatactgccacagccaaaccgacattcacgcggccaaaaaaaagagagaagaagatgcagagtaaccacaagacattcattcagctctgaacaacaatatattagtgctaaaatggaagagcaaacaaatgcagcgtaaacaacaatcagcaagcaactgtctctctctgattaactgatctgataaaggtctagaaccataaactaggggtttagaaaacgtatcctgtcagtcagaaaagcagatgtcgcgcgtcccgttgcgcgcagcaaatctgcagcgcaggggcaatccaataataaaaggagcttcctttttgacgatgtgctccccctacccttcgacctcgcctgtcggctgactgggatgcggctaccgacgcccgcccgatctcctgaatgttttttcgaggttatttcgtcatgaatttgctctccaatctgagtgatatggtatccaaaatcagtgcagaatggcatggcaaatccacggcttcgacgacgccagcgaatgttgcatgttattgatgcataagggcattagggcagcacatttggcatctggaactggtcgaccgagctagattgaaatgtcgttgtttgtgcagtgagcatagcatcggttcgttggattgcatactgcaagtctgcgatgacggtgcatttcaacggccaatgtcagctgcgataggattcaacggctgcttgcatccatctcagatggtttcgatagagaagcactgtatcgtctcgaatttgagtgatggtacccaaaaaaacgatgaagaaaatcttatgtggtaatctttgttgctgctctacctccatgttgccacgacaagtcgaaaacaagcgagaaaacaagggggacggagaattgaactccgaccccctaccgtcgcgaatcatgtgctgcctttcctttcgtcttcgcgcgtctgttttgggccgtttcacggacaacggcatgtcaaatccacggcctttctcgtgctcgtgccaaggcctccaggcgttacacgctcgtcatcggcccaagcagcaagccaccggcccaccgctcctctttccctacttcgccgagcccaagcgccgccgtcttcgacgacgccaacaaacgccgcagaaaacgagatttggggcctgttcactttgttgcaaaaaaaaaaaaaaccttaccaaattttaacaatgtcaaaattttgacaggatttcttatatagttatcaaaatttaacagcaaactaaatgtagctacttttttgataactttaccaaaatttggtaaggttgaaaatgacatcaaaatgaaaagggccttgaagtgagagatgtacctccaaacaatttttaatagaaaattgtgagtgtgtttaggattgatcacgggatcttggagttgaaagatcatgggcagcacagcacagtatcggttcattggattgcacactgcaaacctgtgatgagtgcgcatcatcaatggccaatgaccaggatgactggtgtagtagtaccacgtcttgcatctcagatatgtctgatgtctctaattcgctcgaaacaaatgtagaaatcttaggtgcacaatggtgatgattcctgttgcagctagccagcgatcttaccgttgccttgaaaaataacgataatattgagaaaacagggggttcggagaactaaactccgaacaccacccgcgccgtgtatttgggccgtctcacgaagatgtcattgcaaaatggaataagttcacttttactcctttaaaagttgtcttaatctaatccatgatcctaactgtaaaaccggatatctccacccccgaactactgaaaccggtgcaatttaactcccttggtggttttaaatggcggtttcgctgatgtggcgtctatgtgatagtgttgacctagtctgtggcattgacgtggagtttaggtggcattagagttaaaaacatatatgtgggacccatttatcattcacacaaacaaaattatagggcccactgacatgtggaccctacatgtcatcctctctctcttcttcctccctctctttcccttctctctctccacttcggccttctgcaagaggcgatggcggcagcggcagcgacggcggcggtggcgcgagggtaggcgctggaggcactggagcggtggcggcgacggacggggaccggagtggcggcggcgcttcgggctagagttggcgtggatggaggcggaggcggcgacagaggagatggcaggcggtcgagggccggagcgacggcgggtcggcggagagcctggcggccggtggtggctagcggggagagagctagtggcgaaggccgcccccatcttcctccctcctcgccgggctccgcacgcacctgccccgatcggtggagcggattacgcggttgggtccgtaccacgggctgccaaaggcggacggcttgggcttcgcggcggacttacggatggtgatgcgggcctcgccgaagagggatgtggacgccgcgcgaccattactgcggaggagagcgccgtggcgagtgagtgagcatctgagttgctccacggctctggggtctacgccggcggctgtggtggcacggcggcgggtggccatggcgagttgttcgggccttgcctgcctgccgccgctcccgcccgccgatgcacggctttccgtcggggcccagctcccttgacccttgatgccgtcgcctgttgccgcccgccgctgtgcgcccttcgttgccatcgagccgctaccctcgtttctgtcggatgaaggtgaatagaaaggggagaagaagagagagataagggagagggagggaggaggtggggctcacaatattgtttgtgtcaatgacaactgggtcccgcatatatttttaaattctaataccatataagcaccacttcaacaccacgtcggacgaaaactaagtcaacactgtcacgtagtcgccacgtcagcgaaaccaccctccaaaatcacccggagagtcaaattgcaccggttttaacactttagggtcaagatttttggttttgtgattcaggatcacggattagattttagttacttttaaggaaatccaagtgaacttctccttgcaaaatccacggccttccgctcggtcgggtccatgcgcacacccgcgcgtcgtcgtcggcccaaccaaacaccccaaaaaaccaccgaaatctcacgaggcggcaacgcatcaaccccagtgcccgtgtgcggccgtgccccgcgcccgcgcggctgtgccgtggcgggctcgcggcacggcacggtgacgcgcgaccgtacgtgcagccactcgctcgacacggctgcctgcctgcccacctccaagtacatttaacgtcacctccatcctcacacatggactgtcctcccacctgtctcccgccatcgtctcgccgccgcttctccctctccctctctctctactcatcatgtgtgcggatgcgtcgcccatgcatccatcgccaaaattattggtcacctgatgaccgattctctcctgtgatttcagtgcagtttcagcgagatcgatctacctttccgggacgcctccatgcctgtggcttggttgacgatcaaagcgtgtgcgtgccgacgctttatggaaagtacgagatcttgatagcaaagcgcagagagagaaaaaagttgggaaaaaaaagggggaagaggacgatgctggatgacggaataaagatgcaattctcgattagattagatggatagagtgatagatagatagatagattgatagatactattgttttttgtctctctctcggacactcttggcctacctacctcctgttcatcatcagtcgggagaggcaaaagctacgaaagccatctgtccccagctaagctctgcttttgcaaactgcaattgcaatcgcagtgtagtgtggagtgtgtgctctgcctgtcttgtagccataggcacacaagaatgtggttgttgatctggatcgcaaggcctgatcgtatcggagtaacggaatgtgacatcaaaaggcgacgacgcatagaaaaatatctcgccgtctgattttttttttactttacctttgcatcttctcttctctgtcccatcctgctcatatttcaccacctcgtgcagactggaactgaattctgtatagatcctgcatgataaagagttcagtttgtatatgctgctcatgaactaagccgtacctgtacgtacgcaaccggatcaatcatagaatttaagttccaagtgatcacaatatcagttgctacctcgggatgcagtcttgcaggctccattggtactttatgctactatatagatagatgcctagatggtcaatgtttatctgccaattctaccaccatctgaatgtatatatatacaatcagccagaataaatagttgtggcacatgaacaaacaatcattggcaactgatgtgaacgatgatgatccacagatcgaacagctgctggaacccggttggctatctccactagtagcaacttccacaaggctgcttcggcgaaaaagaaaagaagaagtcagaaaaagacgacaagagaaacaacccaactgcaaggtgatgaccatctagacagacagggttaggtagtgcgcttgctcagcagctaaaatgttaatggcatcatcacccgtgcgcgtttcacgtgacttgacatggaaaattcttctttatcccccgttcggtagagaaccattttctgaacgcatttcctttttgttcttgtcctcatttaaagattacaacgtgcagtttttaatttcaatatcaattaaattgttaataagaggtgcatatgctccttgttaatcccaatccgtccttaacaatgttgatctgggttagttgcatcgtgattacctccgtaattttcctaaaattattggaccttttgtctgaactcagctgtcgttcatctagcgtgaaactgccacttgttcgtcaggtagctcctctcttctcttcttcctatcctatctttccgtttgattttgacagccttgtgttcgcatgcagcgatgattggccacattcagactcttgccaattgtcctgaacagcgttctcttctatggactggtcttgaacagtctctgaaagtagcagaagtttattctctattatcctacagtatctcagatgaaaaataatcattagaaacttctgttggttataggacaccacaccgttctaacagtgtagcagaagagattggcgaatcatgtatcgacacggcgaattaagatagtcccaatcacctaattccagtgacgatccaacagaattgaggtcagcttgataaagaaaagtaaagtggacaaggtgagtgtaatcacagaaacgtaagtacatgaggaccctgatgcaattgcgttgggtggcacaggccgatcgatctgaatgagtctgaaacttcttcggtcctttttcttttgagggaaacaggagaggagacccctcttcgtttcaggaaccgacatgctagtatctgttagtagctggggtgatccaacctgatgggatgtctataactaaatgtgatatgacctgtgtttcttgaaaagtaaggattgtgaactacacatttctgattgttatgggcctgtccctctaaaatggagtactactctctgtcttgaatatagtcgcaaatgaataatatgtgtatcttctcctctttgtaactgtaaggttgtgggttcgcgaaaaagaagtgaggttgtaaatttcaaactagaattgtaaatgtggaattaaattcgcccaaatctatgaagatccctgtcatggcattattgaatagatttgtagtccattgaagactaattcgtttccttgtacagtaacgagacttctaggtaacacaatcagatactgtgtaaaaaaaataaatgagatgtgacctgtgtttcttgatagtaaagacatgctaatgacattctcaacgatttcctaatagcttgaacaaaacaaacctcatgatgaaactgaaattactaaattatttataatttttctgagaatcatatgccttagaatacattccatgaaaattgtgaacagtcacagagacaacaatacgcattccttgtccgactgcatgactctaccctattatggttcaaatcccaatgtctacaaatatggttttgtgcatccttattcggtatagaggctagaaataatcctctttttctttaaaaaaaatgcgttggttgtcaattatactcagctataataatcgcattttttcgccgaatctcgtctcttcgaagttggcccacatgtcagcgagaggcacctgcaaagcaaaggcaaggagttgggaggtcaaattcattattggaggggaccatgaagacacttgtccttgcacatcactacctcatgcccaatttctaaagcaagtgtgtgccaccaaactgaaataaagttgagcattagttttgtggccttgggggcctcctgttgcacttttaactagaaatgaaaagaaatgagagattttgggcaatgcaaatgtatatatgcagtacatttttttgcacttcgtcctgtgagatgtctgcatcctccccctatgcaaattgctaaggagcatctcatgatcagttggagagattggaaggttcagaagggaaaagagggtttaggtctaccaactggttgttagcagactaatacgtcttaacagatgccgtcacctactccgagtgatcggcctcctagcaatcaagaaccacctaaatatggcaagctgggttagaattcaggtaaaaacacaccaagcaagtgataactgaattgcacctactctatttgaatgcacagagtgaactaactgaactgctcaacaagtactgtttgctgtaagcgcaaactcaagaagagtaaaaactgagagtttttagactgactcctttttgtgctactgtcagtggatgaactgagttaattcattggaaaaatcattactacttgattgttcagtcaaaaaaattgaaagtgaaagaatccactagaatttgcggctagctccatgtacagactacaaaccaaattgcaagttcagattgagcgttggatgatccagggatactgcaatagttgcattcagtcaatctcgtccgttcaatttcctgctgcatgttcgactgctacagccgatgaaaattccagtgaatccacgagttgaaacctaagtgagaaaatgagggagcggggaaagagatagagaagaataatcgaaaggaaacagacaaaatggtggtggggtttctttaggatttgtagggagatagtgttaggcagcgccttattggtggcagccgtatattattgctcaaggaaagagtgaggagttagaacaactctagtgtagcctacagagtgaaaccaaaagagagaaggaaaaaaaataacaaaaaggagtagatgcagttttagttcttattattctaatcttctctcttgttgcaatttctttttagaatccttgggatcatctctgtccccgttctgggtggtttctgtcatactccaggaactgtcttgttctagctctttgcttggtctgaaagtcgatttctgcacaggtatatagccttatcctatcaggtttaacgttgttctttggttgcatcagtttgtctttgagtttgatctgagaaaaccaaaaggaattatctttttgggcttgattggtgttcatatgaattcttggtattgtcttctgccttcttgcttgttgaactttccgtttcttgttagctcctttgtggttggttggtgtgccaactgaaaagattgcttcttgttacgtagattattgttgagattgttttctgaatttctcaagcagcggtgagtttttgttgaaattgagctgaatttctctgaaaccaactatttctggatgcattcgtttttgtagcttgctgagaaattcagactcctttttttccttttcatgatttcacaagtactggtttgaactgctattttgttcgcattagatgctgaatttatcaaattgcaggtactgcgaaagctttgggaatagtattgcagaaagcgcagcaatctgaagcttactgtccaaggtagacagctgacataagcagtttagcacttgagctatgttggattcacttcctcgtcttcctgacatattccagtttttcctctcttctttcaagaatcggaattacttcagttgtactaggaattctgaacttcgtttgtagttgctgtctgaatttgtggctactgtttactactggactcatcgtcacgtctctgacaaaactcagtacaccatgttgatgcacgagatgtttttgctcctattaaatcttctgtggttttttctctgaaacgtctgactcaagtatgaatgttactagaaagcaacaacctaaaatcagattgcagcaatccagcagtctgaatttactacctgaaatcatctcaaagacgaattggtactactagttttgaatcctcactcgttttttttgttctcttttgcagccagtttgcagctgaagccaaagactgaatctttcatcagggtttgataatatcaaatacccttgtgatgacagagttaatcagtttgtctcgtcatctacgtgatgattcttcttcagtctgtctcttcttctgcttctgaagacgatggccacattcttctcctcttccaccaatcagagagacctcaccggcggcggcggcgacggaggcgacatgtcgttccagcactacccaccgccgtctaacccttactcggactcgtcggccggcggcctgatcccgctcccggcgagcatcgtgtcgcatagccacattgcgcacggcggcggcgacgagccggcggcgttcagggaagcggcgacggcggacggcggcgagatgggcctgcagacgcagctgctcatggcgcacggcgcggcggcgcggggacaccagggcgggctatcgcttagcctcggcacgcaggtgccggtgtctctctaccagtacaggccggcgggcatggcggccgcctcgctgctcagcccgagccagtcgtcgccgatggcggggaggagcgcgcagaacagcatctacgtgcagaactcgaggtttctcagggcggcgcgcgagctgctcgacgaggttgtcaatgtccgcgacgcgatcaagcggaagggtgacaagaaccagggcaaggattccggcgagtgcaagggcggtgacgccgccggcgacgacaaggccggctcgaacccgcaggagcaggagagcaattcagcccccgagctctcgccgtcggagaggcaggatctccagaacaaggtcaccgcgctcatggccatgctcgatcaggtaatgcctcgatctccatgactccatgtcacttccgaacaagaagaacgtgctcgtcaatggaggttttgttgcgttgtggcgcgcgcggcaggttgatcggaggtacaggcacnnnnnnnnnnnnnnnnnnnnnnnnnngtcgtcgttcgacgcggtggccggcggcggcgcggcgaggccgtacacggcgctggcgctgcagacgatctcccgccacttccggtcgctgcgggacgcgatcggcgcgcaggcgcaggcggcgcggcggggcctcggcgagcaggacgcgtcggcgcagggcggcggcggcctctcccggctgcgctacatcgaccagcagctgcggcagcagcgcgccatgcagcagttcggcatgatgcagcagccgcagcacgcgtggcgcccccagcgcggcctcccggagtccgccgtctccgtcctccgcgcctggctcttcgagcacttcctccacccgtaagaaccacctccgccgtcatccatgtcgatcgatcgatctcaatctaatcctcaccaatggcgccatgaatatccataggtatccgaaagattccgagaagctgatgcttgcgaggcagacgggattgtccagggggcaggtgagattgagctccatgaactcgacgctctcatgcaaagctgatggattcaaatcaagaagagaattccatggttttttttttctttttttacgtaggtatcgaactggttcatcaacgcgcgcgtgcggctgtggaagccaatgatcgaggagatgtacaaggaggagttcggcgcggagatggactccaactcgtcgtcggagaacggcggcggcggcggcggcaagggcaaggacgaggcgatctcgtcggaggaccgcgacgagttccagagcccgtcgagcgccgccgcggcgaggcacgccggcgtcgcgggccagctcaacaacccgttcaagtcggaggcgatgggcggcgccgccctggacgtcggcgtcggcgtcgtcggcctgtccagctgcctcggcggcgccatgggcacgtacgccaccggcctcaacctgaaccaccacgtgcaccaccccggcgccggcggcaccagcctactgcacgacgcgctgcaccaccaccaccacggcggcggcggcgacgccaggttcgtctcctacggcgacatggccgacctcggcggcggcggcggctacgacggcggcagcgtgtcgctgacgctgggcctgcagcactgcaacaacgccggccccgtcccggccgagcagcagggcctgctctacggcagcgccggcgacttcgactacatcaacggctccgacgaccggcagcggttcggcccggcgtcgcagctgctgcacgatttcgtcgcgtgatcaaagcacggcgcgcgatggatgcatcgtctgcggcggcggcggcggcggcggggaataacgcaagacggcgtcagaagcctgggccggccggccggcgccgtcggcgagggtatacaggtatacaagcaatatacacgtacactcgtgtgttgtgttgggggggtaagtaaagtgatcgaagtaggggtgatcaggggtgtaattgtaaaactgtatatgagaagggggtgtagcttgctgtaaagatagattggtatttttgctagcttgcagatttctctactgattgatgcatggatcattcatatatatatatgtggtgatgtgttgggtcagattggaccagatgttcaatggattactgtgaattgcagctacaaatgtttcatgttttgtaccagatgttataaagcaatgcagataggaggggggggggggggggtgtatgagttttgtaacacttttttttactgcaagttcatgatctgaacttctgaagatgcatgagacagattgaaccaagcacacaccatgaaaaatttcagaagaaactcagaagcaaatataagtgcaatagtcattttaatggtcatatatcaaactggcagtacttgaatacaagagaatctcattatgtccaggaacttataatgcgaaaggtcaatcaaaagcatcttaattcttacacttgataactagtatatgtagtgtgccccattttgcattagtattcaacttagcatgctgcataccatctgccaaacacttcaaaagatcacagaaaacttgctcaggttgtttttaattcctccccctagttcttcgtcacatgttggtcactggtcagcattcaatggtggtattcacctacaaaaaaaatgtgaaggacggagatcagattatgatctaatcagacttcagaatcatactaatcattgagatatacctttttaatagggctttgatatcttgtttcaatgcagagctttcaaggaacctgtcctcgctatctgaaacatccaccgttgcgagctcaaaatcatcactgctgcagagctcattccactcgaaccacagcttcgacactcgttctttcttgaaggcggtgtggtgatcatcctcctcaggcgaatcagcagcgacgaggcggtagcaatacaccattttagactgtcctggcctataggcacggccaatcgcctggcgcatcactgaagggttctcatggacatccaagatcactatacgagacgcgccaacgagggagatgccctcgccacatgccttgatggagccaaagaagactctagcatctggtgagttgttgaatctatggactgcttgctcacgctgatcctgagttgagccaccagtaaccctgaaaatatgtacctctgatttccatcctttcattctactgaccagcttttccaagaaaatcaaagagcgcacatactggctgaacacgagtaccttccctcccgtggcttctgaaagagacaacagattgtgtacaaacttggccttcaccccgtcgttgatatcaattccggatatgatggaaccgatcttcctattggtgacatttccatcatctgcatcagctttattggcattcttcaagcatggatgaagagaaacggcattgcatctcgagcgtttcgcaaatttatttattccatccaagcccttaataatatgttcctgtttgctactcatattgagaaaaactgtaaagtccacaattccaggtagctcatccaaaagcttg

SEQ ID NO: 45507 - DNA, 9359 bp, Oryza sativa
  unsure (1)..(9359): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtctcccgacgtggctgatccccacgggctgggtgatccgggttagtaatgtcgtgtgggtaaagtgtaccccctctgcagaggttaacaaactgttcgaacagccatgcccacggtcatgggtggatgtgaggtgattcctagcgtagttttgtttgactactgtttgtgaaattgctgttgtggaaaggagatcgatgtttggaaaaatctgcaactgatgggatcagctaggcccgggtggccgtttgaaagctgttggccgggtgccaatcttgatctattttaaagattgatacattgcacatactccgaccggacgagacgcactgtcttaaccgtgtcgtttgagaagcactcacttagttgattttttttaaaagagttcaaataaaataaattgcaaaaacaacagtccttcccttgaagcctgcattaaacactatttcccatggcttgctgagtactcctgtactcacccttgctctatataaataatcccccccagttgctgaagaagatgaagcggatctcgctgacgaggagtttttccaggagcaagccggctacgatgagttttagggtttcggcctagttcccaagtcgcgcctgtgttgtttggcccaagtcttggcttccgcttcccttttataatgcagttgtgagcttgggatctgtccgcagcccaacatgactgtactcctactctataataaagagacctctgttgttgtgatattccgtcttcctgtgataccagcactgtttcctgggactggtatcgattaacaggttaatttagagcgtcacgggctagttccggtcggtactagttcggggcgtgacaaagaacgagagggaaaaaaaaaagaaagaacagacaatctccgcgatttgggtatggtactagctagcaagattagattgtggggaagaaagagtaccagcacgtagcagcaacaaaccgattcgatctgctttgcggtaaatccagggagcgtccggcctgctgcaggataaagatggtatcacaacttcacaagttgtgcaaatatcaaagatgaacaacgagaaaatgaagaataaattggctttccaacggagaggataaagatacaatcagatgtagcagcagcggacctggggcgctcggttggaaggggcacggcgtagctccccagtgcccggccggagaaggagatggggatggatttctaggtctggacgtctggagtttggacgcctcgggactatatagtaaaaaacacagataaggtcatcagatgtagtaaaataagaagagggaaattaagattcaatgaaaacgagaggtggcctttgcgaaattgtgagcaagaagagagtacctgtaacctgtcactactactactacgtacgagcacagcaccacgcagcagcaaattaaaccgaatcgagcagcaagcaaaggccgtggctctcaccggtggccggcggcaaggatggcggcgcggaaggggcgagggagatgggtataaacgaacgaacacgttgtccgtggggccgcccgagtgggcctgggctaagtaggttaaaggaaacggcttcatgggcctttttttttttttctggtttcttagggtggtggtccgtacttttctaacctggttgggaagaacagataaacgactagtatatatgcttttgaagtgtactggagatacgttgaaacaaaaaggcaacagaactaactatatagtgatatcagtctagttattgccaagagctgaatgctgatatgccaacttggctcagagcaatcttttgctattctaaatttctaatctgtactgccaatgatgtcttattttctttgtacgtttccattagctgtggagctaggcaggttaaatgtacgagtaataactgactaattattgtgttatgtgggacagatccacaagtgaatatatagctgagctacatatagttagtacccccaaccatgcaagagattgagacattggcatgtaacaaaaacgacgacaattctcgagccaattgctgtgcgatatgaaatcgtgatcgatgttggcgcaagcacaaaccgcttgggttttttttttctgggggaggggggggggggcagaaataatgatcagcatgactttatcctacagtactcctgggcatggaagacgtcggaaattcagttgccctcgatcggatgccatgctgcttggcgttgctctgcttggagcgccgcgcttcaacagacagcacagcttgtgcaacgtctactgcttcctgggtgtttcagctcagcttacctgctcgtgcatcacacgcagagcactgctagttacgtagaatctgtagttcgctgtctgattctagcggagtatggctccctctagagatgatgaagactctagctctgcttggggatgattggatcattggactgatctgatggtttgttctatctttagctgtattttgactgttatgtttctcctgttgagtttacacgacggagaaaataacaagagagacgttgaaatgggaaaaaaactaataaagcaagttaagtgaaattaatttgaccaacaacttttaccctgatatggtagtaaaaatgaaccttttctcttgaacaattttatttttctaaaaagaagtactgaacaaattagccgatatgtccatttgttctcgctcatttgttacattccagcttttttttattactatgcataagaacagcgtgcaataattgtgctacccatatgtaatataaaccaacctaagccaccaacaaggaaaccgagagcttggaatatatttgggcctgttcagcaagctggctgcggctgcggctgcgccgccgcgtgcgtgtggcattgttggtgccgtctgtgccgcagccgtaaaacaggcagctgaacaaacccatatatagtatactcctcaaatttacaccaacagcaaggaagcatgcaagtttggtatgagaagcatcaggagctccattacgccgtgtgcttgtttaggttctcgtgatcacggaagcaagtgagctgcggaaagcatgaacacaaccgccgaacatcttccagcgtcttctgaaccctgacagacagcagtgctgagagctaagcatctgagcttcgacttgacccaaatgtccatcctttctgctactccatcagctgctatagtcctgatcagtcgcagccgtgttctatcctcccattccagttatagcctacaggcgagatgacaatttaatttggctaaagctggagacaatgcaccaaaccattataacaaactttttatcttcaagggagcaactttttacttgttttcttttttggcagtcaatctcttccttaatttgacttctgatcgacgatcgagaggagacaaagttagccactgtaggtaggtaagcaaaaacaaaagctcgtcgtctaaaaatgattgcagttttagtttaaagatttataattaaaaagttgtatttttagaataggtctacttgacctgtttaatactatattatctttttttaaaatcaaaggtgtttttgattattattctatgatgaacaattgggcattggagattattggttttgttatttggaatttattcacgaagtggttttggagatgattggatttacaggtgaatcatagatactgttatttcatgtgaccggtcaaaccgggcagtggttgccggtcagaccggcgtgtattgcgcggtctgaccagccgacgctgtgtcaatttcggtttcgggttgtttatttggatatccgtgattattttatgattatggcttctagatggatactatacgtatgtaatactgttgtttgctactaatgagttaagttggagatagcttggtctcggaatatggtttctttgtttgttccatgtgtaggtgactcgatgtctcgggagagtatttgcggtgatggaccgggagtcggcttggggataagacgatgttcgtggtggtcagagatcatgcgggatactaaggctagagttgatgcacgtggttaatggaggttccatatggcatacaatggagttattgtgtgcgtatgggatgtggagtcgaatttggaaggagtccaaatttggtacgattggttatgtaaagtttctttcttgtactagagggtttcctaaggtgtttaagactcctagtatgagtttggttcgtggctttaggctgcctacctcgggtataaatagagggggagcgtgaggcttccctatatcgcttttgtatcgcttttgagagcaattgagttgagttttgagttagggtttcgagtttagtcgaaatttttgtaaggagtgctgttggtgcactttgtaaacatagagagaagtaataaagtcgtaatccactttaagagttcttagatttgtgtttcatcgggtttcggcggtctaaccgactatatatcggcagttagaccggcggcacgcggcggtccgaccggcggcatacgggcggtctgaccggcggcggcgacaggcgcggcaggcatctcggcggttcgaccaatcgatctacatcggtcagaccgacgtgttccaggtggtcagaccggcgcaacaacttcggtcagaccgtgatccgtcgatttcgagggtaacttttatttccgctaaaagttttcggtttttgggtataccaaccattcaccccctctggttggtttagttcttgctattcgatcctacgtttttattatcgttttatccatccaactagtactatactgccatgtaaagataaccattcattgatttaagactgtctgtgtgagttgcatcttattttttaagtttagcatacaattatgcgaattatgtttggttcttttttaccttttcttaaaatttcaacattgacatttaatttggactgctaacagtaaaattatgaacgtctaggctaaaattatatttctttgtttcagtcaagtatatttgatatataagggtgtgtttgtttctttgccaaactcaagcgtaccaaaacattgatgttgccaataagaaaaaaggtattgccaatatttttggtttagctgattttgtcaagcacatagtaacactcttgcggagcaaaccaaataatagcctaacctttcttgccaatttttcttttgtagcaatatccaaacatgcaacttgactaaaattttggcaatagagaattgttgccattgacaaaagttggcaagcgtaaacctcaaataaaccaattaaacaggttcatccgccacaatcattaaagttgtccaataatataagtaaatgttgtttgatggcagacaacactacatatgttgtgctataccgtggccataaaaggcagtagaaaatgatgggccagcaaaaagataaagaagaatgggtttatctagctaagtgatgaagtggagaactacctagcaaagtaacaaaagaacaaagcgagataagtgccatgacagaactccacaagtagaacatcatctctcttcatacaagtagaactcattcatacaagtagtaacacatctagctagaaaaccagaggttacagaaagtgaaaaaaatgctcaatccaaatgttgggcgatgacttggtgataagagctagctgggttctttaggaaggtgtgttttcgtcgcgcataaataatgatgagcaggatgatgaatttcctagactcctgggggcatgtgagacgctgggaatgtagttgccttcgatcggatgccatgctgcttggcattgatcggcttggagcaccgtggatccactgacggcgcaccgtccacaacttctacagcttagaggttggtgttctgcatcttatctgctagtgtgccacacgcagagcactgctagttgtgatgcaaatggtcatcttgttccatgtccacgattccaaccaagtatgggtctctcagtctctgtatagatgttaaggagcctagtcctactacttggcgatattggactgagctgtcagctgttctatcttttggtcaattgctcgtattctgtggttgtattctggctgcatttgtttcgtattgatattacacaacggagaaaataaaaggaaaattgagcaataattttatggttatttggaagtaaaaaatcaagcttttctctagcacaattccaacaaggatgtcgaaggatggccattttgtactaccatgtatacgtactccccttcttattggatatccgttagttgatactaataaatagtttggactgaaaggacaggaagaaaatgacattcctttattttcaaatttctgcatgcatgcactcggccggtacatgcggtcaggtttttcctgtacaaaatctaaacgggtaaatataaacaccgtttgatcgggcttgggtttgatggatgttggatgagatcaggtgtacgggtgtacctactcctaggagaaattttatagtctttaaaaaagtacctcaaggtttctaaattttattctaaattttttatatctcaagataattagtatttggaggtaccaattttatagtataaagtgtacgtagtacctcatggtaatttttaaagaatggtaaaattatctactcctaaggagtatagaaccgtattccttcgaacatgtccatttgcaatcgtgctgcctatatgtaatatgaaacgacgtgaaacagaagtatcttgaagcttgaagcttaaagtggatcagaactcagaaaagacatgtaaaatagactctgcccaatccacagtaccacgagaagacgccaacaataaacttctcaaattagagatttgctccgatccaacaaaaaataactcgaggtatcggtacttcacggtacactggtgaagaaaccctttgtagtcccggttcgtaacccccctttagtcccggtttccaaaccgggagtaccaatccgggactaaagatcgagctgacctttttttttgcatgcccctgttgctgcatggtttatatatatatatatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtaaattgtgtttccgtcgtagtagaattcacccttgggatcaaggatttcttcgttgatgaatcccatgagttgttcttgaaccgccgtgataaattccttgtgtgtggtcaggttatccctcatgcgaatatagtaatgcgaataaactatatgaatgtatgaaattgattagtaattaaacaagaaatcgctacgtaatgaaatttgaatttatttgtatgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaaatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacatctgactaagatcatccgcaacgtcgttaccatcagcagctatttcctcctcgcccgtttgatttccttcaaatccaacgtactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttactttttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaacaaaaagtgtgcaaaacataggtgcaaatgtagtatgacaaaaaaaaacattggaggatgaagttgcaaaccttttaggcacctccgatttgtatgtaaacaccaaaataaattcaatagaaattttggcatgacctcccctcttttttgaagtaattttgaagcttgctcgggcagctggaggaggaagaagacatatatatataggggtgggactttagtcccggttggtagcaccaaccggggctaaagatcaccgggatcattagtctcggttggtattaccaaccgggactaaagttaagatctttagtcaccaaccggggctaaagatcaccgggatctttagtcccggttggtaatatcaaccgggactaaagttaagatctttagtcccggttggtgttagcctgacaggtcctgacagcattcgaaccgggactaaagatgatctttagtcccggttggtaacacaaaccgggactaaagatcaaatatgtccgtttcccttttgaaccgggactaaagatcatctttagccccggtttttattgcatccggga

SEQ ID NO: 45508 - DNA, 10631 bp, Oryza sativa
tagatacaacgatcggaaacgagttggtactgtgagagactagtaactcgaggtatttttttttgaccgcagcaaatctcctcaaattaacacgagcagcaatacgcatatacaagttaattaagcctgaggatcaatgggagctccattttatcctgctcgttctgttcctgtgatcatggaaacatctaagctccggaaagcacatgaacacaaccagggccgccttctagtgtctcctaatagcccacgtcgccgagagctaaggcaagagactgagtaccagtgtaccagaaagtgttatggtaatatggttcattactcattagcaggttttcagcatcgagcagttatgggcataaacaataagagatttcaggttgaggccgtagcttatttaatgtcattgtgaacttatttcgttttactatataaaactgagctaacgtgaggcttggatgttgggatatggcaccatcgaatagccctgaatttgttgcaatttcatgcctataatgctgcactttgttttgcctagaattgggctggccggagacggtcaccctctctttctctcttaaaaaaagtatatataaaacactaaaaatgaaacatacacattttttactagggcgatacttcggtgttctccactggttatattatactactagtagaaataatctggacggtttgttattaagggtacattagtaataatttactaatataataattacagataactttattttttttctggctaggtcgatctgtggtcatccaatgtgctggtattgttcatattccgtcgcaaaaaactaaaaaaaaagagaacaaatgtttattcactgttaaatgacaattatacctctccacacatattttcttagataataatacccctccacgtttctactagcactaactaaggtggtagtataaatagatttgaatcctttgataaataagatcaatggttcagattgttttctaataccagtagagagtaccggagtagagctctactaaaaataaactacgataaaaaatttctcaaaatcaacctaaaaagtaaagtactaaaatttcttttttatagcggcttatagctgtagggcaaaggagatgaattttagccaagtaaattaaccctctcacatatgtggaaaagactaaaataccggtgtctttataggcagagtaggacagagagatagtatctactagtatatagtcacatctgagaggccgagacatgtttatgtacaaatcaaatgaccacctgcaaactaatctaccccatctgaggctggtatgtacattgttcatactcgcatggtgcgtgacagatagatagctgagttagctataaagatggtgtgcacgtacgtaggttgcgcgttcagctaggctggcggccaatctctgtttcttgaggcacattaaatcgacgaagtaatgactctccaggcctccataggctcctaggcatgagaggcatcaggaaatactcagccaccttacggccaacatgctcagcaacctctccaatgctcgctgttgctctgctggactagtggggtatgtgtgatcgccactgctagcctctctagttgtccagtgcttatgtttggtttctagcccacatacagctcctactaactcgaccaaccgtcacttgctagacacgagccgcgatcatcgtgtaatcatgtgatcctgttggttgttgctgcgaacactactatgacaaaaaggcacttcagtgccgattgaaaaccgttcataggtgtcgggttttccaactgtcatcgatgccagttatacaaccgatacatgtaacaatatatagttgctggttgccgataagaactggcacttaatagctttggacaagccaagaaaaaaggagggggaagccgatgaaacagattagcggggatgtgcaaagatcaacacaaagcaacataagagagtctcatcagaataaggatagagagagcatatgtaacgctccgcttttcgtgaggcgttaaaaactaattcggcaaaatcttatatgcgaaaatttccgtcctttgtgtgcgagtctaagtcgtgccaagatctcaattcaaatccgtccttgatccctctcgtcaccatcaaaaattgcctcctcgaaattcctcttccgactcaagtctccaaatcaaactctgaaattctatccctctctttgaatcatcgccaaatacttccctagatccaaaatatccaaaaccccatcttgaatcctccgtctactccttcctctcatccagatcccaattccgaaatctaagtcaaattccaagttcaaattctcttcgaatcaatctcctccgaaaaagtctattttgcctccctcggatttttgtgggccgttttctcctcggcccatctcctctcagccgctcctcctcctccccctcgcacgtgcgttgcgcgtgtgtgctcgctctctctgtgtttctctcgctctctcgtcttcttcctctctctctcgtcgaactcctctcctcgacgccgattcccgccgctgccgtttgaattcgccggtcgcccttcccgcgcgcgcgctcgccgcccggtcgccgccaccatcagcccttgcaccgccgacgccacgcgctgccgccttgcccccgctccatgccaaaccgaccgccgccgtcatcgtcgacgtcatccatggccccccgccgctccacgccgcacccatccaagagtgggagaagcagctgctctcctcctcctcctcctcactctccctcctccttttcttgttttggcaagggaccaagctcctttccctcttcctttttccttttgcccgaccaccatcggcgtcaccgcctgccaccgcctgggccacgggcgcgaccgccagctcgccgccccccaccttgaccgcgccagcctgcgctccagcggttcggttttagccgcccgatccatcgccttcgccgctccttgcatcctcggcgtccgccgctcttgcatcgcccgtgaccgccggccgaacgctcgaccgctctatgtcggtcccccctcccaaaccgacatccctccactataaaaccaagccaccccaaacccctcctctctcgttttcactcgcctcagtcctcacacccaccgcgccattgccgccgaaccaccgtcgccgccttgttgttgctcgtcccgctctcgccgttgccgtccgttgccaaagcaccggaggagccggtgcgtgcgtggacgcgtgacgaggagctccgggcaccacctctccctcccttcttccccggccgctccctctcggtgctgtgccgcctcggcgtcgcgaacacctcgccgcgacactgaccgcgccgccaacactgcctcctcttcgattggtgagctccccaccataatcctcctcctgccatgcgatgcgccgtgcccgctgccgctcgccatagctcgccggccgccatgctctgtcccggaggccgtctctcgtcgccagccaacctcggtgccgctccgcccaatccgacgccggaaacggattccttgaaccccggagatgctcccatccctttgaatcgaaccctcgtcatctcgtcgtgttttccccctttttgatctccggtgattgccgccgccgcaatccaccgtcgtcggctcctctcgcgtcgattcctctcgccgccacgctcccggggatccccatgacctccccctggctgccctaaggccgtcggccttctcctttgtctccgcgccgtgtcgccgcttccgccgccgcctaacgccgccgtgcgtgcgccgccggtgaccatcgggtcccgcgtcaccgcgtgtgcgtcgcaacaccataccggttcggctaagcccgagcccgcgcacccttcgctcttctcgcgcgcggccacgtcggcgtgccggcgagcttggtcgccgccgccagccaccgtcgtacctcccctctcaaatccgtgccgttaaacggatcccccctgacctcctctagctgccggcggtggccgctcgctccggtgcgccgccgctcgccggaacgcctcgcgcgtcgtcggccgtccgatcccgggcgcctcctcctcctcctcctcccctttcgcccctgcccgcgtggccgaccacgtggccgccaccctggcccgccggccccgtttgaccaggtcaagcagcgaccggtcagcgtcgcccgcgcgcgcaggcctggctcggctcggcctcgcccacccggccgtgggccgcccaacccgagtcggcccatctcctctctctctctctctctctcgctagccgatgggcctcacctctctcctcgctccttggaacaaagtctatgttgcctccctcttccaaaccagctgccgtggaacaaagtctaactttgctccctcgtcctccccctaccacatccgccacctattggaccgcagcccatctatcctctctcactctcacttcttgttggccccacttgtcaatgagtcaaagatattcttgagaatatcttttccaatactccacaaatatttctcttttctataaattcaataaatcatttttccctctttcagaaatcaattccttattccaaaattccatgaatcattttccttggtaagtgactgtcaataatattcttgagaatattatttccataaattccgacaaaacatttccttgtccagaaaatccatttagacctccaaaattcatatcccttgatccgtagctccgatcgactccgttccacttccaataattccgtaaaattgagatctatttattggcactactaattagtctaaataggatctttcttttggtcctttgtttaggttttcaattgtttgcgtatagttgcggttatcggattttcgtcgatcgcgggttttctcgatgattcgtgaagcttcgtgaagaccttgagcaaggcaagtcaccctttgatcaattgcccctataattgaaaagtcattattattttgtttacaacttgcattattagaatcacacttaacttgcttggcctcagtttgcgtgccaaaccggcggacctacccagtagtcgcactattttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgataataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgtatgccaattgttgggaacaccggggcggggtcggacaaaccgggttcctggtaaggcaaggacgagaagcttgctcacttaccgatcaaggtggttggagtttgatttgtgaacgcctaaaatggcctatgtttatgtgaggatttgatccttctatgtggcatgaggtaaccctgggtcggcttgggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtggttcccgctgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggcagctggactctgggagtccgagaaaatgaaaaaggctctgggagctgattaatcaagtggaatggctctgagagccgagaagtaatgatctgacccgggaggtcggtacattaccaaatgagctgttgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctatataaacatatatatagttcctccgccctgaagagatgatgaagtgaagtgaagattagggtttcgtcctggttcccagccgtcgcctgtggtgttgggtgttagaccgttggttccgctgctgctgctgttggtgtttcctcgtccgcgtcgtcggttgtattctcgggctgtctgagctgcaacctaagttaaggtaaataagtcctctatttattttaaggattgctatgattcatatttgtcaccgtgggtaccagcactatgtcctgggactggtaccgagatcgcggtttcgtaggaagcggttcgcgccgttttccctacgacacgctcctatcaggtgccgttgtacggcggtatcagattggggtgtgacagcatcttagagctacaacttataaattggaccataaaccataaagacatgcaatggaataacctgacaaattaaccaagcagccttatggaattttgttgagcaaactaacatgggcaacaatgcaacatgcgcattataggcttgagaggcatctagagctctgtttcagccacctcattatattcttgttaccgtgatccctgaagcaagtgaccaccagatatcgacaattcaaccccagtccagggttgttttccggtgtcttttgtgtaccacaccgtcacgttcatgtgttacctctcctgccttagtacttcctgttagcgtggaaccagctagcttgtttaccggtgtaagatttagtgtatgtggcatgagtaagataaattggtgttctctcctcacaaacagcaggcctggtgttgtttgaaagtaacagattattgccatattgttctcactgatttaatacttgattatgggatgaattaaattttttaagaaataaacaaaacacatatcttacagctatagacagtagttttattgaagaaaaaataaagatgcagaggaaaaaatccgtgccacgaattttattatttaaaaaaaaccaagtggtaataatatagtatatatagtagcttaaaagaaccgatttattattcctattagtaccccacattcgttttatattatttgacgctttaatttttctcatagtcaaacttgtctaagtttgatcaaatttacataaaagcgaaataatatttttaacacaaaacaaatatattatcaaaatatattcaatattaaatttaatgaaaaaatgttttagaagttgcgaacttagctgacttataatataaaacggcagaactacctgtaaggatcggtgtgcatgcagtcgcctggagcggctctcgttttttctttagccgaaaatcgacccgaagaaactcgccttaggattctagtaggcatgggaggagtcggaaataagtgggttgccttgaatccaaccgctcacagctgggctctcccctgcttgactaacagggcacctgccacaaactgcggcatatgtggttgccaccactgcccctttgcatatgcctgcggcttcctcactcacgcaaacgagcaacaacgccctgcagcttgctgttggccccggcgtcgatcggcctggtgttttgctgaacccccgttcatgtagatttggaatagagtgcagctgctgtgaatttttcttcttggacatgttgttttgtttcgttgtcgagattaattaattacgtacatggatgagctcaagcttcatcttatacttaatataaaattgaataaaagaagtagattaattaaatgcaggagtggcacaataattattgcatcacagtacaaagtcctccagcatcactgcttatttaccggattattccaatagatcatttgctctacaatccgacttattttaagctacctgttaagtttatttctcaaaatatttgtttaggcctataatcatatcgataatccacgacgatagtttgttttgtaatttcgaatcaaatgacgcttaaataggtgcccgtttctaaaaggggaaagtagaaccgagatgcaatacgtgaatgaatttttgggaagatatttttctacggtactcactacttctctaccgatagtagaaccaatctagactttatatcttttcttattggatgggtcacttatatttgtgctgtcacgtgaactattgataaataaaacatttttttctactagtagtagaacttttgtaaataaatagctacatcacctatactgattataaataagggtaatatccttgtactagtagagatcactggaaaaacagtactcaactgtacacaagagcagcatgaaccaaagagagagatagagagagagagaggagtgtcacccacacaagaacagctcagagctagcttacctagctagttaaaatggatagtaaagacaagggggtggaatagcctttgctacccagagacgtgcaacaaagcaacatgaactctcaggttaggcagagggagggccggcatgggaggtctcagggacacaacagcgtcactgtgagatcatgtctttgaggccggatcgattcgtcgtggccttatgctgtcacattggcaatgtgtgccctgcctgcatgcttgtcttcaccatagatcaccttcgctcaccctgagcgctcgtggaggttcaacctggtaggacgttgggagcaccacagagcagttgtgattcatcaatcaaacgctaattccagcgccctatcatggcaatgtggccaattggccaaacacatggcttataatttggatcatgaaccacaaaggcatgcaatggaataacctgataaattaaccaagcagccatatggaaatttgctgaaactaacatgggcaaaaatgcaacatgcacgtgcgcattataggcctgagaggcatctggagctatgtttctcccaactcattttggttaccgtgatctccgaagcaagtgaccaccagatatcaacaattcaaccctagtccagggttgttttccagtgtctgtcatgcatgtaccacactgtcgcgttcgtcttacctctcccgccttagttttttttaagggaaaacaacactagattgtgccttttcattgaatatagcggtagaaaaaacagctcctaggggcaagaaaagtgaaaaatgttgtacactttaaatattatacatggaggggtagaaggtcccgcaaacgctttgctcctccatcgcccaagtccacgcctcttccttgatctgggcgaacaggaaagatgatatggcattcttgtgctgtcgttgattcctttccttccatatctcccaaactatgaggaggacgagggtgcacaaacctctcttaggaacacctgccgtgttagctagtgtctcccaccaatctttgatagtttgggtcgtctcccaatgcctagggtcgagctgctggtaagccacctagtcgactaccatgctccatattcctttcgtgtatctgcaactgacaagaagatatgggactgtttcgccttctctgcagcagagtgggcagagcccattgttttgccatactctagtcgcgactcgattggaggtccaaacccagttttaaatgactagccaagcgtggaatttacacttccctggcgcccaaactctccagatgagcgaatgaaagttcatggatgtcatgctgaagcattgtgcctgctaagccgacaatgctgattgctgagtattctccatggtttgtgaatttccacacaatttggtctaactgcttattgtttaagtgaatgtctctcacgacaatccataaagagactagttgttcaataaggtccaccgagattgctgggttagcttcaaagtctaagttgttgatccaagcatcattttcttttccctgtcgtagggacttgtctttttttcttcgagattgcacagactagtggcatgaggtcctttgatctgcgcccatctatccacacggaatcccaaaagcgcattgtgtttctgtctccaacggttatttttgttgacacagcgaagagtacctcttttgccttagtacttgctgttagcatggagctagctagcttgtttacaagagtaaattttagtttatgtggcatgagtgagataaattggtgttctctcctcacaaacagcagtgactggtgtagttgaaattaacagattactaccaaattattgtcactgatttaattaatacttgattagtggttgaattaaatattttatgaaatgaacaaaacaaatatcttatagcaagtgttatagacagtagttttattgaagaaaaaaaatgaagatgcagagaaaaaaaaatctgtgccaatagttttattattt

SEQ ID NO: 45509 - DNA, 9153 bp, Oryza sativa
agattcatctgatattttagagcaactttcatatagaaagttttcgcacaaaacgaaacgcaccgtttaacagtttgtaatatttttaacacaaagcaaacatgttaccaaaatatatttaccattagatttataaagttttttttatgttatagatattactaacttttttcataaatttgatgaagcttaaaaagtttgaccaagaaaaaagttaaatgacctgtaatacaaaatagaggaactacttgtaaggatcggtgtgcacacatagcattagcggctctctctctctttttagcgaaaatcgacccgacggactctccctaggattccaggcatgggaggagtcggcatgggttgctccaaatccaagcgctcgcagctgggcggcaagtgcggtttgcatatgcctgcggcttcctcactcactcacgaacaactgcagccagctggttggccctggggtcgattggtctggtgtttgaagtataaattgacaaattgtcccgttgaaccgagggaaatttgggtagtgaaacatccacaagtcatcgtcaggtgatgagtggtttgctaccatctcagcgtagaaggttcgttcgtggagatacgggttaaacatcgtgctaaacagttctaacaatggctctatgaatgatcagttgtttgctttgtttctaacgactgaaagctaatgcagtatcttctgttaaaaaaaaaaggctggtcaatttacgtttatgttaccttccatggtttagtttagtgtgaagctagctataggtcaccagcggttgcctaatatggattgtagccttacgactatgaatgaaaaaagatcgaacaatatatgtgtgtatggaaaattatgatacatattttcactgatttaaaaatcaattatgaaaagtaaattacgatagaagtctcaaaatcatcttaaacaattaagttctaaaaatttttttacagcgacttattagttgtagggaaaatgattagagtttttaggcaagtaaattaacactctcacatgtgtggaactgagtaaaatagtactgatgtctttacaggtagaagacatagatgtactattcaactattcacatgtgagatgatagcaacatttcaagctaatctaccccatctgagtcaggtcgaaatgagacgtgtcatctatataatataatagtacatcgtgtatatttacatgatgcatgacaggtagatggcttaatcaactataaaggtggtgtgcacatacgtacatagcgtctgcagctctagtggccgctctctgttaatttcttgaggcaaattaaattgaccaagtaatgaacctccacagggctcctaggcacgagaggcatctgcaattactcagccaccttgaggtcgacaaggtcagccagctctccgctggtcgatcgctagctgtttgctcctctcgactagtcggggatgtatgatcgtcaattcaatgccctctctacctcttcagtttttaaggctttcatgagctgcagccttcgtgcaatcctctgatcattctccgttgttacgaagagcacagcatcctggatgccgtcgagtggcccgggctttctatcttttgcagtgttgatctgatgtgtcctgatgtatcacccggagtctaggtgttgtgaatttctttttttaatttctgagtggattgtttcatggtcgaggttaattacactgccgagcttaagcctactcttggataaaatttggaaacaatacatagaatctcggctttgaaaagattggatttaaacgattagattatttcaatataataatacatgcaaaccatcgtcagttgatgaagggactagaaaaaagatgcagtacgatcaaatgaatttgacaaaccactccatctcactcaacctaattattcaaacggtgcctaactggtggccgtttctgaaagggaggaaaacagagaagcaaagcacaatgaactttggcaaggtaacgttttgccgtagtctctatggatggtacaagcaacgtagactttacatgttttcttattgaatgggccatttgtatgtacgctgccaccttaactcttgataaataaaacaacttttttatgttagtagcaaaaatcacaaataaatactagcttacatcactttttacttataataaataagtttagtattgttgtacaagtagagaccaccaaaaaccacttagctaagcacaaaagcaacatgaaccaacataaaacagaaagctaggagagtcacccacacaagaaccgctcagagctagcttacctagctggttaaaatggatagtaaagagaaggaaaggaatagcctctgccaaccagagagcgcgcgagaaaagcaacatggactctttggttatgcagaggcagggctgggcatgggaggtttcaggcacacaaccgcgtcaccgtgggatcatgtctcggaggccggcgcgtttgatggtggccttgtgccgtcatgtcgggaacgggtgccctgcctgtgtgctcgtcttcaccagcgaccttcgctcactaggattgctcgtggaggttcaacctggtaggacgtcctgagctctgcaaagcagtcggtgctcctttgtctgacgctaattccagcgccctatcatggcaacgcggaaaaacataacacagagcacagttctgcggtgcgtatgtgggcagcggacacattgttggtagtgttaagttagttgtagtttaattaggataagtatttgattaaggagttcgtggtatacattgtttacgctggccagattgtacatacagatacgtaagggccggagtttgagtcgtatgtagctttactaagttgagtcctacttgttttatgtagtttcagtttgtttaattagcaaacctatataagaccatgacaggctatgtaattgtggtacgtgagttgagaaaaagaaaatggcgatagttgtgtctcgccagaaaagttcctatgtttttggttctagttttcacgtgtgttattcgattctggtgaaatcccaacaattcttttgttactcagaattaatcgaattttcagctattactactggagatgggaaagctcccgtgtgttgccaaatgtaaccgtgtgttttacgaaacacacggtaagttaccgtgcgcttcgcaggaacacggtaacaagggaatataccgtgcgtgaacatgttgcacacggtaacgttgctactgaaccagaaatccatccaacttccgttttcgcgccctgtgcttccgttggcgcgcccgaatttcgtggttggcgcccacggtgcttctaatgccgccgaccagatttcttttttttttgcacaaccaactatatttcgttggtaatggagtgaaaaatcgtaacaccttcatacgaagtcggatcgagataaattttatatgaaaattgtagcccttaatgagatctagaactttttagatgaaaggtttttcatttaagattgtttatgggttcaaatatttattttttctctcagatctatttttgaaattatgttttgagttttcaaaatgatctccgatgaatacatgttctatgttaaaatagagagctatatgagaactataattttgcagaaaaatttaaagatttgttaaaatataagaaattcaaattttttttggtagtaaatgatttcaaatgaaaaagttgtcaacaataaagttgtataactcatcaagatctataacttttactttggtcttttttctatataacattttctgaacagtttgaatttgaatttaaaaatatgaaaacttcaaacagtattttcaaatattaaataatttcaactgaaaaaatcatcaacaacaaagttgtataaatcatcaatatctataacttttattttggtcatttttctatataatatttttttgaatagtttgaatttgaatttgaaaatatgacaacttcaaacaacattttcaaatactaaatgctttcgactgaaaatgtcatcaaaaaatcaaaaataaagttgtataactcatcaatatctataacttttattttggtcatttcttcatccgacaaagtgatactaacattgttcacaaaatcacatatccctcatctggttttataaactataacacagatttgtgaatcttgtgaacaatgttattaacactttatcggatgaagaaatgataaaataaaagttatagatcttggtgagttatacgactttgttgttgatgactttttcagttgaaatcatttagtatttgaaaatgttgtttgaagttgtcatatttttaaattcaaattcaaactgttcaaaaaaatgttatatagaaaaatgaccaaaataaaagttatagatattgatgagttatacaactttgttgttgatgactttttcagttgaaatcatttagtatttaaaaatattgtttgaagttgtcatattttcagtgagaaaataatcttatttcctgattttaggttcaaacattgtgtttttcagaacatccatgaataggagtgaagcatctgtgctggtaatgattgctatacaaacttctttgcaatctcaagcctaaagtatttacttttcctttttcatttatgctcttttcagtgtcattgtgccttttttattgacattctaaaaagttgctcaagttacattgttgactgttcttgaccatattgagataatgagaaatcagagatatatagtaatgtgtggcttaatttggcttatattagagcattgctactggtaaaagtacctagcgacaaaaattgctcatggtaaactacctgcacaatttcactagtaccttttgtgatgcagtagttgtttgtgcactaaatggtggcctctgttcctgaagatccagtcctatatttttgctaggttgatccaaatatgctcatgttcttatttccatctatataattgagcatttggtcttatttcccattaattgtactatgtttgggtttagcatgtaatatagtccaatcttgatattaattcagtttctagctatattgatcttccagtttcttacaagcttatcacaattgcaggtataattatacattcaagcatcaacttcaggatctgtaccatccatttatatcatctttctattattgattgatcaaccgaataatatgttcctagctattgtaactttggttattgctttaactgacatgaaccatgaattgcttgtatgctaattattaattgtaacctctttactgaaatatatatttatgttggaatgtgttgtgctcttgtgtgcttgttggtggtttatattgtgatggaaataagctttgatggatatagtaaacaaattgcaaatagcatatttttttattaacacgttctcttaccgggtgcttcaaacacggtaacgcaccacatgttaccgggtgtgaatgaaacacggtaacacaccaaatgttaccgtgtgtgaaggacactcggtaagccaccgttccgttagaagctccgttacacaagagtccagctacgcacggcagccttaccgtgtgattcagcacacacggtatgtgttttggccttcccatgcgcataattgtaaaacacccgggaagtgcgcacggtaaactgatgaagccgccgagtatctgttcccatgcactagcacccggtaacgtcgttaccgtgtgtttttggcctgttaccgtaggttttgagcacacgagagccttacagtctccagtagtgaaatttatatctctgttaagacccacgttatgtttacggtgtggcactgaatcggaacgattttcgcaggagaacttaccacattcaaagcagggtgggaacgaatacgttagctaaatttatttattcgttctcatatgtgtgtggacatatcccattcccatcacacaatagcatgagagtgctgaattatgagaaggaaaatgttacacgatgacactgaagacatatacattccgtacccttctgaagttgtttttttttattaagattaaagaggtagatgaaattaaatgagacatgattacgattggtggatataaatatggtgtataccgtcgtgtgcgcttaattaatgcgatgatcacaagatcaatcttttcaaaatggagggagacaaccggcaatggtgtctgctgcttactgtttttagacgacaacaatggcggctacatatatagttgatgcaaagcctaaaccaagtgttcaacccatctaacccgctgaaacagcccaactcaaacacaggacttgggggctgtttggatgacggtactttgccacaaaagatttaacaaagtgtgacaactcatatatatatatgcgtggccaaaattttattggtcatactacttgtagaaagcagggtaacaaatcctatggtaagtggcttatttagtcaaatagttaccatcctcaaccaaataaccccatagatactcacagactggaaatcctaatcggcgatcgatcgcctgggatgggggtagcgatcaattcccctccccctccctccctccactggtttccttttttggcaccgcattactttcttattttcgtaaatttatgcacctaaagtttatacacctcaagtttacacatataaagtttaaagacccaaagtttacacatataaagtttagagacccaaagtttacacatctaaagtttagagaacaaaagtttatatatccgattcaaatttgaatttgaattcaatattttttatatatagtatttctatacatctaaagtttatagacataaagtttatagacccaaagtttataagtcaaaagtttacatacccgattcaaatttgaatttgaattatatctgatttaaatttgaatttgaattctatatatagtatttttatgcatctaaagtttatacacctaaagtttatagacctaaagtttataagtcaaaagtttacatacccgattcaaatttaaatttgaattatatccgattcaaatttgaatttaaattcaaatattttctatatatagtatttctatacatctaaagtttatacacctaaagtttgtagacccaaagtttataagtcaaaagtttacatacccgattcaaatttgaatttgaattcaaattttttatatatagtatttctatacataaatttttctaactttttgtttttttaacaaaaattgtatggtttactgtagtaggaagaaaagaaggggaggagaaaggggggagaggagggaggaatgtatcgagtacagggggagggaggcggatatcattcgaatggcatccttacaatattaaaaaaaaccggtggcaagtttgcaaatgctctattattttaagcgacaatgcaacatttacgatgattcggatctcggcgtaaaataatacctttttcaatagtatacatttttattttttgaaaaaggtactggcaaagctaacatgtccattctggctcatttttgccttcttcaaaccagcgttacattctcgctttattttttattttattactatgcacacaagagcaacttggaattgtgccgcactgctattcatattagctctatgaatcagttgtttgctttgtttataaggactgaaagctaatgcactatcttctgtaaaaaaaagtatatatggtcaatttaaattttgcttaccttccatggtttagtttagtgtgaagctagctagtttagatcaccagcggttgcctaatggattgtagccttacgattgtcaatgaaaaaaaaatcgtataatatatatgtatgtatatgtgtgtgtatggcaaattatcatacatattctcggtgatttaaaaattaatataaaaagtaaataacgatagaggtctcaaaatcatcttaaacaattaagttataaaatttagtttttttacagtgacttattagcagtatgtaaaatgattggactttttagacaagtaaattaaccctctcatatgtgtgggaccgagtaaaatagtaatgatatctttacaggcagaagacatatagagatactattcaactattcacatgtgaggtgatagctacctttcaagctaaactaccccatcaaaggctggtccaaatggcgtgccatcgttcatattcgcatgatgcgtgatagatagatggctaagtcaactataaaggtggagtgcacatacatacgtagggcttgcagctctagtggctggtctctgttaatttcttgtggcaaattaaatcgaccaagtaatgaacctccacaaggctcgtaggtgcgagaggcatcaggagttactcagccacctctctgctgctcgatcgctagctgttcgctccactcaactagtgtgggatgtgcgattgccactgcaacgccctccctacttttccagttcttaaggcttttacgagctgaagccttttgtacaatgcgcggatcattccctgttgctacgaagagcataccatcatggatgccgtcgagtggcccgggcttgctatctttccctgttgctacaaagagcacaccgtagatcatttcaatataataatacacgtagaccatcgccagatgatgcagggactaggaaaaaagatgcagtagggataaatgaatttgacaaaccactccatctcaaaaaaggcttctgttacatgtatctaattattcaaacagtgcctgactggtggccgtttctgaaaggggaaacaacatagaagcaaaatacaatgaaccactattggagaaaccatctttggtcagttacccaaaaaaacacaatagtcccggttgctcaaaaatccgtgactaactttggcaaggaaatgttttgccgtagtctctatggaaggtacaagcactgtagacttcacatattttcttattgaatttgccatgtatttacgctgccaccttaactattgataaataaaacaattttttccgttagtagtaaaactgataaataaatactagcttacatcactttcttgatgataataaataaggttagaattgttgtaccggtagagaccaccgatcgaaaaaccactccactatgcacaagagccgcat

SEQ ID NO: 45510 - DNA, 34998 bp, Oryza sativa
gcaccgcaaagtagtcgaggttcctttgccagacgctaattccagcgccatatcaccgcaacgcggccaaatagaatacatgacgcaattctgcggtgcgtatatggacagcggacacattagttggtagtgttaagctagttgtagtttaattaggacagctatttgattaaggtgtttgtggtatacatttatttatgctggccagattgtatacagatatgtatgggccaaggattgagtcatgtagttttagtaagttgaatcctacttcttctatcccaaaaaactcaacctatttgaggatgtgacataatttagtaaaataagtctgaacagatggttatctatatttgtcgtactagattagattatgtcccatcctaaattagattaggtttttttggacggagggagtacttgttatacttagtttgagtttgcttagcaaacctatacatttatgtatatgtaattgtggtacatgagttgcgaaaaagaaaacggtgatagttgtgtctcgccagaaaagttatgtattgtttttcgttctagttttcacttgtgttattcgattctggtgaaatcccaacaattcttttgtcactcacaattaatcgatttttcagctattcgatctctgttaagacccaaggttgcctcgaatccaagcgttcccctgcttgccaccagtgcggcatgtgcggtttgcatatgcctgcggcttcctcactcactcacgagcaacaacgcccctgcagcctgctggttggccctggcctgtcgatcggtcaggtgtttgaagtacaaattgtcccgttgaactgagggaaatttgggtgaaacatctacaggtcgtcaggtgatgaattaattaatggctgcaacatctcagcgtagaaggttggtttgtcgtggagatacgggttaaacatcgtgctaaacagttctaacaatggctctatgagtcagttgtttgctttgtttctaattaaggctccaagtatttttcagttatactcacaatacatatgtatgtatatatgtgtaaaagatcaataaaaaaaagtaaattacgatagaagtctcaaaatcatcttaaacaattaagttctaaaatttatttttttacaacgacttattagctggaggacaaacgatggcagtttatagataagtaaattaacactctcacatgtgtgggactcagtaaaatatagtaccgatgtatgtctttaccggcagaagacatagagatactattcaactattcacatattcacatgtgagatgatagcaacctttcaagctaaactaccccatctaaggctggtcgaaatggcgtgccatctatataatagtacatcgttcatatttgcatgatgtgtgacagatagatggctaagtcaactataaaggtggagtgcacatatgtacatatagcgtgcagctctagcggcccgtctctcttaatttcttgaggcaaattaaatcgaccaagtaatgaacctccacgagattcctaggcacgagaggcatctagaattactcagccaccttgtagactataaggtcagccacctctccgttggtcgatcgctagctgtttgctccgctctactagtgtgggatgtgcgatcgacattgcaacaccctccatacttgatcattccctgttgctacgaagagcacaccatcatggatgccgtcgagaggcccaggcttggtatcttttgcggtgccaatctgatgtgtcctggttgaaaagattgaatctaaacgattagatcatttcaatataataatacacgtagaccatcgccaggtgatgcagggactaggaaaaagatgcagtagggccaaatgaatttgtcaaaccactccatctcaaaatattattcaaacggtgcctaactggtggcagtttctgaaagggaaaaaatagagaagcaaagcacaatgaactttggcatggtaacattataccgtagtctgtatggaaggtacaagcattgtatacttttacatcttttgttatgaatgggccatttgtatctacgctgccaccttaacactattgataaacaaaacaacttttttctgttagtagtaaaccttgcaaataaatattagttacatcatttcttaccgatataataaataagattggtattgttataccagtagagaccaccgaaaaaccactccactgtgcactagagtaacacgaaccaacagaaaagagagaggagagtcacccgcacaagaacagctcagagctaacttacctagctggttaaaatggatagtaaatattaggaaaggaatagtctctgccaaccagagatgtgcaacaaagcaacatggactctctggtaaggctgggcatgggaggtttcagggacccaactgcgtcaacgtgggatcatgtctcggaggccggagcgtttggtggtggcattgtgtcgtcacgttggcaacgggtgccctgactgcgtgcttgtcttgaaaccttcactcaccatgattgctcatggaggttcaatctggtaggtcgtcctgagcactgcaaagcagtcatggttcgtctgtcggacgctaattctagcgcctatcacggcaacgcgagcaaacagaacacatggcgtaattctgcggcatgtagtatgtggacagcggacacattcttggaagagttaagctagctatagtttagttggaataagtatttgattaaggagtccgtggcacatttgtttatgctggcaagattgtatatagatacatatggggccgaggtttgtgtcatgtagtttaagtaagttgagtgtcctacttgttatacgcagttttagtttgcttagaaaaagaaaagtttgtcatttatatcttgactagaaaaaatgcctgtgtgttgcgacgggtgaatgctattttaatcatattattgttaagatttttctaaaaagtacatcctccatttcaaaattatgacgccattggcttttcgcacaacgtttaaccattcatcttattaaaaaattagtataaatatcatttattttgttgtgacttgttatcgtcaaataaaatataatattaacatatacttttacatatttatattaatattttaaataagacgaatggtcaaacgttgttggaaaagacaacggcgttatacattttgatagtattgatatctagtttgaaacttttattgggatgatggtcatatcttgtacgttgctttcttatgatttggcaagagttttgaagcaattaggagtctgactcttctcctaagttaacatgcgagtttttaaagggatttcttatatcaatccttatgtatttctgaaaacaaacgaacctgaaaaccgacttaaatatagatgacataccaaaatatcagcagaaacatcttcaatttttatgtttgacatagataaattaaaatgggaagagtgctactaatggtgcatatttttttcttcttttttttgattaatgtggtataataattcctagtctctagagtgaacatgttggtttttagcaatatttggaacaaaatttgaaatccaaaagtttgttatattttagcacaaagaagtttttttaattgcgatctaaaataaataacacgctcaaatattttttttatttaaatagagagaactttttggcagcaactgaaaaattactcctcgcaatatgtaagtatgcatgtatatgtgttgacaccaagactgactcggctttcgtcaaagtgttctgtaattgcaatctagagtgaattatgcgtgcatatgtgttgacactgagactgactcggtttccatcagcagtacatctttctttttctctcccagacgggaacacaatcagacttgtatgcatgcacgttctcgtgacaaacgtgaagaaaccttgcagctagcttcatctgttcgagttaaatataaatacaaatagagtgtttcgtaataccatcaataaatctatatctttataaaaccaactcaaacacggatgacgtatcaaaatctcggtaaaaacatcttcaatttttataatagtagagatagagttaatcttgttgtagttcaattaggataagtatttagtaatcttccataacaggctttgtatactagtcgtcaacccgtgcgttgcacgggttactatcatatatctattataaatgtgataattttggtcatatattaaattcataggacattatttgaattatagtattttaaaattacaatgattgaaagaagagcatatcaaatactacatgatatttgtgaattgcttttttaaaattaagttactaaagtactaaatttcttcgtattattaattcagagtgttagaaacattttattttggatggaaaagctaacactaaaaattaaatagtatttctaacacgaagtatattatctacaatactatgatatagacggtcatgactcacaacaaaggctatgcaccctgttgttttccgacccctaattaatctattacattagaatcggcatctccagtaaatctattactatactatgattttaaattcgtttgtactacttgttttaaagcatgagaacaatttttaatcttgcgttcatataatgaactaattaagaccgtgggtcatttgtcctacttcagattgttggaactctatttattacatagtaaaaccaatacaccaattgcatctacttaaaaaaaagtcgtattgtcttgcaaaagaaaattaatttaattacttgctgtagtgtttaaaatggctggtgcttagctagctgaaccccaacgccggcaccgtcaccgccgatgccgacgctccattaactgtggagctagctaggttaatcgtactagtaagagcaagtataatagtgagttataagcttactataagcttacgtggaggagagagataacaaaaaaatcaagaatgctggctctcatgcaaaagctagcttaacataaactcctaagtaaatacattaaatgtataggtgagagatagagagatgaggagaaaattatagccaaccttatagctaatccactatatatgttggctttaaaataggctaatattaggaagtgagctctactattgtcctggctctaacaaacagccgcagccacaatggttggtgtttttggggcacagaaatcatgggcatgagtgacttaatttcctagattgatgggcatggtaaacgtcgggaattcagttgcctccgatgggattctatgcagctttggcattgccctgcctggagcacggtgcatccacagatacggtgtagcgtgtgcgttgtccactacttccttgttggtgccacacggcatacctgctctggtacaacacgcagagcactgcttgctgcgtgctgacggttcgtctagttcttccacgtcgtcgattctggatgagtacgtacgggtctctcaagagatgctggatggtctggccatgcgttgggacaattggactgatctgatcgatggttgttctatctttggttgtatcctgactgtattgttgcaatgtttctctgttaaggcttacacacaatggagtaaaaaaaaagcgagaaactaaaaggagaaaaacaaataaaacgaattaagggaaattaatttgagcgacaacttttacgatgatctggtagctaaatgacccttttctcaagtacaattttattttaagaattttaccatacctgagaaggtaccaccaggtactaggaggtaaaaactccatctgtccgtccattcacaaagggtatgatcggaatagcttgtgataatcatctagtcctacacctggcatcgtctcttctacatcttcttctccttccacatcttgtagtcccaaacaattccgtcccactctatagctccgcgacacactgttgagacctgaagcacaccgccaatggttatagaggaggctacaatccaggatccagttttggggcctcatcaggatgggaatagtgggagggcaggcgacgctcgtgaggtgagttcatgtgccaccgacacctctgagggggtggtttgctggtgaagaggagaggcagcaaacatggacagacggagctcgccaatgattcagctagtggaatggaaaaggatgaacaaaagaaagagcaagtaaaaaatggaaagaagggctcgcctgaattcgggaaggagaatggtggattccttccattgtgatgatgaggattgggcatttttgctgtttgagcaccatgtcctgtactcctgtacgtcttcaatggtgatagactatctaacagttcggatcaagctaataaccagaaaaacatattcctggtcattaatccaatgttatctcaactagaattttcaaatactcggctctatcattgtggatcaacttctttaggtacatgaaagcactaaatttccagacaatatagctcatgcacctctggttcgcatggttcttggtgccaccaagactaggagttgaccccaagcagagagggcactgaattcgcagttgctgctggcctcggcttcataactgatggatgctgggtggcgtccccctcctctttattgcacaaccaggacagctgacatggcaacgcatgactttggaggtgtccagagcataaaagggggtggtaggtcccagctcggtctgaaccgcggctgcagcggtgtattatcgatgaggggagaagtgctaaagcagaggttgccgttttgcgagagtgtcagtgacagcggaaggagagacagcctgagaggacgagagagagctagcggagaggaggtagtgttggtgggaggataagaaaacaaactagagcagcgtgggggtgggggtggggattggcgacgggagcggactggggaggaggaacaacgccatgggaggaacgacaccggcgtccaccatcaaatcacctccctcaagctcgaggtaaacgttgtatcggccaagtcaagcttgttgttgtgtgcccgtgttaattacctctacggttctcgctcgatttgaggatagatggcgctccactcccacctgcatgcgaaagtacaaatttgctctcctaccatcaacaacatttggtacctgctagatgccatagcgccaggtaccgagcctttccaagccgttacatagaatggaatggacgaccaagatttggtacctcctcccctcaaggactgtaaaaggcctcttattattattttgatggttccaataattgcagatatcctcactcgtacgaaaaaagggtccaatttaaagagtgtagttttggctgatatttcataccacgtaggagtatatgtaaatggtacccaaatttaaatggaggtggcagtggtaaagaacagcattagaaacaaaagctttgcaatgatcaagacgtgtccagagctctagcttaggcaaacaggcatgggaggcactgaggacacgattgcgtccacgctggccttccttgcaaacgcaaagtcatccagaagcagcgcaagatatctctatggacaaacctgcagtgttctgcttgccgccctctgcatccgggagcagcagcagcttcatgttccccggtggattcaccctcgcccctgattattgattgatccgcgtagaggtcaatcggcatgcagggccgagccaagtacgtatatacgtagtgagtttaacactaggatagctaattcgtccccaaccagccgtgaaggaagcctgccaggaattcatgagatggatattatcgatagaactaagtattgtttggttttgtttgtattttccaaaaaggtgaaagcaggtattatcagaactataaaagcccatgaagctcctcgtttcttgtattgtcacgttgagccgggggggaatttattttaatattttaatatttaatttgtaacatcgtttattttcatgctcatttggtcttctctttcccttttaacgaaagtttggtgtttcttcttgcaacatagccaagcattgagttatatggtctgtgaaccgcgacataatttttaatttcaccatttaattttatatttaatttagggacctttttgtttttcttctatttcttagacttggcttttggaccgctataagtaaaagcatatgttttatgtttaaattatatgttgttgctcttttttttaataatgtaagttattctagccttcgcaatgttttgttgcttacttcattcatgttttccttcaagttagccgtaaccattaataaatagttgttgttgtattatggcacacaagacaccatacattatgtagcgctctagcttgtcataaaaggtagtagaaaaagataggctagcaaaatatatatagaagggctgaattatgtagctatgttactatgtaatgaattgcaacaggtaactacgtataactagtaacagtaacaaagggtaatacaaagctatctgcttgttgctcaaataattagacaaagcagaagcattgttctctaatcatatctccccaaactcacccgtggatgtaacacatctaggaactggaagcatcggggagggcgatcgatcacttcttcatggatagggcgaggtcattggctgagagggaggcctcgacgaacttgccgatggtgaacttgtcggccgctgcagagcgcactgtagcgcgccgtcctgaccaaaggcctctgcatccacaagctgaggatgaaggtgatttgggatggcaccgagaggtgcgagatgaagatggtaattaccagaggatgacgtgtgggaccaaggatattttataaataattgttttcttcatttgtagatcggactgatctggtgaaatagctgccgcacatattttgtaaataccggttactttacacctgaacttcttccacggtatggaaaactcctggtgtaaaaagtttagggtgtaaagtaaccgatattagagtttagtggtgaaaatcgaattaccgacatcaaacgtggtctttgaaagttgaaatgtggttactaaaagtcattagcactactttctaagaggactcgcgcgctaatttaaatggtagccaaatttaaagaggtggagcgcaccaattttaattgtctagattattcagaattttgggatagaagaagacatgcaaggagtagtaaattagctgaaaagaacttaatcccactattaccacactcacatgtacacacggctacttatatggaccggtgtgcacggctcacgtttttgacccaagaaatcgacgtgacaacgatcgagctctccgatccgatcccctctagctaggattgtaggcatggaggcattggaaattactcggtggcctctgatccttccctcgcagcttggcgatctcctcctcgaccaaacccggcgcttgcgtctaacgcggcatgtgcgagttgccacaaccacaccattgcgtgcgtgcggcttcttccctgcacgccacgcgcgatcgacgacgtacgtgttgcagcactttgttctggccctggtggcggtaccggtgatcttggtgtttgctgagcccagttctgatggtggatgagtaggtcagtccctctgttgcatctattccttgcaacagagtgcagctgctgtgaatattttttttttcttgaccatacggatgagctagctcatgcttagccttacgcttgaataaactggaacgtaataaatagaactcggctcattaccatcaagagaccttttgcaactaaggatacatattttcagcttttttttaaaaaaaatgattaaaagcctgacctctacatccaacttggatgtacccaacacatacagtgatgtcattgataaataaaataaattttgacaagttggaaaactcatatattagtaactttcactacttgactaaatttggtgctactcccccgtcccatgatataaaggattttaggcggatgtgacatatcctattacaacgaatctggacaggtctgttggagccttaagtttttgttggagcctaagcaagatgggttgagttgtgatccaaattcatttacatatgtataaaggtcaacttcggacggagcgaagtggaggcccgtcgccggtggcttgggccgtcacatagctgaagaggtctgaatatgatagctgtgtgtatattaaatttgttaatggatcacgcatatatatacttactgttatatattgatgatatgttgattgctgccaagagcaaagaagaaatcactacattgaagaaactgttgagtagtgagtttgatatgaaggatcttggtgctactaagaaaattttaggtatggaaattactagagaccgaaattctggtttgttatttcttagccggcaaagttacattaagaaggttcttcaacgtttcaacatgcatgatgcaaacactgtttgtactcctattgcaccttattttaaattatcagctttacaatgtgctagtattgataaggaggtagaatacatgtcaaggattccatattctagtgctgttgatttttttatgtatgccatggtttgctcttgtccggatttatcttatgctatgagtttggttggtagatacatgactaatcctggtaaaaaacaatggaaggctatttagtggagtttcaggtatcttcgagacacagcaaatgcttgcttgaagtttggcaggactgataagggacttattggctatatggattcagattttgctgctgatttggacaagcgaagatcacttataggttatgcgtttactattggtagttgagccatgagttggaaggcaacattgaagcctgttgttgcccagtctaccactgaaatagaatacaaggctattactgaagcatgtaaggaatcagtttggctgaacggattgtttcctgagcttcatggagttgattcttgcattaacctgttttgtgacggtcaaagtgccatatacctcactaaagatcagatgttccatgagaggataagcacattgatatcaagtaccattatgttcgcgatgtagtcgcacaaggtaagataaatgtctgcaagataagtattcatgataatcttgctgatatgatgacaaagtcagttcatattgctaagtttgagcttttctcaagcttagttggtataatggtttaacccaatagattatttggcgtcgaaagtgtttttctttgttgtgttgagggtgaaggtttgatttatgctacaagaaggaatttgtctcaaggtggagtttgttgagttttaatccaaattcatttgcacacgtataaaggctaacttcggacggagcgaagcggaggcccgtcgccggagacttgggctggagcaaagcggccgttttagggtttcacctttatatatacttctggaatgtaagctgccgttcggcgttctaacctcatccgatatatagtgaagatatttgctagctggcgcctatggtttttctctcctaatttaagaggggttttcacgttaaatcttgtgtcttctgtgattggtgtatcattttttatcgtttatttgccgatcgttttctaaatatatttgttggcatgcagcaagtaatcaaagacagtagttgtagtacgtacatattctctctgtacttgtgctgttaagtcgccgtagtaccttgattgtttatttagccttatacagacttgacgtctcatgcatgtctcatgacagagggagtataaatgatggcctttccgattgtattttcatcccatagttcatctatttataaaagacaatgctccacttctaaagctgcgtgacacacatcgagagctggagcgaactaaagagctggccgggtcagtgtggatgttagcatgtatacacgtacacgcatccgtagcgactctattgatttgttgaaactaattaagatcctagcttagatatgggaggcatggggaattatttagccgccatggaactaaagcttcgccctcgcttgtttctgcgcttcttgtgcaaccgcccatgaacatacgagcaatattttcgctatgaagagcacggggaggatgctggctgcgaggcccgttctggcctggccttctctttgtccagccatgtcgggatggtcgtacgatttcatatgtcctaatgtattgctcgaagttcagtttgtactattggagaagtgattatcccatttagtaccggttataacaaccgcgactaaactttcatctgtcctaatggtattcgaagtgcagctagcggccggacgagacgagttcgatctcgatctctcgctagtagtcttctaggcatgggatggaggagtcggaaattacttggctgcgtcggatccaacacttggcagctcggcatcgctctgcttactaaccgggcgcctgcgcgtgtgacgccgaatgcgcggttgccacggctactccattccagaattaaattttaaaatatacagtattttcctagaatttgcacatatatacatgcttttgaaaattttacaaaaatatatgtttccgcggattgggaatgcggtatcgggcagtggcgcgacgccaagacgcgcgaccgcatccgtcggtcccgtagattggttgtgcggcaccggtgctgacataatatagtcgtttcactgcctttgttcaattcgagctgctagtgccaagaagtcatgcatgcatgtcagaatagtgaatgctaaagctagctacctgttaatacaatcaaagttttatgagtatatcctttgtttgttgcgggatttggcggtggtggcgcggctccgcgcgaccattccgcgggagcgcgtcggtctattcttctgcgcaactgctcctggtgctgggaatggacgccgtcgcgcgctattgtcacgcgggatcgacgcgatcgcgcgttttggcgtcgcgccaccgcccctcccatcggtcaactgtacggtgccgtatttccaatctgcgggaaaggtatatttttaaaaaaattacaaaagcaggtatatatgtgcaaaatcgaagaaaataatgtatattttaaaatttaattgatccatgcctgcagcatccctcggcaccgcgacgacgcgctccggctaatcgttctgccccagtatggtgttatgctaagcccagctctcattctcacgatgatgatgagccgtcggtcagtcctgtcctatctacctagctattccttgcaaattggagtagtacccacctgctgtaaatttttcttgaccatatatatgttgttttatggtcgagggttaatacatttcaatgtaataaatggaactcctcttgttagcataatgagttcgtttttttttgttgtttccaggagactgtttaaaaacataggtgtgcctggttacatgacaaaatgtgtccatcactaaattattgaagcatccatgactttggctataattaaatagagagttagacgaaagttttgtacatgcaattgatgaatgagaaagcataccacaagcttatatctttatgtctcttacattcctagaaattatgcaacttgttttgactaggcatataatacagggtcacacgatgttctaccgaatatcgacgaagaaaactagtaaaaattcatagattccttttgcatcttgctgatctaatcacgaaaacgaacttctcccctattccccgttccgttttcgctattcccaaagaaatccactaccgtctgacttggagtcgtcggtgaaagctgattgggaattcgtgaaacagcttgcgggctgtgcatgtcacaacgcccacggacaccatattgcgccgggaccgcacgacagtgaggtcacaccgtgccacaacccaggcgtcgatgtgcaagcctcagcgtccatgcccactgaagccacgccgccacaccaagacacatgtaatgtactgtcgtgaaggtgctggccggacatgaagagggaaacagaaatatagacgaagaagaatgaagaagaaaagggaaaaagtggcgaacaacaccagctagcggagccacttatgccgaccattcatggcgctgccatacccacagcgcatgccgaccacttgatgtgtggctgcaggaccgtcttgtaatgactgaacgagtaccaaaggcgttggccgcgcctccacgccgtgtcgagactgttgcttgcccgtgcctagcaccgctgaccggccgagctactccgccggttggccgcgccccgccacacgggcgcgcaaccaccgctcgcggtaccccgccgaccgaccaccgccacacatggcaagggcggtggttgtgtggaggtggggtgggggaaggaaaaaaacgaaaggaaaaagtagaaagagttggtgattttgcaaaaatgcgtccgtattttctcgaaagtaagcacatgttcttctgcattggaaaattggactttaaatcctgaagtttttagagaatacagatataatcctctgcattggaatatttgttggactaaaaaaaagatgtgaaacacacatgattttcctttgcgtccagtatatatagtgctatgattataaaagaaatacaagaccgaggtgatagtgagaccagacacaaactatatatatcctagtgagttgggaactaaattttccaacgaccgtcgagacgatgatgcatcgatcgctctagtttaggcatataggcatggaaggcatctgggacaaagctgcatcaactctagtctccctagaaacgcggaagcgttttagcctcgcttcgcgtatccggccagtggtgttgacagcaagtgcgccgtgcatcctagccttcctagcgctgcgcacacccccggccccatttcagctgcattttctcatggttggttttagcgagcaatgtgagcgtaatcggtcctgcgaccgtgcgtcgtattctctagccgccctaccacaaacagagacctcaatcggtcgcattttggtggaaccccaaccataaataaatctagttttcttagtgtgagttgcagcatttgaatgtgcaatgttctggttactgcaattcaattgagaggatgcatggagatctttttctggtcgttctaatgcatgtcatgctcttttattttttttgtttctacgaaaaatattagacctttccacaatcctctattttaacatggtttaatctattcatgataatgtggtagcccctccgacgacaaatattaattgacctttggttctttttacggtatttgaggttctaccttagactacaattttagtttataaatctagtcagagatatagtgagactatcaatgtgcattccatgaaaaatctactcacactatttttacgttttgaactaaatatttttaaaatatatttttttgagaaaattgtagtatttgaaggttaaagtttaacctgattttatccaaaaagcaatgttctaataaatctccagctatagcggcaagctatagatagcggatagggaggggaacaactaggatacttcaattttgacgctaagatttgtcggcagctaatagctacacttagttagagatagcatcaccaaaatagccaaagatagctgcacttagctgctaaaagtatgaattagaaactatgaattccatatatgaagtatgaactacgaattggtgatgaactctatctgtcaatttttagctcaaattctatcattttttttaattttttttcttatattttcaaaaaccgctaaatttcttagctatagctatagctggtcttagtttttggagagctcaaccactaagaggcttagctgaagatttagaacattgccaaaaagtcaagtactcgtgaccagggaatataccctcatagcttgttggttggactgaatattttctttggctacatgaagatagttgttgagttattatagttgtcgaaagatggcaccccagacaccaataatgcacattaatatgtagtgataggctatagaagacaaccaaagtaacataatagtaggaggtagagaaacaaggtgcatagctcaatatgtgaaaaaagaatttgagaagtacatggccgtcgaatgattgtgtgtgtgcaccattgtgtgccaactggaagattccatcttcttaacatgttggacaattcatcctatgcttctaggcatgggatgcatcaggaattattcaacagccttagattggacccttcgctacagcttggcgttgctctgcttgactaagagcaacttcaacccgagcctcatccctagatccccatcatccgttgcaggacgcagctccagtagatggatgtggcttggaagctccctccctctctccatgactaggaccttccgtggcgtcgtgcatagaggtttgtgaggtggcggatccgaagtctgtggcggggccgacggatggagacgtgcaggccagcggtggcgtagaggcatgcagtatcgtcgttggagccttggaggcttgcaaggcggcgactcatatgcaaatgacgatggagggatttttacatttccttgtttttcctagataagtgctaatgactaacaagaagttgtacttgaagaagggcatttaggtcatttcatgttagtactaaacttgcattgggaatttagggatgggtttttttgtgagacagagggggtagatctcatgtaatcaagtagggagataagggaactgtttccgtggtcatctctcttcatgtgagtgctattcatcccatagactaagacagttagacgcagtcatcattttatagaaggatagtactccacttcaaagatgcgtgacacacatcgagagctggagttaaataaacaaggtcaatgtacatgtacacttgtgtacagaacgcatcgatagcttatctctctcaatttgttgaggcaaattagttaaatttgacgtgaggatcgactctccaagcgaagctctcagcttagctagatatgggaggcatcgggaattattcagtggccatggaactaaacatcccccctcactcgtttctgcactgcttgactaacggggcgactggaggaagctcagcgtctacaattgccgcttatcccagcttgatagctttgatagattgtggcttcgcagctcgcgcactgcacgcgcgtcgcacgctgccggagccgacctgatattttcttgcaacattttcgctatatgaagagcacgcgagcctcgaggttgtcaaaaaaaaaaaagctcgaggctcacgagctgctcaagctcgacttgtcttaggctcgattcgagcttggctcgagctccagacgagtcgagcaagagcctctcccaaagttcatgagcattgtcgaggagcttgagcttccaatgagtctaatataagaattttgttgttatttaataaacttggagatcaaatattttatttgtatatcttgtattgtcatcatatatttattttattattttttctcttttattaatatgatgaactagaaattaattatttttaaaagattattcttgaaatatacattgttttacataaatattaagttcaatagtcgagcttgatcttgatcgagctcgacatagcctgtataaaagctcggacgttttataggcttgaactcgagcttgtatgagctcgatcctatgcaagcgagctagctcgggctcggctcattgacagccctaccgcgatcgatgccgacgagaggcccgttctgtccttgcccttcttccctttgttgtgtccagttgggatggacatacgatttgatctgtcctaattaataaatgtttttttaggaacatcactgttgagaagtcttagagttggacacatttaataaaaaatatatagaattaaatagggagaggttgtgattggttgggaagtggagataggtgggaaaagtaaatggtgaagggttgtaattggttgggaagagaatattggtgaagaagttattatattttgggataaattctaagtgctaaaagttattattttttgggacggagggagtagttgttttcccatggtgttgtgccaaggccgagattaatcacttacactgctaagctagtttaagcttcaacgaaatttggataagacgcaaaaaaaaaaatcagctcgttacgtcgtagactattgcaatatactccatccttccctaaatatttgacaccgttgacttttttaaatatgtttgaccgttccttttattcaaaaacttttgtgatatgtgtaaaactatatgtatatataaaagtatatttaacaataaatcaaataatagaaaaaaaattaataattacttaaattttttgaataagacgaacggtcaaacatttttaaaaaagtcaacggcgtcaaacattttaggatggaggtagtagtacatataggtagtcgtgaaaatttggtctttgatagttcccggtgataatgcacgcaaataaaatggagaaggaaaacaaagaaacaatataacaaataaatttgacaaaccattaattccaccacaaaaggctcaattaatttagtctaacccgaagtacgctcccaatatttgtgctctctatttataaagagcaagccgaactgagtcatgacaaaaggacaacgggagtagcttaaagttaacagcttaaaatagatcgcataagcatgtagaatggaattgcttgcggagcagatataaggtctaagaggcatcggaaactctgttgtgccatggttgttttggttactgcttaatgcttatgtttatcataagagccccactacggtgttctctattgatagtagagaataatgtgagccattattcttatttaatcgaatagttcagatctatttatattatcgtctagtttaaggtaatagaaatatggagatgtattattgtaaataaaaaagatgaggaggggtacaatcattatttatctgcgactaaacttttttccttcttatttgttttttcgatggaatatgagtaatgccattgcaatggatgacctacatgacgatctagctgggaaaaaacataaatgataaagttacctctgatcactgtattatgaattactgtcttatccttaacaataaacgggatagtgtcttatccttaacaatgaacgggatagtataatactatcgtagagagcaccataacattgcttttttttaataaatggaagcttatgtttggtaatacgggacggaaggagtacatggccagactacttatagataactccagctgcctccaaccctcctatgctgtccacgtgaggcttaaccggattttggaaagggtttttggacacgaataaaaaaactaatttcataactcgcctggaaaccgcgagacgaatcttttgagcattattaatccgtcattagcacttatggctaatcatagactagtcaggcacaaaagagtcgtctcacgatttcctccctaactgtgcaattaatttttcttttaatctatatttaatgctacatacatatcttggaagattcgatgtgatgtttttagaaaaaacttttggagaactaaacggggcattatataggacatccaattcgctggacagtgtcactatcagagatcaattcagccgcgtcggatccatggaacgggcatcgatcgatcgatcgagggataggccacaagctaggcaacttgtgcattcgctgctgctggctctaaaacaactctagctgctctactattgcagagttgcgccccttaggcatgagaggtgtttgggacataccagagaccagctgtggaagcactttgatgcatcctcgcttcgcgcattaaaatgtggcacgggccacttcatgggctctgcttgttttagcaactggagtagtagtagtattactctgttgtccaaacatattaaaccaatatactcgagagtgctattttgatgtgctttagtgcggctagtagtagtattcagtagatccttctaaccaaatgttactatctgggtggccggtgcaattgtccggtatgattttacttgaaaatttattaaatagctatcttgtttttttaagactttgaaagaccaaaccttatcatccctgtgtttctaattttatagttttataaaaatcacaccagttgctaccacttacttttgtcatctctttttttatttgtttgcttgatctaccattgattttattaattctccttggaatctttataaattggatagtatagtttttagagtttattgtctcattcggttttgtttttataatttctagaagtcccattaagcgctgccattatactcctccatggtccgtccactgtcttttctctttttgtcattgcgattttaaaagtcgaatataattattgtttgggttcattttttactttttataagtccccccaaactgtcagtggctttgccactgtactcctctacggttcacccgctgccttccttcttattgtcattaagattttgaaatcgaatattattatcattgtggtttattttttttacttttagaagttctgaacctttaaaaattggaccttatagtttttagaggttattgtcttgttgggtttcagtttttataattttagaagtctcgtcaaacgatgccactatactcctctacgcagtgtccgccgccaactttttattttcattgggattccaaaaatcaaacataactatagttggaatttattttttactttctagaagtcccgccaactgtcgacggctgtgtcactgtactcctgtatgacccacccgctgtctcttctttttagtcattgggattttaaaaattgaatatgattatcattggggttttttattactttctagaagttccgccgacagcgttgactggttacttgacggcctgcctgtcgtccctctttttaatcgtcattaggattctatttggtgttttattaatattttttagatgtcccaccaacctccaacactttaattctttataagtatgttacttaattactctcgtcatgaattttagatggtcttttctttcaatagtctttatgttttatcaccaattttagttatttataaattatattcctagttgaatatttttttaattttagaatttattttatttttattttgaattttaattaatactgtattatgtttttttagtatttttatattttattttcaatttcagctgtttcgaaatggtattcctacttgaactatctttttaattttttctaatttcatattttattttatttttttattccgaatattaattaatgtcatattggtctcgtacatggaatcttctttcaatagtgcatatttttaattctgaatttcaattatttttaaattgtatttctacttgactcttctttccttttgctccaattaatgtgggaatttctagctcccacagtgaatgtggttcctccttttaaagctgttttaataatatattaatagatagatttctttgatggttctatctgcataaacattgcagttaagttattttatatctgttttgtgtaattgcacataaacatatactccgtacatagtgctaggccatataggctatagccatgtaacggtaactagagagacagaagggatagcacgaggtagagaactaagttgtgtggctgtacatgtaaactgtagagagcaagcaaagaacaaagtttgtccctcttcaatgtatcaacgaactcatccatatatcccatatatccatgtaaacatataggaacagaggaggtatcggaaatctgggtttagcagtgatgtagaaacgatcgtacaacggaaaactggtaataacttgagaaagccattcagccctcgctcatccttgtataacttattcgcgttgtaaaataaacttcttctcatatccctagaatattcgttctagctaagagcttatcgtctccccagacagtttcacccgaagagaacacttctctacggctacacgttctcctaatgcctaagcaagatgaaggctaacgatgagaagtaccgaagagctatctcctacagggtcccttgcataaactctcagccagacaaataaactgggatgcacaaaagaaattacttcatataacacgagcaaatttacatacggttttccctttcgggaacccccgagcttacagacttgctccatgcagtcttgcgtgtttatgagggggatgaattctaatctctcgggtggacgtccacccgtttcttgtatgccacctaaatgattatgaaaaagttacaaaaaaatttataagataggttaatatgtaatatatcatctcacaaacatgcaagttcaaattcgacttctacaagttgtaacaaaaataacaaatttgactgtgaatatgtgtgtagtagttagagtttaattaacaaataaatttgcgtgtactaatttgacttttatatttgtgcaaaagattttacatcccgaatatttcttaaaaaaattgaatgaacaatatattttcaaatttaattcttgttgcaatatagttcacataggaactcgtgaaaacttggttttagatagtttccggtggcgatgcacgtgactaaaaggaagaagaaaaactgagaggcaatataccaaataaatttgacaaaccattccacctcaaaaggctccatttattctaaccagatggacacttccaatatttgtgctctctatttataaagagcaagacgaactgagtcacgaacaaattaaaggacaatgggagtagctcaagggtaacagcttaaaatagatcatcaaagcatgtagaatggaatagcttgctgaacagagctaaggtaatatccttgttgaaatagtatgggcaagtggcaaccatgcatagtggcggatccaaaaaaaaatcgattcgttggtgtcataacgtgtctgttggtgtcatagtatgctaattatacttagatcgtgatggtataatatatggataaacagtttcgctatagattttgacaaaagtcgttggtgtcgaaagcatgcattacactgtagatccacccctgaccatgcagcatgtatgttaggtctaagaggcatcgaaagctcagttatgccatggttgttctggttactgtaatataacaagcaatttagtactgtgcagcaccaagagatagaagtacaagtccattagtcttctaaaagatgggccatatattatgaacgcattcaatgtgaccaagaggtgctattttttaataacataccggtacctatgatgggaggagagccattgggtcagaatcgtaggtgttggttctatatgcgaaccagtaactgtgtgatttttatttagcaccaacacctataaggtgttttgtaattgggggactaatatgtcctgcagggtggggcaaaggtatggagatgctgagaataaccatccgtttataaatgatgtactttcaagctgaggtacttataaatcattcgcctaagagacataagtacatgtctttaggtttccagaagacaagccatatattaagagcgcattcaatgtgaccaaaaggtgctaatttttaataatatactagtacctatggtgggcggagagccattgtggtgaggatcatggtgttgattctatatgcgaaccagcaccaatgtgcttttcatctagaaccagcacctataaggtgttttgtaattgtgataatgaccattgtcctgcaggttggggtgaaggatatatatggagatggtgtgaaaaaccatccatccataaatttcaagctgagctacttaaaaagactctgagaggatgtgccatctatatacatagcactcgactgccgcgggccacttagatagctgagttaacttaaaagggccagcagatgtgcacgtatatgtagctcagttttggaggcaaattaaaattgacggtccgacgactctcatcagatcgagtctctgtcgctcctagctaggatcctatatatgcatggaaggcattgggaattattcaacatcccttcatcggacccttcgctgctgggcgttgcatttctggactaatgtggtggccgaaggcagcgcaacgtgtgcgaccccctcttcctgccaaatagcttgtggcttccccactcacgtactgcacgcccaccgcgcccttccaacattgtggcgtggtgttcgtgcagacattagacctttaggcagagcaagtggcaagggaagttctcacgcctgctctgcccggttatctctttgatcaccatcacagaaggctcatccatagctggttccactgctctaatcggtgctagatttgttgcatcactactcttctgggagactcatctgtgtcaactctcaaaccggcattgatgggagagcacgagtgaaaagaaaaaaaagaataataagaagagttcgacagccccattgtttggttgtttggtggaataggtcaaacggcatatttgcaaataaaaaataatttgtgaataaaacttttatgtatgtgttctaaacgatctaaaaacaaagactgaaaaataaactacgatgacaaaactctaaaatcaactttaaatttaaagttgaaaatttaaattttgactgataagcgtaagcataagaaaaagacgaggacgctgagcatgtctcgatgaacggagctgacgcttcgagccaaataatcagaatcgttaccgagacaccgtagaataatcacatttggatgcaatttttggctccaattaaaaaaagcacgaatgttgaaataaaaaccacaggaatgagtacacactgggacatactcccaatcatatttaggcttcatcctcgtattggagtatgggaagcatctaaaattaggaaataaccaacagacgaagagaatgaatactaatataatgatcaactatgaacagggggagtatttgtttttatgttttcacaactgacccaatggttatacaacttccaatcttttaggtttgatcgatgatccggttcggttttttcgactatggataggacacaccctgacagggatgccgagaggcccattctggctcggcaactcttcattataatggacgaattgttctgccctattgtattccccagagtgcagctatactatgtgaaaataaattctcatcatgttgtttcttggctgaggtcaactacactgctattttttcaataaaatatgtataccacatcgtttcaagataatatatatatatagatatatacaccctcgtgaaatatgtttaagatagttcccggtgataatgcacacaagcaaatggggaaaaaaaatcagagctgcaaatgaaccaaatgaataatgaatttgacgaactgttacaccatataacggcccattttcttttttttagagcatctccagcagggacttcaaatccagcccctattcaatttttgagagttaagataaaaaaactagatccagcaggggccctactacagcccccaaagtgaggaggccctcaaatcctcccccaaggccccagtcctggggactccggagcacgcccccatcgtcatttttttttggcgcggatataattttgcttcgtgcattttcttgttattcccgcacggctgcgacgacggatcttctccggcgagcaccgacgaattcccagcacctccatcaagactgccctagaaaggtaagacttttccatacctttcttgcccgccgttctcgaggccttcggcggcagtccatgcacatgcccggccgccgatctcccgccatctgcctggccacacgccggccgtcgcgtgccctccgaggctgcccgcacacacgtcgcccacctgcacgccgcctgcccccacgctggcctcctgcccccattgatttttctggagaaactctaagtaggtcatgtggtgcgggggttcagtggtagagtactaatcaattttctgaataactctgttcttgacacctgtggacatgtggtggtagatggttctggtggagactgacttgtttttaatatttttttggagaattgtagtggactttgtcggcaagaaaaatctaaattctcagctagtaatggttgtgtttagttcacactaaaattagaagtttagttgaaattgaaacgatgtgatgaaaaaattagaagtttatatgtgtaagaaagttttgatgtgatagaaaagttggaagtttgaagaaaaactggatctaaacacggtgaatatatcactgtatttatacttagtagcactgtacaattgttgcaatggatcgattagaaccatatatatatatacaggagtaagtggtactgtactagtacgattccactgcttttcatagattgaatgttgcatactgtatatggggtatactctgtaccgtgtatgtgtagttggatgtgtgcatatgctctaaattttcttattaattttatgattttgtgatggcagtgttttttatatggacttctacgacgacgatgacgacgacgatgatctcattaccgattggtgggatcaggaggagttgtctgacgatgatgactactacattgcagctgctcttcttacagacatagagcataagaggaccaaaagaaagcatcatggttcagtcccaggtcgtgagataattcatagggacaggtttgctggcaatttacgcatagtggctgattattttgcagatcctcctatatatagtgcaaaattatttaggaggaggttcagaatgtcaagggagctcttcttgcgcatcgtggctagtgtggaggctcatgatgactacttcaggcagagaccaaatgcagtgggtcttctcggtgccactgcattgcagaaggtgtatggtgcaattcgcatgcttgcatatgatattccagccgatagtcttgatgaagtcgtgaggatttcagagagcaccatgatagagctttcaagcactttgtcaaggctgtggtggatgtgtttgctgatcaatacttgagggcaccaaaagctgaggacactgcaaggttgatggctataaacactccaagggggttcccagggatgctaggttgtattgactgtatgcattggaggtggaagaattgcccaacaggctggaaaggacaatattcagggcatgtggatgggccaaccatgattcttgaagctgttgcatctaaagatttgtggatttggcattccttctttggactaccaggttctcttaatgatatcaatgtactacagagatcgccactctttcaaaggcttacatcagggacagctccagagttggagtttatggtgaatggaaataaatacaccatgggttactatcttgctgatggcatatacctttcttgggccacttttgtgaagaccatttctaattcacaaggtaacaagagaatacattatgcaaaagttcaagaaggagtgagaaaggatgttgaaagagcatttggtgttctacaagcccgctttgcaatggtgaggggtcctgctagattttgggatacagagaccctatggtacataatgacagcttgtgtaatcatgcacaacatgatcattgacaatgagcgagatgaaaatgtagattttgactatgatcaggaggacagtgaggtgttgaggaaggaggaataccaacgacgtaataaacctgtgttagagaaatttctaaagatacataaagaaattgaagaccgacgggtacatgagcaacttcgagatgatcttatggaacatttgtgggcgcttcatggtgctcggtagtttgtttcattgcattttctatcatgtgtgggttatgttcaatatttgcttctaggatatatcattttcatgtttgaaaattttgaattcaattttgaatcgtggtgtttgaaattgcaaatttgaatatggttgaattccatgcgctagaattatttatgtttaaattactatgtgttaaactagatataaatataaattctatactaaaataaaagagaaaaaaaataggggctaagatatggaggctactgctagacataaagacatatttagggtcctagaacattgagggcagcccctatttaacttttagggactcgaaagtaggggctactgctagagatgctctttagggaaaagacatgagctctaccattcatttatagaggaaagcaagtaaaacaaacggaaaatccttttacaaacagaggaaccaaggttttcccccacaatacaggaaccgatttttaggtagccagcggccacaagcagcaacaaacgactaagggccatctaatttaggggactagctgagctgccgccatttgtttacacatttccaagatcgaattcacaacatgttccaccgtgctgtaggttcagttgaaaattctgtcatttcattgcagccaaatgacccaagccgtgcaaatgattattccatcgaaaatattcctttgatccttcaccatatcttccttcagcaagtgtcccaccagctcatgaagttaccatcaaagcaggaggaggtcggaatgtgtggaacttgatttggaacggctgcattttcttctcgatcagccgctatactgtcccgttgttcgtgttctgtagtttatatacacaaatagtataacatgaaccaacgtagaagagagtcaacaacataaggacgacgaggctcagagctagcagctgataaaatggatcagaaaggcatggaattgaatatagcctgctaagcttaaaacgatggcaaattttgctcctcaagtgctatgattaccgttcttctcagaaccagggctgggaagcaacgatacaacgagggctgctttcccagtctgggcaaatgcaattagataaattcaggctttagatcagagcacacatatgaccggccatatgccaggtttcaacttttgtaattgccagttatatatagcgtgcaggcgagatgacacctctggcaaaataacaagacgtctatatatgacatgtttttgataatgcagtttctttacaaatttactttgaacactcaactttcttcaatttccctttgtgatcttttttttttgcgggggccctttgtgatctaatataatggtagagcattgtaaaagaaagcacccttcaatcaagcaccatccgtcttaaataccatagccacattttttattttgtgactaagacatcatgcacgcatccctgaaaaaaaaaagaaagacatcatgcacgcagcggtatatctatgatttttatataggtggtccaacttatatatatttttttaaaaagaccctaattataacaaagctaaaagccttttaaaggaaaaagtacgagttaccctgaatcatcgtggtcgactaaataacccccctaacccaaaaaccatattagaaacatattagaaacgagtttttgctttgttcaaaagtttttttcatagatgtataaatatgcattaattgggctaagattttttttggtggcaccgggatcataaggaccaccctgtagacccgcctatacatgcacgttatgtagtgatgggccataaaaggctgccaaaaagagggtagaagaggcagaaaaacaaggtggctagctatgtgaaacaaagagcaggggatagtattcaggcagtcgatcaagcatttgcactatctgcgcaagtcaggcgattgcaacagccatatatataacatgtaggaattggaggtaccagaaacctagctcttgcttcgaagaacagattgacaagtttgactacccaaaaaactgtagaaattaagcctcgcggccctttttcagttcatcttcctgtcatatcctatgctatatgcatatcagacagaagcgtgagcctctagctagtacaagcatcaacaaagtggagaagctgcgaatggtttgtacgctagcttcttccatggaagattcacccgccatgatatatggaacttcaatgtggtgatcgcttgcgcttttttctgaagactgaattctactacgatgctacctgaaaaaaattagccccaaaaagattctttgctgctttgatttactatactagctagtatgtgggcatagcacatgtttttgtgatttatatttgatcgaaaatcgctggttataggtgaaataattgtccaacgccacatatatatatataacaaaggctgcatcgtggattgtttccatttctcattaaaatgattgtgaacaaaatagcatgcattgtcgctattttatttcaacataaatataataactgctactctaattaatatccacttcaataaaaaaagcgcaaagcctcgatcttcaatctccattcaaaaataaacattgaatagacaaacaccacaaaagtacaattattagataaaaagagtggagactaaaaggatgattaaatgcataacttgttggacatatatatccttgtggaaaaaatctagtatgttgtattctgatatattatatcactacaagagaagtgctcatctctcccggttcgcaaccctctttactcccgggtagcgaaccgggagggagaatccgggactaaagatggcggtctttagtaccggttcaaatacgatgtagtaaagctccggctcatccccgtggctggcttagccatcctttagtcccggttggactaaagatttttttatttttttaatttagttgtgatgtgtgctgcctatacatatatatgcatatatattatggatatatatgtttaaatacatatatatatatatatatgcataatctagaaatgtatatattacaaatatacatatatgtgtacactatatgtatctatacatatatatgcaagtgtgcacatatatgtatatgcacttaagtaaatatggcctatatatatttacttaagtacacatatgtgtactatatgtttttacacatatatatgcaatgtgcatacatatgtagaaatacatataatatacatatatatgcccttaagtagttataggccacatgcatacattaacaaaatatgagtttgcacctaagtaaatatacacatatattaccaaaataaatacacaaaagtaaatgcatgtgtacacaaaagtaaattagtgtgttcactttgcggggaaacaaaattgagctataaacaatacttacaaagtccgcgcactgagaatagagacgtcgagggcgtcccggtgctataagtcgaagacttctttggggcggatccaaagaacatcttctccttgataataatctgagtttcgcaccatcgctcggaacatctctctacccatccctgatttatccatgtaccattgatggaaccggtcatctatgatcttattaggcgtgactagcggttcaccgagtttaaacttgtacttgaccgaagcagtttcaataggtgcgtcctctagcaactgctccatcttcagactcgtttctttcaagaactttcgtatctctatttctcccggttctatgaatggctaaacatcttgttgtggatgctgcctcagctgagggacttcctttccgcactttattgctgcagactttgctataagagccttcttcaatgttcaatcatagtcagaaactacgattggtttgcccggttccatcattttaataaagtgctcctgagcctccgggtctataggaatcttcttttccggactacgtggattcaattgtgccctaacttccactctaacggcttcatcgagctcctccggagtcttgtcgtacgaccttttcttgagagctgggagccttggctcgtcagatttggccttcttcataggccttgacggcgcaggttcatattggcgggaccttgacttggcagccggtgcaggctgaggagtcggtgcagacttggcagctggtgcaggctgaggagtcgtttgccatggaccagacggtgcagacttggcagcaggtgcaggcggaggaggtggtggaggcggaggagccggtgcaggcgaaggagccagaggagccgatgcaggcaaaggagccggaggagatggaggaggcggaggagacggcgcttgcggcggggatggaggtgtggacaccccatcttgcccgggaaacatgatgtacctcttcagccagagtaaaatggcatgggctgtgtctccaagtctcgtctccccgtctcctccggggatgtccagctcgagatcctcgtaggttcgttccaccagctctatctcgaccctcgcgtatccaggtggaatgggcttgcaatggtatgtacccaaagggtccgtggatattgatcgggagaggcatcgaatttgcaatagcctgcaaagaagacgacggcaattttctcctcgagctaacataggcaccaaatcaccaatgcagcatgcttgttaggtttgaggggcatagctagggtgatcgatacaaccgtggctgctttccgttttgtattcctacgtactatcacagcattgagagctatgcagctaagcttcacattaggccaaggaaacgagacaatgatcttcatttcttcaccttgaccagcaatatatatagtttaaatccatgcttccagatcagagagagaaagagagagaaatccaactgtcaatcgtcaccaacgttttgttttggtgccaaatcatagtaaaaagaacaaagccggtcagtgaactgctagagcccctactcaccgggtcagtggtccgaccaccggtttgtctggtccgacagataaaccggtagagttatttactatatgcatattttcctaagacaaggtcagttagctagcggtatggttgcgggtttacggcgctctgctaagagcattacaaacagttcccttattctattctctatctttaaatttaggaaattttgagcaaaaatcgtattcaacagattccctaacctatctcctaataatccaggttcccaaattcggatatctcgttacccactttcagggagcgattttttcttcccaatcacggtcttcactctcttgcacacgcacgatgaaaaaggttcccgcgctccttttctcgcctccctcaccccgcagcgaacgttactcttcctcgcaggcatcggcggcagcgaagcagcaaccatgcaaccccttccttgcaagcatcgtcgtcggatttccaggtggcaatgcagcggccgtccctttcctctcagtcgcaggggtaagttgaaatgggagtgtcaattgcaagaaagttactatgttccctctgaaaattgtggatcgcacacagggatccatgataatcgcaatgtgtatatgcatgggagaggatagtgtagtacaaaatatcggtgaaacaaaaattatttttgacttggtgttaataatcattttgtgagactagagcacgctagctaagccaatgcaaggcactttaggtattttattggatactttcttgggtttttaggtgcaacacagaatcaattgatgcaccctacttggatcattagcacatttgtagtgtcacgccccgaactagccccgaacggaactaacctgtgacgctccaaattaacctgttaatcgataccagtcccaggaaacagtgctggtatcacaggaagacagaatatcacagcaacagtggtctctttattacagagtaggagtacagtcatgttgggctgcggacagatcccgagctcacaactgcattacaaaagggaaagcggaagccaagacttggaccaatcatcacaggcgcgacttgggaactaggccgaaaccctaaaacttatcgtaactgacttgctcctggaagaactcctcgtcagcgggatccacattatcttcttcagcaactggggggggttatttatacagagcaagggtgagtacaggagtactcagcaagccatgggaatttaagtgtttaatgcaggcttcaaggaaaggttgttgtttttgcaattgattttatttaaactcatttttgaaacaactaagtgagtgcttcttaaacgatacggatgagacagtgcgtcacgcccggtcggagtatgtgcaatgtatcagtctttgaattgattcaaggttggcacccggccaacaactttcaaacggccacccgggcctggctgatcccatcagccgccgattttccaaacatcgaacccattccacagcagcaatttcacaaagcagtagtcaaacaaaactacgctaggaatcacctcacatccgcccatgaccatgggcacggctgttcaaacagtttaataacctctacagagggggtacactttacacacacaacgttactagccttggtcacctcgcccgtgtggatcagacatgtctggtgacttggggctttcacgacaaggcatttcgaaagccgacacaggttcaccatatgccaacgagaggggtcccagaccgacatcaggttaggtcccagaccatactgtgccaggaagcccgggggttctccccgacaccaccccgttgaatccacatgtctcttggcatcatcgttcccccgactagctaattactcagccaggtgtgtcccattccacccatgtggtcgcacttgccttatgttcggatgaaattccaaggaaacggtccttaagtgcaagaacgggaaaatgtactcccagtacgtctcccggtctgcgattttagaaattcattttagttcgcaagcaccgacccaggtgtcgggttttccaagtcttttgtaaaacctaagttttacccatcgttggatattttaaattttgagggggggttccgatgcgcgtacccaaaggcccgtgcat

SEQ ID NO: 45511 - DNA, 805 bp, Oryza sativa
attgacctctaagtgtgccattagatagatctgagatttgaggaattttggaagttgaacggagtcaaacggacttacggttggaagatgttgaatttctaagattattggatttttgatctaaaggaaaaaggatttaattaaacccttttgaaaaagaaaaaaaagagggaggaggaacggacttcacgggcggcttgagcgcggcccgagaggggttggcgcggcccggccttgccatcgggctggccggcctgaggggcagcccaagggggctctcggggaggggaggaaagagggagccattgggccgggtccaccttgcgtggtcctgggtggacccgcttgtcggtggctcggctcaccgtgagcaaggtgcacacggggcgtgctagggtttgggaaggggaggcgcggtgcacgcacgtgctcacggtgggtgcggatgaggcgggcccacacgcagcctcacggctctcggtggagcgcgcgcgcgagcggggctgaggggagcggctgaccggggttgtcttgacccattcgcggccgaggtggcaccgacgtggccgctttgtggcagccacgcaggccggcgagaggtagacgaccatgtcggccggaacggatggcggacggcggctacgaacggcggggcgaaccacggcgatacaggagagagcgagcacaccgggtggttgtacgagacgaggggagacgagtcaacggatcagattcaccggagggagttcgtcggtggaggattgtggcgtcggccaccggcggcgagagaagaggggaacgacga

SEQ ID NO: 45512 - DNA, 703 bp, Oryza sativa
ctgcaccccgattgcatactgcttaccaagccataatggaacttctattcaaacacaaatggtgttcgaaaagacttaactttgcctgacaatttgcttcgtgaagctcatattctctattggacatctcctgccatgggtcataacaaggtaagctcatttcaatgcttaatttagagcagctttcagatatggttttcaagtgtgatgagcttctctgcattcagcaacttaagcatccaaacttcacttaaatgtttataactgataacttagtactgattagaaagtgcatcctatataattgttactgtcttacaactgtaatttctctgcattctttatttttagtgtagactacattccgttaccatcttactgataattatatgcttttgtgtgcaaaatactaggcttgaaagagaaagtgctccgcaaagtcatgatatgctaagatgcctcatctaatcaatatcactattgtgctattatccactggtatgcaggaagcgcatccagaaactaacaaaagagttcctgcaatagttgatgctctcgaaaaactggagcttacttcgaaggtatatataagtaaaataacactgccctttcgtaagttttaaaatgttctatataactgaggccttactgtctgtaccttctaaaatgactgcacatcagttaagaaaacatgttctttcat

SEQ ID NO: 45513 - DNA, 6052 bp, Oryza sativa
caggtggcagtgactagaaataaaacacatattaaatgaaaatgtttaaactaaaactttatgtgcacagtcataacccccaatgtatttttttttgcaaaacagggtggtcttcccttgctccaaaacacagagattctaggtggtggaccaattgggatatttctaattccaaaatctttgaaatcaagataattaatctaaggaaacaacacaaaagaaaaagaataagtcaatctttagaaatattatgggtttaaaaaatgacttaagtaataaagaagagatgcatacagcaagtaagtgtccgcagccaccaagggtttttgatgtttgttcctttgatttactctccttttggaacttggctatgtatgtcataagccattcataaacaaactttgaccagttccactttgagctggacttgatattaatcagaggttcaaggtattttgggctggggtgagtgtctgagttggggcaaagaaaggttgatagtgcaaccaccatgaaacaacgtaggacatcatcttctgatagtttgttcacacccttgtcgctaagcaaccttgtcattcttgatctctaaacctccatttgggataccaagtatgaagttggtggtgtttgggttgattggtatggatctcccattgacaactatatctgagcagctgacatcagtgtgactagctatccatttgacaaaagatagtggtatagcacacctttgaaagtttagaagagaaccaaaagcagaattctcaataattaacctttgctcgttgctgagcccttcaatcaaattggaaaagtatgtgatgtttagtctgcttcttggttttggggactctgcacttctagatttattcatgttttgtgtgctggaagaaaaaaaatagagatgtaattatgtcttgttaacaaagaacaacataaactaattaacatactagatgtggaaaaaaatgtttaggaaaaaaaagacagaaagtgataccttttgtttttgtctccttactggtttgtctgtcctagctcttttccttttgatcgatcctgaaaactaacagaggcaaaacaagtatgaagttattgatagctgtctgtggtagtagaaaatgatattttggaaaaaaaggaagaaacatatataccagatcttttaatgtgctgacgagatctttttttgttatgtatttgtcagaatcactggtttcttcctcttctgaaatagagttggcataatcagaatctgccactttgttgtccgacttgctatttgatgaacattcatcatctgatgatgtcctgtcacttgccatgctggaaaaaagaactagagaagtaagcacattaaaaggaaaaaagagagatcttgtaaccaatcaaaccaaaaaaaaactctcaatgtcctgataggctgctaagacacatgttaaactatgccaaaaaaaaaagaagtagtgccaaattcaaacaataccatttgcatcttgttgctttttgaaaattcgtgcaaaggttgaaatcatgtgcaaaactgcatatgcaggtataacattattaattcacaaaatttaatgtgttgcacagaaaatttgattactatctcatataagtaaatgtcaactacaacatcttggtattgcgaaaaaatgtgttaactactagcatgattatagttgcacaaaatcataattaaagttgcacgaattaataaccaaagttgcacaaacattaaaaaatggcgactgtaggaataggaaggtgcaatttttgcatataaaagtaacaaactggatagatatggcattatattattcgaccgcccacatttccaagctcaccagcaaaatcaaaaacttagcagaaggaaatgtactcttcttggcctgcagcaagctcctccccctgtagatccaacgctccctgaaaacaaaattgtagtgagctattacatctgagcatacaatcaatctgaagttgtgcttgtttataaccaaaattaggaaaaaaatcataaagtagtcagctaaaaaagaattagttgcatgatttattaattgaaattgcatatatttataacataacttgcgcgaaatgtatagtattagttgattttgctatttggactatgctgctggggtgtagatggttgaagcggaaaaacacagtaaatgaaaaaaagagacacacttgatgtcgtgtgttcatgagaaaaaaaagatacaacatgaaagtagtatgggttgcaaaaagaaaaaacacatgaaaagttggacaaaaaatctttataaaccaaacttgtagagacttaacctagaagttgcccatgtttgaaaaaaaaggcaattactaagctatataaaaacatattaatggttgcgcatatttagaaaagtgtcaactacaacatcttgggtgtgcaaattgtaaaaaaagaaatcagtactgccaaagggatttacgaaaaatgaagaaaaaggtaactaataacaagggaactaacttccagccacaagctccaccatcccactgtcaaaccactgccaatccttctatatccaatccatccttagactactccccaagttacagccaaaaaattgcaaagagagtcactgttgattatactactactgtattagcatccgcagtttgctcaagtttttcaccagatcaggtttttcaccagaaaaacctgagctcgccaaacatccaaaagaaccgccgatttgttgtggcgttgatcccgagtcccgcaaaacaccaaatgaatccccttcccatcataataaaaagaaaaagaaaaggcaatgaaattactaagaaaacaagttgtctaccaaaagtcctcacttgtatgcatgttttcccaaacaacaaacgctatttatcaaagtaaacggaaatttggttaaaaaaacattagttgcacaaaattattacacgacttgcacgaaaattcaaaatggctactacaatagtcagggagcgcaactagcgtagatacataattttcagaaaaagaaataatgaaaatttagggccatgtgctgatcgaaagcataggttttagtttgaggccatatttaaagcagtaaataagtgaatcacttatacaacataactgtacgtagcatatgaagagatatgctttatactgtccatttatacagtactatcgtaaattatattgtccatttattctctatattttagtttcagattaatcttactgtttccattaatctcaccctcgtttgcgtttgccactgtcatttgctgagttgctaatgacacagaccgatgcttttgcgaattgcgattactctcctctctcagtgatctactaagattaaacataattgataggagcagagcctggagttcattttcagggaggcttatctcagattgatcactgatggaatggaagcaaaagtggcttagtatgtcacagttgagcaggagtatgtcacagttgagcaggactaccgttaaaaaaaatacacagcacagaaaacaaaagatagcttttttctacaagcagaaaacacaactcctccctgtatatagtgacactgaaatccaaaaaaattgtggtatccctgtatacagtaacctctgattaactccctgtataatctgacaatactgagggacaaatgtaagagcatttgctgggatttaatgaaatattggttagttcttgagctcgaattgctaccaaatccctaaacccctttctaaaatgccacggcacagaggtcatcactggcctacaggattaacgactaaatctagagtaaaaccatgtgtgtgcattccatgatatatcagatccaagtagtgaaactgcaaaattccctaacaaatgaagttagagagaaaataattagtgccaaggtttagaaccaggcagcggcatagcccacctcccgccgactatatcatacacgatgtgcagtaaaaccctaaaaaaatttcccaaactacatcgaacaaaacatcaaagcacacacaccatgtggtttcaaatccaggatgctttactcgacattgggcaaaatcaactcaaaactcaagcaatgaaacaaactccacgggattccccctccccttgaaatggtagccaatccagccctaatagctcacaattcacaggatagaaatctggaccaaaggaaatcaggccgccacggcgtgaggatttgaacaaaaaagagagatgaaaaacctgcagtgcatcaactcctctccccccgcctctcttctccggcgccgtccgcggccgctcgcggtgcacagcccacctatcgccgcccccctccccttcccctccactgcctgccttagaagaatctccggcgccttccgctcgcaggactccgcctgctgctagagaaacagaaacgtcgagaagcagaagcgctctctagagagtcacaggtgtggtggatttttccagagctatttgtgggctgtgggctgtgggctgcgggctctgggcttattagcgaggaaaaggtgatggaaaagcacgacccatataaaaaaaagagcctttccactagcccgaagtgcgcacaaaagttgactgatcgattaaaattttgcaggcgactgcaaaatagcaaatgcgatatatatatatgcactgcctgcaacatgctacactcatctcctgcaattttccgtatagtttgctacgaagaacactcgccttaaggacgcctagctagcagtctcgttgctgtaagcctagttcattgatctctcagtgctaaccaagctttgttcaaacgattgttcgtgtaatcgtctacggcgacgattctgaaacgtatgtaatgccatgactgggtccttaattttaactgtacctaactgtacaatgggccaaatgccccatataaatccttgcgtcaaatcttaaatagctgaaactaattaataaattagtgtggccacagtagttttcaaatacactttattgcaagtttgcaaccaacatacagcaggggcagacacagagttgctagcaaagaccatatatataagaaagcagccatggacagacatacacatgggcggctgtttctgagttgggaagcgtctcagctttgttataagtaggcagtcctacaggcagcttgacatgttcgctaatacacatgcttggttacactcgcaacccagtattcaagttaggaacgagaggcgtcgggatattgggagtctcattttctcgtcaactaggcacgggactcgttggttctcctgcttcaagtaatctgtaggggagcttcatatcccggtattctgtggcttttattgccgttcacgaggctgggccaaggatgcatcaagtttcggagatgactatctctggactaacttgatcagaacagcattggatcaagcacattgcagtgcgctggtagagcggtgcttgcgcatcagtttctgtaggctctgtcagagaccaacaaggatgttgagacagattgtaaacacatgtgagtaataaacgttgagataagcccttccttgatctttctggtgtccatttttgtccacactcacggtatcgttgcacaaaaaaaataatgttgcaagtcggcaaaaacagagttggcagagtgacgagcagagtgtgaattgtgtggtattgagtttcccactgggaaaattttgataatttgacacttttttcgttgcccaattgctttaattgacatttgtgtggatgtcattcgtgtatgactatgtcaaataataaaaataatttaaaagagtgttaaattatcaaatctctcccccactggagacactgctgctgagttacggtaaggcaagatccacatgtgtgtatatttcagcagtaagtaatcaaagggtattggccatagccaatcatcagatcttaattttgttacaagctaagagctgtgaacaggggacatcgccccgtagatcttcgatgtccatgtggtgttaagtcggtagttctggtcggctgtttaattagcgtattaattac

SEQ ID NO: 45514 - DNA, 717 bp, Oryza sativa
tttttttgtcatattacatttgtagctatgttttgcacgcttttttgtctccaaaattttgttgtaagttgatgagggagaaaatttgtgtggggaagaaagaatatatagaaatttagttgatttgctaaagaaggttttataaaatagttgagaaggaaaactattgtgaaagttaatcttgaatactagaaaaaaaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgactatcattattgtaagaataattatttttgtacgattttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagccataattgttggacatcccacgaagagcaaggtgttgaaatggaagaagatgaagtggaagacgacaatattccggactttgctcagtacgttg

SEQ ID NO: 45515 - DNA, 2281 bp, Oryza sativa
acatcgcaacgggaaaacaatgttagctatggttaaagatcttaaagtagtgttcggaaaggggcctgagagccagcctatagagagcgaagatggtcacgcggcgatgtggaaaaagaactctatattttgggagttaccctattgggaattcttgtacgtacgccacgcaatcgacgtgatgcacctcactaagaacctttgcgtaaaccttcttggcttgctaggtgtatacggaaagtcgaaagatacactagaagcacgtaataatctgaagaatatggaacaacgcggcgaccttcacccggaaccaaaggagaaaggaagccattacttgagtccagccagctacactcttagcaaggcagaaaaggaaagtatgtttgaatgcttggagagcataaaggtaccatctggatactccacgaatatcaagcgaataataagcacgaaggagaagaagttcacaaacctaaagtcccatgactgtcacgtgttaatgacacaactgctaccagttgtaataaggggtatccttccagacaatgtccgggcaataataacaaagctatgtacattcatgaacgcaatttcgcagaaggtcatcgatccggatagattagaaacccttcagaatgatgtggtgcaatgtctcatcagttttgagttgatatttccaccttcatttttcaatataatgacgcatctgctttgtcaccttgtgaaagagatcagtattcttgggcctgtgtacctacacaacatgtttcctttcgagaggtacatgggcattctgaagaagtatgttcgtaaccgtgctcatccagaggcaagcatcgccaagggttatggagcagaggaggtcatcgaattttgtgtagaatttatcaaagatcttcgcccaatcggggtacctgaatcacgccatgaagggagactacagggaaagggaactctcggaaggaaagcaataatgacggtagacaacaatttattccgtaaagcccattccacggttctgcaacaatcttcattggtagctccttacatcgaggagcacttggctctagttcgcgccaggaacatcggtaagtccgatgcatggattacacggcatcacattgatactttccccgcgtggatacgacaacatctcatgggtaacaagtcgatcaaccaacaacttgccttcctggcgaggggaccgtctggatcgatcgcgacattccaggggtatgagatcaatgggtacacattctacacgagagctcaagacatgatgagcatgaaccaaaacagtgctgttcgtgtcaatgccatgggacacgatggaacaactggcacgtattaaggtgccatctaggacatatgagaacttgactatggtcctctcaaggtccctctgttccggtgccaatgggttaggttgactggtggaggcataatgattgatgacagtgggatgacaacggttgaccttaacaaggttggatactcggacgaaccttttgtccttgccaatgatgtaacgcaagtctttttcgtgaaggacatgtctagcaaaggaaagaagggcagagggcctgacgagcctaagcgtcacgtggttctcccaggcaaaagaaaaatcatcggagttgaggacaagactgacgaggattacgatcagttggatgggcaaccccctttcacggtgacgattgaccctagcatcctcctatcaaataaagacacccctcactcacatagcgatcacaaggagggaacaatagtgaggagaaagtatgtgcggtcaaccgtcaccgccgatgtattgccgtaattattgtgtacacgatgtaaactattttggatgtattgattatccatataaatcaattgatgtatggcatatgttaattacgcacgattattagaggttttaacaagtttaaatcatgtgtatgctagttatatgcgatacttacaatttttaaaagttttaaatcacgcaggtggcaatttcatatgttaattagagtttttaacatttaatttactatcattctgtagcgcccgttccgttgtggcgcctagcgggaaaactatctcctaaaaaccctatttgcgaaatctgtttctttgcttgctgtctagtgtccgtgccatctcagatctcaaatccacaatctatcgtcgagttcaatcctgaatccaaatccttcccaaatcaatccctccgcaaaagtctattttgcctccctcgggttcgatgggccgaatccctctcggcccatctttc

SEQ ID NO: 45516 - DNA, 13139 bp, Oryza sativa
gtcatcgcccggcccccgccactccacgcgctagcctccaagggatggaggcagagctccccccctctaccgcgtcgcccccgctccctcctccttttcccaaagaggcaaggggcaagccccctttctctcccccattttccccctttttttccctctcgccggcgtcacctcctgtcgccgttttggccgctagccggagcgccagctcgccggcttgaccgtccaatgtcggttcctctctcccaaaccgaccttgtcgcccatttaaacccaagctccccccctccaatctccctcgtgttcgtctctcgctgccactgtcgccctgttcgccatcgccgttcgtcgttgcgcgtgtcggaggagccggcacgagcaaggacgcggaaggggactttggccgcgcaatcttcctcctcttcctcggcccgaggccgaaacgatcacgtttcgcgccgtcggctctcgtcactgcgcccgcccgcacggtagtgcctctctccgttcttccacctcgttccatctcctccccttagactcaggtagtagcacgagtagcctccccgtagctagccggcgccgccccgaccgttgccgccgctcgccatgtgctcgccgccatcgccgcccgagctcggaagcgcctttcgtcgccggccttcctcgatgcgtttcctcctaatccaacgctagggacggattcccgtagccgcgtagatgctctcgccgccggtaatcggcccctcgtgacctcgtcgccgtttcccccttcttccgccgccggttgccgccgccgcaattcgccgccgtcaagctccctccggcgaatccgagccgttggctcgtttcccctcgtcctgtgcaaccacccggtgtgcccgctttcgcctgtatcgccgtggttcgctccgccgctcgccgcggtcgtctgccgtccgttccggctggcgtcgtcgtctacctcccgccggcccgcgtggcagccacgtaggcgccacgtcggcgccagctcggccaagaccgggtcgagtcgaccccggtcagccgctccctccggcaccgctcacgggcgcggtccaccgcgagccatgaggctgcgcgtgggcccgccgcatccgtgccctccgcgaaccgcgcgcgtgcgccgcatcccttccccaaaccctagcgcacgccgcatactccctccgcatggtgagccgagccgctgacaagcgggtcccacccgggaccacgcgaggtgagcccggtccaccggctccctctctcctcccctcccgcgcgcgctctgggccgccttctgggccggccggcccatttagctcggccgagccgccccttttctctcgggccgcgccctagccgcccgagggaagtctaattcccctccctcttccttttctttttccaaaagggtttaaataaattctttttcctttagaccaaaaaaccaataatcttagaaattcaatatgttcccaactgtaaatccgttggactccgttcaacttccataattcctcaaatctcgagatctatctaatggcatgcttagaggtcattaatagggctttatttttcgccgtttgttgagttgtcccattttgcgtgtcgtttcggagcctgaagacccgcagtgcgaggatttcgaggatcaagctcaagatctcgagcaaggcaagccacctttgaacatattgagccaatatttgaacttaattatattgcttgcaaaatattatgcattgataggattacacttaatttgtttgcgctgtctgaaaggcagaccggtgggcctacccaacttgttgcatctgatccttccattgttaattgttatatcatgttcccttgtaaccatctagctgcgcctcgatattcgtgcactctgtgcgagtatcgacggtcgccttcaaacttaaaatctgagtaacttcttgggtaaaacttgggttttacaaaagacttggaaaacccgacacctgggtcggtgcttgcgaactaaatgaatttccaaaaccgcggaccggggaacgtaccgggtgtacggtttcccgctcttgcacataaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttagtctgggacccctctcgtcggcatatggtaaacctgtgtcggctttcgaaatgccttgtcatgaaaacttggaggtctcccgacgtggctgatccccacgggctgggtgatccggttagtaatgtcgtgtgggtaaagtgtaccccctctgcagaggttaacaaactgttcgaacagccgtgcccacggttatgggcggatgtgaggtaattcctagcgtagttttgtttgactactgccttgtgaaactgctgttgtggaaaggggatcgatgttggaaaaatctgcagctgatgggatcagctaggcccgggtggccatttgaaagttgttgcccgggtggccgtttgaaagttgttggccgggtgccaatcttgatcaattctaaggactgatacattgcacatactccgaccggacgagacgcactgtctcatccgtgtcgtttgagaagcactcacttagttgatttcagaaaagagttcaaataaaatcaatttgcaaaaacaacagcctttccttgaagcctgcattaaacacttatttcccatggcttgctgagtactcttgtactcacccttgctctatataaatatccccccccaattgctgaagaagatgaagcggatcccgctgacgaggagttcttccaggagcaagccggctacgatgagttttagggtttcagcctagttcccaagtcacgcctgtgatgtttggtccaagtcttggcttctgcttcccttttgtaatgcagttgtgagctcgggatctgtccgcagcccaacatgactgtacctctactctataataaagagacctctgttgctgtgatattctgtcttcctgtgataccagcactgtttcctgggactggtatcgattaataggttaatttggagcatcacgggctagttccggtcgggactagttcggggcgtgacacattcatatgctaattataattgactagagaatttttaaaagtttcaaatcatgcatgtggcatttacatatgttaattagagtttttcacaatttaatttactatcattcatatgctaattatatttgactattcgaatttttaaaatttttaaatcatgcatgtggcatttacatatgttaattaaagtttttcacaatttaatttaatataattcctttgctaagtatatatgatgattacaatttttattaattttaaatcatgccgtatgtatatacatatgttaattagagcttttaccaatttaataatatcattcatatgctaagtatatatgattattagaatttttattaattttaaatcatatatttgcttattaagttttatccacttaatttattatagacaacaataatttttcgaagtaattgtcattaatctttgtactttaaataattgtaatgcattatcttctattttagaaacacatatgtaatggaaaataatatttagtgtgcttatcagtagtcccggttcttaaccctaaccgggtttaaaaagaatttggaaatagcgggaaaatatctttagtcccggttgatagaacaaccgggagtaaagatttctttactcctggttgttgagatcttttttttagtcctggttgttctcaacaaccgggagtaaagatatctttaatatctttactcccggttgttctcatcaaccgggactaaagatctagggctatatatattcccagtgcgcgccctcatcttctccaccaacacttagaagtttttgcccgatcgatctctctcggcttctccttcgccgccactgcctagggcatccccgcgccgacgccgccgccatatctcgccatcatctcgcgctcgtcgtcgtcgccgccgccgccgcctcctccgccgccgccgcatctctggggtgagagccgccgcgcgccgcctctctctcgatctctctctccaatctcgatctctctctctccctctcggttgccgccggccgccgagtttcagacgccgacgccgacctcgtcacgacacgacgccgcgccacgacgactccacgccacgagacgccacgtcgccgcacgccaccgccgcgccacgccgatgccgcgcgcggcgccacgccgccgccgcgctgccccgccgccgctccgctgccaccacaccgagaacgtgaacgagcgaacgaacgtgaacgagaacaaggtgaatgaacgtgaacgagaacgagcgaacgaatgtgaatgagccaacgaacatgaatgagaacgagagaacgaacgtgaacgagaacaaggtgaatgaacgtgaacgagaacgttgtcggacaaacgtgaacgagccaacgaacgtgaacgtgaaatgcaattataggcaggttaatgaacgtgaacgaagaaacgtaggtgaatgaaacgtgaccttaacgagaacgcgaacgtgaacgatatcgtgaacgaaatgtgaacgtcaaatgcaatatatgttacttcgcgtttatcctaatacatatttttgtatcttgcagaaaagacgttgtcggagtcgtccctcaagccggagtggtagagctagccctcgaaggaattcgcccaggcaagtaacgtaattatatatatatgattgatatatttgtaatgcaattaagattattagatttgtaattagacttaattagcatataagattatgtagtgttctaatatacgacagttacacttagaatacatgactatttgagttttagtagaagattattggagttttagtataagattattagatttgtaattagacttagcatgtaagattgtgtagggttctaatatacgacagttacacttagcatacatggctatttttgtcttagcatataagattatttgagttttaatataagattattatatttgtaattagacttagtatataattattgactagctagggtcctataatatacgtcacatagacttagcatatatcactatttgagttttagtataagattattagatttgtaattagacttagcatgtaagattgtgtagggttctaatatacgacagttacacttagcatacttgctatttttgtcttagcatataagattatttgagttttaatataagattgttaaaacataaatgtctcatgacttagcagatatttcctgtataaacaggtggctgatcgcgatgaggaacagatattgtacgattcaatcgcggagggaagcagccagtactggaacgaagaagaggggaacgaggatccaaaccagtatttgaacgaggaagggaacgtggagagggatgcggaggggaaccaggaggggcacgtggaaagggatgtggaggggaaacaggaggaggaggctagtggaagtcaaccctccgttggacagaagagggcacgcgggcaacgaggtgccgcgaagaagcttgagggttggcacatcataacggaagtggaagaagatggacgacctagtgccccggcagaagccgccaagaactatgtacgtcacagcggttgggttgtgcgggataacgtgcctgtcagtacggtgtactggtgaagaacaagggcacgcggagatcatgagagctttgtcctagattcggagaaagagatgctgtggaccacaatgctcgagacattcacccttcccgtgggtacagaggacaaaatggaaaggtggactctaaagaaaatggcagaacagtttcagagcttcaagggagagctgtacaagaaatatatcctgaaggggcagacaccgaacttcgacacattcccaaagctaagggatcaccgggacgagttcgttgcatataagacaggtgaacaagggcaggcgatgatggaaagaaacaaagaaaatgccaccaagaagaagtaccatcaccacttggggtcaggcggctatagcgtcgcgatgccgaagtgggaggagatggaggctagcttgcttgagaggggtatcaaaccggccaccgctaattggccggaacgatcgaagttctagtactatgctcacggtggaacgctcaacccagctgatggctcactggtcttcggcgatcagatacgagaggctgcgcgtcgactaacagatgcagttgaagcctcttctcaggacacattccgaccggatagagagagggacgagctgtcactcgccctgtagactccagagcatccaggacgaacacgaggcaaaggggtgattccttggaagattgggttcaaggaggacatccacacgtacaggagtcggatgaggagcaagagagataccgaggcgaagattgcagatcttgagttcagggtatcgagctacgagctcagcatgcaagaggaggtggcaaggaaggttgatgaacgcatggccgcacatcggtccactgatccccagccgaccattcctcctgcaatggtgagcccgttaggaaaccgtagcagctgcgcttcaacggggcaggtaggatcacagagcatggacgccatgcaaacccaggacgaatccacctgccccgttgatgacatcactcaacggacaccatgtgagctacatattcctttcaagaacttatcaataaaggtaagctcgtagtttatatattttagatttgcccattccgctagttgctgcttatatatgttgattactaataaataacctctcaccacatgaaggtggtgtcgggcatggccatcccaacggaaccttcaggtacttaccactgcaggccgattccagcaggatactcgaaggtcgaagttgagttggtcaaaggcgcgtacgaggacctcgagctggattaccctagaggagacggtgagacgcatctatgagacacaagccatgccattattctatgggcgacaagcggcgtctcgtgcaccatctcctccggccccgccatctcctcctcaggatcctgcactgtctcctcctcatgctccagcaccgtctccacctcaagctcctgcaccgactcctcctcgggctcctgcaccgactcctccgcaagctcctcttccgacaccttcaaagtcaagggccccccaagctccaccacctgcccacacaagggcaacgaagaaggcgaaagttgacgccgccaagaacaaggacccggggtacgattgcacgcaagaggagcttgacgcttacgtggcatcagaagtcaagagacaattcaagcctcgaagaccagaaaagaagattcctatagacccgagtgtcatgaacttcttcaggggtatgtctgcacctgccaaggaggccattaagctatcggactatgagcgaacgctgaagaaagcatcttctggaaagtccaaaacagtccctcagcttggagagcaaccaaaccaggacatcgagccgttggtgaccggtaaagaaatgacgatagaagaatttattactgacaccggtctaactacggatcaattgctaggagtcgcaccaatcgaaaaggcagaagtgaaatacatgtacgaactcggtaaaccgcttgtcaaccctgagcttctgcagtccctacccacacaaatgtacaagttccatcagctgtacatggagatgagcgccaccggtagagagatgatcggagcgaggatcagggacacggacttcttgcaaggagatgacattctctggatcaatttcaagggaatctacgaactataccagctggacgccctcaacgtctctattatgagttgctggattttgtaagtatatcattcagttagatttcttactacgtctcctttaattaattaagtccttgtatataagtagactatagaaaataatatactcccttttatcgttgtagaatggagattcaaagggcccgacggcggggggttttcgatactggattcatcgaccctcggaaagtaaacgtcgcaatgctcgaccaatatccgcaagccacagaggacaatatcgtccatctcctgaaggcgcagcattacaagacgttcatactgttgccgtacaacacagagttagtttaattttactgtcttcctataccaaatttcattcccgtacgaacttgctaagtgtttcatatgtaatgcatcccacgcagattgcagattccactgggtgcttttactcttcgacctgtcggcctgcaccgttaatgtatatgactcaatggataaaaaagagtctacgtttgacaaggttttcgaacttatagacaggtattgtcataagttcctctgttaattaagaaaatcttgttatgttaattgctactacgaatcgtagctttaaactccatgtagggcttggtatcagttccgtcatttggtccgtggcaaatggagagaaagacttaggtggaagttcaaatttcctgtgagtacacatgctctacatttatatttctccgattcaaatacatacaagtgtatattaattagatctctcgttgtttgtcatttatttgtagtgcgcaaagcaaaagaagggaactaacttgtgcggctattacgtgtgcgagtattgccactgccttgcagaccaaatcatcaccacaagagagctcaatgtacgtacaaataaattcaaaatttcattacgtatcgatttcttgttaattactaatcaatttcatacattcatatagtttattcgcatgagggataacctgaccacgcacaaggaatttatcgcggcggttcaagaacaactcatgggattcatcaacgaataaatccttgatcccaagggtgaattctactacgacggaaacacaattcataggtccttagcttctgagctagcgactactactacgtcgaaatcgtagctagctaggacatataatggattgtaattaatacatgactacatatgtttctatatgcatgtgtacacattttctataacgtaaatatattttggtcatatatatatatatacatatgcatttgcataacatatatatataaatacatatatattatgcatgtacatatgtattgaatcatatataaatataatataatatatatatatatatatgcatatattatatatgcatatatgtactgaaacatatatatgcatggtttatatatatatatataaaccatgcagcaacagggccatgcaaaaaaaaaggtcagctcgatctttagtcccgattgggattaccaaccgggactaaagatagcgatctttagtcccggattggtagtcccggtttagaaaccgggactaaaggagggttacgaaccgggactacaaagtgtttctccaccagtgtaccccttgcgattttctcggtgacccatgcttcgtcttgtcgactgattgataggactttcttagaaatatatgatgcaaggaactttcttttatgacggcatatcacatattgtatacattcatctaatcgtccaccacgatggttttgaaccatgtgtgaatgccacgacatggtcttttaactatagcgaccaaattctcctcatagctccatgtgcaaaaatcttaaatggccacccttactaacaaattaatttgccaccacggttttcaaatacttcattgcagccaacataccagaggacgatgtggttgttagcaagaccattacaagaagcatccggagatagacacatatatattgctgtttgagttatggtagtctcagtcctaaacaaacagccaattcaagatgttcagaaatgcaagtgtactcacaagtcacagcaactcaacaatctgcatgcatctcctgcaaatgtggcatagatatatttctctcaagctagtcaggcatgagaggcgtcgggagtttgggggcctcattttctcatcaactagtcaggaaaatgtagatgtgcagtgccgtataacatgctgagcaagcagcgttctccctgtactctaccttttgttaacgtcagtgcagcgtcgccggtggtggacgatgcacgcaggtgcttcgctgttctaactgatctcgaacagctggatgggggttcgatttcatcggcgaatcacgattgggtgcctgttcgtcagttcttgcatgctctgttaattagtgagatcagtaacgttgacacatatatactgtaaaacatgtgtaacagattgatgctgatatcaaatctattttgagatagcccttccgtattttgagacagccatatgcctctttaaatatgccggttaaaggtgccgatttttttttcgatttcaacccacggaggttgggaaaggcatataggtgccggttttatcactaccggcacctgtagaggcgatagctatttgatgttttgtagtagtgtttgctttttcctagtcttccaacaagcattgacatactacattgtgtgttcaagatagtccaatcaataggtgtttgattgcatataaatcttctttgtttgattgcattcattacaaaatcgcatcgtagtgttagcaccgcatattactagtttaacttgaatgaattgaggcaattgccacactttatagcgtacactgatgttgccagataaaatcagcggctaggaaagaacagcccggattgctagacaaaaagcgcatgccattggaatagtcaacgaaactaaattgggtgatcctatactaccagaggatccatggttggaaggcagcaggaaatcatgaattacgtactttgaactggtgttatagataatattatatgtaccagttggtgaaatggtatgctttggctagaccaaaagattatgcgatttgctccggtccaacaaaaagtatctcgagataccggtaccttatggtaccaaatcgtttgcgatcgttggatctaagaatgaccatcttacctagttggatttaggaccttagagtactactcaggtcactataattactgggctacatgctctttcgctgtcctgatccttttgtaatcctctatgagtatgtttctctcgtgcatggagatcatccctcaaggacgtgtcatctgtcgcaggtttgaaagctgacctagctagccatgttgcaagtttgacgctcgcgtacgtgcatggcaatctgtttgcaaccagccatgtttacaatactagttcgttgttatgtgtaaataaaaggaaaagatgtttggtgttatcagaattattgaatcggtacaacaacatgtatcataccatgcatcgcatcatggaggagtggtgagaccgtgagactatgagctaagagtttttaatgtttcattaagtatcttgtagtatgctttattgattgaaatttggtgttttattattcttttaactgatgtctatcttcaagtattgatgaatgttgggacaaaattaatacaacaagcatatgtgtatcacttctgtattcaatgtgcccaactgtaagcagtgtttatatatttatacaggatgtacaagagaaaattacatcgctaccctaatcgctgatttatctaggtggctggatggtgggcctgtttatggctctttggtaaactcctcggtgacaggagggctgcgcccattaagggagcggcacagattcccgagggcgcctgctattacccgggtaaaggcgtgctgcgggtaatagcgtacgctgtctgccctcgtcagcggcgtcagaggtggttggcagatgcgtactgtgtatttatggtgttccactatatatccgttcacccatcttacgcctagggctgttgaggccctagcttcttctggagcccttgtacagctccggaggacctggaaggctttgaagtccttggacagctccggagtccacggacagctccggaggccttggacacccccgtagcccttaggtggctccgaaggccttggatgaccctggagcccctaggtggctccgaaggcctgggtcggctccgaagcctatgtttagctaagctccggagtctaaatcagtagatgccttcggtcattcttctgatgtggatggctccggtaggtgctgcatcacaggacggaggctagctccgctacccggagccactccccccaacaaagcaaaccactcaaaaaaaaaaactccagctattctaaataatctgtcctactcaaataaaactaactctttgccaaattatgacactaacaagctgcactggagtaataatataatggaatttctacaattgtagcgcctcccattttttttattaatctcgttcacctttttcctatgattattctatatcctatatatatgtaagcatgctcttatctctcatatctcctcatttaagtagggtttaatatattatttttaattctaattctcttgtaccctgtgtatgaaaatatcacaatgtaaatattgaaacttacaatataatttttgaaatttacaatgtaagtgtaggtaatttacactgtaaaacaatttcattattttttactgaaacatacgattcaatatattctactccatgcagaaatatgatttactatctacgtgctcaaaattttctgaacggttgtcagaccacaaaactaatgcctgaattgtaagatcaactatttgtcttataatatcgttcctcgaggaaaatattgcacgcatcagattcagataatcaatcacggtctgatccagggattataacacgaaatccggacttcctgcactgcgtcaaacacaaaatctgctcggtttttccgggaaaatacttagtgcaaaccatatatgtagtcgaaatttagaaactaccgttggatcgagaaatggacgttcgagattcgtgcacgtcaccatgagttaaaatttaactcgcagattcactcatgagttaaaattttacttggagttaaattttaactcac

SEQ ID NO: 45517 - DNA, 18232 bp, Oryza sativa
gatccaacggtagtttctaagtttccactatatatatggtttgcactacatattttccccggttttccgatcaagttcaaaaatgatcaaattgaattttaaatttttgacaagatttgtttggatctccttggattttgttggcttatcgacggtttccatgaaatctgaagatatagttcatgagcggtttttcatccgatattggatcaattgtgaaccgtagtcaatctggtcatttgaaatcaaatccggagacccaaattgatgtcaatctaggccatttgaaacatttcgacctaaaggcctcgagtggctggcccaccttcaaatttagatgtagtaaccaataatgcacataaacgcctataaaaatgtgaacacgtacatacgatgagtccgtctggttttccacttcccaatggcatcaatcttaacgacaatgcctccttccatcccctctttttcttagacagtcatttctccctatatcttcagttcaaccatgtatgtaagttgttgatttgcttgatctcacgtctccttttccaacaatctcataattcccttttctcgaacaaacatgaggcgaataatttcaccgcacggttgatgcacgaaactatggtgtataactagctaggcaaaggaggtattcggaatggttggaggcaacttatgacgaccatcgaccgatccgctgaaacaagaacgacaacaactaacgaggttggcgcagcggagaaaggtgagggccatgtgactcaatcacccggcgaagtaatgatgctatgaaggagtctggtgaagaggtacatggcaaagccagggccacgcgaatcttggtgatgcgatgaagcgaaatacctggtggcgaagcaaatgcaccaagtggcaaagcaggctcggctccgtcatgccaaaaccaggggaaaccatcgaccaaccagctaggccaaaagacaattgctatcctcataaatgtctccatcagagggacaaccatattaactcactagcacatcaaactatagggttgtaaatctggccagtaaacctataaatagaccttaatggcggtttaacggagaatccaaattttcaattacaccatacttattatttttcaattccttccacttagagtagagcatgtctttcggcagaggtgttcgtaattcgaccacgggaatctcatggcatatcatttgctcatcaaatggcccgggtttacaaaacttggtgtagtagcagaacgcttgccaaagtgacttccaggtaattatggtaccgatgagctgctgttcaccaattacatggatccaagatcccgcctcgccagtggggatgagttcacctcgtcctcactgatcatgatgggtcgtcggcgttccaacagtgcgttcatcagcagttgctcagagtaaattaaaggaagtgcagacctagctatacgatgctatatacgtatatatatatatagctattctaattcgttttaattagtaagtcctacaggaaccatccgccagcgtaataagctgttgtacttgtaaagaaaacgtagaatattaaagattggatagcaaaagctccatctctctcctctcaatctcaccagtgcggtaatggcccaggcggtaccaacttcacacatatataatgtactcctagctactagcacatgacactaattatgacatggaattaatttttcagggtttcttctaaactactggtaactgcgagagccggtacaataacggactatgaatcagctataaaactttctgatgaatagcgtacttaactagttattttccccgggcaaaactgcaaaattccatacgtacttcatctatctatttatgccacactaatacagttcttaacaaaatcatgtgtatatgctttgacaaaataacctttgagatgcattctgaaaaataataataaaaaagaaccctttgagatgcaagtaagcacctagctgcagaaaattaatgaccaaggtgttttgtgcgtacatgtattatttactactaggcatattctgagtatattattgcacgtacacagcagttaagttttttttttcccatggactatatatgaggaaccatggccttatctgttctgtgtcaagggtctccacacagggtaaaaaccaaaaccacaaatacttgatcttggtgctctgagtgaatcaaagtactatttgttgatgagatatcccatgaaacccaacataatgttgaataagccatatgggtttgggaggcctcaagaacttacctatatatgccgaaattcacatcagatgttagagaatcgatgacagttgcccagcatcgcttaatcttcttccgtgcattccttctctttgctctacaagataattttacatggtaaatctaccatgtgatatgacagccatcttgatcgcaactgcaagctgatggtatctcatgcaatgtgagatcattagttgtagatgaacaggttaatggtcagcagttcttcacaacatgtattttccttacaggaagaaactttgcagttaattagtatcagtattgcagtatcaaaacaaagcatacaacaaaattttgcaaaatagaaattcatatcctaaatgaagagaccaaaatgaaaagtttttcctcttgtcatagtacggttttaaatagtttaaattgataaaattaaactaaaacaaaaaccaagcaaaacaaaaaaaaacaatgaagagcgtggtattacacgatttcattcccgtgatgatggcattcattgcatataaatgggataaaaaaatgcatcaatgaccaaagtctaaaactccaattttcccctccaaggtgtcttactcaattgttttccccttctagtgtttacatacccatacttgaggatggctctcaaacctaataggattccctcacacatcttttccctaccaaataaaaccctatcacattgccggttacaaaatgctcgttgctgccgatttggaactggcattgttgctcgaatgctatcgctactggtccaaagaaacaacaatatatagtgcttctagaaaaaaaaacaccgttgtctctctaactcgcagcagcaccacatcaacgtaccaatggccatgcccgtcatcatcatttgcagcaactagcacccaaaatctgttgccatcttttcccacaccaattaagctagagaagctagatcgatagccccgaggtcggaccggtcagatctggcaaacaagagcttggtccagctacaactgacctagcttgttccctgtaaaattaaatcatgatataatggtctgaaataaatcctagaagcctaaacatcaattggcaattttgacctttggagccgaaggatttgagtggcttatatttgtccagaattgcataggtgtactctaacatgtgggacagagttcatgtggatccccatcatcatcatgatgggatgagattaatttgctccatcctgcctagctagatccaacgatcagaaacgatttggtactatgaggtaccggtacctcgaagtactttttgttgaacatgagtaaatatcatttgcaatagaggctttagaatgcaggccatccatcaattggggcagcagctttatgcaccatgaaaaggacaacaacgagctctatgtaggcctggatcttcatacaagtagtatagagtgcaccttcttaattccttttctgttcggctctccctctccataaaatttattacttccaatcttcaggttcttcgtctcccgttcttgacctcacttctctcattacaacttgctcaaatctgcctctcttcttgaagtaatattaggcataaaatttgaccacaccaatggatgcaagaggtgatatagtatgtgggcatgggaggtgtagggaatggcaccctcatcaagcaagcgtgatgcatctttcatcagtgatctcaccaaggttgcaatccaacagtgtttacatgaagctgttcgccgcctgcaccccagtatatacatagaggtttacttttaccatgcacgtatggtgccctgtcgttcggagatggttcacttcttgagttgcatgaatcgcagaatggaaagcgtatatagtctatgcagttgaggttttgttcatttggcacggtataataaatgagtgggattatcctatgctgacaaaacaaagccttagtttagtgtaggagttatgtagtggatccacaagctgtcaagagctgaagtttcagacgttcaaaaatggatccagagttagggtttgaattcatcttgacacaaacgtgggctgaattattaacttgtgctacctgtaccaaaatttcatttgtatatcacggtgacaattgtcatttctttaattttgacctcaaacgaacaaatgctaactaaaggacagatcaatcatcgcataggataaacaatctgttgaaacatagcaagtggagtagtgtctgggtattctacctctgattgggaggtgctgattagtgtagggccaacatgcatgggagcatttctatcatggtgagagatgtgtttatatgcagccaaacaccagcatgcatatatctctcaactgcgatatctaggcatgagagatgttgggaatttcacggcctcatgcagtcatgtcctgatccataagctacgggaaggaagaatctgtttgtagcataatttgactaatatttagttttatttgggtaagccacattatttagtttagttgtctagatttatcgagtggttagttaaatgtgtgtggattgctgggaggcttagcagtgatacttgtgacatagagatactatgggtcagctaagtttaaccacattcaaggaaggtttttgcgatggtactatttgcatgtacattagagagtgaagacctgtgcagttggttacttggttgctggtgaaaatttgctgcagtccaggatccttttggggctgatgatcatattcgtgcagtggagaagtctatagcgtgctgctacttgactcttctcttaaccgcttgcatgcgttggtgtgcggctgcgtgaaagatgcagctgtgacgtcggattgtaaacgatacggcatgattagagcgtgcagctgctaggaagatagagatatatattttccatcttatcagtttgtttcctttgtttgaacgttgctactttttgtgttagaccgatgaccatgctacccgtgtgtgtatatatatatatatgccggtgtacggttaattgaggatgccgaacaaattattaatctactattttcctattctttactttcctgttattttcttttttttttgtttttatggctgagttctagcaacataagtgtttggttaatctttaccgttttgcgttgaaaaacggtcgtgcttctctacgaaaacgagaaggttattatcctttgcaaacattgctaggaaactagtcatttgttgttacgtaagtacgatattatcttcttggctaattttctcgtaaattagtcgtgtttggttctacgaaagtgaattaatctcaaagtcggtttagttggccggttttgatttattgattttggtgactctgttgattacaccgtacatcgttagatgatcttgtgttgaccacgaaataatgtcaacggaatatttttcactaattggcttctacacactctcgcaatcccaatggctttgtggcagatgccacacatttcttgccacagagaatattgaggatcattagggaaaaatatttaattgatgatttggttgttttgcactattttgttagtggcatacgcaatgttttaatttggtggtttttgcttcgtataaagggttaatccgggatattattagggatggcaacggggcagggcgggcgcgtgttgggctggaatgaccccacccctgacccccaactctccacctggccccggctccgagtggacatgcggggccaaatcaggccctgccactggcccctacggggccccgcaacctgacatgggccccgcattgagtagcaattccatcgaattgccgtgcgtctcagcgtttgtccatgcacgccgctcgctccctgtgcttgcgctgtgcctgtgcactgccgccgcgtctctgtggcaccgctgcaactctgtaccgcgctgctaccggaagagactaagagaggggcgtgcgacgggagtccggaggggagaggaggggaggaactggggagagcggcgagcccacgagatctggcgaccggagagagccgggagagaacgggaggggactgcggagagggcgaccggagggttggggactccggggtcgcatgagtgtgtctgcgcctctgcgggctgcagctgtgtggtggcgtgggaacaaggtgtgaggggagccggggtggtctagttagggtaggttagggtttttttccttatatatgctgacttctactgttttactaagatgggcttcttgggcctataatgggctatattttaagaggtaatatacggggccccgcgggtggaatgtctcccgtcccctcacccgtcaaaatgcggggccccggcccagacggacccacggggcagaaatgtcccccacccccgccccttagtgttgcggggacccggctccgtggggaaattgccatccctgctattatagttgaagcataaggatttaaatataagcagaccaccacctaactatatttcaaacgtggtactaaataatcatcactacagccacgcctcacgcctggatcacttggtcctaaaccagaccacgtgaacacgtcaagtgcaattgatgagctatagtagatgttacgagatttactccggtccaataaaaagtacttcgaggtacctgtacctcacaataccaaatcatttcggatctttagatttagctgggtaggatggacattgttagatccaacgatcggaaatgatttggtaccgtgaggtatgggtacctcgagatactttttgttggaccagagcaaatctcatatgttatggatctttagaagaaagtaaatttccatcaaagccaatatctaaagctagtttacaaagtcctataagaattcggcttccatcggatggtctattcaaccaaagaaaaagccaaaatttgaattttcaaacttaattttgatattgattttgagatattttcaacgtagtttctttttcagcattggcttttaagtcaccgagaacacatatataaaagttttacctataaatttatttttattctctaataagccgttttggcttattaaaagaaaagccaaacgattgggcccttcgcctcctattccacaggagcatcttttctcctaaaaggatacatataccgaaggttgttgcctaatcgataggtgcatctaattttggaagaaacttaacacaattcatggtaaaaaaaaacagaatcacatgcagtaattgcgccgaaataaattctagcttattaaaggtggtataacactacaacagtgggttaatttggatataaagacttgcatatataatgagaaaattttcctatattctctgtggaaaactaggtgatgtacaaggaactttgctctccagctagacactatagcaaaagcatccaccttggtttcatttcgaacaaagatagctaagcatgcgaataggaggtgtcgggtatttctttcctaactagaaggagaacaaaggggcatgcattttgttgctttgcatctgcagatgaactatgcagattgtaccactaacaaataaaactatgaatttacccccaaagactttgctaaatgctaattcgttgtgatgggttctgtgaaatgcatgactatagataaaatataatagtcatacattccacaatacttggttttaattagtgaatcgaatgctcgagaaaatattttttttcatatatgacaaatctctctgtagtatttatttttcaataattgagcctttttatattagcttcttattgaaccaaacagtaagaaagataaaaaaaaagtgcataccattaggggtagagtcactcccataatgttagcatggatgtgcaactggtccagatgaaccccctgccacaccacgttcacttaaccatgtcaaagtaattggtgtggctaaagacttggctgtgttcttaatcacctcttaccaactttactctctcgtttttcactcgcatacttcctaaaccgctaaatggtgtatttttcttaaaaaaatctatataaaagttattgaaaaaaatcatattaatccatttttaagtttattttagctaatgattaattaatcatacacaattagattgttctaatttgcgtgcgtggatgattaattaaagttcccaactttcacctccgaatgcagtctcaaagaggttcaattccaaatcccttctgtgctatcgtactaaatattttattgaaaacattttaaaatatgaatgagttcactttaggtcctttaattggcatgaaaataagaaaaccacaaacactggccttgaaaagagtacttataaaggtagctcatattgagagagggatctgcactcacatacatatattttttttttactaagctcccatgcatatattatatatagagagaaggcgggtgcactgtggccttgtggggatgggaggcatgaggaactcaacaaagcgcagctgtcacatataatgctctcagcactgtcatgccataggaataacctcgcaagagcaaagcaggtgttatttcttggccgatcactaatggtagctgtggcttggcgggttttgatcgagcttgtaaagcgcagatatctttgagcaattttctcggcaattgagcgtacatcgtcgtccatttctcctgtcgacactggttgatactctctctagttcatattataagttgtttgattttttttttttgctagttaaacttgtttgagtttgactaagtttatagaaaaatatattactccaatactttgatattttagatgttgctaaattttactataaatttaatcaaacataaatataaaaaaagtcaaacgatatgacataaagggaacggaaggagtaggaccgaaggatatatagtatcagggaagagagagggaaatcaacatctaacacatgtatggaaactggacatgaccaaacatacgccgttcaacaaattcattaagctatccataagtgatttgcactaacgcatacatggcttgtaacattgtagaacgttcaactcttcaagtgttttaagacccatacagatcttaaggggagagcacacatatggaggaaagattggtttcatcagagaactaaaaatcatgtcctttataaattaaccatccattcgaagtttcggtgcaagttcagggtacaaattaaacatactgttaccacggggaactattttaaactctcaatgcatgggacatcccatcgttgtttgcatgtcatcaaaatagttaagaaaaaaattgaaaaaatttaacaagaatgattaatatgtgataaattacaccataaacatacaaggttaaatttaacttctataagttgcaacgaaaaaacaaatttaattgcgaatactcttgtatgtttgtggagtgatttattatatattaatttatcttgttgattttttttaaaaaaatttataaccatttatatgacatgaaaataacgaggggatatcccctcgagggtttagaatccactcccccgttattaccacaccccacgagtgatccggtcgatcaaagttgctctgttgccaagacgcgacgaggcatatttgttgaatgttgatcatattgcataagacaatatcatatatgggtagtcttatgaacttaattatctatgctgaattttactccatgtattgcttcaacattagaaagcctgttgaacgtacagcgtgcctttgcttatttattgatgaaaaatagggcgaactgggtattttagtggcaaataaggtaccagtacagtttcaaactgtaaaaccggtctgggatttttcacgtttgttaccacagtagtatatcattggtcaagcaagcatggacagaatacctgacacaagaagttaagaagtactcctaaaaacaaaaacaattgttcagactcacaagcagttcaggacatgtactagtctgtctgtgtccagggttcgtagccagaatttaactttttttgggacggaggggtatgtccttatcttttttaaaaaatatgcgtcaataattagcatttgttgcgtcagaattgacaagtctcaaaggaaatcggattagaaaaaattatatcaaactggcaggttgatgagatttgtagttatatagttgaagctttttcgtttgagtttaacatgccagaaaagcgttataagtggtgcaatctattttgaaatacaaattttagaattgttcaaaccaactcggatggtggctatatagaagtgatagaacgctaagagatatacatcttagagatatacatctttttcatttgaaatcatgtttctttttttgcgaggaatgtattaaatttttagacaagaagagtcaaaagaattgcaacaaagaaatagataataagtgtcacgccccgaactagccccgagcggaactagcccgtgacgctccaaattaacctgttaatcgataccagtcccaggaagcagtgctggtatcacaggaagacagaatatcacagcaacagaggtctctttattatagagtaggagtacagtcatgttgggctgcggacagatcccgagctcacaactgcatttcaaaagggaagcggaagccaagacttggaccaaacatcacaggcgtgacttgggaactaggccgaaaccctaaaactcatcgtagccgacttgctcctggaagaactcctcgtcggcgggatccgcttcatcttcttcagcaactgggggagggggaattatttatatagagcaagggtgagtacaggagtactcagcaagccatggggattaagtgtttaaatgtaggcttcaaggaaaggctgttgtttttgcaattgattttatttaaactcttttctgaaacaactaagtgagtgcttctcaaacgacacggatgggacagtgcgtctcgtccggtcggagtatgtgcaaggtatcagtcttttgaattgatcaaggttggcatccggccaacagctttcaaacggccacccgggtctggctgatcccatcagccgcagattttccaaacatcgaacccaaaccacatcagcaaatttcacaaagcagtagtcaaacaaaactacgctggaatcacctcacatccgcgcatgaccgtgggcacggctgttcgaacagtttaataacctctgtagagggggtacactttacccacacgacattactaacccggatcatccagctcgtgcagaacggccacgactagagaccttaaggctttcatgacaaggcatttcgaaagccgacacaggttcaccatatgccaacgagaggggtcccagaccaacaccagattaggtcccagaccatactgtgccaggaaacccgggggttctccccgacaccaccccgttgaatccacatgtctcttggcatcatggctcccccgattagctagttactcagccaggggtgtcccattccacccatgtggtcgtacttgtcttatgttcggatgaaatttcaaggaaacggtccttaagtgcaagagcgggaaaccgtacacccggtacgttccccggtccacgattttttggaaattcatttagttcgcaagcaccgacccaggtgtcgggttttccaagtcttttaaaacccaagttttacccatggttggatattttatattttgaggggggtgttccgatgcgcatacccgaaggcccgtgcatcgaagcacaacagttaacaaaggaggtttaagtgttcaataattcaaggagggtaattgcagcaattaggattgggggccggtaggccgtctcgcaagccgcggccgaattacttgtgtaaatcctattcatgcaatatttgtggaaaagaaatacttagatttaaattataggtgcaagatgattgtcacgcctggaaattcactagtaatttccgaacttatttgtgcataaaatcctcgtccaggaatcagccgaggtacacaaactgacagtttaatatacaaatccatcataataataacgttagacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccttaacatcatgtctaccatgcgtcgcgatactagaaagtacccgaatagaggctgtgacaataccctctgtacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatctttaaaccatcattaagtaataatgagtcataagttatcccaataatgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctctaaggattgtgtttaggatctgtgtgacttgccttgcaataatcggtcttcaattaatcttctgaacactcccgacgcactcacgaaccttcgcaacgacggaaacgacaagctaacacgcaaaacgaagaaaaagactaataaaaaccaaataaacagtacaaaaacaagcataaacagtacatgtggatatttttaacatgtagatctcgattttagatgaatttagcaacttgaaccactcaaaacagagttacgatgatttagttatgaatttttaaagattaaaccggattaaagcatttatatggattttaattgaattatgacgcaataatgaattacttttgaaaaggaaaaggaggattattgcgtcatcaaaggcagtccgggtgcatgggacggtctaaggaaacgaacggccgagatcgattctatccaaaacgggcggccgggatcaacttgatctaccgcggttcacgggacaaggcgacgatgacgtcagcggtgacgtcagcgatgacgtcagcaccggcgacagctcggcctcgcgcgctcgccggcgaacgacggcgcaacgacgcaaacggaggacaccaatgggtagaggacaacacggcgaactcaccggtgaccaaaaccacggcggaagagcaacggacggcgccgacgatgaggaagaagcggcgacggtcttcgggtcgacggtgacggcggtgctccggcggtcttcgacggcggcgaagcagtggacggggacggcgacgacctcgcgatcccgatggtggcgatggcgaccaacgacggcggctgcaacggcggcgcggcgcggctgaaccgacggcaacgacagcgacggctagggctacgcggaggcggcgctagacgctacggcgggctaaggcaaaggtgacggcggatagaggagagctcgggggtgcttttaaaggggctagcgagcggcgacggaggcccacggcgaccggcggcgagatggaaagctagggttggagggagaaaagtcgatccgaatcgagctcaaattcgtcgatttccaaacgaaattgaccgaagtttctataagagaaaaggaagagaagatcgaggagattatttcccctcaaacgatttcaccggaaacggaaaggatcgaccggattggaaagcggcggcggctagggtttcggccggcagcggcgcggggaggaagacgggcctgataggtggggcccacctgtcagcggctgagagagaggaggaaggggcgcggcggattgggccgactgggccggggagggagagagaaaaagagaggttttgggccggctttcggcccaaagccaaaagagacttttaaaaacctttttcaatttaaattattcatgaaatacttccttggctcaaataaatcccagaaaaatctaggaactatagaatcaagtaaagtatttaacaaaattttatctagcccaattttatattgagatttaacaaattaaaattagatcttctcttttaggcttttaagatcatttctaataattccttttaaacaacaatttataatttaaggatttttaaacaagaaaagctcttaacacttataattagatcattaatgatcaaataattactgaactgttctttgtatcatttaggaattgagctccgaaaaatccgagaaaatttcagagagtagacttaatcatggagaatttaataaaaattaaatccatccatgctttatatttaggaaattttatttcccacatttaacttcacttgtaaattaatgaacatttaatataaattctaataatgatttattaaataatttataaatcctgaaataaaaatcaggatgtgacaatgatcaacggtgacttgccttgctcgagatcttgaacttcatcttcgaaatcctcgcactgcgggtcttcgggctccgaaactacacgggaaacgggacaactcaacaaacggtgaaaataaagccctattattgacctctaggcgtggcattagatagatctcgagatttgaggagttttggaagttgaacggagtcaaacggtcatacgattgggaagatattgaatttctaacattattggatttttggtctaaaggaaaaggatttatttaaatcctttttgaaatagaaaagaaaagaaaagaaggagggcgggaaattagactttccttgggcgggtagggcgcggcccgagagaaaggggcggcttggccgaacttaacgggccggccggcccgagaaggcggcccaaagcacacgcgcgggcggggaggagagaggaagccgatgggccgggtccaccttgcgtggtcccgggtgggacccgcttgtcggcggctcggctcaccatgagcgaggtgcacgcggggcgtgctagggtttggggaggggaggcgcggcgcatgcgcgtggttcgcggaggacgcggtgcggcgggcccacgcacagcctcacggctcgcagttaaccgcgcgcgcgggcagggctggagggagcggcggaccggggtcagcttgacccggtcgcggccgaagtggcgctgacgtggcacctacgtggctgccaggtagacgacgacgtcggccggaacggacggcggacggcggcggcaagcggtggatcgaaccacggcgatacaggcgaaagcgagcacaccgggaggttgcacgggacgaggggagacgagccaacggctcggattcgccaggggatgctcgacggcggcggattgcggcagcggcaaccggcggggagagaagggggaaacggcgacggcgcgacgggagaccgattcgggcgagctaaagcatctacgtgactccgggaatccgttgctagcgtcggattgggcggagctacgccgagcaaggccggcgacgagcgggcgctacagagcacgggcggcgacggcggcgagcacacagcgagcggcggcaacggtcggggcggcggcagctagctacggggaggctactcgtgctactacctaagtctaaggggaggagatggaacgaggaaggagaacggagggaggcactaccgtgcggggtgatggggcgcagtgacgaggggccgacggcacgggagtgatctctccggcctcgggccggggaagaggaagaagacgagcgcccggagtccccttccgcgtcctagcgcgcaccggctcctccggcacacgcgacggtggcggtcggcgagagagatagagggacggcaatggcgcgagcgaaaaatagggaagattgggatggaaaaaggaagggagggcgcctgggtttatagggtgacaatgtcggtttggaaaccgaccttgggcggtcaaggcgcgagctggcgcttggcgctcgcggccaaaacggcgacagaggcggatgacgccggcggggaagagaaaaggaaaaaggaagggagaaagggggcttgccccttgcctattcgggaaaggaaggagggagagagggcgatgaggaggagccctgcctcctttccttggaagcacgcgcggggagaggcggggccgagttgatgacgacggcgatgacggcgggggcggtttggaaaggagcggcgacacgggcggcaggcacgggctcaggcgcggcaggcactgacggcggcggcgaccaggcggtcggccaccacggcgtgcgcgcgtgggaagcaacgggcggcgcggcgatttgggcggcgtcagcgggaagcggcagcgagggcggagggcgctcggctcggcgcggctcacgcgcacgcacgcgcagcgcacgggcagagcgggggagagagagagagagatgggggggagggagagatgggccgagaggaattcggcccatcgaacccgagggaggcaaaatagacttttgcggagggatttgatttgggaaggataattgagattagggtttggatttggattcgggacttgaacttgacgatagatcggggatttgagatccggaatggcacggagactgactgcaagcgaggaaaattttttttcgcaattaaggtttttagaaattacattttcccgctaggcgccacgacggaacgggcgctacaataagttttctacaggtgagagggtaagaatattacgtgtggagcctaggttagaatcctaaaggctgcacatgcgttgagagtgtctattgagaaattgtgtgacttgtgatgcactattccttgtaaaatacaaaatattttttctgtgcttcttttagctcttataaaattttaaaaactcatataatgcttgttgtcggtcgtccggcgttgaacggaaaatcggacgccgacgccgacagttgtagaaataattttctctctcttcattctccttcccacgcatctactatatgctttctgctatagactttatgcatgcatgtgtctctatttataagctttaaatatctttttcttcaaaacagtttatccgattgtatcattgtatttgttgtaattaaatctttacaacaagatctcacttgattgtatttagacaaaatatgtatatatatgtttcagtgtattaaaatttaatgttttgcgtgtgagaaataaatgtttcagttggaatttgactatgttgcacattttttgttcaatgttgccattgattttttttaagtgttgcacatggtgctatttgggtgatttaata

SEQ ID NO: 45518 - DNA, 12337 bp, Oryza sativa
tgacaagtcatgctttggggaggcccaaggggccatcccagctgctctagcccattggccatgggaccagcgttcgccaatcggccaagtggaggcccatgtatctcaattacatcgtgtacccatgtaagtgtccttttcatgagggcaaccatgtgaattcccctgtaaaacctaaaccctaatagggggacttgtaatgggattataaatagacccctagggccatgtaatggggggatcccaagaaaaaatcttaaatatacacactcatcgttcccaacaactgttgagtaaccacgtccttcgacgtacgcagttgtcgttttgacaacaactagtttatttacaaatgttgcatgtggtgttatttggatgtttcaatatcttatgatgttttactaattcatttataattgttgcacgtaatgctgtttgaatgtttcattaagtattttctaatgatttatcaattacaattcgttgtttcatgtataatatagaaatgtttcaaaacagaatataattatatttatattttttattataaacataatcaagtgagatcttgttgtaaatatttaactataacgaatataatggtgaaatcatatcgtcgataagataagtaatttagaaaaaaaatagtttaaagttttactaaaaatattgctaagagagataggggcttgtaaatggtattggagctcataggcatgcaacagctatcagagaatgacttagaccatttcttttgcaacgtgtagcatgcgccccgtgcagtctagcagacattgcaacgtgtagcatgtgccccgtgcagtctagcagacgtcagacatgcgtccgatatttcgtaaaatatcgtacatccgtagctctctcccgtatatgtcatccgttatgggtaataattatgacgtacggatcatcactagtggggtggtatgtcaccctgttgttttgtagtgcagtactgggtggttattagggaccgttagacaagaccatctatgggagttcacacattacatataaatctcgtcattgacccatggtctatttatggtggatatatcagttgcaagtggggtctatgacccatcacatacgatgggtttttttatatgacttttaaatatgtggtccgaggtaatccaaatgtgctttcacaatgggagaataacattatgtagaattggtcaaccctgtcttcgatctttttcttcttctttttttctttcaggaaattgctcaacacagtcatgcacgaaatttggattactcgtgtagcatggacagacacgagctgggtgtaactagtatggcaaccagggccagatggatatagactagaccctgttagatcgcacccaaaaatttttcaccctgtcaaatcgaacgtttaacacctatatgaagtattaaatataggctaaaaacataactaattgcatagattgcgattaatttacgagatgaatctgttaagcctaattactccatgatttgataatgttgtgctacagtaaatatttgctaatgatagattaattaggcttagtaaattcgtctcgcagtctacccacggattctgtaattagtttttttattagtgcctaaacaccccatgcgacatcctatataatatccgatgtgatacgccaaaactttacacccctgaatctaaacactacctcaatatacaagtgcaggactctcccatattaaaagtgaaaccattattaatgaataaacacacaggttttataaatttcaaggatggaataacccatgtacccatgtatatattttatttctacgctacgcaaattaaattgtgatgtgcacctatataaacattctccaaggagccacaagtgatatgatcaatcaaccagagatgttgctgtttatcaagacccgacactcgataatataatgctatatatgtttgtcaacagtaattgcatattttcagtaggtatgggagtcatcagaaattagctttgcaagcttagcgctttgtaagtcgcttacaggcgtcataatggagcatgctgggctcaacctgtttcagtgtctcatccagtgtgtcttctagttgttactcctacatagcacttccttagcttaaacatgcatgcaaataccagcttgttcgatcttactagaaatgcagtactagttagttcactcctgatggacatgttccagacataaccgctgcccatgctgttgtgaacacagccagctatagccatagccaatagctaaccttcaagattcaagttgcttaattcctgtgagtaataatacctaaaaaattcaaaccatatagccatagccaatagcatgtcagttctcaccaaaggaatgctgtctagctagctacttgctactgatcagcattaatcatgttaaatatctatacctatactaattaggcactttctacgagttctcacgttaaccagaaatatcagaccattgattagatatgtcatattatcgtgacggtagattaatatcaaccgtacgtggactctctctaaagcccaaccaatattgcaattgggcccacatatgaattttaggtttcatgcatgtacgtatgacagggtatatcaatctcagaaggagtcctcataggagatcgtccccaaatctcgaccgccggggcaacgccacctgcccatgcatatagaagcgatcaatctctgaagatgaaggagaacgccgagtcaccgacggcacgattccggcgtccaccacagttcctgcataaaccatcgtacgtcaccaatgaaatcactgcccaccgtgtcctgcactatgcaacatcaagcatgcagtacgagagatcagggtgacgatcatgtgcagcgtccgtatctagatcgacgtacaataaaacgatgcacatgacgtgcaccaacgatctgcttggtgtcgaacaggatggaccttggacttgcagcggctatcaactgctggcacaattatccgcaccatcacctatcacaagcaagatgaccgcatatttaatccccataggtatatattctttttgtttgaatccagcaatgtattgtctgaaaatatatatgcactctaattttgttttagcatttggcatttttgaacaaataatacatgcatgttgttcctttatcacatgattacaattttttatgttaatttctcttgataaaaaatatgttttatgtcatcctttatttttgagattgtagatttaggttccgctggttagtgttggttgggaactaatccttcacgcacgcaaacggtgagacagataataagcatgattaattaaatattataaaaaacatgaaaaacagattaatattatttttgaagcaacttttctatataaatcttttttggaaaaaacataccgtttatacgttttgaaagtgtgcgcgagaaaaataggagagtagaagttatcaaagtgaagaaaagaacacacccttaatgatttgccatcctggtgcacatatcagggcaccacaagtcgttggcatgcagtggagtggacatgaaaatctaaatagttagcaaatcattaaatttgccacacgctgcatcaaaatttatttgaacagattaactttctctaataatattaattgttattgtaaatattttgttgacaagtaatatgttttacgccattggcagcgaaatgacaagtgcacatgtaaacaattccaaaggtttcacaacaagaagaacaccatcaagttgaaaagtaaaaaaaagaaacacttaacatccgaaacattttcactgttcaagagattaacatttcacaaaatatggcaagactagaacaaattaaatctctttagatttccatgcagtcaggatatttaccaataatagcctgcaaaatatatttatctagcaacctgtaacttcggagcattatttactagaagtaaaaattatttagtttgctcacataaaaagaacttcattattcagtattcatttattttaaaagatgtcattggcagagcatattacattaccaattgaaacacatgcaagttctgggatatatgctctgaattgagtgatttcaactaaaataaattaatatatgtaatgtatattcattattaaaaacactgcattcttttcagcagcatgttttatatatttactgaaaaggctaacaacactgcctatatgtagagtattcaatatcatccacaagaaaaaaacctacattgacaaatagcggagctgcgaaacaagtataataatttattatagcaaatcaaatttccattgtctggtaactgctagaattctttaataataacccatgcaacgcacgggttggcggctagtaatgtaaatgcatgactacttccagttggacccgttcgatacatccagttggaggtatattttcagcacatgcaaaacgaatgaactcattagcacatgattaattaaatattaattattataaaattgaaaaatagtattatttatttttttaacaacttatacatataaactttttatcaaaaatacaccatttaatagtttaaataacatgctaacggaaaacgagaaagttgaaatttagagttgagaaaaagaactcatcctaatggtaagatgacaattgttctttatttttcttggtgggtcaggtaaagtgacaaattgacaatgtaatagatttttttttcaaatacacgtgtactgatctttgtagaaaggtaggacaacacacatgtgacaaccagtacgctttaaggtgccaatggagaattattaactcacatacatgcagctttgagggagtggagctttgtacaaaaatgacattaagaagccatggtagttatacatagaggaacgaccttccatagaaacaccaggttctctataatgtgatcctcaaacatttggtgaatgacaccgcgaagccaattccaactaacttcgatttacacagttctggatgtgaattaattactgaattgcaagaggagtggatacttaggtggtgtttggatccagggattaaactttagtccctgtcacatagatagactacttacaaaactaattatataaataagagctaattcgcgagataaattttttaagcctaattaatctataattagcacatgtttactgtagcatcacatatgctaaatatcgattagttaggctcaatagattcgtctcgcgaattagtctagggttataaatgggttttgtcattagtctacgtttaatacttttaattagtgtcccaataactgatgtgatatggactaaattttagtctctatatccaaatagggtcttagagcctcatcgcttgcccatattccctaataagcacttttgacttattaggaaattaaagttaatttatatgtatttttttatacatttgttcgtagggaccaaaaagccaatattaaaaagaaattacattgaaaatatcttaaaatcaactttaaaatcaaaattcaaaatttggttttttgctttggcttgtttggacaaccgagaggctcttggcattcgttagaattgcacattgaatgccatcagaaacgaaaagtgatccccgcattgctctgcagactacagactgaatgtgtgctgtgaggtttattctgatttcgaacgctgtcatttgtagcaattcaaaattctacactttcaccccccggttacaataatcaaaagtctgtgcatcgtacattcgtaaggatagagaggggaaagggtatggattacggaacgattgctcacgaaggaatacaatttcatgtatcttctgaattcaaagaactagttggtcagagcttcttgtattcgagggataatctgtaggaactcagtcagtcagatcaacaacttaaaattccttcacatcatgttctagcaagaggaccctaatttaaaaaaaaaacagtctgctttatcatggctctcatttaatacgcgaaccaaggaagcatcatcatgaaatgcagcatgtacccatgggtagagacgagtatatatacatagagatgccatatatactaagagatccaacttgggacgacacgtcgaaaatgaaagagtgaagttgtcttcaaaagccattggggctagatcgttcattattgctgcttgcccagtggcatagggatgggaggcatggggaaattagtcggaacagttgttcacatcatctcttatctggttaggtgatttatccggagctaagatttaattcagagataattcctccatgggatgataccatggtgcgatgacttgatgaaggtgagtccaccagcccgactgacttacacacataggctcaagagaagggaattctgcaacattccctggcaaaattcgattcgaaacatttgttgtccattaggccatttggtggtagatgctacagatagagcaatggagtggccctttgtaaaattaaagtgtttttattattattctgtgatgaataattggcatatgtgattattagttttgatatttggagattattggcgaagtggttttggagatgattggattttcagatgatataagggtactactggatatgtggtccggtcagaccggcgagtggttgccggttagaccggcggtatgtgaccggccagcacgcggtctgaccggccgactctgtatcggtttcggtttcgggttgtttgtttggatatccatggatgtttcgtgtttatggctgtcgccgcctctagcctccaacgccacctccagcctccaccgcgccgccgccgccgcctccgccctccaccgtgccaccgccaccgcctccgccctccaacgcgctgccgccaccgcctccgccctccaccgcgccacggccgccgccgctgccaccgcccgcagccgacgcctccgccgtccaccgcgccggcgacgccaccaccctccaccatgccaccgccaccgccttcgccctccaccgcgccgcggccgacgccaccacctccgccctccaccacaccgccgcctactctgtcaacgtttttcattccaaacttacccctgaaaaattttggtcagactgagaccgagaccgaatttgccggtcttgagattttttggatgaaattcggtcctaagttttcaaagaccaaactgaccaaaaaaccgaagaccgagaccgaatttttcggtctgaccgaacgcccacccctactgggttcgtatcccactagcgcacctttttctcacattttactctctccaactgcccccgtacgcacgtgaccaccttgcacaaggcagtccgggcggttcatctccgattttcttggcggttttcctacaaaaccgggtggcccaaccggtttataccaacccaattgcatagacggtcttttaactagaccagaccggcggaggctttggttctggttttttccggtccaactgccggtccggtccggttctaataattatgtatctgcatcttttttttttcccaagctgtgagcatctattaggtgttaattttgccgcccatgattttacatagacttaacgggtcgcttcctcaaaacagattgccatcattagtgaacaagggaagaccatagagtaaaaacttgaaaggtgttcgtgaggtttaaactacgcttgttttgcatatggtataataaattggaatgtttagccattgcattggtagcaaatcctcccttgctgtggcgacaaactttttagatgaatcaaatcatgcaattagtgcccaaattgtattagtgtatcacaggaagctgagttcttagacaatcagctcagtcaaaaaacagtaataaaaaataggtggattggattgcagcccacggatggagtgcgatacttcagattcatggtgctttcggcctgttcacaataggtcaaagccagaaattaaactggaagccgaaataaccggtactgatcatgtcattaagtttcgttcatggttgttgagacttggttttttcttcctcatcccaactcacgtatgagctagctagcattatataagcaagagaaatgatcgggtagtatagacatgctagtcgttcaggtgtagatgctagacatccttaatgattttcactgcccatacaaataaatgagagtttatagctactaacaggatatacatacatggctgatcactgtaccatgatcttgtgttttggggtatagagaaatagggagtaggaggcatagggaatttacgtgtgggtactcatagtgctcatccatggcacttcagtggaaaaccactacgatcgccaaggcacggcacgcctaatcggggaaatgctctcacagctctagcacaaagcctacggagaaccatcgacactctacttgggccaacccggccgagtgcccagccagcagtgtgtgttgcagtagtcgaatcggccggcttcgtcgatcgatgctggtcctgcgggcattggcagttaaagctaatcgccaatcaattgaatcctgctatcactatccgcttcaagagtgtacttcaagtcagggtcctctttcttcaacttctggaacaactctaatgttttcttgcacatcatatcatttgattgttcctttgatatatatttgatcgcaaagagtcttcagagatctcttagtgaatggaacgtcacgcattgaaacaaaaaaacttgcagttatgcagtacacctttgacaggttcacattattaatgcttctgagatgtctcacgagctctttggtgtgtatgtctatgtgcttatgggagctccagtgcttgctctcaccacatgtttctgacaacggatggttatgctatgatctgttttcgctaatgtaccatccattgtcctgccgacggtacactggtacagcctaataagagccttgcaatctgttttcgatgttaccctacataagattggtgcatacctgtcatcgactggtgcatatcacttgtcgaaaacatagtaatttcaaagcatcaatcaattttaagtatattttactgaccgcacaagcacatggcagatcctggactgatttatctgtcccaccatactttacacttcttccatacctgcaacgatgcacaccagcatactttttctcaccaatagttattactccttatgtcccaaaaaaattataaaatttagcatagttatgtcaaacatttttaattttaactatgatagcaaaaaaatgaatagcaaaaagaaaaagatcaatcatgtaaaattgatgttactagatttatcattaaacaaactatcataatatgcaacttttttatttaaaacatcttaattttatagatattatttgttaaattagcatctcgaagactgggtcgaagtccaaaatacgtatattttgggacggagggattactcattaacaaaatccatggcaaccattgaagatgcatttcttattgcgaacagttctgatctttgaagaataacttgtctttaatggtctaaaaaatctatagtagtgcaatgtactatcaaaattagactttacatacttatatctattttgttggatcactactttagatacttgatgccaaaaccaacctcctaggaatgcaaattgtagagatcgtacgcttcctgtagagagtcgaatgaaagacccactttcggttcactaacaaggtcaaccttcttctcaacaaagttttcgatacttgattccaacgcgcatacacgaccactgattaaatcttctgtttccatttttattataagcacagcccacatggttataatctctcgtcttgctcaacataatcaaacctttgtgagagatgatggaagtggtgacttgtctttctataagaccttaggacttttacgttacactatacttgcaatatatacttacaggagtcctactccggtactttctactcggagtagaaagtaatctaggcccttgatcatatttaattgtagggttaagatctagttctactcctaccagaattagtggaagtagaaatgtggaggggtgtttttgtccaggaaaaataattcgcgaaggggtattattgttttccgatccatagatcgatcaccatgtcatcctcgtcggagttggtcgtgcaagatcttaatcgatccatgtaatccatgaaacaacacagtgatcagaaacggcaagaagacgaatgagccgagacgacgccgccaagcaaatgacattgcgtgcgtgcgtgacgctgccgccgaagcccaggccagaatttttaccaccgccagaactcctgctcaagattgtcgctcgctcggacgccaccacactcgtccgctcccagacggacgatgcgactgaggaagcagacaaggcggcgacggcggggaatacggatggcgacggagggggtggacaaggcggcgaggccgggggaggaatagcgaggtgactgcgtgcaacggagttcggacctgatacgatgcgaacagaagaaaacatcccatgccaaaattacctctaaacgatattaggagattacttacctgccctttaaaataaacggtcaagattaattctacttggagtagaatactgcaagtagattgcaccggagcattactctacttacagtataaacaatctaacagtgtgaatttatctgatcttctttttaccgtataaattgtgaagggtatatttgtttttccatatttttgcggaggatatttttgtattttcgcgttttattctttagtcagatccggatagtgagaaagggactcgtcccatactcccatgcgctaccaccgctgccgacagccaccgcgtcgcgccgccacactcgaacgctgtcatgtatggggagagaggaaggggaagcagcacagagcgcactggagcagcaacatcagctccgcagttgttgtgtctctctgatatagttgaacgagtgtgggtgattcttcagagttcaggctagtgtgcaagatggaggcagatgtgtgtcgttactggcttactgcatctgaacttatgtactgaatactgtaaagaaaaatgtaaaaaatgtaaaaatgtactgaatactgtttcgattggaaggaatcgctctgcctccacgctcgctcgtccgtcaacaatcgatccgccgccacgcgcaatgtattccgaagaatcactgctgctctagcccaatgtgctacgagatccagaacaaataccaactaaacaaccctttcgagattaactcccggtgcaaataaatcgcaaatttacattactaaacagccctttctatatttttaacaaatatcaaacttgccctactatatgctgcaagtatatacctgtagtagaatgtaacgtagaagttctctttcgcgaagccttgtatacatatttacaacacaaagatatgatgatatatgataccttagtaagtcagggacgaacatgcgaaacttccacataacaatatataatttgtgctgcatttatgacatcagacatatgtcgccaagccagatagagcaccaagtgcttggccaaagatttcaccaagctatcagcaagcaaccactactccttttcttcagttccacgttgtttgggagctgttctgtttgctgaaatgctgaattccatctcgttccaattaacctgctcaaatttgcactctctagagaatatgtaggcatggaaggtgtcgggaattcggccttcacgttgttcagtcttttgccatcttctgtcaaagaagtaaatgtcgttgaagccgtgaacaacgatcgttaattcaaaataagtagcaatattgatcaatcagagagaagataaggagctggaaactgcggttcggttcttgaagttaaatgttgttctttcctctctctctcacttttaaatgggacaactaagcaaagtttattcttcatgaaaattatattaaatgttttccatcgtgtggctggcctgaacaaattcatctcaacgagtttttttttcttttattgattcagaaataaaaataatgcttgcggtatcctttcacaaattactgtttttggatgtatctaccaactatgacatgttttggccatgccccctagccacatttgagtaccaatataatccgagagattggggaccttagagccccttcgtggggccttgcaattgagccatcgaggtaggtgataggtctacagtttataggtggtggagtatttgggttattatgttgctttcggttcgaaatatttcaaaagccaaaattaaa

SEQ ID NO: 45519 - DNA, 17460 bp, Oryza sativa
  unsure (1)..(17460): unsure at all n locations
gtggtaattataagtaaggagtacacgatgggtgtctccactcaggtagcggttgttggccaatgcaactaacacaattgcagctgaaatatatggctattgaccggataaagctagtactaataaacaaaattgaaggccgctaaatattactggagagtgaaaaatatcatatattattatggtaaaaagaatgttaatttagtaggaaggaacatatataagagcacattagttgcatagctgatcaggaatacagtcaagtcatatagcaaacatactgaaacaccatcaatattttatatttaaacatctacagatatagtccaattatctacagacattaaaactattatgtaagaatggtagaaaaatttcctgcttagtataagatataggagttgggaaacgaattaccttgcatatataattaagtacacacccttgattaactccttggaggagtgttcgaagctttcagaaaactccaaaaatatttttatatcaccaagctgatttagcgtgacaaaagatattaaaaatatatcttgagtatacatctacatcagaaaagaaaatgaatccgaccgcattttctgcgtagaatctaacatcgttcttgatggggactttgtgaaaaaacacatctatagatgtaccgagatatatataatttcaccagtttaagatcataattaaaatactgaaaaaaaagctccatctgcttagcagcccatatgagtgttacccagctcgatgagttgcattcttcttagatctgatcggtgacaaattaaccaatggatgcatatgatattatttgccacttccttcaaataattcaggacaaagaaggaatatgaatcaactaaatcagtaactaaggacctgaaacctaggaaaacaaaagaggatacagtaataataaaatttgttaagacaatcaaactgagcaaataatgctgctatatactgaatacgtcccataatgcaaaactgaaataaatattcaactcatgctggtacaaatcaaaatggtgtatgaacaaaattagattgatcgaacataaggaaagggaaagttggtgggtagcctgtgtcagatcattggagtgattgaagaggataaccgggtgggagatgcatatcaatctagcaagcagaattgcaagaatagtagtaaaacgccaacagcctggtagaatagtagatcgataaataagtgagatggcaaattggatagagaagcagaacttataaagggataagatctaggagaagaaaagtcattacgccattaatggatttacttgataatagtcatgaagcgttctcctcggtggttgtcgacggtttccgttcgtcacggctcccataactgcagatgcattggtgcggaggagaagcgagcgcgggcccgcagcgcagctcccgcaggcacgtgcggtgcggaggaggatcgctagggtgatggagaatggatgcaactcgacgcatgtggcggctgcagcggtagcacagatgggtaggtgaaagaagtgggctgggcttgacacgttaccgagcatccagagtagagccagaggctgagatgttacaggtgacgtggcttaaccacaattcagctttgggtcttaactatatagaaagaagggataggggaagtaatcggtgcagtgtatacttttagttgtgtagatgagatgctagacatcttgtgaaggattttgttcacttgtcaagtgctcatacgcatgacactctaccgaaataggatatggaggcacagggaatttatgtgtcgccgaaagcttttggttcttatccatggctctggagaggaaaatcacttgccaaagaatgctatcagatccggcgctaagctgacctatccttcagacttccagtagcgcctagctagccagcaatctatgttgccgtggaatcggccggcttcgacgacgaccctcacgagccgcattcgatcaagtgctatatggattgcttgcaccacagcctaatcggcgatgaccaaatcatgctaattaaattgatggatgtggttaagacacaaggacaacaataacgaagattggtcgttgttgttttattaactatatgtgttaatgtgtgtgatcttgaagctagattttttatatatacacacacacatacatgtgtgtgtgtctatatatatatatgtatatatgtatatatatatatatatatatatgtatatatatgtatatatatatatatgtatatatatgtatatatatatatgtatatatgtatgtatctatatatgtatgtatgtacgtatgtatgtatgtatgtatgtatgtattagttcatactccatttttatttgcatttagtttccatgtttgtctttgacatggtattgtattcgaaaacgctggcacctgggcgaccggggtgggggtggggagaaaataaggtgatcccccccccccatgcgcatgtgctcccctaggccccaccatgtatctccacaaaaaatgtttcacctagtgtactcacaatgtttcactatgtatagatataatgttgcagtgaattgaaacattcttttacaacaaatcacccacatattttggaaaccctctattaagataattcgtttttttttgttccaccaaaaatgtttcacctagtgtactcacaatgttttactatatatagatctaaggttgtagtgaacagaaacattctttttgctatttgctgaaacattgtttttatataagatgaaacaacgcccgatttaaacgattgaaacattttcgatctacttagtgaaacaattccaatatacttggtggaatatcgtgcaacatttaaaaataattcaataattaataagctaaaaaaatttcgtcggaatatatccatgtgtggtcttgttttaaagatttaattgcaacaaatttaatggtgcaatcggatcatgatttggataaataatttaagagaaaaaatagtttaaagtgatttgcacgaatgcgtcttgctgacgtcagcgcctgatttttcccccctccccatcgggcgcccgattctaagtcgtgtcctattgtatttgatggccgcaattttaatttcccttaactgctccctctatttcatgtaataactggtaatttttgttttggaattgtttggtttgactaccgctataaacatatgttagaatgaaccttttcactagcttgtttacaagactacaagaggtagccaaggacttgcaacatgtcaaattgtccatgttagcttaggaacaagtggactgcatgctaggtgactcttatacatgtggaaatttctctcgcaaactaattaagaatgttagccgaagaaataaaaaagaacctatatgatatatagcatgcatttccattgcgagaatttgtgataatatccaggcgtgggaggtgttgggaacttcgcggcctcatccaatcccaattctcgcaacccgggaaacggggaaagcattctgctactttccctctctgaccaggcaaacccgacagtgttggtggcacatatgactaaacgctcatatgtctatgtaattgcagtgttggtcatgttaactctgtttgccttcaatcgtatgtgttctacaacccgagtgacatccagattaggagggatccaaatgatgatgtgctttttagttttagtttaagcgtttgatctcgtttcattgctttttttaatttgtcagttgcatgcgttgtagcagtgttacgactgcttctacatgcaatggttaatttggttgtaacatgtgttttgcagtggcacatataaacctttgagaaaagtttctttcttttgcaggcataattttacctgaaaaaaaattactacttgatgaaacacaatccaaagtgaacagaaccacggcatttgaatattactcgcaataaatggcgaaaaccatgaattcaaccatattaaaggcggtacaagagtgctatatcgtggaagttgtaaactactccctccagtttcatatttcctatgatgtgaccatggctaccatggatgcaaccattgctcacatcatggatgaacaagaagatatcgagatcaagtactccaagtgctggaatctgattcggccacctactacactgctgacttcaaacggccaccgaatctgcatacgacctccgttttcagcccgtgagtacttgatggaaagctctcggagcctctttccaacggatccagcctcatccccgaattccatctcgtgtggccggaatcacaggcacaaggtgctgcatcacctataatgggcctatgggcttgtaacttcatttgggaccccagctcaggtggggcccatgtggggtgcgccccaaccaggtgaagcacgcccctaggcacccctaggtcatcctcccacccctatatatagctaggtaccccttcagggtttattgggttttgtttagatgaaagtttagccattgctacttccttgcagcgcgcgtgtcggctagaccgtccgtctgcttgtattcgaaaccccaacttatcgtgtgtattcattcctatttgcaattcagattgcttttatcttgttcttgcttgtttcttcgatttacttgtaggaataaggttgatctgcaccggcaagatcaacaacccacggagaggtgtatcgatcgcaaaggcgcaacacaacgtcttgtacggttgtagtcggatcgtcaatgtttctcccaaatcatagttatctcaactcaccgaaagatcgggccaacaacagtcttgagtgccgagtggaactcagggttcatcaggtggtatcagagctttcgttgctcggtgagtcttcatcttcctataaccagaaaatagccatacaaaaaaattcgtatcatttacctaaccatattgtgccattgcattgttcttttcaatttttgctttgttgaattttgtgttgcatcgtcacgtcgtgttgctggtcttagcgtctagttcgtttagagtttcaagttctggtcacgttttgtaccacagtcgtcgctgccaccgtgtctctgttgttgtcgggacctacgaaaatggaatcggctcgctgccacggttctatttttgtagtttctagaagtttctgtcggtcagttttgaagttgcatctagattttgcttgagtttgtagtttggccgtgagtctgtagttctatcgtgcttgtggggaggaatcggttttggaaatatgcaagattgatcaggaaggaaatagtagattggatcgtttaaaaataagtttctgtttttatcctacacaagtccggccttccatatcacagaggactgaaccactctatcttcgccatcctgtgagtccgactccctccctctctcacgtggttcctcggttccgagttgtgttaaacacattggtgaatttttgtttagtgtcggtttcgagatctgtttgcaaaaacagaacctatgggatgagcgcattccatttttgtatagtccaaatttttgggtttgcacttttgcatttgagtccctgtaatttgtatatttatagttgagtccttgtaatcttgcattaaggtccttgagttggtttttgctgaaaaaaaaattaaaaaaaaagaaaaaaaatgcagaaaggtgctaaaaataaagaaaacaaaagccgcaccaaaaaaaaagaaaaaaagaaaagaaagaaagaaaaagatagaaaaagaaagaaagaaaagagaaaaatcagttgtatctttgagtttgctttcacaaaaatactgttatgtttgagctgaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacctagagctccacagatttgattgcagccgtacagcaagtgtttgccaaggcatcgatacatccaacctctattggggtgcttgattgagtcggtgtatgtcaccattccgcttgccttggtaagatcttgtaagagcttagttaaaagcttgagtttgtgtgatttttgagctgccactatctagtagttaataggaacgcgcatatttttgtgtatgtttcttgtttgctactaaccatggcaggattgtgcccgcggaaacgagatggtcatgctcaacgtcaacatcttcaccatcaacgagatatagcgacttcttcacgcatcacatatgaggtacatgataatgatcttacaagggtagaatctaaattgcctggttttgatggtaagtatgattccgccgcttatgttaattgggaactagcagtagaaaaacaatttgatgagtatgatttttctaatgctcaaatgattaaggctgctagtaataagtgtaccggttctgtgtctttttggtggcatactgtgggaaataagcttgaaacttaggatgaatgcaaaatactgatgagaaaaagatttgtgttttcatactatagacgtgctctccttgagaaatttgaacatctaaaataaggtgacaaaactgttagggagtactttcatgattttaaaattggtatcacttatagtgatttacaagaatctaatgagaacacaatgactagatttttcagatgacttaattccaatattcaggctgggcttgttaatgtgacatataatcatataggccaattgttcatgcttgcttgcaatgttgagcgcaaaattttggagaacccaacggagcaacaagctatgcttgtgcctcctatcactgatgttttgcaggaagttcagaacagtccccaaaatgagaagaacgatatgtttgagatgtcacttccttcactcgcgaatgaggagaaggctaatgcacctacattatctgaagagggcataaaaggtaaattaaatggtgcagaaattactcaagatgagtatgcttctgatgaattacatttttccactttccatgctgatctagagcaaactttagtggaacctacttctgaattgcctttgtcacaagttgatttgcattctgttccttgtgataaagaagagttgtgcgatagtacttcacttatatccattccacaactagtgaatgaacatgctacttttaatcttgattctccatgtactgaatttaagtatgttattcacacgtccagcgagaatgatgaacttcaattgcaatcttctttaaatacattgggctatgttatgtttgatgattcttgtgagctcaattgtttgaaggacaaaatatttgctcattctgattagccaagtcctcgtaatgttatatttcacatctttggcgattataatgatcttggaatatattctgtgcatagagtttacatctgctcagatttagaacatcctgtacatgtggataaaacatgcaagctagagaaaatgttattgctaaccaaattgtctcgagtttgccttgttttgattggaagaaacaggttgttgtaaatggactacgcaaagagcactatatggaaaaaccgaggacggttttccgtaaagaaggggaggatgatgtgaccatggctaccacgtatgcaaccattgctcacatcatggatgaacaagaagatatcgagatcaagtactccaagtgctggaatctgattcggccacctactacactgctgacttcaaacggccaccgaatctgcatacgacctccgttttcggcccgtgagtacttgatggaaagctctcagagccctctttccaacggatccagcctcatccccgaattccatctcgtgtggccggaatcacaggcacaaggtgctgcgtcacctataatgggcctatgggcttgtaacttcatttgggaccccggcccaggtggggcccatgtggggtgcgccccaaccaggtggagcacgcccctaggcatccctaggtcatcctcccacccctatatatagctaggtaccccttcagggtttattgggttttgtttagatgaaagtttagccattgctacttccttgcagcgcgcgtgtcggctagaccatccgtctgcttgtattcgaaaccccaacttatcgtgtgtattcattcctatttgcaattcagattacttttatcttgttcttgcttgtttcttcgatttgcttacaggaataaggttgatctgcaccggcaagatcaacaacccacggagaggtgtatcgatcgcaaaggcgcaacacaacgtcttgtacggttgtagtcggatcgtcaacgtttctcccaaatcgtagttatctcaactcaccgaaagatcgggccaacaatagccttgagtgtcgagtggaactcagagttcatcgtcctatctttgtgaaaataattttatttacctagcaatggttaaaacagcagaagtactagcaaggagatctaaagagagaaaaaaccgccctatggtctaaagagtagaagtactcttcataaagtagaaaatttcagtttcagagaactgaaactcccaaacctgcacatgatgtgatactgaatattagatacatgtcacattcagtaatgcaaatcactagaattacatttttttagataatgagttgggattgtacaaggagtaccaagtaactatgagctagcaatataatgaagaaacatgtcaaactttgttttgggggaaaaccaaaaacagaataatctcagattctttgcatttgagctaaaaatcataatgttattgcatacagtacacaaacttttgttccgtagggtttgagttattgcaagcggccagtatatacacatgcatatgtagagccacagttagtagcttcagctagcttgaagagaactcgaccatgagtgcatcagacagctcgagcgacggcggcaaggaaaggaaatgatcagttacatacggtcaatagttcaatatcctattatcctggcaacaatatatttgcccttacaacacgagatatgtgggattgaaaggtttcaggaatttatctaggtcgacctatctccctgtggcctgtgggaagaaatacaagacgcaaattgagtgaagagataatgcatgattgaacatgaaagttttaatccctatgatagtgttggacggagatcaaaagaaacaaaagttgtatgttatgagcaggagtgtcagaatgctagagggtgaccacacccatgtccttctacttgggttcaacccctctgcatcactatagtaactaccgctgcatgatagacattattaacatttttctatttacgtgctccatgctaggagaaggactgtgttgtaacagaggtgtagagaatataggtacctgatatccatacgacctatacagaaaatgcacacatgtgtatccaaatagatgcacacatacatgttgatacatatctagtttggtctatactctctcctgagcgattgtagcaagtagcatatatatactaccattttgatgagttcatgaacaaaaacattgataaaaatggccttaaaagattggtttatcgaagatcgagcagtatgccagtataagaagctatacatagtgccaaacagtcatagcgaggcaatttcaaagatattttacttgcttccttttcgaaataaaaaaaaaagggttatgccaaattaagtttgagctgcatggagatagtatgccataaacttggtaggtgtcaggaatatataaactactgaacaattgaaaagtggatggcacccaacagaaggatgcagaatcagtgatggttgttgggcttgctttggcagtgtatatatgtgcaatcgaaggcaatctcaagatgtccagggaaatatttgccccctatatatgtcatgcacctcacagtagttctccggccaaagaaaacaactgtgaggtgcatgtacttcaccgattgtagtacttccggcttccgttgagctctgctagcctaggagaaagctgcaggttccatagcatttgcggacgatttctgatcagccttttattttcttgctgatcctactcctttttttcatattataagtcgtttgattttttttaagttaaaattctttaagtttgactaagtttatagaaaaaaattagcaaaagaattcattaggatttttgacttcatgctctgccaccagcccgtttgatcatttagcaccaaatcggataggaacatgaacgtacgtaaaaaagaacaagttctatgacattcataatgtatcttgaatccatttacagctttccagtttccagccctatattacagccaatgcagaatgcatgcctgcactttgacttcagatctcactacaccatgacaccaaagtatgtaccaacaggcatatgttggtaaaatttttttaaaaaaaaacatcactgatgaactatatgccagtaaaggttattggcgtactatatttcagcaattctgtatagtaggatacactatgtgtcggcaattctatgttgctttggagctacactatatgtcggaaatttgtgttgccaagacaacagaggcaaactaaaatgtgccaaaagagccttcgatcaattggattaaaactgcattactccatagaattattgctcaaccctatcaagtaggaaataaaatggattacttctatataattcacggacatactagttcagtgtaacatggcaacgacggatgcatgtaagaaaacctccacgctgtgcacacattgatgtcatcgtgtggcaagaggggtactattgatcgatattgttataaaacttccgccaatagcacatcgagatctgaacacaaaaaaaaagttatagaatatgcaaatttgatgacaacactaaggcaaggcaagatatttgttaacgaggtttagccgaagcctatatctcaagacactaattattggtgttcctccccaatctaatataattataggttgtgtttgatacatgagattggtaacccatctcctccgcacggaaaatagagcggtccattagcgcgtgattaattaagtattagctattttaaaaaaaaatattaatttgattttttaagcaactttcgtatagatattttttgcaaaaaaaaacacaccatttagcagtttgaaaagtgcgtgcgtggaaaacgagggacaggggttgggaacacccttaaacgaacgcagccatagtgtattagtgtattcacgatcattgaccagctaagtcgtcagccagtcaaccctctcctatgctattgttgtcatgcatttacaacggatgtatctctacatatatttaagagagagagagtcggactctgactctaactataactatatcataacacatattacaactctaactaaaaaatggtaaccaactttgtatatatattcgatacaaactctaacagataccacctaatgttatttctagtgcatctggtatgttaccctaccatacatcatgaggaccatacattaataataccccctttgactagggctcctgtcccccctcctttctggaaaaacaatatcatgtgaaaccattatatatcaaaataacccatgttttataaatcaaggataacattaaccatgtatttatttgtggctcaaataaatatggtttctacctacatataccatacctgatcgaacagctagacgatgtttgtcgagacccaacaatgtaatgtcatgattgtcaacagtacttgcaacaattttcgtaggtatgtgagtcattaggaattagctttgcacgagttgtgctttgtatgggaactacacacgggcttactgagctttttgggctcaatttgtttcgatcatgtaaagtttttcttctgtaacatagtatagaattcctttagttttcccatccaaacttgtgtgaaccaaagtatcactgtccgctcattgcccactggctgttcgaaaactggcagtaatggttatgagccaggcagtgattctgtaccctgtactagtgaactatacgtcaggacatgggagtataggttactcatgcacgtatataactacattgcagttaaattgcatgcaacatgtgtgtagcttcatctgtatctttactacttaaaaaattcgtagtgatggtggtgagtcctgaacgatcgaagggttaacattcatcgaaggatcctctcacaggcatcagcggatgagattttctcccacgatccacccgtcgcaccccttctcatctccccgatccgcatcgcgctccctgtctctccgatccgtaattccgcatcgcactccccagccccccatccttcctcctcggcgcgccgcctcctcaccccaccgacgcgccgccttcccatcccgcccaacccgcgccttcttctccagttgtcctccctccgtattgtgccgtccctcgctccgcccgctcctctctctctccatcgcgccaccgcccccctccataaaccatgacctccctcaaatcccgatcatctgggcagccgtcgttatcgtcggactgagctcttcgatcatcaccctccgttgctgccgctgcttcggagccattggaatggaggatgggaatgcggacctcagtatggttgaggggttggacgagatgatggcggtggttgcaggcgcgcccaccaccacgctctctggagtgtggagaggcgcgcgcccgctgctgcaagtcaccggcggtgtcgtcggcatcatcattagctagctctgcatattaaaaacatatgagttgtcaagtaaagttagtgcaatgtaataagatgtttttaatttacctatgagaatcactattagtatttcctcttgcatcaatttagtggaagatatcaataaacaacagaagatattaaaaaaggaactatttggatggaaatatgcatatattgatggattatcaacacctggaagctaatggtaaatagttaaatacaatttatttttctcgatagcctagcaacataatttcattaggataaaacctttattcgtacctaatatatttccctcttgctaagatttagctcagggtactcttcattcaatggcctagtgtagcgcccgttccgtcgtggcgcctagcgggaaatttatctcttaaaaaccctaattgcgaaatttgtttctttgcttgttctctagtgtccgtgccatctcagatctcaaatccccgatctatcgccgagttcaatcccgaatccaaatccttcccaaatcaattcctccgcaaaagtctaatttgcctcccccgggttcgatgggccgaatttctctcggcccatctccccctccctccccggcgctctctctctctctctctctctctccctccctcccccgctctgcccgcgcgccgcgcgcgcgtgcgcgtgagccgcgccgagccgagccctccccctcctccctcactccgcccgcgcgtgcgcgagagccgcgtggtcgccgcccgtgccgcgcctgcgccgtctgcgccgcccggccccgctgccctgccgcgcagccgctcggccccgtgagccagcgcgcgtgcccgagccgcgccgctcaaaccaccgcgccgcccattgtttctcgcgcgcgcgtgccgtggtggccgaccgcctggtcgccgccgccgtcagcctctgccgcgcctgcccgcgcctgccgcccgtgtcgtcgccccgctccaaaccgccccgccatcatcgctgtcgtcatcgcctggcccccgccactccacgcgctagcctccaagggacggaggcagagctcctcctccctctgccgcgtcgcccccgctcccctcctccttttcccaaagaggcaagggacaagccccctttctctccccccttttctccctttttccctctcgccggcgtcacctcctgtcgccgttttggccgctagccggagcaccagctcgtcggcttgaccgtccaatgtcggttcccctctcccaaaccgacattgctgctcctataaacccaagctcctccccctccaaatctccctcgttttcgtctctcgccgccactgtcgccctgttcgctgtcgccgttcgtcgttgcgcgtgtcggaagagccgacacgagcaaggacgcggaaggggacttcggccgcgccctcttcctcctcttcctcggcccgaggccgagacgatcacgtttcgcgccgtcggctctcgtcactgcgcccgcccgcacggtagtgcctccctccgttcttcctcctcgttccatctcctccccttagactcgggtagtagcacgagtagcctccccgtagctagccggcgccgccccgaccgttgccgccgctcgccacgtgctcgccgccgtcgccgcccgagctcgaaagcgcctctcgtcgctggcctccctcgatgcgtttcctcctaatccgacgctagggacggattcccgtagccgcgtagatgctctcgctgccgggaatcggcccctcgtgacctcgtcgccgtttcccccttcttccgccaccggttgccgccgccgcaattcaccgccgtcaagcttcctccggcgaatccgagccgttggctcgtctcccctcgtctcgtgcaaccacccggtgtgctcgctttcgcctgttccggccggcatcgtcgtctacctcccgccggcccgcgtggcagccacgtaggcgccacgtcggcgccagctcggccaagaccgggtcgagccgaccccggtcagccactccctccggccccgctcgcgggcgcgatccaccgcgagccgtgaggctgcgcgtgggcccgccgcatccgcgtcctccgcgaaccgcgcgcgtgcaccgcgtctcttccccaaaccctagcgcacgccgcatactccctccgcatggtgagccgagccgctgacaagcgggtcccacccgggaccacgcgaggtgagcccggtccaccggctccctctctcctcccctcccacgcgcgctctgggccgccttttgggccggccggcccattaagctcggccgagccgccccttttctctcgggccgcgccctagccacccgagggaagtctaatttccctccctcttttcttttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcatgcttagaggtcattaatagggctttattttcgccgtttgttgagttgtcccgttttgcgtatagtttcggagcccgaagaccagcagtgcgaggatttcaaggatcaagctccagatctcgagcaaggcaagccacctttgaacatcttgagcctatatttgaatttaattatgttgcttgaaaaatattatgcattgataggatcgcacttaatctgttgtcccgtctgcaaggcagattggcagacctacctaattcgttgcatttgatccttcctttgttaattgttatatcatgtccccttgtaaccatctagttgcgtctcgatattcgtgcaccctgtgcgagtatcgacggacgccttcaaacttaaaatctgaaaaacaacttgggtaaaacttgggttttacaaaagacttggaaaacccgacacctgggtcggtgcttgcgaactaaatgaatttccaaaaccgcggaccggggaacgtaccgggtgtacggtttccctctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacttgttgttggtctgggacccctctcgtcggcatatggtaaacctgtgtcggctttcgaaatgccttgtcatgaaagcttggaggtctcccaacgtggccgatccccacgggctgggtgatccgggttagtaatgtcgtgtgggtaaagtgtaccccttctgcagaggttaactaactgttcgaacagccgtgcccacggtcatgggcggatgtgaggtgattcctagcgtagttttgtttgcctactgtttgtgaaattgctgtggtggaaaggagatcgatgtttggaaaatctgcagctgatgggatcagctaggcccgggtggccgtttgaaagttgttggcccgggtggccgtttgaaagctgttggccgggtgccaatcttgatctattttaaagattgatacattgcacatactccgaccggacgagacgcactgtctcatccgtgtcgtttgagaagcactcacttagttgtttttagaaaagagttcaaataaaatcaattgcaaaaacaacaacctttccttgaagcctgcattaaacacttatttcccatggcttgttgagtactcccgtactcacccttgctctatataaataatccccccagttgctgaagaagatgaagcggaacccgctgataaggagttcttccaggagcaagccggctacgatgagttttagggtttcggcttagttcccaagtcgcgcctgtgttgattggtccaagtcctggcttccgtttcccttttgtaatgcagttgtgagctcgggatctgtccgcagcccaacatgactgtacctctactctataataaagagacctctgttgctgtgacattctatctccctatgataccaacactgtttcctgggactggtatcgattaacaggttaatttggagcgtcacgggctatttccggtcgggattagttcggggcgtgacacctagccagatccatgttgcatgttaattatgacatgggttgtgctatttcttggtggagaagatcgttaagtatctcctggcatgcatgccgctgccatcaacattctttcttgatggctgtgagcatgtcatattttatctggtgttatcccggctgatgagcatcccgttcgatttttttttctttgtttacattggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45520 - DNA, 967 bp, Oryza sativa
cgccgtcgccacgccgccgccgtcgccacgccgccgtcgccacgccgtcgccacgccgccgccgtcgccacgcgtcgccacgccgccgccgtctccacgtcgtcgccacgccgccgcgccaaccgccgccccgatgccgccacaccgccgttaacgaacgagaacgagaacgatcgaacgaacgagagcgagaacgaacacgtcaacgtacgttgccgcgagaacgtgaacgagaacgagaacgatcgaacgaacgagagcgagaacgaacacgtcaacgtacgttgccgtgagaacgtgaacgagaacgagaacaagaacgatcgaacgaacgagagcgagaacgaacacgtcaacgtacgttgccgcgagaacgtgaacgagaacgagaacgagaacgatcgaacgaacgagagcgataacgagaacgatcgaacgaagacaagtgagaacgagggaacgaacgtgaatgagaacaagcgaacgaacgtgaacgagaacgagcgaacgaacgaggacgaacgttaacgtgaaatgcaatatatatatatatatatgtatatatatatatgtatgtatgtatatgttacttcgcatttatcctaatacatctttttgtatcttgcagaaaagacgtgttgtcggagtcgtccgtcaagcctgagtggaagagctagccctagaaggaattggagcaggcaagtgacgtagtaatataaatgattgttatatttgtaatgcaattaattaagattattagacctgtaattagacttatcatataagattgtgtagtgttctaatattatttgtgttttaatataagattactttatttgtaattagacttagtatgtaattattgactacggaagtggtgcgacaagtagcaattgactattgtagtcttaattagacttagcatatacgcacgaaacacttagcatacatgactattttagtctta

SEQ ID NO: 45521 - DNA, 1773 bp, Oryza sativa
  unsure (1)..(1773): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaagtaatcttatattaaaactcaaataatattacatgctaagactaaaatagtcatgtatgctaagtgtttcgtgcgtatatgctaagtctaattaagactacaatagtcaattgttacttgtcgcaccacttccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaacacaaataatattagaacactacacaatcttatatgataagtctaattacaggtctaataatcttaattaattgcattacaaatataacaatcatttatattactacgtcacttgcctgctccaattccttctagggctagctcttccactcaggcttgacggacgactccgacaacacgtcttttctgcaagatacaaaaagatgtattaggataaatgcgaagtaacatatacatacatacatatatatatatatgtatatatatatatatatgtatatatatatatacatgtatacatatatacatatatatatatatatatatacatgtatacatatatatatatatatatacatatatatatatatatatatatatatatatatatatacatatatatatatatatacatatatatatatacatatatatatatatatattgcatttcacgttaacgttcgtcctcgttcgttcgctcgttctcgttcacgttcgttcgcttgttctcattcacgttcgttccctcgttctcacttgtcttcgttcgatcgttctcgttatcgctctcgttcgttcgatcgttctcgttctcgttctcgttcacgttctcgcggcaacctacgttgacgtgttcgttctcgctctcgttcgttcgatcgggctgcagga

SEQ ID NO: 45522 - DNA, 1444 bp, Oryza sativa
cgtggcgtgccggcggcggcttggcgtgccgccgacggcgtggcgtgacggcgaaggcttggcgcggagtcggcgtggagcgtcgtcgtcgtggcgtgtcgtctcgtggcggcggcgcgacggagagagatcgagacggagagatcgagataaagggagatctggcggcggcggctctcaccctagagatgcggcggcagcggaggaggcggaggcggcggcgaggacgacgagctcgagacgacggcgagatacggcggcgtcgacgcggggatttgccctaggaagtggcggcgaaggagagaggccgagagagatcgatcggccgaaaacgtctaagtgttggtgaagaagacgagggcgcaccgggaatatatatacccccggatctttactcccggttgttctcaacaaccgggagtaaatatcttttcccgctatttcaaaattctttttaaacccggttagggttaagaaccgggactaaagattacagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattatgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtggcggttgaccgcacgtactttctcctcactattgttccctctttgtgatcgttgcatgagtaaggggtgtcttcatt

SEQ ID NO: 45523 - DNA, 3034 bp, Oryza sativa
tacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcatctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattatgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggcttatgttcgaagtgcttgcctttcttccgtaccgggtggtttgctgcaaggaatcgacgatgacccatgtatacaaccttcttacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataagaatcggcatcattatgtacttcctcttcatgcatagccaggggggaaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcatgttgacgctcttcagcgtgccatcgcaacattctagcattccccttgttcctgaacaaacaccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccacgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactctagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacaaactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaaccccttttcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaacttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatatataggggtgggactttagtcccggttggtagcaccaaccggggctaaagatcaccgggatctttagccccggtggtgctaccaaccgggactaaagtcccacccctatatatatatgtcttcttcctcctccagctgcccgagcacgcttcaaaatttcttcaaaaaagaggggagg

SEQ ID NO: 45524 - DNA, 19233 bp, Oryza sativa
  unsure (1)..(19233): unsure at all n locations
atcatgcgctgtttttcgtcaatatgtatacagtaatatatttgcatctttctgtaccggtctaggtcgtctatatatggtgtatatctccttgttcacacatgatataacactagtagaaataaatagggactgcatcactttctaagaacccacaaaatataaatatctccaactccagcaatatagagacttgctatttatttctcctgtatttctacttatactatgtctacgtatagtttaacaccttaagaattcaaatatgaatatttctaatgttagatttcaaccatattcaaattcaaacgtcataatagttaaagttcgaatccttaaaggctcaaacatgggaaaatgggaatgagaaatcctgcgtactaccaagtatccaagaactatagtcaatagataaagttaactctctatacacttttccaatacaatctatctgagaaatttttttttaaaaaaaaagctccttcaaattaatcctggaaaataccctgaagttataaatcacaatttgagacaaaattaagaacaagactgaagaatcattccaattaattccccctctacctcataaacttcagcgcatgcagtgtcaattttagaaggtcaaaagccaatacatggccccgtttagataacacccaaccatcttcaaataatgaagcgtacgtatgtcttgctgcaggaattgaacaaattaacatcgatgattcgaaagctctgaacggagctaaaacaacatctctcatcaagtttaaatgttctgataggacttaactgagcagtccagtttctcgaaccacttcctcctcctaaaatgttacggagtagcatattttaggtggacacacgtattaagaacgtagatgaaaataattggttgaagattgtgattggttaagatgagaaagtcgataaagaaaattaaatgaaaaataattgtgattgattgggagaagatgataggcaaagaaatacctttattttgggacagacattcacttacaaaacaccttatatgtaccggatcataggtaccggtttattcaaaaccgacacctattaccatttcccacctctttaggatgaaaattttagataaaaactggcacctataggtgctagtttgttaaaaaaaactagacctatgcttatattataggatttggttatagctagataaaaaccaacacttatagtagtactacttttttttaaaaaaaaatcagcacctataataaactacaggtgcagccgaaccggcgctccaccacgagccgcccctcttctccaaaccctatccactccccttgcccacccccatcgccccatctctctctctctctctcactcactttgggccttgaataataatcggcatcatgatgtacttttgcttcatgcacaaccaagggggaaggttgtaaacacatagggtcacaggccaagcagtggcggatccagaaaatcgattcattggtgtaataacgtgtctattggtgtcatagtatgctaattatgcttagatcatagcgttataatatatggatgaacagttttgctataggttttgctgaaagtcgccggtgtagcctgacactggcccttatactgtagatctgccgctgaggctaagtgctacgaccgctactcatctctccaaatggattcatgcgattcgtactaaaaccaaaccttatattccttgcatcattaccgaagtcctcaaatattttgtcgatctttcgccactatgacccgtcgacagggtgtctcaacatcccgtcttgtttacgttcttctacgtgccagcgcatcattaagcatgcgctttagtcttgtacaaatgtctcagacgtggtattatagggaaataccacatcaccttagcaggaactctcttctttgaaggttgtcggttaacttcatcggggtcatctcgtctaatcttgtatcgtgatgcattacaaaccgggcatgcttcgaggttctcgaactactcaccgcgatagaggatataatcgttcggacatgcatgtatcttctagatttctagtcctagagggcagactaccttttaagcttcatacgttgtttccgacaattcgtttccctccagaagaatattctttacgagtttcaataacttgccaaatgccttgtcagtaacgccattattttgccttccattgcagcaattccagcgtggtacccaaccttttgtgccccctgttcgtaacctgtgtacaataacgttttgtggtccactaacatacgctccaatttttggacctccttttcactttcgcagtctttctttacgtcgcacaatatctgacctagatcatccgcaccgttgttttcttcaacagctccacccccatcgcctgttgtatctgcaaatccaccgtattgagcccagtctggaacgttgtcattttcttcatcatcttcttccattgcaatcccaaagtctctatgcaaggtccaacaattatagctaggtatgaattctgattgcaataagtgggtatgaagagtccttgatgcaaaatactctttctagttttgtactttttgcatggacaatatataaaaccttaggcctgtgggcattggccacataaaaaataatgtacaccatcaacaaactccttcgatcgtctatccgcggtatgccggtatacatccattgccaattcatctacatcaaataaacaaatgttaaggaaatccacgaaagtgaaaataattaaataatcatataatatttaaaacatcataattaaactcacaactgaagtcacaaatctctctgactatttctttaagaaaattgtaaatatgcttttccatgtattatccttttaaaaaaacattttacaagtttttaaaaaaatgaaaacatatttttaatgattttttcttatttctaactattttaatgtgttaaaaatggacttagttttctattttttttcttcattttctacaattttcctttgttttatttttttaaaacatttttatcaaatgtgtcttattttctccaaatatttttctctccctctttttccatatacttttttgagagataatgacatataaaaacatagctagaaatgtaatatgctaatcatacatcaatacagaataaaattgctaacctttcatatcccttcgatttgtgtaatatcaccaaattattttcacgaaaaattttggcaacacctcctttccttctccaacctcttggcagcaatgacacgggccgaaggaggaagaaggcatataatttttagtactggttggtgttaccaaccgataataaagatcatatagtatcagttggtaacaaaagagcccagggtgcttaacatggtagtactgacaaagttcaaccgggactaaaaacaatctttagtatcggttggtgttactaaccagtactaaagattgtattgtgtcgtgagggttattaaatagtactaaagacggcatctttagtctcgattggtaatagaatcgagagatttgtatttttgggaaccacaataaaagatcagttctccggtagggaatgcgggacacaggcactatgcaaacgccaccacgtggcaaagcatatgacatgatatatagaaacattaattaccctctattgatacatgtactctctccatttcatattataagattttctagcattgcccacattcatatatatgtcaatgctagaacactactacatgaaagattttcttggacactagacccttttgtttccaggcggaccataagtgcaaccgcacatgaaaatgagggaagggcgtcgggccatcgcccacacaggaaaatcatttttcgtgtgcggatcacttaacagacccgcacaggaagataagcctattttcgcgtgcggttgttaagtcaaccacacaggaaaatagcccaccccaagtgctgcccatcatcccatcttcctcttatcctcctctccatcctcccatcacgcgcgcgcctcactcatttatggtcctccccatcctacctatcctcactgtccctctcctcctccccatcctcccatctccctctccctgtccctctcctccccggcaacggcggtgccctcggttagggcggcgaaggtggtggcatcggcgggcgtggaggcggcggcatcggctacggtgttggcggcggagcggatctgtctccggccgccgcgtaaaggccagatccgttgccagccgccgcgggaaggcaagatccgtggcccgccgccgctgggaggccggatccgtggcctgccaccacggggatgtcggatccgtcgcctgccaccacgaggaggctggatccgttgccggcgaccgcggggacgacggcggcaggcctcaggcaaggtggcgatgacgatgacaggcctcgggcaaggcaacgatgatggtggtggccgtggtattgacggcggctaggttagggcttgcgggtggattttgattttttttgtttcagttttttatttttcccatgcgggcggccaaagcgcccacacgcgaaaatcgatttccgtgtgcgggggcgtcacccgcacaaaaaccaggatttttgcaaacgttgccttccagacgggtggaagctccacatgtgaaaatcaattccacccgcacggaaaaatctttcatgtagtagtggaaagtcttataatatgaaacggaggaagtacctatcatgtgtttacatgattcacgtccattaattaccctctattgatatatgtacctgtcatgcgttacatgattcacgtgtgtatgaacacgggagaccaaattaagttggcagtttgtcctttttacatcatctgctgctcccagttaaatgcaaaatagttcgtttgaaaaccgcttgagattgaaatatctgtaatggcatacatttatatcttttagataatgacatacatcctctcttactataaagttacaattaatccactaaatcctaaagcttaccatataaaaatgtcacattattatccactaacaatatgccaaatcaccatccactaataattactctctcggttccatatataaggcacaactattttttttggatgttccataatataaggcatatatgcatgtataaaattaatcaggacctcttctccattaaattattactttttaaatcctccaccctcaagatctctaattctattggatgcatgcattatatttattagggtgattcaaactaggatatgataataattattttttggtctttgcgttaaaggtggtcgtgccttatattttggaacggagggtgtattatatttaaacatcatacaagcatgctatattatctatagttttatattttattaaattttagagcttttaaaatgcaaacatgctaaatcgttattccacataattcacataatattttaatatatatatttattattttttataatatcatatatacctgtatagttcattctcacttagttaatgttgtttctctcttctcttattaagcaatattacattaattgtttttagtccttagatgattaattaatctatgatccaaattatatatcttcttttttctctcattaagccatatcacctcaattgtttatagctgttagatgattaatctatatggtccaaactatctccttcgttttgttctcataaagccacatcactttacttttatatttatatttgaatcattattctatatactatttaaatttaaattatcataaaccacatcaacttacataagcttatattatcttgctatcttatatattatttttacttattgttattatactaaaattttataacaacacgcggagtttcacctaatttatatagattcggaatatgtgttcacatagataaacggcatgcatgccattgatcatcttttattaatatttatgcgggtgacactgggtagaaagcagtgcccaacataattattcagagatttatataccatcaaggtattctatcttacctaggatattttaaccactacttcatataccacacactactacaaaacatcacaacagtgccgccaatcactgcaggttagttaaaaaccgacgctctctataaatcaatgactgttaattagactgtaaaaaaaacacagggatcaaatgagagagacatagacttaaaggaaaattttcaagagataaaatgcacgagaacacatgcatgtttcctagtttttaagaaaattgacgcaaagttacttttgcgaaagctgaatgcttcaaaaaaaaccaaacggccaggttaatatagttaatttaggaaaaatgatgccatattaatgacttaaaatgaccagtaaaccttttattgtaacagcagttgcttcctaacaaaccaatcatacagcacagccacgccagtagacccagccaacattgaagagcttgccgatgatcctcccaagaacaccagtggtggcagtgggaccagcgtgttatcccgacgagctaccttgacagtgacctatggctgtgtttagttgagggggaagtttggattttggttaaaattgaagatgatgtgactgaaaagttgtatgtgtatgatgggttgatgtgacggaaaaggactgaagtttaaagtttagatccaaattttgaatctaaacacagcctatatatcattggaaggcgttggtcagcacaacataggtcacctcagctgggccataccatgtgatgaccgtctcgactatggcactgttgtagtcggtgaagtcacaggtgcaggtattgcagaatatctccccaacgttatcttcctcatcgtcatcttcttcttcttggctaccgtcatggagattgatcaggtcaatgccgacatacaccgagatggcaaaagatgggccagttagcacgaggttcccctgttttgagagaaaacataacccaattaaaagtggtttaagcattcttcgaaagcataaaatttacataattttcacaaaaattatattgaatcccatgaaaatattttcgagagttaatttcagtttggacccttcttatcgaggtttaacattggaccttatttactccataatttcaccttggacacctttattttacccttagtttttcctctgtactcccttttattcatactcaagatttgtctcagtgtgctacaattatctgcaccttggtcatacttcacactcatcttgtctcgttacgtccggaaaaatacaaccatttttttaaacgcttattgtattaatccctgtcccatgaacacgccaaattcctcgctgttctactgctgcctttctttgtttcctctgtttcttctcatcttcttactctccaagtcttccaaatcgccgtcgttgcggcagagctcctcggtgcactagctctaattttgattgcctccggttagttttatggtgatgattcactcggcttcttctttatggactgctcgttgctgctgattgatctacagtgctgcttgatcaccatcgatactgtaagtatcatgtattcaacatgttcttctactaatctccaggcatgagttgcatcgatctagttaattagtgattattgcattttctataatttagtatatgtgcaaaagctatgcagggtactgttcatgtagattatatataatatcattgcaggagcctaattatcgactcacttccaattatgtccgatgttctatgcattgcatgcaacgcaattgtttaccaactagtgggaagctctgcagtattttcattcatggattcttctattgactacttttgttattgcagcagtagattacgttcttaattttgttaaggtcattcgcgatgatattaattcatgagctccgtttgatgcgtgtatggcatgtttgattcgatcatttcaataagctgcttaaaaattgattttttttagacacaccccctttattttttttcaaacgggccgaaaaaagacccatacgtacaaagattttcgaggtggccagcaaatacctgtatgtgaaaattaattttcgtgtgcgaaccttgtgatatgttcgcatgcacaaataggtaaattgctttatttgtgtagacaggcctgttaagaggcgtgcctagtaaaaaatcaaccgctcaatcctctccccctcttcttttctctcctctctttaaaaaaaaaaatctaattccccacttctctcctctcatctcctcctttttcaccagccccctcctccaccggctggccacgggagcagcaacaacggtcgtgatgaaggcagcgacaagagcggccacgacgcccggagggacaacgatgtgagccgcggaacaggcttgagctggcataaatggacccacgatggccggatccaacggcggtggccttgccacagttggatccagcggagatggcctaggatgacaacctcaacaatgacgatgaccccgactgtttgcgcgtaatggtagcgggagcagccaccgagcgccttggcagctcctcctccactaccactggcaggcttgcaaaggccggatccggcgctggcgggctcgcgacagccggatcctgagaaggtggccccgggtcgatgattccgattgctagcagcggtggtggctagggtttcttgaccggagggcatggatcgatggcggcatcccctagatctagtgagaggggaaggaagcagtggagagggcttcggatccaacggtggggtcgtcgtgttcaccccgatgaaccctgtttgacagtgacccatccttcgacgacgttggtcagcactgcgtaggtcacctaagcggggccatatagcctcgattatggccatgttgtagtcagtgaagagaccgttgcatgtattgcagattatctccacctcgttctcatcattatcttcattttgttcgctaccgtcatggagacaatgggtacagataacaggggcatatgccaaggtggcaaacaatggactggttagcatgatgctgccctgttttgagagagaaaaaataatccaattgaacctagaatatgcattatttgaaagcatcaattttacaagatttttaaaaaatatatcaaatcccacaaaaataattttaagagtgaaaattcagtctggactccttactgaagttccatgttacaccccctttagcccatactagaaaattggctgccggttggctcgccttgtagctagcccgtccatatggctttaaaaaaatcatttaatcaatatagcctcttatattgctacatcgatttctattttgttgtaacctatagcaggtagtatttttccttgtcatatgctaatcaccatctattacatatatgcaggtaattttcagggcaacgcactggctccggttttaggcaagctacaaagatgtgagtatgatggggagttcctaaaggttgcatgccgcaggttggagtcaatgcttatgtaactatttgctaattatgggtgaaggttaacaaatagacttcaataaatgtgttcttcttaaatgtgttcttcttattttggctaggttacctttgtttactcgtttctggggtgctactttgtaataattggatgtaactctttttaagcaaatgctgggatgatatattctattatcttaaaaaaatgcatattggctctgcgctagcttgttgcaacccgcagggaatggggttagaccggctgtgctgtgctcgggtggagcatgctaaggtatagctttgtaaaaaaagaaaaaaaaaagtacgaattacccaattacagtactagactattttaaccctaaattttttaaactggataaattacctcctataactcagctcgaagcggttttaatcttagtctcgaagcggttttaatcccacaggcacacaagtggcagtctaatcgataaaaataataaaaaatagtgggccccgcttatcagcatcttctctcttttgctttcttccacctccttcccctcccatccatctctctctccagtcaccaaggagcactgagtaatggcagcaacggcatcaccaacgcgggaggagaggagcagcaggtagcgtgcgtcttgcagcctcaacggcacgcgctaggggtggcggaggacggcgcgacagtctaggcgagggcggcggcagcattcccggcggcaggcggcaatggtgtgcgagacgagggcggcgaaacgggatgcggcctcggcttccatcaacacgcgggagctagggcgagctccggcgctgaacctctccggtaaccggctcaccggcgagttactggaggggttcttctcgctggcgctgctcgagaaggtggatctctccgggatgccggcgagcgccttcctcggcacgacgctctgcggcgccctgctcgccccgtgcgccaaccccgcgctgctgccgtcatcgctcgggaacagcaagggcggagggaagctcacccgtggcgcggtcatcggcatcatcctcgacgtcgtggctgtgctcatcgtcatgcttgttgggaatagtcccacgttgaaagtttagggggagtgacaccaacttaaaaaggggaggggtccctcacctcatgagctagctttggggtgtagaaaggctttctcccggttgggccaacatctcccggttttgggccaacaagtggtatcagagctgggcccacaatctctctaagtgccgtgcacactcgtgtggtgtaagcccgaagcccagtggaccgcgggtgtgaggcccgtatgtgcctatgtgttgggccagtcagtggaccgcgggtgtgaggcctgtatgtgctcgtgtgtggagcctggtcagggctaaggggcaccaatgtgtgacgggagagattgttgggaatagtcccacattgaaagtttagggggagtggcaccaacttaaaaacgggaggggtccctcacctcatgagctagcttttggggtgtagaaaggctttctcccggttttgagccaacaatgctcgccgtggggtacttggcatgcttccggcgctgagcagagcaacggctggtcggagcaccaccaccgcagcggccacccccgacatgacggagcccatcacggtgaccgtggcgaggacggacagcgagacaaggacgtcgccgtcaagcagtcagcagtcgcactcgctggcgatgatgacaggcgaaggcaacaagctggtgttcctcgacagcgtgccggagcggccgtacgacctggacacgctgctgcgcgcgtcggtcgaggtgatgcttgcgcgggtggtcgattacgaggagtgcggcggcggcggcggcagcagcgaggtggtggtttgctctggtggtggagagaggtaggaggggagtgacctgatagtgggccccaccgacttttttaaatgaattgatgactggactgccacgcatataccacgtaggaccgaaaccactccggattgagttaagagggttatttgtccggttttaatagttgagggtctaaaaggtctggttttcgagttcgagggggtaattcagtcgtctacgatagttcaagaggtaattcgtactttttcctaaaaatacaacgctatgtttgtacattgacttagcataatatcgttgcacgcatcatggtattgataggatcatcacttcaaatgagttcacgcgcgatttgaaattattaccttcccatatatatgattgatgtagcattattatttaactttactttttctccattttcttttttactatagcccttttgtgccttcagtatttttgagttagtttataattttctttggagatagcagtgctgttattttattggtgtttcaaagtttggtagggtaataaacctttgttacatagttgtacaatgtatgtatttgattttttttttagaaagtggctaagtccataccagtttgtttattagattatatatgctcagatttttgtaataaaaaatagtcgtgacatccttttaaatataaaattttataattttacacttagctttctttacaacatgtaggagtgaaatagagcaagaaaagaataataaggaagatagagggaaaaaaaaagaaaggggggggggggcaaggcaggcccaagacaaacaggcccagcacccgtctcctacctgttgggccaggcgagctgaagcccacgccccagcagcagccagtttggctctagtgcgggcgtagcgcgagcgtttgatgaagcggtagcacgcgttgcgcaactattggtgccacgtggcgcataattttgcaagagaacccgtcaattttagaatattagatttttatttttgttttttatacattttttttgtttcactttgaactcctttttacctaatcctcaatgttactctccgtgtgacaacgtaaactgcactctggtgctcatctcgaccatgccgttgcattgatgtcctttgcatacccaaagacggcagggttcaggaaaatgggactaaagtgaatcaagaagatgtttaaaaagggtgtccaaagtgaaaatatgctaaaccaaatcgaaacttgggttaaatactaaagttaatctatttctttcttgattaatatgaatgctagttgcaaatatacgagttcaaaatttttgagtttttcatttgcactataataagaaaaaaagcaatgtacttgtatgtagcaccaataattattggtccggaacaaattaaggagctacacaaatcctgaattgctcattcgccattactagtcacgggaatattaggccctgttcatattatagccaaaataaaacttaccaaattttagcaatgccaaaattttgacaagatggtaatattgttaaaattttggcaggatttcttatgtatttaacaaatttagcgacaacctaaacatagatatttttttgacagcttaaaaaaaaagggtatggttgaaaatggcattaaagtgaacaggcccttagtcttgagactcttgtgtaggtttagactctgttgtacagttttagctaaggcccagtttagtttccacaaaaaaaacttttcaccatgttaaatcgaatgtttgcaactcttgtgtaggtttatcttgtgtaggtttagactctgttgtacagttttggctaaaacccaatttagttcccacgcaaaaattttcaccatgtcaaatcgaatgtttggacacatgcatagagtattaaatatagacaataaaaaataattacaaagatttgcgtgtaaaattgcgagacgaatcttttaagcctaattgctccatgatttgataatgtggtgctagagtaaacatttgctaatgacagattaattaggcttaataaattcgtctcgcagtttacaggcggaatctgtaatttgttttgttattagtctatgtttaatacttcaaatgtgtatccgtatattcgatgtgacacgccaaaacttttcgtctcacgatctaaacacagcctaaattcagagtatgaaacaaagtctgatggtttacgcaggaaagctgatttatgagtcagattctagaattgtggaatacgatgggagtcttacacaggggcggaacccaatggaccaagggggtgcccaggaacccggcccaaaatctaaaataccttgttaccctcgtacctagggaaaagtacacccaaggccccttaacttgtcatcgagatacaaaatcgtcccccaatcataaaaccagataccgggcgtctctcaactaacaaaaccattcgctttaggtttctcggtggttttgacccggttttatcccacgtggcggctgagtcagcgtgggacccacgtgggtcccacatgtcaggctatccatgtcagcctcctctctctctctttcccatccttccccttcctcatctctctctctcatttttctcctcttgtccgacggagcaagcgagccatcgctcggcggcgacgatgcgggagaaggggagtgcgttaccgatgcagtgggcacggcaggcccggcgggggaggagcgcggcggtggctcctggaaaacacggcctcgagctcactcccacgcgcttcaaccgcgcgtgccggtcccaggaggctgtcgtctccgatgatggcgacaacggcgacgatggagacgcgctaccaccgccgacaacgacggagccgctccgacgatctaccaccgacagcaacgacggagccgcgcccgcgcgctcctgattcctaaaggcggtgcctgcttccgcgcttcgtcgcccgtcannnnnnnnnnnnnnnnnnnnnnnnggcgacggcagccgtgcagcagctggccgcggacggtgaaggtgacggcgtaggcgcccacgccacgggcccgcgcgtagccgtcggcggcgtaaccggcgttgagctcgttgcagcagccaacgatgtggaggccgggctcggcgatgaggtggttgagaatcgtgaggttcaagtccccgggcacggcgaagacgtcgctgacgcccacctgcacgaggcggtgtgccaagtggcggccgagtgtggtgtcgccggaggcagcggacggcaccaccgcctccttaggagatcctcctccgccggtggtctccattgtccttgttatcgatcgatcttaattactccgcatgcgggcgtatatatatgcatgatgaagagatgatgtgcgtggtggctgttgtaaatatgtggttgtcgatcgatcttaattactttgcatgcgggatttttcgccgccgctgtcctcatccgctcccgctgctcctttgatggtgcccgcgatgacggtaccggccctaggaggttgtcgccgacggcggtggcggcaacgacgacgaagacgcaccaacgcgctacatccgctgtcgccgctgacgaagccgctcctgggcagacgtgctaccgccgccgccgccgacgcgcggacgcgctactgccgctgctgccgatgcgctacagtcgtcgccgccgacggaaccgctcctgggcagacgcgcttccgccaccgccgtcgacagagccgacgactcatctgggtgtgtgtaggagagaggaagagaggaggaagggagaggaggctaacatggatagtttgacatgtagggcccacgtgggtcctacgctgactcagccgccacgtcagacaaaaccaggatcaaaaccaccgagagacctaaagtgaacggttttatcagttgagggacgcccggtatcagattttgcgtttggaggatgattttatatctcgatgacaagttgagggaccttggatgcactttttcctcatacctacagcatagaggcaccacaccctcctctcgtccggcccaaatttgaaaggcccaaccagaagaaagccccaaaaccaaaacgattttgctatatctcactcggaagattttttcttatctctcactcgattttctcacttaaatttacagtgcattttcttgtaagttacagtgtaatttatgaaacttacactgtaacttttgtaagttacactgtaatttttgaatcttcacatgtaaattttaaattttgtattggatttggtctttttctcgaggatatggtaatttaatgttcattatggtgtttcttaattgctttttgctttttattatatctatcggattttaatacaaatattaaaaatctgtgtgatacgattataaaaatcttttgaaagatgtataggtactcccaaaccaaaaattaagcagtgggagaaactgaaacgtccaacgacgcttcccctcgaagcctcgcgtgataccgaagcggtagtttcgattttctcgcctgagtcgcctcaacgcccaatctctctcctcgcattcgtctgacctgtcacctctccccgggaggtcgcccttttctcgccgcctcaccggggacccagcccggcagccccaatcgaagaaatttctcatgtgtaaagcactaaagcctttccctggtaggtttgcctcccttttccaaaattttgcactgattaggctagcttagggcttgcaactatagaggcatatagagatagatgacgggggcaggaggaggatgactggaggaggacggcggcaagctgcaagctagcaacggccaatagctggagcttgccggctggccgctcaccctagcttatcgatctactctgagccccacaaaaattgcagccagcagcactagctgagagcaactgaataagtgaactctttctctcaatttttcttatccttagtttgtagttttgtgccaaaataaacttgaaaatttttatttggtcttaatagattgctatatagcactggatagtacgaacaatatgaagaaatttgttttaatttgtaccaaatcatttcataacttattctcggttgaaaattaaactatattttcaaggtcattatcctatggaggaatgaagacggtgacattcgcatgatatattcatattattagttgatttcttcattatggtacgtattttttatttttttatgtatttcttgtggtatattcccttcaaatgaagaaataatgcttatatttatttattggtatgcaactatttagtataatatcgctctataattatagatgttagtattacataaataaaggtaggaatccctcgtcttttctctagctccgcccctagtcttacatgggtgtcgcagggcggtgggtaggtggagtcgtcagtacggctgcggctgtagatgacgtcgttgcagaagctgatggtgccgcagggcggcggcgcccgcgaagatctccgcagttggtcgtacgcggccagatcgtcgccggtcggggcgtcgctgtaccccgtcgccgccgccatgaatgagagatcgaatactctcgtcgatcgatcggcacccgcccaccgattaccgaatgtatcggggacagtctgcactgagcgaatagtatcaaatcagtgggtagagaaagacgcaaacggaaatcaaaaccagaaggagaagaatcaaggaggaggaagctggagtggaggaggagatcgatcgtcgaaccttgcggcgccggagcaccgatcaccgctgtcgggcgtggagtagcactctaggagagaactagacaaaaaggaaggagagaagatcgaacgactactcgacgaggattgccgggatgcggcgggccggggagcagcgtggaggctggatccgggcatgacgacgacctctctctaggccgcaccgccgtgtgcgtgtgcccctcctccccgagccgccccggccccgccgcgtgcctccgccacgatggaaaatttttaatgtgttttttctacttttgtatttttcaaaagaatttctcaaggaaatagtccaaatatcaccttagactttggacgaaattccatctagaatcatgagttttaaaacccgatatctaaccccctaaattttatattaccctctaagatgattttggatggtggtttttcatattttgaaagcttacatgaacaactttgaataactaatataatatatttgcataccatcaattgtaagtcaccaatttatactcatacagtgatactatattattattatacactggttcttatttataaatgtgagctaacgagtgataaaaagaaagatttaattaagtggagattttaatatatatatgtccaatttgtatatcacatgatcaaattcatccaagttatatacaaattagataaaaatcactaaacaaaatcaccttaggggataatatgaacgattttgcaaagtttagggagttgaatttctagttttaaagttcaggatgatggatggatttctatctaaggtttatggggggtatttggattttcttcatttttccaataatgcattctaaaagggccctgacagaacaaaatgattctctgataaaatttcattttaattttcctagatggaaatcacacgaaccactgttttcaaaggttcgataatacaagttgcaaatgcccacggtaataccattgtcttcttccaattaattaatgtcgatcagtatatagtcaactgcattatatatatgcctcacgtctgcaaaagggacgtgtgtattaccttctcccacagcgcgcacagtaagcagcaaccaacaagcacgctggcacacagtagatagctagatgagattattacttcaatttattcgttgcgcatataattaagaagaaaccaagatcattctgtactgctgccaatttatagctagtcagtccggtgtccatagacgcaagctctactgctgttgctcgatcgaccggtgtttgcaattatcatgagcctggtcaagaagtaagtttttaatttgttcactttattgcctatttcattatctacagattagtgaaatactccttccgtccaaaataaaaacacactaatctccttccgtccaaaataaaaacatatagtatagattaatggacaaagagtttttcagatttgttgtattagtaggggtcatatttcgattattttttattttcggatggagggagtacacatttatggcatagtttagatctaaagtttggatacaaacttcagtcctttaccatcacatcaacctgtcatatacatacaacttttcagtcacatcatctccaattttaaccaaaatccaaactttgcgctgaactaaacacagcctatagagagcgagatagcccgcaaaattgatcgactctatgccgctgaattgacaatctcattccaagtttcccacacgatttctgaggaattgtccgtggtacggcgttttttgaaccagaaaaggtccgcaaaacgaagttaattaagacaaacatatagtacgatctatattttgctccagatctccgatgttttagagaaaatatagttttatatatactcaatatcgtaatcatattctcttgagctatcccaacgcaattgtaaaagcgtgcgttgctaattgctctaggactgcaggatttctcacataatttcactgatatatcactactacgaaaccggtttttgcaaacgggcgaaaaacatttttgtatgtggttggaccagccgcatgcatgaaaagatcagcgaaagtcacga

SEQ ID NO: 45525 - DNA, 20766 bp, Oryza sativa
cgctgctgctcccaccggcgtcgtggaagccgctcccaccggcgtcgccgctagccgctcccgctgccagacctgggcgggaggagaccgtgcgcccgccgtcgaccgctattgccacctcctcctcctcctcgtcgacggttgcagcatcggggggaatggagccggtcgccttctcgtcgttgtcggcggcggcggtgagttggggatggcggttgcgccgccgcccactcactggatccgccgcctccgttgcgcgcctgccgtagccatagccggagctggccctcctgagggtggcgccgccggatgcgctgtccgtcgacgccatcgccgcccagcctgctcctggccgccagcgcccactctcggagagggagagggagaggatagaagaaagagagagagaggagaggagagaaagagagaggggagagtaaaataatagaggggtagagagaggaaatgagttagaaaaaaattgaagtggtgagagggaaaagagagtggagggatatgaaaaaaataggggtggcatttttgcatacgggtatcttaagtggtccgcaattttacatgcggacaacttaagcgttcgcatgcaaaaatcatgcggctttctaaacttcgaatcgaattttataatactaaatgaactcatgtgaaaaaattgtcaaaaataaagctgcaaaactcattgagatctgccaatttgcttttggtcatttctccatccgaatttgattgcactatataaaatttgaattttaaaatataagaaattcaaataatttttcagctagtaaatgatttcaaacggaaaaattgtcaacaataaagttgtataaagcatcaagatctacaacttttgttttggtcatttttctatatgactttgtttcaataatttgaatttgaattttaaattatgacaacttcaaataatatttcaaatactaaataatttcaactgaaaaagtcatcaacaacaaaaacaacaaagttgtataagtcatcaagacctataacttttattttagtcatttcttcatccgacaaagttataataatattgttcaccaatttaacatatatctcatatggttttataaattataagagagatatgtaaattttttgaacaatgttactatcactttgtcggatgaagaaatggctaaaattaaaattttatatcttgatgagttctacaacttttatgttcatgactttttcagctgaaattatctactacttcaaaatattatttgaagttgtcatctttttaaattcaaaattttaattgataaaacaaagtcacaagaaaaaatggccaaaataatagcattaagaacacaataacatgatagagcatgattttaaaaatatttaggaaaaaaccatccaatttggagttcatatgagtaagataaactagtttcaaaatttcaaattttattttcgcatattttcaaattttattttcgtatatggccccttcaggaaaatcgatttttccatatgggcgtcttaaggagccatatgcgaaaatgccgctcgatttttccagacacggtaagttatggtccgtttgcaaatatcgtgagatctcgtacacaaaaatcgtttgtggactagtgtatagagctgttttaaagcgtcagaacacacgaatttgtactccgtaactcattaagtcataggttaaaaaacactcatttgtagtgttacaaagtactccctttgccctataaaaatccaatcatgtatatgtctatatttaaacgcaggattgggtttttacggaacaagggagtacgttgtaactatattctttacaaatgaaaaaaaataatgcaaaaccatatatgtagcgcaaacttaaatattactgtagattccagaaaagcatgtctgagacttatcaacgtcattatgagtacaacaagtagggatacaatttataaataacataatatcggaataaaaaatattaatttttcagaaaaacacaatccatctagaaacacaatgatgacaaatgacaataaaaaagggagaagcaagagggccgcgaaggagcagggcgacagtggttgatgtgacatctaaaaatataaataaacatcaaatagaatcccaatgatgattaagaggagggacgacagccaggacattaggcatctgttaagccgatggttggcggaacttctataaagtaaaaaataaaccacaatgataatcaccatgatttttaaaatctcaatgacaataaaaaggaagggcaacaagtgtaaaaactataaacaaaactccaaataaaatactagtgatgattaataggagagatgacgggcaactcgttaagcatcacaatcacggtggttggcgagacttttagaaagtaaaaataaaccacaatataatcacatttgattttaaaatattcaatgataattaaaaaaaagtatcgtgcagggtgtagaggacttctagatgacggtttggcaggacttctataaagttaaaagtgaacaccgatactaattatgttcgagtttcaaaatctcaatgacgataaagaaaggaaacggacggacagtagaggagtagagtggcggcatttgacgggacttctaaaaattataaaaatgaaagccaacaagatatttaactctaaaatttataaggtgcaattttaaatttccaaggaggacgaatagaagccgtaatagatcgagcatgcaaataaatgggtgacaaaggagtaagaggtagtgataggtgtgacttttaaaaactacaaaattagaaatatggagatgataaggttcagtcttttaaagtccgaaaataatgagataaccatttaacaaattttaagtgaactcatatgtaaataattttgtatggatacttgtcgtgcgattgcgtgggccacctagctagttcttattttatcttatagtaattatcaggtttatactacatattttcccacaaagaattcatttaacacttgatatgtgtgtatacacctatagtaaaacaaccagtgaataatacagaactgtaggcaaataatacaaataatttgtaaaattatgattgttttgtccctatcataatttgttactaaaaccagacatagtggttaagtgactagacacaggaccactaccaaaaaaaaaaaaacctcatcggtactgcccaagaagacccatcagtgctggttccctgcctggcacaaccatttgggcaccaatgcacgccgttcggggtattttgctatgttaagatgccattcggactgataaccgcagggaatattttccagcgcacggtccagggcgcacttagcgaccagctcggcaacaatgtcgaggcatacgtcgacgacatcgttgtcaagaccaagacaagcgactaattgattgacgatctgcgggaaacgttcgacaacctccgacgatatcgcctcatgctcaatccagagaagtgcacgttcggagtaccgtcgggcaagctgctcggtttccttgtctctagcagaggaatagaagcaaatcccgagaagatcaaggcaatcgagaacatgaagtcgcccacaagactcaaggaagtacaaaaactaaccggatgcatggcagcactaagcaggtttgttgccaggatgggagaacgaggacaacccttcttcactctgctgaagaagcaagacaaatttgtatggacacaggaagccgaagaggcattcgttgcactcaagcgctacctatcaaacccccctgtacttgttgctccccaacctaatgaagaattattcctctatattgccgccacgtcatattccgttagcaccgtcattgttgtcgagagagagaaagtacaacgaccagtctattacgtcagcgaagctctccacgacgcaaagacaagatatccacagatccaaaagctgctttacgctgtaatcatgacatcaaggaagctacaccactactttcaagcccacatagtcacagttgtctcctccttccctctcagtgaagttgtgagaaacaaagacgttgtcggccgcattgcgaaatgggtagtcgagctgaaacaacttctgacgtgtcattcagcctcaatcggccaactcatagattcccctccacctcagcacatttggttgcttcaccaagcacggaaagccaaaatatgatacctgttcctcatcaaaactattactctaggctcacacaatttcgtgtcccgtgccctccgggaagagagaaaggaccaaaggaggagaggcatccacaccaccgagctcgtcgaaaagagagagaaagaggaccgggctagcgctggcgacacagccaccgcggacaagaaccggaaggggtgaagaagggaggagggggaaaggggagctcgacgtcgatccacgccgccgcttaagcctcaccgccgccgccattgttgggggtggaggagagggcgccgacgaagacaggaggggggagagggagaggagctctcggtcaacccgtggtgccggtggaagaggaggaggggaggcgcggcagccggatgaggaggggaggcacagcggaggtggtgctccacccccgacggcgccggctaacctcgtcgtccaacgctactgtgccgccgagctccggtgaggaggaggggggtggtgtgccggcgagcactaggccccaccgcctggctctctatggtagggaaaactgggaaaggaagaggggagagagggggaggggaaaagtgaaaagtaaagtagtagtggtgggacccactataaacatcttgcattgtagaacatgtggctaacattgtttttggtctaggtggcatgcgaagtccaccaaagcttcgtgacacactatgaaagcccttagtaccggtttagaaattggcattgatgcgcatgtacgagcaaaaaagaatatgaagcggcggctccaagaatcggctctagccgattcttcgagcccgcccccatgatccacgttttcaaattcatatcccttaatcaatccccttcgacaacaagaacactcaatcccagattgatcaaccggaagattaactataaatcaatcacaagcaagaacatgaagagggtctggacattcctcaaacaagagtgaaaaattataaatattaatttataaaggtgaggctgaggatctgtacaccggagaaaaagagggcaacaactgctagtctgctaccacctctccctagggtttatcttatcgtttgggccggggttaccgtcactccgtggtagctcgataactgtgataatcacgcggtgaccgcctataatcgcacaaaaatcacttccaaaaaattgaattcaaaactctatggtttcgcggtttcaccgcggttaccgcacggtttaccgcgatatgtgggatgtgggatttgaactcaagatctctcacctcaggcctcacgcgtgttgccatcatacctactacacacatctagcttggataagatactttgttttttaattaaccctgaagacatctttagtactagttagtaacaccaatcggtactaaaatatcttaagttcagattgatgttacagtgctggttggtaacaccaacccgaactaaagatcctctagctttagtctcggttggtgtgttaacaaccggtgctaaaaatgtttctagggacttatacttttagaactggtagtaaagcatctttagcactgttttttaatctaatcaagatatttgtgttttgggggtgtaggatataaaagatcatttctctagtacttgtgtatgtatgttttttttttgacatattttctattcaaatttgtagtattagaatgtatatttgtttagatttatgatattaggatgtgacttattttatactaggttggtttattttgagattgagagaattaatatattagtatatgatatgcattgttttagtacttgttacactaattaaaattcctcgaccgaacgaaatcggcgtggcaaaataatcttggctagctaagtaataaatcggaggatggagagaacagtcgtcgttgagaatgtggactacaatatcatgacaagcaactacagtgatttcatcatcgacctccaaagcaggctcgctgagcatccagaacaggctaacttccacggccgtcccgtgctagcaaggcaatgccatcctaaacagccggcgagatggttgtacattaaccttgtgggcgagaacaacgatagggcaaccctagccgtccgggatgacaatgtctaccttattggcttcaggaacctgaacggaaaatggttccatttggggttctcgctgaggagcgttccgattcttccggaaccatccacgtttttggagtgcgacgtcacttatcgaagcttacttggtggaaatgtgaaagatgttctggtgagggtggacgtgcggaagatttctgtgatacatgccgtccatagactatcgggctacgcgcagcgtcgatgtggagtcgatggagccaccaaacgggatctagcacgcctgattgtcgtgatctgcgagtctgctaggatggctgcacactacaacacggtaaacgaggttggctcattcgcaacaggcaaattagactcgacctttggcacgtggattacctgtggaactgggggcttatgtcgtgggtggtgcagcagcagggagggaagatgtggcccatcaggcttataaactccggaatcaacagcataagtgaggcgctcgcagtactccaactgctgcttaacacggcgagaaggcctttgccagatctaccacgagcttcaccgccgccgccagtgctctatctgccacgtcaggcggcaccggcagtaccctgcccaccggcgcctccgttatggttgccatcgccatcggtgccgtcgtcattggcgttacatgtgcccctctttcatgcgtcctccttagaaagatggagtcctacagcattagctatggcgccgccgtcattgccgttacgtgtgccgttctttcatgcgtcctccgtagaagaaaagactcctgcagcatcaactgatggcgacgaaggatctaccgtcgactactgtgttggacgcttattagtggaggtgttggccgtgtggtccagctttgacagctgtaccatcgcagtatttgacgggaaacgcggccagatcatctacgagaaccaccgaggagatcacgatggcatccacgattctcaggtaaggaggacggagtatatatatatggactctctccgtcccataatataaaagattttgggtggatataacattcgtacattgaattttaacagatcgtctatttagatttattataccaagatatgttacatccatctaaaattttttatattataaaacggagggagtacgtttctagctatagtcttaccgttacttcttgtgaaaatgaaagatggcacattcgtggatgtgcatatactactccagccagtacttctctctgtcctaaaatacaataatttgaaactggattgaacatattttagtcgtaggttgtattttttttagaattaaatagtacaaagcagacactcacaacgcacgcacactcacgaatttgaaaagcttataagggtggtatactaaccgaataatacctattggattttaaaagtacgatttcttcatgaattttatccgttagcgttgcatgataaatttaattttgtcatttatagaattacctgctggagattgggttcaaaaattatggtatctagggcagctgactcttgaagttccattagaaaaatagaaaaatagagaaaacttatattgctataaaagacattagatatataaccatatataaattaaattacgcctgcttttttctttatcagaatttttagaattttctttaacttgttaagagaatatttaggagcattaatcacatatttgatttaattttaaattttttttgtgttgtttatcaatcataaaatccaggtactatttcttacttcgtgcatgcatgcctgccgggcatatgtaaattctggtctatgcaactgcaagcttgtcacacagagacataattaaccctaacgtggtatttgcctatttgatggggtcacgtcatgtaactggattgggatgaccaattttaaattttttttgtgttgtttatcaatcataaaattcagggactatttcttacgtccatgcctatatgcctgccggacatatgtaatttctggtctatgcaactacaagctatgcaactgcaagcttgtcacacagaggcataattaaccctaatttggtagtatttgcctatttgatggggtcacgtcatgtaggacatgggtggataggacatggcggcccattttttgtgggtgtttggttgctgggcaggggtgggatggggcggcccgaagaggaatattctcctcagatgctggatggggggatccgaccgatttgcccggatccagccgcccgagcgcccgggcaagctaggcaagcgagggaggcggtcgcgtcacccgcgagcgagggagggaggcggtcgccgggcgagctggccggcaggatgcgggcacggtggccggcgcgggtgcggcaacgggaagcgggagcggcggcagcaaggagaagagggggtggcggtgagcccgaaggcggcagcagcgggaggagggaaggagacgacggcggcaatgcgagttcggcggcggcgggaggcaagctcggcagcggcgcgggatgcgagctcgtcggcggcgggaggcgagctcggcagcgacgccagatgcgagcttagcagtggcgggaagaggagcgacggtgagcccggaggcggcgggagcagcgagctcggcggaggcaccggaggccttctcttttttttttcctatctccttctctctcttttttttttgggggaatttgtgatttgtagtatatatgaatttgatgaggggggtatgctcaccctttctaagtgagaggtgaccacacctgctcatccacctacttcctccaaccaaacaaaaaattggatcaccaaatccatcttcatccctacaaccaaataaaaaactggatcgccatatttacccaatcaaacaaaaaactgaatcgccctatccaacaaaatatggtccgccatatcccatccaacctatccaatcttgaccgtgaaccaaacacaccctagctggattcggatgaccggggtaggcccgagcacgggagaggagggtgggcctgggatgacacctttgactttttatgtatatgtttcatcatccgtctcaattttaaaaaatatatgtgattaattttttttcggggaatgtgattaatttatagatgaactatttttttcatatttatataaaatgtttgaatgagatggatggtcaaatatatatagaaaagttaaagttcacggtgtcaatctattaaaatcggaggaagtaataaaatgtataatgtgcaggtatagggatcacactatttttttatttgacaataaatcatagtccatgtgcaccttaaataattgattgaaatgtcatgatataaaaaaaagactaatcatcaaacaactcaacttataaaaagttattcctagacgatcacacatatattagctcatgtctccacatgcatgtaggcttgcatgagacacccgtaactgggagattaggctatctatccatggaatttttatttaaaatcagtaacaaaataatgatttagatcttaaccaccgtggagaaaaaaaggggagggaggagagacgcatacacaggcgcgtgaggggaggcgagggcaacgacgccgtacaacattggacccacacattcaaggaaaaatcatacgtggcagtctgagagcgtttttaaatcgccatatggtcgtttgagagcgtttttagaaagtttaatggaagaaaaatcatatgtggcagtctgagagcgtttttagatcgccatgtggccgcttgagagcgtttttaggaagtttaatagacttttagtatataatagaagataaatttagattcgttggattaggatatgtcttatccaattatagattgttatattttagtacggaggcagtatatgtgtagttgtgtgcacacgtgtgtgtattagaaaagtacttgttgattgactgaaactctgaaggtgctatatatacagggtaatttgatgctgactggaccgtacagggccatctcagccgacgggagcttcctgatcgaagttcataccaacaatgctggcgatgttgatggtacgctgttttgggactgctacgacgaccgcaacgaccatgagcacgacataacattgactaacaccatcaacacaagccttggccccgttgaggtgacctacgcggtgctgaccgacgcagtggaggccaccgtgcaggtcaagctgctgcatgcttctcgccggatacagcaccgccacgcggtcgctgccaccatcttcgtctacggtgatatcaccgcgcgcagcgaatgcttcagcgtcgggagcgtgctcttcagccgtggctcgcagaacaaggtggcgctcacctcgggctccacccttcttccactgtcgcgatgcgttgttgcggtgccacttaacgaccaggtcgagatagaggtgaagctgtatgttggaacttccagcgaagagagtatcaattacacttttatccatcgtattctcgtgttctactcgggcggtgaacagctggcacaacaaatattcctccatggcaacccagcgattgaagtcacttggacaccgtacttctgaaggcaagttgaactatcaacctacttcaaattaacgttgtatgttccttcttaattacattttttggactcatatattagattgaccatatatatcatatatcttccaatatttaattttacagcgagtgctaaacagcataagttgacaaggagattaattatctgcagttacaactactacagtggctgcaaggacagccaactgcatccatccagaaaatatgttgggtcggtatatatctagatatctctcaattactctacatgactatgtgttccagtaaataaggctctttacataaacggaattgtttaaatacgacgatttcagtaaagaagcaggttagtgtgtgctctatatatgatctgtactagtacaatatatactatgtgctcctatacgttctgtgatttgtccaagatatttatcatacaggtgattaattgtgtgtcagtgtgtggttgtgaactcatattgtactagccacttagtcgtgcgttgcacgactttgaattcccatatgaaagccatgtatatatacatcgtaattaaatcaaaatcaccaatgatgagcgaattaaactcattaagatgagactgaatagatttaccttctgccatgcgaattgtgtacgggtgttatttgaggcataatttgttggcgagacttttcttcatgtatataaaaggcaggtgtataatcatgaaattatatgcttgaaatttgaatatttgcaagattgtatgacatgataattaaatctagaaagacctttatttccaactaaaaggttcaaacgttatattcaaaattgaccgtttactgttggttccaataaaaaaatgctcattttatgctcatactactgaagtgcttgttgagttcctagtatgtttttatgagctggggtaaaagaattaggcaagcacagcatctggcccctcgttggcttcttcccgatgtctctagactgtttgctctttttgtactgagcttctttcactagatcgtacggcatggactgaatttctgttgcatccaacggctcacattaagcagatccgacggtggtcgtttaccagcagttgtatcggacggtccctgttttatggatgacgtggcccaaccagattgcaagaaactttatttctttcaatactttagatccctcgaatagtttgattgttaactataatatacaagtatgtgactattgattgtcgaagctgctcctgtttaatttttacattaatgaaaatggattacatctccagcttctgttatgacacacaaccataaattttatagtaataaaaaaaggtaaagataaaagtaaatcaaaatgagaaataaagtgatgggacaaatctccaactcccctttactattgactagcgttaaatcacataaatttttttagttagcaattataatggaactacatcacccatagtggaataatagacccttggctaccgattcgaagagtgtagcaccattgcgcatagtatcctgctcctcctgtggtagcattttagaccaaaagtggagccagtaagaagacattaagataacctgcatagggttagataattggttaccattaaaaactttatcattacgacaacgccaaattgaccaacatacaacactagcttggaaatgctactgggcgagcgattgccctcgcccgcccagggcgatcagatccccctcctcctccccctccctccctccacctggtttccttttttggcgccgtattactttcctattttagtaaatttatacacctaaagtttatacacctcaagtttacacatctaaagtttagagaccaaaagtttatatatccgattcaaatttgaatttgaattcaaatattttttatatatagtatttctatacatctaaagtttatacacctaaaatttgtagacttaaagtttatagacctaaagtttatatatccgattcgaatttgaattcaaatatccgattcaaatttgaatttgaattcaaatattttttgtatatagtatttctatacatctaaagtttatacacctaaagtttatagatccaaagtttataagtcaaaagtttacatacccgattcaaatttgaatttgaattcaaattttttatacataattttttctaacttttgtttttttaaaaaaattttgtggtgtactgtaataggaagagaagaaggggaggaggaaggggagaagtgggaggagtggctatagggggaggggggcgggatccgatcgttgggcgatcgccctggcaatcgatcgcccaatagacccctccgcactagctcctattagaataatctttttaatggacctagatacccctctaagccaattaccaaaaatatttttggcgtcacggggtggagggatattaaagcaaaaaacacacatctctaaacaaaccgagcaacatgacactaaaaaaaagatgttggattgtcttttgtgcatagtagaatgaacaatgtttgtccccaagttttatttttgccaggttatctttcgctagaactactttcttgtgaagaaactacataaagaccttgatctttagtgaaatttttaagtcccactagaatttacagttcatgatcgcgccatacatagatttgattaaaatttggccattcttatggaacgaccatacaaaacagtccttttcatttgacagaataatattagctagcctgaggatcaaatcgttccactcgacgcgcgcgctgccgctgctgcacttcaccctctcgctgctcgccggcgaggacctcctcttcttgaccgccctccgcacccaccactccaccacgtcgtcgccgcccgccgtctccctctcccgctttgtctcatatggttcaatagaacctagaagatgagcgagggtcattcagtaaagtatctttttcaaatggtaaaaaatgataagagcaccactaatagtgattaacaaattgctctactttggagtgctctcagatgagtagctacagtaaatggtcatgagagcactaccaagggaagtccaaccatgagattgttacttggatctcatcaccacccattccaataacacgttgtacatgttgatcactagtctaaggttcaaattcgacggcagctctgacaatctcatcaccggaaaaagaacgcaagtccaaatcgatcgtcaacagcatcatatatagctggttctgcgaacgcacgccctgccaatgggatcaagtagagatggcaatgggggcccgttcaccgtttccccgcggtgaattcacctattaggtgacggggatggttaatatctactcaccatggggaataaaatggttaaaaccctctcaccatcggggatgacggggacggtgaaccattaaccgtccccgccccccacggtgacccgactgtactgtacaagggaggaattctagactttttagatgtattgacccacaatattgaagcccatttaacaggcacatatataatctaaccctaagtcaataggtcaaactccaaatcctccacccacccaaatccacaccagccaccactccggccgagtcacgcgcgccgccggtcgccagtccgccgggagccgcgcgcgccgccgttcgccagccaccaccgacgccgccgggagccaccacgcatgccaccactcgctgccttctctcgccgggagactgaagccgccgtcgccatggactgaagccgtcgttgctggcctccttcgtcgatgcgccgccgggcctgcagccgtcttcaccgggagccgccggcagcctccgtcgacgcgccgccagcctgcagccgtcttcaccgggagccgtcgtcggcgcgccgccgagagccgccgtcgccgccgccatctgtcgaccatggcttcggcctctcccccgtaagctacgacagcgacgatgcaaggtgagcatactacaatccctaatcccttctctgtgcggggacgggttcaccacgaggaaaaattcaccgcgtggtgatcagggatggagaaattatagccccgtcgtggttgacgggggcggggacggtgaaatattttcaccacggtgacggggacgcaagcatgacccccgacggtgaattcaccgttgccatctctaggatcaacccgttcgatcctatatgtgtgccgctacttaagtcgctgtagaacaggacgcaaccaacatcgagaagcttgttgcgtgcgacaatcctcccaagaacgccggtgcttgcaatggagtctgttggcaactttttgtgacaagttaacaagcacaatcacaacactgtacctaaacgccttacggtgattgtagagtcaccaaccaccctaacccagcaagcactaggtcaagatgggttttgatagattaaaccagctagcagagccgatttagatgaaaactagggataactatccatctcgtaggcaaatggaaggttttcagaacaaacctacaaagaggtgtcgcactctcacagcggcagtggataatttacaacgcaaatcgacaaagatagacgaactaaactagaactaattgaaagtaaaaaagcaatattgaaaaaaacgattctattgattgatcgttggatagattacaattgaaccggccttgtcccttatataggggttgatcttaccctctacaggctctcctccacgtccaactcgggatagaaaccaaaagaaatccgaaacatgccttcccaagcaagaaaaattcgagacccgacaaaacagactcgggctcggactctgccggtcagaccagccacatgtcggcggtctgaccggagttcaggccacggtctgaccggcctatacacggcggtcagatcggcctgctagaggaaaacaccgttggatcccaaactttggcaattattcctatttcaatcctaggtgctaaatttgggtgtaaacacataccccctacctttttggtgaacaacgtgaacctgaaggcatagaacatgttgtcttagggtgataatccaattaccggccatagaactttctaaatatcttgccaaacactcgggaagtatttcttcaagtagttcccattgactgctctctgaaaacgctctccatgaagtgtctccaaaaaatacgcgttccctgaacaatcccgcatactcgataaggacattcccaactaggagaccaattaccgaactccttagatcgagtaccctctcccacttgaaacaattttgctttcacccttttgttgtatgctttagccactctcttcttctctttctctatttcttccaaagcctttaaacgtttgttgataacatcatcaagattatccctatcaaggtcttgtagtctccactcaacaaatcgtcttgcttgatataccgaagagagtcaagatttacctcgaccgacaaaacggcttcatatacataaatcaactcaaaaggagtgaccttagtagcaccatgtttagatatcctatgcgcccataatgcttcagaaagcaccttatgccacttatttgggtgttcttcaatcttctttttgactaatttcaacaatgttttattactcgattcagcttgtccattagcctgagcgtagtaaggagaagaactcaacaatttaataccgtaagattcggcaaaattcttcacttccttagacataaaagaagcttaaaggtataaattcgtaattacaacttaaaataaggacaagaaaacaattaccctttaaaaaacttaatttaatagtggaccataaaaaaaaccttatttcaaaaattcgactgtaacctcaatactaagtccgaagatgatgagatctaacaactaaacgttgcatagggcagcaacctctctgccgccatgctgccctagtgagttggtggccaccgtgaaaagggggtcaacactcaacatcaagagttttggcgcggacctcccaacctcaacgccagtgattctagcgatgaagtaaaggattttttttattagaagttctagatctcaacaatgctatgactgcactagatgtgatgaggctagacaataacaacggtggtgtgtagaatagcaatgagttagtagcggtacgggagtctggtgacgctaaaactcgagttggatgacatcatattatctactcccgccggtttgataatacttatcgtattggacaagagcatagttttcaaaaaataattttgaccattattttttattataacatgtataaatcgttaacaaatatatgattttattaaaatactttttaagactaatatatatgtagtcaccatatttaaaagataaatatttaaaaaatgatttataatcaaagattcgaaagtttgacctcactcttgttcaaaaggacaagtattatcagtctggagagagtagatgttgtagtcattttgagctcatgatcaaggcccctatctcattgctaggtccatttgatgctgaggttatttgaagacactaaccacccgccatgttgatccaccagatcagactcgtacccatggcggtagggaagtcacactactagaaaatcaatttttcacgcgtttgaaaaatatttttcatggcggctaagtggaaaaaccgccagcgcaaaaaatcgtgggggtgagaggtcaagggccgccagtggaaacacatcttcgctagcggttaacttaagacggccgccagcgaagataggatatcttctctggcgactctcttaagttgacgccagcgaagatatggtaacttcgctggcggtaaggggacatggcccgccagcgaagatacctacatcttcgctggcggccctcttaacttaactccagcgaagatgccatatatatcttcgctggcggtgtggtgacgtggaccgccagcgaagatacctacatcttcgctggcggccttcttaaccctccgccacctcaaattattttcaatggcggttcaaacgaaccgacatatgacgaccgtcaggaaaaatgcgctgaactatatcacccagctacagtaacttcgagcaccattaggagcacgattttctctatgcgcagatcaacattttcactggcctttgctttatgacggctgcgatttccgccaacgaaaacccaaaatagctgccacgaaagatgatttctataatagtgtttagtgctagtctcgttggcattgaaatggtgaagctcagtgttacttggcattttaggttgaggtttacttttaaaacatttaaataagcttttagcacgcggtccgtttttaaaatacgtacgtttcttgaaggattagatttcctttttttttctactcctgtttcgtccaaccttgcattgcactcgatcttggtaaccatttacttcactatacaaatcctgctgtttatataaatcgaggtgcccgtggaaactgatctgtaagcgtctgtctatttccggtgcagcgcggacagcgccagcgccaactgtttatttattggttcgctggtgacctggtgtcaacgtaccccgggcagccaattaaccaccccttgtcaaggaggtagagtaattaagagccatatgacagtctctcttacagtctgatgatctcaatatcacacgaattatactgaccaaggacaatatttatatgatggattgagatgtttgcattaaacatgtgaatatatactgcttaccgtatggcttaccgtgtaattcttaatgtggtttgacttcttctatgccttttgtcaactaaacttacagcaaaatcgaaatgtcacagcaaggagaccggccggaaagcaatctgaatgcatgcttttcacaagtcacgaccaggccgtgaaaactacggctaggctgacctgaggtcaacctttctttttttctacgttggatattatatagtacttccttcgtcccactgaaatgatactaattcgattgatttgttacgcctataaattaccaacagatcgtgcctgcaactctgcaactgtcatactgtacctcttagtttgcgaagctagcaagtctggtgtccttggacgcaattagttgttgtttgatcgaccaatcgatcgaataccgtcatccgagcagtaagcaccacttcttcgttcagctatattacccgtttgattatcttagttctcttttcggtcataaatacttgaatttcaatttgagccagctttaataggcaaagtttcagcatgaactaggaccatgcatgtatagttaccctcctttgcactttggaccatgttccatccatttaacaaaatggcacttaactcactgcataaaatacatgcaggtaaaatgatttagacaaagtaccaaaagttaccaagatatataattattgaatacaaaatgtcacatatttatgaactgatggactatacaaaattattaaaggagtaacatgttaacaggcccccttttctccaagcaacaactagcattatagcaatcaagtattttggcggaagaagaagaaaatgggagataagaagtttctgtgagtttctagaaactagggaaagggttggaggtaggaggaaaggaagatcaagttaatttcaagccttccccgttgccattctgcatctgttgtttgatccccttaaaaaaaccgttgttgcttttgttatctgccttgggctagctttagtgaattgttgtaacgaccatttgggagcccatccggtcctaacaatcccctctcttcgaaattcagcttgtcctcaagccagtaaagtgaatcctcttagatcccatggttgtccaagatccttctggctagacataaaacaataattggaattaattgaacaggacaattattttcaccccatataacttcgtagtccatttaaattctccatgtatgatgaacgatagcagcactgcaatgaattgctgttgaacagtgagctccaacaacatgtccaggagtgtgctcatctctcaggattctcatttcaccagctctagcaacaccacgtctcatctatttattgatagtgtcgaaactcaattgatctccttgagaaggctaatccctacatgcgaattggagaacacgaacaagaacaaaaaagatgacaactcaattgcagatgaatgatttataaagaactcgaagttgggtttccacaaaccgatgaacggcaaaattgcaataacaaaaataatctaagcaaaacctaaccctaactcgatgattaatactaaatatatagattctagggtcaaccttggacccattgatgtgtccccattgtactccaacacgatacacagcccaacgggcccacctggacagattctagatgccttcttgtttcaacaaatcatgttgactcagaaggaatttaacgtgggaccagatccattggaaatgtgctctcgttggctttccatgcatacgtggactttcgaaaacagagtccgaatgcaatctaggctacaattttagtgttgactgctcctggagtctgaggtggactcgatatgagcccaaaattgcctattacccctgttggaaatttggtcataattctgcatattttaatccaaaataataagataataaacatgatattcggaatgggatttgatccagtgatagtggtaaatataatcaacatgagcatgcttaatatagaataagcatcaacaatcacatagtaacgcaatgctgacattgcgattaacagtaaaaattctaattgaatagagagaatggaagtataccccaagaatggttctccactagatggagagacattataatgggtatacagtgtctaccgtattaacagacccta

SEQ ID NO: 45526 - DNA, 16675 bp, Oryza sativa
gctaaaaggtgggggttaataattagcccatggaaccaaacagggccctggtggcccgcacacgaaaagaaattaatgattctataaagtgaagttggagataccttttagagcgagtttaatgtatagctaacttctaaccttaagtcagctataatcaatctagtagtcttcatgctatagttaagtacctataaatatatatatcacaccattaatatttggtcccacctttcatacacacatagtgtattggagtttgtgctgcagttagctacaattatgtagcccactttcctttctctcttctcccttatctcatccacatgtgtttataagacaatcttatctcatccacatgtgtttatatgtcttatagcctgctattgtaattgctcttacttaatattctccttttagcttattttttataacatgtggatacaagttagatataagtgctcactttaagattaaattaacttggacgccctaatgtaggtgagtggatattatgtgttaaaactaaaaaaataagtgaaatctattaacttattaagtgttcgctctcgtgacctagaaaattctcatattaatcggagaaaaaaaacagagtccatattggaatacaattttaaaatagctgaaatttggaattaaaaataagaaatattgttagagaagactacagtccatacttgtatacagtagaactaatggaaattcggaattaaaaaagaaaattaaagtagatgttacagtccatataggaatacaaatagaaataacaaaaaattgaaattaaacaaataaagaatattggaataagaatatagagtccatatagaaatacaatttataaataactgaaattcaaaattaaaaaaagaaatatagaaagataagtttagagtccatatagaaatacaatttagaaataatattattttaattaaaataagaaatattggaagaagagtatagcgtccatataggaatttagaactaattaaaattctgaataaaaataataaaattaaaagaagattttagagtacatatagaaatataatttacaaataactaaaatcagcaattaagaagggaatattggaatacaatttaggagtaactgaaatttaaaattaaaaataaataatattgaaagataagtttagagtccatatagaagtacaattataaataatgaaaattcggaattaaaaaaagcattactaaaagaaaagtctagagtccatatggaaatacaatttataaataatagaaattcagaattgaaaaataagaaatattgaaagagaagtctagagttcatacaggagtataatttagaaaaaaaactaaaattttgaatttaaaataataaatataggaataaaatttattaataaaaataaattcataattaaaaacacaaagaatgttggaaaaggagtctagagtccatatagaaatataatttagaaataactaaaactagcatggtggcccgcgcagcttgcgcggctagcatcattatattttctctcatataatagtatatatgttttctcaatatattattcaaatatattaaaatgacaacataattttaaattttgcaataactttacgaaactactaatgggtaatattcatattgtattttatatatatgttagttattaattatttttaatatcaaattttaattatttgtaaattatatatattcgtatatggactctagactcgtcttttaatatttatctttttaattccgaattttctgtaaattgtatttctatatagacttcatgctcttattctaatattattatttttatttctgaattttttttatttttaattgtatttctatgtggactctaaactcatctttcagtattctttaatttttaatttcgaatttcagttacttctaaattgcattcctatattaactttaaactcttcttcccatgtttttcttaatctcgaattttagttatttgtaaattgtatttttatacggactctaaactctacttttaattttattatgtttattctgaattttagttagttttaaattcctatatggactctgtatatactctacttctaatattccttatttttttaattacgaatttctatttttttcttaattgtatttctatatagactctatactctacttctaatattccttatttttaattccgaatttctatttttttcttaattgtatttctatatagactctatactctacttctaatattccttatttttaattccgaatttctaattgtatttctatatagactctagtctcctcttctaatattccttattttttaattccgaatttcaactatttctaaattgtattttatatgaactctagtctcctcttctaatattccttttttttaattccgaatttcagctatttctaaattgtatttctacatgaactcttctttttctttttctccgattaatgtgagaatttctagaccatgagagcgaacgtggaggcttctttttctattcctttaataatataatagatttggtattaaaaaataattaagaactatcacgtatatacaacacaaaatgaatagtaaacattgatagtttggtcaagttagtacaaaatttaaattatgttgttattctaagatattttaataataaaataagaaaatatatatgctattatatgagagtaaatataaagaggctagccgcacaatttgcacaggacaccatgctagttcaataataagtggacataaaagttctataaatttataaaaagaattactaaaaacatgtgtaggcatgaactatattaccgtcaaatctagcttaagtccaaacttaacttaatttgaatgggaaaaaagatctaaattacaagttacattgtttttatctgtttgatagttttcactggatatttcctctggatataggtgagctaattcctggagatgcatggatcgaaccgaagaaaattggttatggaggtgagagttgaggacgtgaactacaacatcatggcagacgactacagtaaattcatcgaggatctccggaaaaagctcgccaatcatccgcataaggagatgatccatgatgttcccgtgctggcaaggcaacaatctcctagacagccggctaggtggatgtatattaatctggtgggcaggaagaaggacagggcaaccgtagccgttcgggatgacaatgtctaccttatgggcttcaggaacatgaacggagaatggtttcacttgggcttttcgaagtggagcgtgcccattcttccggaatcatccaagtttttagaatgcgacgtcgcttatagaaacttacttgatgtaccacaaggagaacaggtcatgagtaggttggtggaggtggagctgcggaagacggtggtgctagatgccgtccataggttgtcgcgctacacacagcgagggcaagatgatcgtattgatcgattcaccaaacgggatctggcacgcctgattatcgtgatctgcgagtctgcaaggatgaggccacactacactacggtaaacaagggcttcgttcacgacgagacaaccagcctcaccaagctgcacgtattctacttgtggaactgggggcttatgtcacgggcgctgcgccaaggctggcggccatggcccatcagacttgttgaagatgcccgggcagtagtccaactgctgctcaacgctgcggccgcgatgccgttgcgaatgaccgaaacggaggctgcctcctcgtcctttgccaatgacatgccttttgcctcctcggcctttctcgatgtcatgcattttgcctcctcgcccgatgagatggcctttgcctccttgccctttctcgattggatggattttgattactccaacactaaagctaaagccactgaagcaaacgagcagcctgcagccatagatgacatggcgccagtaaacgacgaggagcccgcagtgacgactgatgacttggcttgggaataccatgaggagtcggcagcgagcgatgacattgatgacctggcgtccgaagaccatgaggagtcggcggcgtccgatgacttcgcgcccgtagtcgacgaggagcctgcagcgacggattacgaggacgaatttacaggtcaagtccatggccgacgattagtggagttgttggccgtgagttccgacttcgacagctttatgataagtatctttgacgggaaacgtggccagatcgtctacaatcaccaccaaggacatcatactgtcatccacgactctcaagtatgtattactcgaggttgttatgtgtaacgcgcaactttttttaaagaaaaatcattggtctaacttatatatggagtacatgtggttttacgaaattaggacatgtaataagtttttagaagttgatgaccgaacagctgattaaatatatataatcagatggagtacttattatatagatggtctcttgaggtcatttatatatggactatatatattttcaaaccaatgaatataagcattaatttgcccttcacaatgcatgcagcgcaatttggtgctgactggaccatatagggccatctcagctgacgggagctttctaattgaagttgataccaacaatgaggatgtccatcctgataagaaaagaaaaaacaatgagagcgaggtctcatctgatgatgttgatggcactctgttctgggacagctataacgattacaactacactaggtctgacaggatattggctcacactatcaggacaagccttggccccgttgaggtgacctacgcggtgctgaccaacgccgtggaggccaccgtgcaggtcaagctcctgcttctcactggagacggcgccgccacgtttgctggcagtgacaccctcttcgtctacggtgacatcacggtgcgcagccactgcttcgacgtcgcgagcatgctcttcagccatggctcgcagaacaaggttgcagtggcactcacctctgacaccgcgaccattccactgtcgcggtgtgttgttgcggtgccactccaccatcgggttgagatagaggcgaagctgtatgttgaaacttccaacgaagaagagagtatcaattacacttgtttccaaggtaagctggacttcgccgccggccgtgaccagcagatacaacagatatcccacggcgacaaccctgcagtggttgaagtcacctggtcgccggacttcttttgaaggtacattgaactctcaacctatatttcaaatgttttcggattagttggctatatgcataattttcagcacttatctttcacacttacagggatcgagtggtaaacagcatagatcgagacgacggtcgatcggcggagattctctatggtgaaaaccacaaaagtattgtaaggtgaaccaataaatggttcgttctagaacatccaggtatctagctatatcgcttaattattctatatgggttctgtataaataaggctcttcatataaacggaattgttttaatacgaggatttcgatgaggagaagcagatttgtgtgctatactatgatatgtaccgtctataaaatattgtgtgctctgacgttgtgtggcttttcgaagatctatcatataggtgattgtgtatggttgtgaactcataaaacaacaattattgtatccctccaatagttttgtgttaattacaagtatgtgactattgctggtcaaaattactatttaatttgtgtatagtgcaaaattatagttatgggtcgcaaagagcatggccaaacaatccaatatgctgattatacaatggaaccccggaaacgccaactcacatttcaaatttcaaacgttattgtattgaactttggcaaagagaagcaacattagatccacggttgcaagaggttaaccacacccgaccccatctgtctgatgctcacctccaaatgcctttctgtcggaagaaaatgtgccacacacagatgagcaatggaaaagtatgcaaccaggtagctcatgttgctgcacaatcatgaaatggtatagaattaaaattatcaagtccatttgtcaaataaaagcattggagaacatgagcacagcttgaatagaaccaaatcaaatcagatggtagaacgaagcaaaacggatcgaagagacagagagaaaaaaaaatcatagacaacaaggaacgagggggggttcaagaggtcaaaaaacttaaccatgcttgttgccaaatcccatgatgaagcgtagcttctctgcagtggcatgctaggaaatgcgctaccgtgagctgaatgcttcttctgatttgtgcgacacctaattaatactgcaaaagcattaacatagtggctttggtgttaggctcaactacaaaagtgtgataaagacatcaagctaataaatgatacatgtcgtaaacttgagtcaacggtcatgtaaatttttgccaacttcggatgaaggttcactaatagaattcaataattgtgggtctttcgtcttgtgttggtgcttattagtttgtttcttttctttttaggtaaatgttgctacatgatacccaaattttgtgtaatttgcttatagacattgaaaaacatgtcatggttaaaagacatcctaaaaaacttgtaatttgctatatgaatttttcgacttaattgaaaagataaattgttaagaaagacaagaatgcccctagatcacgtgcttcaaacacaacgttagagtaaaaatttagaaattatgcaactttaaatttagcatcacccttagtacatcactagtaaatattatatttcatctttactctagtctcagctcaaaaacttttgaccatagtttttctagattataaaaaggtaaccacaaatagtcttagactctcctaaacggcttatatataaagctaggcgacattgccgatcttaggtcttaaagaaacattaaaagcccaaaaagacatttgaaaacttttgtatctatacggtgaaagcagcaagctttcttacacgagaatgtgtcacatcatcacaaatatattagccgtcggataaagagtttggataaacaatggccattggattaaaagggtatatgtatttaaaaaacacaaatgggctaaacatatggaaatttctggaggtttctggcacctcctcctagacacatgataaaaaagagagttaaaagagagaagaaacacaagacttctagtgattgctcttataaacatataatacaacttagttaaatctataattggctagcgaaatcaatacttatatcaaaacatttttaaaagcttaccttaactaatagaacatatagaaaagttcttaaacaggattaaaagtcgcgcaacgcgcgactatgtggctagtcttccagaaggaaattcgcctccaaacaggttgggctttaaaagcccaaaaccagacctccctcccgtaaggccggcctggacaaaattctggcatgggccctaatctctgaaaaattccaaactataataataaccagattattgaatcttcccatggctgacaagtgggcccttatacagagagacgctgacgccagcatgacgctgcggtgacgcccaaaatttcggggaatgggaccaaatggcacgcagacgcagcagcaggtgagaggcgacatgcatgcgccggccggttctcacctcttccatttcagcaacagctggaaaaagcgccaagaaacaaacacctcatcatcaagccaatgcaattcaaccccacaaaaaggccttccgaatgatacagctcacatcatcacaccagccacacatctgcacaaggtctctgtaactgctactgctgatgatgaatcattgttcatcaggatgatatatgattcacatgaagaacagaagtgagcacaacagaagaagctcctctccatttcagaagtgagcacatcttgtgaacaaaaagctcatggaaaggagggcactgattataatgtgaacacgtggcagatgaaccagcagggaagccattataatgttgtcactaattggagaaatactttaggttacagaggatacaggacagtgactggatgatgatgatggaaactcaatactacattttcagaggtaaaaggaggagatgatcactataattgaggatcatcagatcttttcttccaaccttgtgcttcttctgcacatcattattgaccttttgccacaactgtgagaaaatgcatctcaaactagtgggttttttaggtacatcagaagctgaatttttcctctattggttatgtacaagattagcaaacactctcaggagtttcagttgtgagttgtgacatgcagaagcattcactagttcaaaacaagtggaaatgttcacttgttcaggcctgagttttggtgtcagggacaactacaagtccagaaccatgaaaaagattgcacagaagactgaaatattagggtcaagtacatcaaccaaagtagaaatattatacaggagtacatctaaccaagctgaactacaaagccgacatgcacctattcagtgaatcaggttattgtttattaacatatgacaagatctgcactagtatcttttccatcctaattttataatagtttggtagcagcactaatacagtttgacctgatcttttatgtcagatagaattatgcaggagataagaagatcacctagatatagattattgacaatatcacacagacaatcttgcaggggtcttatcattattggcactagaatttaactcataagtgtgtgtaatgtgaaatctgttactccgcactctatccatgttgatctcctaatctaattcttaatatattatattttctgctggcaagaagccttcaaataaattggacaacagaactgatccatcacaaactgcaatccacaatgaggaactcttaaaaagattcccatattgaatataaaaccaaattaaggatttcacagaaccatatgtagaactgaaaggatggaaaaagtctacaccgctacagcagtacttcataatgtcaaacattgctgaattttgcacgcatgatagtttcaagatttgaccttttgattaaaccatccaaatatcaggaccaaacatgaattatgacacaacacaatcgaactaaaccacagtagatttttttttcttgtttaatttttttgtcgacattctcgacaacaggccacatttcatagcgacctcacagatttttcaactataagttactcccagaattagccgcgcacacatggaggactaacaaaaatgccatgatatacaccaaatgcagcatcaaaacatgggaagaaggaatcatctttacataaagatggttcctttcctttccccccttcctttacagaacggcacacattttataattactactagaccaccacaagtgaggaaaaaaaccaagaacaggagagctacctataaccaccacatttgcgcgatcaaatccaaattctcgacggttcgatcggcattacctatcaccaccacattgcgcgatcaaatgtgaattctccatgtttcaatcggcgttgagcatcggcgaatcgagcccctccatgcggctgcgaacaatgcggtggaacacctccctgacctgcctttcgagaggctcaaggccggccctcatggcggcgcacacggcagccagctcggcggcggcctcccgtacctcggcctcgcgctcaccggagagcgggacgggtgcggcgtcgatcgcctcggcgagccgctgcgtgcatttctccagcgcgtggatttccttgaggaggccgcaggagttgcgcctgtccttgcgcttcccctcctcggtgaggcgctcctggagcgcgagcagcggcggcgcccatgggaacgcggcgcgcggcggcgcggcggggaggtggtgcgcctggagcgcggcggcgcggtccgggcacggcacggcggcgacgagggcccacgcggcgaggtggagcaggcagcccatggagtacaccggcgccacgagtcccccctcgtgcgcgcgcggcgccgccaggccggacccgatggcctgcagctgcctagccgccgaccagttgcgggagacgctccacgagagcgagcggaagtgggaggaggaggaggacgacgacgaggaggatgaggaggaggcgagcgtcgcggagcgggagggcgacgcgcgggcgcggccgaaggagcggttgcggtgggaggagaggaaggaggcgacgccgccgccacccgcggcggccgcggcgtcgtcgatgaggagcaccgagaggtcggagagcgccttccgcgcgcggcggagctggccctcgtggatctcccctggggcgagcagcacggacgccgcgatgccggcgagccgctcccaccgcctgacctggtcgacgccgtcgcgtgcggcgttgcacacgtcgagcgccttcaccgcgcgctcgtagaaatcccccaccatcttctccgccgccgccgacagcgccccgcggcggcgcgccagcgccaccaccacccggaactcctcctggcacagcaggaacgcctcgagcagccgccggatccactcgatggacaggagctcgtcctccccgcccctgagatcggcgaggtgcgccgccacgtgccgctggaacgcctccaggtcggcctcctcgccggacgccatggccggggacgcgccggcggcggcggcggggctgtcgcggcggagcgagaggagggagcggccgaacgaggagaagggcgacgggtgggagtgggtcgaggaggagccctggtagtcggtcgccggcatggtcgccggcgagatcgccggagaggaaaccgaagcggatcttggagagagagcttagcgggttaacgggtgagatggatggagatggtgaggtggtgatgtgtggatggatggatggatgggtgtatatatgtatgggattgtgattagggaggggattagtttaatgatattttggggtttagggggaagtggtcttagctaatcatgattgtttggatttgtttaatctttggtttgtaaatgatttctttctgtgggtgcaaatattcttctggaactgagaatgtttctagtttttgtttagctttctctctcagggggttttggtaggaggggctctaaaagggttgtaattactcctgggtccttacaaagttaaaatgaaatattgtcatcttttgcatagaatgaggtacgagcattttactatagtggaatacttgaagagcccttcttgtttgagccgcgatttctaagttgttgctaattttacgtcgtaattttagaattaattcaatggtttatttgccgaccttttaactttggaactgctaagagtagaagtacaaaattgttatcctatttttttattgttatgatcatgtattattggtttatatatcgcaaccatagaaataccttccaaatcggccggtctcctcttatcattgttaaaaatgtattgccttgaatacgttaacgagcatgcttgtttgagctacgacttataagctgtagctaaattcagaccctaattctagaattagtctaatgggttttctcaaccttgaactttttgactgccaagagtacaatcatatagtttttatcctaaaattatctttcattccttcagtcgtcgcgtattttggttttatatatcgtagccatagaaataccttccaaataggccaggcccctcttgtggatatgaaaaatatcagcaaagattgttgtttgtgtattcatcttcttctcactgtgctactacagtgatcagctgactatactgacaatctgacatgatgcacaataattggccatacttcatgttgatgcatggccaatttgaggcagacacaaaaaccatcaatcctggagggcttttctgcaaaagggcaggatcagcagccagattaattggcgaggtttagcttaaccaaatcgcaaaactaaacaaatccgatcaaactccggtgaccagtcgccatttgcagaggggatcattagatcaattcattatcatcaaatcaaaagagaaaagtaaaccaaaccgagttaagcccctcgagccgagacgaatcaatcagcaaaaagctagtgctacgcggggaggggagtggtacacgcggcccgagagtccctgccatgtgggcccgacacgcgtaacccgcccctcccacgcggggcccgtgcgttcacacctccacccccacgattttacctttctaccccccgcactccagtgctcgcgccggcgaccgacccgggggcagtttgggaataggactaccgcggcgcacgcggggcgtgggcgcggccggtgggcgggtgccacgcggccaccggtgaggcgcggcgcggggcccgacgaggtggggcccaggtggcagtgggaaacggtcaagcggccgcacgggcgcgggtcggaaacggttgggatgaggtgagggtggcggagccggagtgtggtgcggcgcgtgcgggtggttgtacggacggaccggacctggccgttgttggtgccggtgaaacggggtgaggtgtacaaaagcctatcagggactggagtcgtgtgcgtgacatggtgagctggcacgtagtagaggctgctggttatggttggagttttgtgatatgctcttttatattgcaggattttatttttaaaaaaaatcagtaaactcagtcatttcaattttagagagatgaattagaggagttgagaagaaatagtttcacattataataggtgtggaataaatctctttcaaatcttctcaatcctctcctggactaagggaaatttttcatactctgaagttctgtcctagctaaattctcagtggtgtttatgtacagtgagatgttattgtattgtttaaatggaatctgattgtttgcttgttgacttataagctgaaattcaaattttcaatcttagtttctgttgtctcactttttttttacggcttatcagctgaagccaaccaataaaaccataaatatgtaaacaatttctcttaccatggaaatatagttgttcaattttaagtcctaaatttaagatgggtgctcgtatttactgctaattatatttttagtggtaggtgatttatatccatcgatagtgagatgtttgtaatgacgcaatcaatttaagacgcactggtttagtccctcggaaagtggatgtggtcatagtgtcatgttgtgtgtgctcgactgttcgtttatacaaataagtgtgcatatatttgtacggatttctgtacaatatttttgttggaattaatacgtgggctactaaggctcatatggagattaatttttttgaaaaatcaataaaggtcccctcttggaaccttcgtccttcgacattctgtatcgggagaagacgataattagctttttggaaacggctcgcgtgactgcttgctggtctttcacgacggctcgtcttcctctacactctagggacatccagcaccgccgttgttcctgcagtgcgcgctgctcctcatcaatctaatccacaacaaaccagagctttcgttatgtgttcaccatgtatcatctattcgatgtgctcagggtttactgtttagtatatatgtctagatcgtatatcgtggttatgttagtatacatagtcaataacgtgatttatttatgaaataaattaaatctacgtgtgcttatattaccgttaatgttttgcatcggaatgttctgaagttcttggccgctttgtaacccgtactaatcgaagcaacagtgggcgaagtggtcgcaatcatgcatcaatcttcggggatccacactacttgtgcctaacgtttggtaggccgtcaaattacaaaaaaatcggcgatgctttttggccactcgatcttgtacgacttttgtcattctccaagccacactatcagcaaatgtttcaccgatggtggcattcgatattagccggtgtggatttttttttctttctttctttcttaaaaaaaaacagcatatataagtacttctattatgaaaatgtcaccgggaacatctattgtctaataataattgggatcgagcaattcatatactcccagatatgtctccttttttcaagacaggattcaataatcaacgtattaagctatggaactttattttagatcttgttcggttaatacatctcttaaagtattgaagctgtggaattaatttggagaattcctttatcacagattaactacacaaatcatgagaagagagttgacttaaaaataagaggtgatgcaagaaataaaaaaacactaggtacgataaatcaaaaaaagcaaaggtggggcattgaaaatgctactacaatgacgtggagaagtggtggccagaacccaaaacgcataaaaaatggctcgttaacaaacatggtactagtctcgtattaatcgagggtttaccttatcgtttccagatgaactcatctactctccctcgattcaccgatcaaaaaccgagcaaattaaaatcggtctgtgcaccaatacattaaattttaggtgtacaaataccctgcaaatatttatgattggtaaaaaaacatattaaattgttctagaagaagaaaagtcacaaaaccattgcttgcaatttgcaaatactccagtgtaaaggggagtactccaagaaaacaattctgccagtgggcccaggtggcgtggccggacacgtaaaccagcgaatgagaggatagcatagccaagggttggttttccggggaacacacggccggcagccgttgttgttgtgacttgtgagggaaggcaaatccaagcctgccttgctgttgccatcgtatgggaagaggacttgttgcttgtcttgtctcttgcatgctcagtgctgcatgcctagctagccggcatgttctaattggacaaactcactactgtttgttcatccattccgatggattatgacatggacatgtggtcttctatgcagggtctcccaaaccactgtggccggggttaccgcgtcccggcggtaagcacggttaccactgtataaaaccgtgtaaaatttatcaaaaatttaaattgttttttaaacttatttgaatttaaggaggttaccgcggtatttatattaccgtaccccgtgataagcccggtaaccgcagtaaccgcgcagttatcggcggtaaggtaacccctgcttccatggctatgtttcgagtagattttaactttttttcttcaaacttctaactttttcgtcacatcaaatgtttgaacacatgtatggagcatcaaatgtggacgaaaaaaaaaccaattgcacagtccgattgtaaattgcgagacgaatcttttgagcctaattacaccattatttgataatgtgatgctatagtaaacatttgctaatgacggattaattaggcttaataaattcatctcgcagtttacaagaggaatctgtaatttgttttgttattaatctacgtttaatacttcaaatgtgtgtttgtatactttaaaaaaaaattggcacacgaactaaacacagtctatgtacattgtttagtgtcccttctaccggccaattttgacatgcttagagcaaggtcaataacatagcccgctgttggcttcaaaaaaatagccatgacatctatagtaagcagtgtagctaatgtctacaatagaaatactataacacgaatattttattgttttgtgggacccaccatcttctcctacctcacattctctttctccctcctatccccttagttcatgtcttcatgtcttcttctttcttgagctagcttcgattcgctgtcaccgacaacggaagacggcagtggcagacgcaggagatggcagtggaggtggaagacggcggtggccgtgcggcgggcgtcgaagatagcggtggccgggccgcgctgcagaggcggaagacggcggcaaccgtgcaggcgagggatgacgggggccgtgcagcggatgtgggagacagcggcggctgtgcgtcggcacctgtgagtctaagggcagcggtctggtggccgcgggagttggcaacggaggcaggccaacgcaaggcatggccgatgcttctccatctaggtaggccccacaaactcctcaagcggcgcatgcagcccgacaacaaattagtcgttgtctctatctctctctctctcttcccctctctcctccagatcatcacaaaatcctacgtggaactactactgcccattattaattgtatctgctcttattaaacataggttaaattatggagtaaaatgcaccagcggtccttaaacttgtcaggaggttttacttatgtccacgaatttgcaaagcgcacatcgaggtccctaaacttggtttattgtatcatcccggtccaaagccgtgtttgaccgtggtcttgcctacgtggcatgccacgtggacgatgacatgaattttttatatttttttctcccttcttccttcttttttctcttttatgaaaaaacgatgacatgg

SEQ ID NO: 45527 - DNA, 17243 bp, Oryza sativa
attcctgcagccctggtcttgcctacgtggcatgccacgtaggcaagaccacggtcaaacacggctttggaccgagatgatacaataaaccaagtttagggacctcgatgtgcgctttgcaagttcgtggacctaagtgaaacctcttgacaagtttaaggaccgctggtgcattttactcttaaattatgcaatagtttgttaccatatattactttagcattaacatatactatctccgtcctaaaattaaccttaactacacttcttcacgaaaaccttaaacctgttgaacacaggatcataaaatagcctatggatctgtctggttacatgtcacatattgccaaaccaaatactattagactagttgtagtttgttaggttagtgtttggttggttgttgaaattgtggcaagtcacattttactactttatagacccacatatcatagatacaatttatagccaaacattaccatacttgtgatgaacaaattattggccatatgcccaaattttgtatggcaaagccccatacttatgacaaatttagctgtggaaagctaggcacaaccaatagaagccaaactaaccaatagaagccaaacaactagaggtacatttccatatatcccatcatggaagttatgcttttttacataattctacttgttgtgtgtgaaaataattttttttatcgtaatgtacgggcaattaactagtcatgtgttaaaaatagagttttgacaagggggattttaaatttcgtcactcaagtaggaatttaattattcactataaaattaataatgtaaacatagtaatggattcgaagaaaaatatctgatactcttaatacgtgaaaataaaagggaacgtacagatggacctggtctcatgaaccggtcaaaattccagctgaagtgttgaccatgcgataccagtagcggtggtagttgttcgttgaacaagttcagaccataagctaatttcaaccagagaaaaaagttcagacttgaagcctgaccacacacacacttggcacttgtatataggcagagacacatgcactgaacctgagtactaagagtatcagataaaatacctacagtacctggtactgagtactgacacgtcgtcatttcatttgcttgggaatcaagaagaattcaggatacatcaagtttgcattcattagggagcatctgctggttccctttctttcttttttctctcctaaagtggatggatgcttcatggcctcactcacacaaccctatcgtttcgcctaagcttataagtcaaattttgtattttaaaaactaattttgaaatcaattttatgcttttttcaccatagttttattttacaggatttgcttttgaactggtagggacacctgtacaaaagttgtgttcataaattattatttgttttctaataagccataaagataagaatttaagcataagcgaaagaatgaggcggtcagtaatctcagttatcagaatggttcgctctcagtgataggaatatatactatctgaattgatgtttttggtcccaattctttagtatttcttgggctgcaggaaatgtgttcatgcttgccaagttgatcgattacatttgacagttcagtcactgctactagatacctcctgatctaaacaagatatatttcaccttaattcagggtaaagccaccttttttttttataccggtaaaagttgattgtaatagaagcagatgttgtatcctctactgtccctttctggccacctaactctagaaagagaagcactgtatctaaaataggaagtcactttcgaatctttatttggatggagatgcaggcttacatggattgtacaagatcggtttattttagtgcctgccgtgataagatctgcatgatttgggttgcaaaagcctaactattggtcactcttggaagcaaacatagtatgcgctttctgatggtgacactggactacttgagcctaatacaaggtacaattatccacctcacaactgaaatcatgtggacttgaatcaccaaattattagctttctcagttaataaatcactggagaacagtcaaatgaattctgcgaaaattatccgatgcacatacagaatacctgttatagagagagctatgggtcaaaaagaaataaagataacattcaattacaaagcaaaatcagaataaataagctaaatgctaaaataacaatttgccttttgttgcttgggtgtttctgagttaacacatcatcagtaacatacaacagaacggcgtcccaggctaaacttggggatggtcagctccatccaggggcatgccctcagggcgtcaaataagaagcatccatgatgtttctggcctgcctggaagttctattcgcaggccagcttggtgtcgaaactactcagggagatagcaaatgcctggaaggctgagagcgggtagtggtaatccatggtgaacatgtccttggcaaccttcccgaattgcagtatgaccttatcatgctctggtgggggtggtggaacaggctgtgatggagttggggctcccgcagcaggctgcgtggctgcgatgagctggaagttcttgacagaagcaacagttacccggccccggaagtttaagcaccagcactgtagctgctcatgccatcttggagccttgttttggagaatcaaaggtgtctccttgcactcctcatcatcgctcaatacccggcccccaatccttgggccatctccaattgagatgtcagagaactgagcactgctgaaatgcatggaatggtccataacggacgatttcgaaaaggagacactcctaaaggaggattcattgagggaatgggcaaggatgctatccggctggctaggaacagtcccaccagcctcaagagatgaggcagggatggagtgcattaaacagcacatccgcctaggaccccgagttccaaagacgtttagctcatatgagatgtttgctatgctatatgtgctgcagggatgctttgctgttcccttgttggagaatcttcggcttgttttccctgactgtgaatcactagttgcattgtacggagtgtgggtatcatatattacaaactttgtgccaaggaagtttgacctacaattcaaaatggagacatattagcagcagcaataatttttagattaaaatggggtaagttctgaaataaggttgtagtttcttcgggttaatacctcaattttccaatgtttgtgttggtagacctagataaattgttagcattcatagatatcacatattctgtacatgttgcatgccagtttctttttgctgatagaaggaatttgccattgtcaacaagcacagctgcagaaaagggaaatcaaaacatctaaaattagtaaatgctggtactgaaatactaaaagtattccagcaaggaaacaaaacatatatgtgcaccagtgacggagcacgcgcaaaaattaggtgggtcagacacacaagacatactgaagtaaaagaatgacaatgcttgcatattaaaacggtacaactcataagacgattaaaaataacaaacaaacaacggtttccaccatataatattaattcgttgtgcataaaaatattatgagaagttaagaacatatgccgacatcaaagcagctcaaatatgtcttgcatttacacacataaaattagtaaatgtctttccatacatctcatcccgagattccctcctattttgtttcgtcgtcatttcctaatatatctagtcggcaattagctaagctcacttgatgttactagcaggcggacgcaaggcaacagaagaggattgagttcgcacaacagggctcaaagggctagcagtggtcgactttgaggcccgtgccggccgatggcagagcttgtgcagctaggagctcaatgcaagcacgctgagctcatcgcctcattctcacgatgcatgcgtgcacaacagtatagccttgaggccctttgtatctgatgtgcactatgttacctataattggaaaccaacaatgacagatgcacacccacatggacacagcaaacagatagcatgcaattccaatcaagcaaaggacacagcagctcaaattacaattgcacagaaccagtcccacttgtgaatatactcgcaccatatgggtgtcattgaactattgaagtggttcgaatgcaaacaatctcaagagaacaacctacttgtgcataacaacgggaatatattttattagtgtactgttgcttaattgacattatcatggatcaggtcaactttttttccagattgtcaagtcaagtagtaaataccaagtggtataggtcaggtaaaacagtagaacaagtgcatgacagaggtatacaatactaaaaaatagcacttaattatacataacaactattgtgtgctgtatcctattattttggttacaaaaatgagacaacttattacagaattgtagttataaagaacctaacttaactgtatgaaagccaaggaatgctgaatgatctgttcacaagttcgcttgtgcatgattgtggaagatagacaatgacaaataaggaataatatgtttctagcatattcatgtcaaatgataaacatggcaccaattaccatcccaaggcaccatctaccctatgcaagggctataagaaagaacagctcttcatttgctatgcaatacaagcatagttttggcagaatatatgcactcattcagcagctcacaagtatatacaactacatatgaatcttcttatgcagaagcaaatatgggctctggtacataggcgcatacaacataaagcatatgagatgtaacaagtaacataccagagccaagagagaggtacaaatagtaggtctgcgtagacttatccctcctaatgaaacactgcatagttccatctcgtggcccaggctgtacatagaagcggaataacatgaacttattagcatataagcaaacggtaatcctgcaatatgtgggtgttctttctatttttgtgtttcgaaattccaacaatatgttgaaggacaagcacctaacatggacgaactgatattgcttgtaaaggatataaaactaaaaacaacacaatttgcatgatcacctgcctcagagaaatagggaaggtgatcttcccacacaactctggattcttgacgatctctttacacatctccctccatgttctgcagacacccgcacaagcaaccacatgcttcctagaaggccatgtagcctcactttcttccaacctctcaatgatatcacgaagcaattccggaggcaagctagcccagcagctgctctggattacaggcaccgggtcatgcaactcatggacagcaccatgagacttccccctgcgatgccccagaatcctgacctcaaatcccctcctcgataggctcccaaatccatccctcacatcgcgcacgatgctgcgaaacgacatctactctctgaaaaaattgagatctctcctcagctaccaaaagggatctatacttttcgccaatgataacatcccagagtaattccagaccaactcaaattctcctcattattgttgaccccgcaaaaagaacctgcagcacaaatgaattgaattggtcaagattaatcttcgattattctttcttgaaaaagatgggagactagacgacggtgccgcgcacgatggcgacgttgcccctgccctgcgggaatgcaggtcacaatgcccccaattatctctctccacaccgattgcagcagcagtagcagggcggaagctacgagggggcacgcgaaaatgctggattcggcaagcctacctaccaacctactccccggtctcccgcgccgaagatgcccaatcgataaacacgaaacaaaattctctgctactgcaaaccttgtcgtgctcgcgcgaagagggtagacgcatcgtggaagagagcgcccactgctccgccggatcgagcccgccccccgtcgccgcccgcgtcgagccccgcgcgcgcgctgcccgcaccggatcgagcgagcgagcccttccgcgcgtagggtttggtcggggcaaccaattgggcggaagggggagaggggaagaggaggaggtggtggtggttgccggcggcggagatggccggagacggcgggatcggcggaggtggggatgcgatgcgaggcgtgtggtgtgagaggagacgaggcgagagtgtttgggatttctttttatttattttaacgtgtcgtggtccctacttcatacggtgcggtggtgtgtatattcattcccaccaatataaatgtgaaaaattctagaatgacttatatcgtgatacagatgaagtatttgatttgtttaaactttatgttaagatataatcatttctctattattccctccgtcataaaataacataacttcccccacccatttatcgccgcaaagactttattttgaaacaatcaaatatattagaatttaataaagttagatacatacatcgagatgtgataaagcgaagattattgtaggcattgttttagatcccatcccaaaactttacatcatgtcacatcaaatgtttgaacacatacatgaagtattaaatataggctaaaaaataactaattgctcatattgcgactaatttacgagacaaatcttttaatcctaattgctgcatgatttgataatgtgatgctacaataaacatttgctaatgatggattaattagacttaataaattcgtcttgcggtttactgacagattctgaaattagtttttttagtagtgcccgaacaccccatgcgataccctatataatacgcgatatgagacaccaaaactttatacacctggatctaaacacccccttagtcttttaaacattgtatttgtaggtgtaacaccgtcacctcttatatcaactaaggtaattatttatctggatactgccaataataaaggataatctagttttttatcttcgtgaaaaacttcaaagatattatcccaaaatacctttggatacttcggagtattttaattttaagagtattcacaattaaaacttgactgttgattttctttcaaaatatgcttttagtagttataaaatcagagtctgaaagcatttttagtattgaatgttacaattgttatacggtaaatatatttgcagtattgacctactgttgatttaaacctataaatttcaaagtattactatctaataaaaacgacataagaaaacgacatgaataatatgataatcatttttgctccaatacaacaggacatatatgttgattaaattatcggagtcatcatttggcttatatttatgcatatttgtattacttattagcaaccaaataataatttatagatgaaaagtttatatacgtatttttagcaatttaaaaagtaaatactgccaaataaactacaatgataaaaccataaaataaacttcaaatttgaattttaaattttcaaaattggtttataaacatacatagcgaaacaatgggattatctgtgtagtgctgctgatgcattagttgtcagcttctgctattgcatcagcattgcagacgttctgcatccatagcaaaaagatggtggtgtatgtaaaaaaaatcgtttgcaaattgcgagttacggaagcgctgtgttactccatccgtcccataatataacaaattttaactttctacttacactgtttgaccattcgtcttattaaaaaaatttggaattattatttattttatttgtgacttactttattatccaaagcactttaagcacaactttttattttttatatttgtacaaattttttaaataatacgagtagtcaaacagtacccttatattaggggaccccttatattacggggacggagggagtacatttattgcaattatgcggtcgaattttccgtacgctctctctgcccggcagcacgtactgtactgccgatgatgctgcagggtcactgtgtatggtcctccgttctgcatctcggcgatggctctcatcccgggcccaccaaggcctggtcaaaagtcaaaactaacagccatatacgccaatatgacatgattactgtaaaacgaaggtggtaaaatgtgatattacagcaacaacaagcagcagcaaagatgcccggtccatgcagctaccattcaacatacgagttgaccagtcaacattgaccgagggccccacacacagagacccactgctttcttttcacatcgccatctggctagcaaggccaccacattttgacttgacttcagcattcatggtcaggaagagtacccccttgattgagtaaaacaaagttggatagaaaaaaatgatgaaaactttagaatacagatggagcccagtatcacatggaaattttacaagtagagagaatcaggagatataatgatatataaacaacaagaggagaggatcactgagctagctataaagcattgaaattgttgtcacttgtcagtagtcacagataatctgccacctctaccatcttgcataaacaatctgccacctctaccatcttgcataaacacggtcctgaattgaattgatctgcaacctgaaattaacaatccggggaacgaattgagtttcagacaaccattattcagttctagagagaacttggaattattggaagagcatggaagaaacaaaactcaatgcagaaaataacaggatgctaccctgataaccatctgcaatccattttagaaaaaactataacaatgtaatctgttttagaggcaaacgttcagagttaagtcacatattttcgctaaaattagccataaatttaagatttaaaattcaaattttggctgtggttgataagctaaagagcaaacgatggagttggctaagcataggtgaaccagctaagctagactcatcagttatatacttacgagttttagagtaaactctctgtaataaagcataccatcatatttaaaagcagtgttctacatacagacaaactgtaaacattgttcgtgcaattgaacaaatataagctacttcttgtcaagataacaaacaccataccaattacccattaacaacttatccatacaagagtaagaactaatatctgtttaatcaggggaaaaagaaaaatttggatattgttgactttgaatcatgaagattattggatattgaaactcagcttggaagtgccaatctgacagcacacaagatcaccaaatccgagcagcatcactatttgtatcttggtgatgcagttgcttcccttttgttatcttttattcgctgattatgtttacacccaagtacaccatgtatagaaccacagtcattgcagttgatcttaatactagtcacgaaataactcccagttgatagtacatatctaactgatgccttctttgctgtagaacagtaaaatctccgtcaaaaactgatgccgcctctatctatggatgggactaatttttgtactacaggggtttgggactataaagctgaagtaaacactatcaataggaaacagccccaatgcatgatttccatagttccatatacactagtagcacagtactacctaaaaacttgtcatgaaaaaactcccacaagaagctacccaaattataaacattgagcattttttagtaaaagtaactgaaaatctagtccatttgcttaccatattgcgaaatgaagtgctaacagaacaaagatcatggatgattagcattgccctttatcttaatctcaagttctagctccttgtgtcttaggtcaagctcaaaccgcttattctgaagcatcatttgttcattctccaacgccaacttttccaattccaagtccttgttcttcctgaacatctcccacttgagacgttgctttgcgagttgcacagccttggtttcaatctgcaaacgatgtttttgaatctctgctgctttcagagccaagtctttttgcaccaaagccaaatcacatccatctggaaagggtttgttgatatccaacacgtcatagggatcagacctcccactaccatcattcgagcatgaggtgacaaaacctacatcaccatgatctacaacatgccacatccttttatgcattgaggggccccttatattggtatcaactgctcgatgttcttcctcattctcctcataatctgaatcttcactctgatcatcatctagttcagcatctccacttgcatgcctcatgaaatcattatcctctttacatctaagagcaagctgtagtgactgctgaagtgcgggatcttcaggcagacttatacggttattattatggtaggaacacatctcttcatagaacaagtgtttggagttcagtatcttccttgcatcctctttcatcttctcagaaatatccatgtgatcaagaagtgagtgattctccacaacattacaagcagtaccccttccaaggatatctgttagtcttttgtatctcttattaaggtcattgaacttatcctcacactgctgtggcgacacatggcaacctctctcgcccatgacctttgatattgctttccattttcccttcttttgcatcattgaatagttcctcctcccaccgcctaaatcagctccaggatcctcccctgtgtaggatactgcagtaatcaaaagcttcaccattgaatctgtccacttcatccgatgccatggagagcccttcttgtctttgccatcagcagcatcctcattcatatcgtgctcctcttcatcactcccatggttctttgagtggtgtctgtggtgatggtgatgatgggcaatcttcccatgttgtcctaactgaactccatcagagatgttatcaggctctgtaaccctatccataggaatggtaaaattccctggtatctgaggctggttgaagccctgatttcctgagtttggaggatgcatttgcttggagataccatgcaaatctaaactcccataggaaggtccctgtgtcatattaccaggtgggttgctgccttccatttccccaaagcgatcacccaaacacttcaacttcttgttggtaccatataagatggacacaggagtgcacgaggatgcacatgaatataacctgaaatggcagtttggtatgaatttttggaaatccaacacatgtatattgcacatttctatacatctcaatcttcagaatcaatttgctaaaagaaaaagatcttcagaatcacacaatatatcttaactagagtccatatgtaatcagggccacctaataagaaataactaatgcacaaatttgaagagattttaaatcagtgttacacaataaagggtaatttcagcctcctatagttgtcataattgccaaagcaagataatattggagcactaaaaatcagagtgttctgaagaatctaaactgcatcaaccaacaacctaattaatcagcagcacaaatgacaaatcaaaccatattactccactgggtaatgtgagtggaacaattttaaaacattattgcagtggcaagtggcaaccaatcaaccactagccaaaacaaaaaaatgttgcaacctttccatgctactcataactaacgagaagaaaatgcatggggaaaaataaatcaatttgtcacctcacaagaaaaaatagtaaaaacaaagtgtcgtgcgcaaattagctgtccatgtgtaataataatccacgaaccacaccaaaatataaactatcaaattctcacacgcacgatcagtggcagaggactaaaaaaagaagaggtgtggctcatgaattatcatgagaatcaacccaagaataatgggaaaaaaattctcaaattgcaccacattgtaccacacaatattatcttaacaagtctatattaagcatgacaacaacccctcatgacactaaaaattacctcaagtaatgaagtttcagcagtacatgggatagccaaaggaggatagacatataaataatctgcaaaacagatactcctagcaaagatggatcgattaataggctatctttaaggtggataaggcaaatagcaaagattgaatcatcctgttgatctgctgctgctgccggcctgccctgctacttgttggcccgccacctgctactgccgcgctgcccaactgcagccacagcctgcagcccacccagccgcccttgccggctgccgcagctgcgctggcggccctccgccgcctgtcgacgtgccacctcccgctcgcccgtggctgtcgtcactcatcagctccgccaatcgcacgagatggggaatcaatggagatgggggaaccaagcacctcggcagcgcgcgaaaactgcccggctgcagtggattgggagcgggaggtattctctactggtggagaacggaaacacgggattagggtctcaaaatttttggaagctggtttggatatctgttggatccattttttttgctcgaaaaaccccaaaatttgaaattgggagtagtaggggaactcttggtgatgctagtaacacacaaaacaagcccaatgtgggtctccaattcaacggcgagaggccaagaagcgagaacgccttcgcctgtcggccgtcgctcgctcgtctcgttgagtccgtccttctccccagcggcgacgccgcgctctgcgccgccggacggcgcgaggtatggcgagccctaccgagtcctccgcacgattaaaccccggcccccaagcgctccgcctccgaccggggtagcccccgagctcgggatggcgtacgtggccgcgacgagcctacgcggagtgctcgtcgccagcgatccgagcggcgagtacccccccccccccacacacacacacacacgcacacacaaaaaactcattgggtttaacgcccccacgcgatgacagcggaagccgctgcgaccaacaaagcgatgcatcgggagggaaaaggagagctgactcacgacggtatccggcgactgaactgaacgccggcgaggagacaatccgcctccgcctccgcctcagcctccgccgaaatattgggcctcgccgagcacgaggtttctctttctcagaagaaaatgccaaagctgaacggaaaggaaggaaagagtacgaaaggtaccataaaaaaaacaaaccaaaaaaaggaaatcgccgaaacgacacgtcggaggcgcgattcctcgtggcacggtatcggctactgtcgcctaccgctgacacgcggggcccaccgacagggggcccaccgaccagggggcccacatgtcatcttcacggtgatggcgtggggacggtgaggcacggcggcgcggttcccacgttccgttccgtttcgcgttacgggggtgggtggggcccgcatcacagcggggccatgacggcagcaaccgaaccccattctctctggttggggggtttattattggttatgggcttgtggcaggatgcagatgacacctgaagaaaagaaaatataaacacacttggtgattaattgttgcatttgcatggagtttaatagtcaaaaagtgatttcactggatgttatgatgcgaaaggagtcgtctaattgcacttgtaatggcgttgtttttgacaaaaatctatttgttgacttttggttatgtcagggtgtccggttgttcataaattctgatggggaatgtcaaaattgtactgcaagggtgaaaaagattgcagagccaggacactcttccgaatcagacgagtgcaatacaccaactgtgtattgtctgctgatctgacgagctcaatcagtagacagaagtttagttcggagcatttggctaacgtgtttcctaaaccatcattgatttgccgaatttagaaaacaattatcacaccaaaatgaactagtatactgaaccatccagagatgccatgcctatctcttgggcatcatcaagaggcagttcgctgattcctgaaaatattttctgaaactttcagcacaccaacttggagagtagcagtactaaatttactcttggcgatcgcatgatccgaggaatctttgaacaagctacggacaaacaaaacaaacaacgcatgacgtcaaccacgatctgatcagaacatttctttactcccattaatttggtgatcctgctttgtaatcttccattgacagaaaaaaaaaaggctcctctgccaatctgccatcagggcttgtaatcaactgctccctcttgttaccgaccctaatcctatcaagacaaggcccaaaggcacaagacaaaggaagcccaatacccatgtgagtgggccggactgggttgtgtaagggaacatctgagtctataaagatgttacccaggcaaggagagaggatcgttgaaaaatattatgtacagactatcttccccaaatcaattccaatcctctctcctctcccaactcctctgttcttcctggactcttccttccttccttccttcctcgttctcaagttgttcgaccgaattctcaagaggggttcgtgacaaatctgtatcagagcagtcgatcctggagtacttggagaaaccccgctatcactcgcgagcgcaactcaaggcaaacaagatggagcagcagctgagcgagctcatgacgaccatggcgacaatccaaaagcaaaacgacgccatcaaggtgtcgataggggccatcgaagaaatcaagccaatggtggtggagctggtggggtggaaaccggcggtggagaaggcggtgaccgagctgcgggaggagatgggggatctcagggcgcaagttcatcaactcgccaaggggacgacgccggaggtcaaggccgacgagcgaccagcgccttcctcgactcctcccaacattaagcctgacgagttacctgcgctgcttccaactccaccaggcccgaagctgaagcagatgaaggaggaggagcgctcgattccgcaggagcgcggtgaagaatctcatgggctatttagccatcgcgtggacttgaatcaccgggggaaggctgtgtggggaaatccctcttcacagtttctcccggtcaaggtgcgttcaattccttttcccctactaattatgttcatgaatttggagggaattcgcggggtagggtttggggaattcaaaacactacatctagggttgagtgtccagtttttgatgggggaaatcctaaggcatggaaactgaaatgtgaaacttattttgggttgtgtggaactcattcagatcactggattggagtggctattcttcagttcacgggtgctgcattgacttggttgcagtccacccatgctcatgaagttagcggtagttgggaagaatttgcagcgtgggtgtgtgggaaatttggtagggaggagttccagcgtttggtgcgctagtttaataggttgagacaaactgaaggggtgatggcgtatgcagagaattttaatgagttgatgcatgggttgcacgcgcatcatccgtcttggaactctgaattttttgttactcaattcctagaagggttaagggctgagattagggctgctattgtgttacatcgacatgccaatttggatactactgtggagttggcttgtttgcaggaggaagtgttggaaactaatctcaaggaaggccgtaagattgactcacatggcagaaatactttgcgtgctacctccactctggcacgtccatttgggggacagtggatgaaaggggaagaacgactgaaggctgaagtgccagctgaagataaagttgctgctcttcgtgcttaccgttgttccaaaggtttatgtcatacttgtggagagaagaggagtcaggagtatcgttgtggaccgacagtgcaattacatgtggtggaggaattgttgcaattatttccctcagaggatgttgttgaatctgacaccaatgatgctactcctgatgaacctgaaacagaggaattgctggccatttctagggaagcagttctgggcattgagtctcctaagacaatgcggttgcaagggttaattcagcgccatgaagtcttgatgcctgtagattccggcagcactcatagctttatcagtgaacaattggcaaatcgattgtagggaatatgtgcttctgtatcgccgttgacagttaaaattactgatggaggtttactcaagtgcacaagggagtttcctgattgtcaatggtgggttcagggagaatctttcagtactcctctgaaagttttgccgttgggttgttatgaggtaatacttggcatggactggcttgagcggcatagcccaatgcaaattgattggaaactcaaaactttgcagttccagtggcagaatcggcaagtgacattacagggagttatacctgatacaagtgattgtcctccggtgacctgcaatcagcttaagggtttgctgcatcataatgttgtcttgcaggcagtggctctctgtccggtggacacacctgtgaaaccttctcagacaattgtgccagctgatattgaaactttgttgttggaatttgcatcagtttttgatgaaccaactgggttgcctccttctcgtgtgtttgatcacagtattccacttttgccaggggcgtcgccggttaacttgcgcccttaccattacaaccctgcgcaaaagactgaaatcgagaagcaagtgtcagatatactgcagcaaggggtgattcagcgcagtgctagcccgttctcatctcccgtgctcttggtacagaagaaggatggcagttggcgattttgtattgattaccgtcatattaatgcgattactatcaagaatcgttatccgttgccaattattgatgagcttttggatgaattagcgggtacatgttggtttacaagtttggatttacgggccggataccaccaaattcgtatgaagccggaagatgaacataaaacggcattcaaaactcatcatggacattatgagtttaaagtcatggcttatggattgactggggcaccggctactttccaaggggtgatgaacactatatttgaaccattcttgcgaaagggggttctggtttttatcgatgacattcttatttatagccgaactcttgaggatcatatta

SEQ ID NO: 45528 - DNA, 3352 bp, Oryza sativa
aagaacgtggtgttccattggacctcagaaactcaagcggcatttcaggccttgaagaatgcacttacatcagccccggtattggctttgccggatttctccaaagtttttgagattgaaacggatgcttcagcttttggcataggagctatgttgatgcaggatggacatcctcttgcgtttttaagcaaggcattgggaccacgcaatcgaggactgtctacttacgaaaaagaatgtttggccattttattggcagttgatcattggcgctcatatttgcaaggagctgaatttgtgatccgtactttagcggagtttgatacatttgggtgatcagaagttgaccacaccttggcaacagaaggctatgacgaagttattggggttgcagtatcgtttggtctacaaaaagggtactgacaatcgtgcagctgacgctctctctcgccgtgcgcaggatacttcaggggaagttctttccatttcagtctgtgtacccgtatggttggaagaggttcagcgtggctatgctcaggatgatcacgccactcaactgattgccaaacttaccctgcaaccggatgcctgtccacctttttcctttgatgctggcattttgcgttatcagggacgaatctgggtgggagagaatccttctttacagcaccaaatcttgcagaccttacatgctggagtgttccattgcttggtctgggctacggcgttcagttaaatcttttgtcgaaaattgcacagtatgtcaacaagcaaagacagagcgtgtgcgctatccgggttttctccaacctttacccgttcctgagcatgcctggcagatggtatcacttgactttattgagggattaccagtgtcttctaggtttgattgcgtgatggtcgtggtggataagttctccaaatatgctcattttgtggccctggcgcatcccttctcagcttttgatgtggctcaagcttacttgacaaatatttataagttacatggtttgccgcagtctctcatctctgatcgggatcgtatttttactagcacactttggactactctgttcaagctggccgacactcaactccgaatgagtactgcttaccacccgcaatccgacggtcaaacggagcgggttaatcagtgtttggagacctttttgcgttgttttgtacacgcatgtcctaagaaatggtttcattggttggccctggcagaattctgttataacacatcgttccattttgctctcggcacttccccttttgaagctctgtatggccatccacctcgtcactttggagttattgatattgctgaatgtgttgtgcctgatcttcaagatgggcggaaagagcgtgtaacatcccagcccagggcttaataggattaatagaataatcatataaacaagttgcaacttcttttccgaaagccgatctccaaagaactccagggttaagtgtgcttggcctggagcaatttgggatgggtgaccgaccgggaaattcttcccgggtgtgcatgagtgtgcttggcctaaagcaatttgggatgggtgactgaccgggaaattcttcccgggtgtgcatgagtgaggacaaagcgggcccgtcctgggggaaggcgggacgttacaaaatatcagatgtaagcgggcccggcctgagtgggcccgtcctggacaaaatggtatcgtcctgggggaaggcgggactctcacggtttcacgggcgtgtgtgtcgcagttgtgcaggcatggtgcgcatggctggtgtggacccgaagtggtcacacagcatggcacatgcgctggcactggacacacggacgaaggcgggactctcgcggtttcacgggcgcgtggacccggagtggtcacacagcatggcacatgcgctggcactggacacacgaacgaaggcgggactctcgcggtttcacgggcgtgtgtgtcgcagttgtgcaggcatggtgcgcattggctggtgtgggcccggagtggtcacacagcatggcacatgcgctggcactggacacacggacgtggccaagaggggacgttcctggcctggggttgatcgacgggggcgtcaatctctcttaaggggacgttcctggcctggggttgatcgacgggggcgtcaatctctcttaagggggtgagggtgtaacatccccgtcgatctctcttaagggggtgagggtgtaacatcctggcccagggcttaataggattaatagaatactcatataaacaatttgcaacttcttttccggaagacgatctccaaataactccagggttaagcgtgcttggcctggagcaatttaggatgggtgaccgtccgggaaattcttcccgggtgcgcatgagtgaggacaaagtgtggagggcagtctatgacctatgaaagctacgccgatgtaagcgggcccggcctaggggaaggcgggacgttatagagcgcagtatcattacatccttactgcggcaacatttgcatcgagctcgacaacgtatgaagcaccaagctgataagagacgttctgatcgtcaatttgctatcggcgattgggtgttcctcaaagtgcagccgcatgctcagacgtctgttgctgttcgagttaatcacaaattaaggccgggatgttatagaccgcagtatcattacatccttactatggcaacatttgcatcgagctcgacaacggatgaagcaccaagctaataagagacgttctgatcatcaatttgctgtcgacgattgggtgttcctcaaagtgcagccgcatgctcagacgtctgttgctgttcgagttaatcacaaattggctttccgtttctttggtccttttcaggttgctgcacgagttggtaaagtggcatatcgattggtgttgccagcctcgtgtgcaattcatccggtggttcatgtgtctcagttgcggaaggcatctcaacctcaagtacctgatgctccagcactccctcctgtggtcgcggaggttgatccagttccagcacaagtgttggcgcggcggcttgtccgtcgaggagcggccgctgtgcctcaagtcaaggtgtgttggactgggtgttcttcctcggaagcaacttgggaagacttggagcgattgaaggagcgtttctcggatgctccagcttggggacaagctggttctcaagaagaggggaatgttaccgaccctaatcctatcaagacaaggcccaaaggcacaagacaaaggaagcccaatacccgtgtgagtgggccggactgggttgtgtaagggaacatctgagtctataaagatgttacccgagcaaggagagagaat

SEQ ID NO: 45529 - DNA, 13453 bp, Oryza sativa
ttcttttggtcctaccactaaccacaaacttagcatgacaaaagttggaccatgcatgccatgtataatacagcagccaccggacaaatgcataccagagttcagaaggtgcataatattcagccatgaaacaaatccaacaacattctgataggacaccaacaatcccaaacagagtagcttacatgacaagggcttgtgaaaactgaaaagaaactgccttgtagataagcgattaaaaagccagagcttagaagcacttccggtgaacaattgctggacccgactcatcatactctccctttgagatccacatctgtagcatagatgccaaaagaatgatgttaacagaaagcagaaatacctgcattcttgctacctcataaagtgtaggcgtaaggtttacctgttggaaggtgctaagggaggcaaggatggaccctcctatccagacactgtatttcctctcaggcggtgccaccaccttgatcttcatgctgcttggtgcgagggcagtgatctccttgctcatacggtcagcaataccagggaacatggttgatccaccactgagaacaatgttaccatacaagtccttcctgatatccacatcacacttcatgatggaattgtaagtggtctcatggattccaggagcttccataccgatgaaagagggctggaagaggacctcagggcatcggaacctctctgccccaatggtgatcacctgtccatcaggcagctcatagctcttctccacagatgagctgctctttgcagcctccagctcctgctcatagtcaagggccacatatgcaagcttctccttgatgtcccttacaatttcccgttcagcagtggtagtgaaggagtaacctctctcagtaagaatcttcatcaagctgtcagtgaggtcacgcccagcaaggtccagacgcaggatggcatgaggaagggcatatccttcatagattggcacggtgtggctgacaccatcaccagagtccaacacgatacctgcatcaagagcaacagttcatgaataaagtgaatattttttaaaactctcaaccatgtgagtgagttattaccagttgtacgtccactggcatacagggagagcacggcctggatggcgacatacatagctggcacattgaaagtctcaaacatgatctgggtcatcttctccctgttagccttggggttgagcggggcctcagtcagcaacacagggtgctcctcgggcgcgacacggagctcgttgtagaaggtgtgatgccagatcttctccatgtcatcccagttgctaacaataccatgctcgatcgggtacttcaaggtgaggatacctctcttggactgcgcctcatcaccaacataggcatccttctgccccataccaaccatcacaccggtgtgacgggggcgccccacgatactagggaaaacagccctgggcgcatcgtccccagcaaacccagcctgccagcaattcgcaagaaaagtaaagtatacgattaaatcacataaacatggggataactgctacaaagaaatactacgaatgagcaccacgaaccttgaccatgccagttccattgtcacacacaaggggctggatgtcctcgccgtcagccatttcctcctactggttctgaattcctgacgcaaaaacagaacaacaggcatgcgccgcaacacgtcacgaaatggccattttccaacagaaactagacgcaaaccctccaggaaatcaaaatctcaaaagatcaactgctaatatttggcacatcaaaacttgcagcgaacagaaaacaaaacagaatatgcaaaactacatatcgatagtccgacacaccgagatctagaacttgtagagcaaaaagagtacgcgataatcaaccgcgcacaaagaatcaagcactaaaccgtgatgcaaggcaaactcaggtggcggatctagacgtggagcatgtgattcagttccaccccccacaaacattttttgcgcgcggggaaaaaaacacaaacaaacaaactgctaccagcatcaaggtttaataaggcgaatgaagcgaaaagtatccagatctagaacagtgaacagaagctacgagtacgtgcgtgcgtgcgtggggagggagagatgaggaagaggacacgcagatggatgctcaccggggatgcggccggaggagggaggacggtggcggcggcgcggcgggacggggagatcggcggcggaggcggtggcggcggtgaactccgagtcgcgaggaggcgagagtggagtcgacgcggagtcgagggggggagggggaggggtagataagagaagagaggggggttcctcgactagggccacacaatcattttttggacacaattaagcgcgctctgatttttcttttttcacttcttgggtacggttacgctctgaatctgagaactgagaagttggcgcctgtctgtcccaaaacaaaaataggaccctctatggctctatgggtttgtctatactgaatcccgcttccaaaatttaaagtttaaggtttgctttcaggttctttttcatctaagtttatcttttacattcaattttaaatcgctaagaatacatacataaaaaatttacctataaattattttttctctaatacgttgtacggcatttggcaaaaaaaagaaaaaaaaaaggaggagcctacgagttctcctaacacgatctctcatcaacttcggttatgtcgagctgaaaaacaaactagatggtagtatttcttttcacagtccagcatggattgaaataggagcacctatgaaaattttcatacaagcatgatgaagaagacgtcatctttatccacatatttggtcaatgaccattttcacgagcgtaggcaggtagtagagtgctcgtcaagggtgctagtgcatacctcaaggtgattataaccggttcatcacctataatatctcgacatggtagagcatgtaacttatttgctatacaagtaaaccacttaaaatgtactaatataacttagttttataatgcaaacaaaaatttattctttacaagaacacaatttaaaattaaaaatgtgtctctatattcttcctttgtgccttattttacttgttttttctcactcctcttccataattatattgttagcctagttgacagctaggtcgtatgccagtgttttgtaatatatatgatcggttctttttacatgagttagtagtaatattgtacttgtacatatagtctacatgcatccatccatatgcttttttaaaaataatctgagagatttttttaaatataatccagtatgatttgaggtaacgatatatgtgtaatttacacctttttatatttaagaaaagaaaaaccatgttaggcctcgtttggatcacattaattttcttcaatttcgtgcatgaattgattttcttcataatgctgataaatttgtttccaaacaaatcttggtaatcaatgctttttcaaaaggatatattatccttccatttgaacatttcttcatagaaaaagaaaaccatggtgtccgggctcttaactaattatcgcgttaacggtgcacatacattaacacacacgggcaatacggattaaaggtgcgattagtgcgctaatcaagtgggatcagcacaattaacctaagctaggcatggcagcaacacagccaggaacagctgttgcctgcgctgtcgtctgcctgactgatgatatgatccgatgggatcttgattttggggaaggatggaagaatttcaggctattttagtacacccccatgtgtgcctgaaaagctgcttgctgttcttgcgctgtttgatcaactcgctttattaattttgttcctcccccccagctgtgttgatcatgaccacatgtgggcaacccctggaaagaaaagcaagtaaagcttaattgggttggaatcataatcagttcatcaatcagagaactcaatgtattgtagttttgcttgctagatcatggcgacagagaaaaacattccatagtgaaattctaaaattttgggtgttttttttctaataatacgtgctaagtgttacgtaaaaagagattggtcatctggcaaacctatggctgcggctgctgcagtccactccttgcctcactgttggtgctggctgcactgccgtagtctcaagcaactaaacaactctaaacatttcacaaaacctttgcatctatagaaattcttattatttcgggttgtcttcaccaacaccgccttgaacttatgtgtgtttaataatataaaattaaccgtaaagttttttcttttattgtctaatttctagacaatattcaaccaaatgttagaagacatgcaatttgatgaaaaaggatgggtttctgtgtgatattatggctaaaatatgaggccccggttattccgcaatcgattttgctatacatcactcgggtgattctttacctgatatttgacgttttttctggccgctactatctccagggttggggtgggggcccatacggccaggataaagcattgcatgcagcaactccagtgggatcattagacgtgcgatttttttttctctcatttgttgttttttcgcgctgctctctatccttctctctcatttgaaactaaaataaaaataaaatacaaaattacagtcctatataactaaaattacatttgtaaattcagttgatacgatatgtaagtgcgctgtaattttgataacaatgatgtgtcagtaaatatgtatttgttattttctttaaaatataaaattacagtcctatataactaaaattacatttgtaaattcagttgatatgagatgtaagtgcactgtaattttgataaaaatattgcgtaagtatatatatatatatatgtgtgtgtgtgtgtatatatgtatgtatgtatgtatgtatgtatgtatgtatgtatgtatgtatgtatgtatatatatatatatatatatatatatatatatatatatatatatatatatatatatatatatatatatatatatatatatatatgtgtgtgtgtgtgtgtgtgtgtgtgtgtgtatatatatatatataaaattttcttttgtagtccgttggatgtaaatctaagggtagaaaaatctggatgatttcttgttaaaaatcacccgacaaatggatagacagtcccccaagtagacgtctacttattcattacatgtctcatccatagagctatgaaaaaaatttaattagaagttgacaagatatattaatttataacataatatatatatatatatatatatatatatatatatatatatatatatatatatatatatatatatatatatatatatataaacatgtaatttcaaattttgcttgtacaaattataacaaaagtaacattttttttaattcctctatgatttcggctagacgtgcattctgcatatagtccctcaccacagcacgagtagtcgtctcgtgtgtatgatgtatctgggtgtgccttcattgtggcacaacaaaagtaacaattttaatttacctgtcaatattcgtatactaattactccctccgtttcaggttataaaatgttttgattttgatcaaagttaaactgttttaagtttgatcaagtttatagaaaaaatagtaatattataaatttattataaaattatatttaattattaatttaataaaactaattttggtaatgtaaatattactatatttgtttataaacttagtcaaatttgaagcagttcaactttgaccaaagtcaaaacattttataacgtggaacggagggagtataacttatggacaatgaatttgaacttgcatgcttatatattgatatattttatcattgtttttaatttttttttattgatatgcaatagacaagtagatgtccatctagttgattagaagagtttgcttgataaggagtaactatatgatattcaatcaggggcggagctagaacaaaataaaggggttccactcgcttgttttagtctggtttgaatcaaatttagcttgatacgggtgcctaagtttaaactaacggggtatatatatagtgaaaatagataaattgtagctaaatttttttttgaatcaggttactgggcacccccctagctatacatagctccgccctgtattcgatagttgttttttatgaaaactactccctccatctacttttaatagtcatatttcaccttgacacacagaccaagaataagtaattctacttatcatccatttaaacatgctactagttattcctcgtaaacaagcgattcattaatatttacatttctcaatacccatgtaaccaatcatgtgtggtagaatggagagtcacgcattaaattcgagaaagtcattaagatgatgggtcgttggattgaaatatgactatcaaaaataaaattttcagatttggaaatatgactatcaaaagtagatggagggagtattatataaaaaaaatatctatagtataattagtttcatgctggacttgcaaacgtcgtgagcctccaactgaggttgggagtgctaattttttttttctctcttcgcatgattggcatgaatctctaagcaatttaacggtcacaaatccaattctccacatgtgtgctactgagtattttttgggagtagctatatttatggcgccatatttttcacgaaaaaatagtcggcatgtatttacattgtaacttcctaaattacatatgtaattttagtgtatttacaatataagtctcaaaattacatatgtaagtcttaaaattacatatgtaaatcctaaatttacgtactaattacatatgtaaatggtatgtaagtagggtgtaactactatataaatcagtataaatgtaattattaattttacgacggaggtgaagtgctaatgaggttggagcttgattaggtgcagttggttcattcgcataagctgtacgatgggtgcaggtgcttgaaacgaatctcatcggcggatcttacggttaaaacatccgactgtaaattgccctaaaatatgtcgacacaaatttagcaaaaccttatttttttttctctgcataaatctcaatacaatttaacaaaacttagatgtgtacgtagagaaattacaatgcaactatgatataattgcaatgtatcgaagatgtaattacaatataactatatatatatattataatttttttctggaactacattattaattataatgtaattagtctaatcaccttgtagtaccatattttaatagcacattctctgaaatatagtaaactctcgcagaacacatgcatgtaaaatccaaaatatggttgtcacgataaaacaagaaacccagcgtcctagcccatgatatttttttttgacacgaacccatgatatattgacacacattgaactgttttgtcttgaaaaaactgtcgccacaaatcagcaaatcccttgtttttttactactattccgttttggtttgagttacgtgtcgccgaacgaacttttttcgtttttagattttttttaatatttacagaaataatctatcggcgaacaaaattgcaaaaatagaccctgccgcccaccattggggcggcaagctggcgtggcagacggtgggtcgaccgcgccgtctgccgccgtcggccaaaattacgattaggcccttgccgcctatacagagggcggcaagggacccagatgtaaaaagtacggccaaaagatttttctatgcaatgttaataataaataaagaagtatttgttggtaaaacttgttaatattgttataaaaatgtattgaagttggttgttgcgcaatttcatatgttaagtgaggtattattttgtaccttattcgacgtattagtactcggataattaatataggcctatcgcagtctcggtcgtagaaacattatatggacttaaacaaggagaattatgtaacatgaagaaatagtagtacaatttgaacatgatacaactatttccattgcggttacatagatgatattagatttgaactaggagggaggtagtgcaatagttgaacacaacgacgatatagtaatgggacaaggaagcatgacagcagaaatttcaatatgccaagttgtccgataatagctaacccctacgtgaggatccctctcctctctcaaaccgcgctttagtaaccctgtattgctctggtagttcaagctgcacaacacggctaggtagagttagaacccttctggtgtctatccattctctgtattgacatctcattggtggttcctaggaggaaataatagatgtaaagcgagctaagttagtaaatgttgtgagaaaataaggattcatgtaatcaaaatattcttaccatgaaatcgtcgtccagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgactttcttgtaaacaagtggttaggtcgaggacgggattttctgtatcgacccactcgatgtatgcgcaagccgtagtgcgggtctgccgaatagagtagtgttacgaagaataaagcgattgcctatacggaataaatgagcatatgcagataataaaataccccacggtcatagttagggcacctaaaaaagcgccttcctcgaatatcaggattcctcgaagccattagttggcatcgatcaccgcataggcagagaggacgctggcaccaaggtggtagtaggtatacacaaggatcgctgcgccagtttggatcctcaacaccccggcgtctaaccattgacgaaagccggtaggatttgtaatgaagaagtggggaagagagtactgaatgtgattgagttctgaaagattgtgaggcctcactcgttaaggcgacttatataggcgcaattcatcgagtgatatccttgacatgtgaacgtggtggggcatggtgggtacgcctgattggcgccgaaagttgcatgcttgatcggcgccgaaagttacattggtcgtatgcggcaaatggcgggcaaatactcgtatcgcacgcgaataaaggaggctgcatcggtgcggcagaaagtagtcgtgcatgcgccgaaaggtatcgtgcatgcgccgaaagatatcgtgcacatataacaacaacgtagtcattacacaagcatacaatactgaaaagtgaagcaagtaaacaaagagaagactgctctactgcccctgccccgcgccgcgaccacgcttggtcctccgggcctgtgctcgcacgtggtcctgggagtaggtgaaacgatccggtggcacagcacgggtagcacgagtgtctggcggaggagtggcctgcgcctggtcctgcgtctgcaccggcggtgcgcctcccagctgtgaggggccgatgacgtcctctgccgagcctgaagcgaagtcgaagtcagtgatgtcgaagagcacggtggaagacagcaagcagtccgacgaggtcccagcatggtccagtggtggaccctgactcgacgtgccggctgcctgtgacgaagtcccggtgtactgctggaactgcgctgagtgcgaggtcgacgcagctgcctgagacgctgaccctgcagcctgggagaagtgggcggcctgcgtcatagcgaactgggcgaaacctacacatcgacaacgggaccttgtaagctaggacataaaatgcatgtaaattgattgtcgaagtaatgttgtttttttaagtacttgtggggggcacaccagaaggcctagccgaggaaggcggggtgctgaacggtgcacgaaaccctgaatcaatcggcaagtgaaacggctcacatatatgtgcgagacatgtacagaaaaatccttaaaaatacttacctctgtgcggagggggagtcggcctaggaacgtgcgcagctggacggggaccagtcggtacgggtggccgctgtacagctgtgtctgcccgagcaacgtcgtctgcacgacaggtgagcactcggagaatcgactccaccatccgcgtgtacgtcgtccggtgttcctctacgggtaccggaatccccgcgtctaaacgttggctcgtcgttgaaccgtcaacgacgacccggttgatgtcgtccacctgcatggttattttgttcatacatattcgtaaaatttgacgatgagaaagacatgaaaacataaaggaatggtgcgatgcatgggtactcacacaacgagcgaagtcctggtcgcggtgcctggcgtagaggtctctagtgctcgcaatgtggggctgttgctccaagggagcgaaggtgaccctagtacgggtgcgtggctggtaccagcgtaggtaggcctagtacgcctcctcagtgtgtggctctccctcgtggtccacgacctccttggttgcgagcaaccagttctcaacaaaagtcgccaacttggcgggccagtcgccagctgactgctgacccttgcgcgagtgcctgcgaattaatgtactagtgcgaaacgtgccgtcagatcgtcctgccagtccacagccgtggtcactggcccaacagtgtctcccgcgagcggtagccccaacaagtacgatacgtcctgtagggtaggggctacctcaccgcatagcaagtgaaaagtgtgcgtctctggcctccatcggtcaaccaaagctgctaggagggacttgtccacagtccatcgtctggccgggtccacgtggccggcggcagcctccaccagccgacacatcggtaggaggccggcctcacgcagcctgcaataagaaattaatatgtcattataaaaaatattacagcgcaactaatttatagtaatacactgttcgtacctctcgacaaaggagtcgtgaaccgtgagtagctcaccgcacgtccgtgcccggaacgtcccaagctgagccccctgcaccgcagtaaggtgagaccggtgtcgctgatctatcgccgggtccaacagctgaggtgtatcctgacgtgccatctctgaaaaatatagtgtttcgtgttagaacaattcaaaaagtagtaatgtaaaacaaaagatgactcgcaaaattatgaaatagtaataaaatcatgagaataattatgtacaacaacagtacaggctatttaaataaagcaaacgttactaatggtacataacgatgacatgcaatttaacatatatgtagagttcgataatataacataacataacataacataacattacgtgtcgaagtccgacatacatcagcatacctaaagacactaggtgccttagtctgacgttacatcacgagacctaaagaaatgacatgccgaagtctgacattacacgacgaaacataaacacatcgataagttcgaaataaattacaagcaaacccacatgccaacatagaacataagaactacaccacgtagccagacgtggcacgacgacacctaggacgtggtcgagtggaggtagtgccttcacccgtagggcgagctccatctgctgctcatcctgatagtcctgcctccgccgcacttggtttctccttgtctttaggacaatgcttgtaggtgtgcccacgttcatcgcatttgctgcaatgcttcaccctgccagcctccgactcgtccatatcgttgcagatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactaaagtactgtgacacatatactgcatctggtatgccacactccgctgcggcagcaatgacatgggtgcatggcctgtggagcagcttcggctttgaacaagagcaatgacatgtgccgtcggctttcagaacacactcctgcttcactctcttgcggtagatacccctgcctgccttatcttgacataatatctcaaacctgtgttgttgggtaccttgcactagagctcgatgtttcatggcctttttacgcaactcctctagctttttctgcatgaaagttccaaacaaaatgctgttgttcggcatagagggaagaactgcctggaaccgatccctaagatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaaagttggactatccgttgggagacgtccaagagattgaggagggtcatcaacggcggtagatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacacatgcaccacctactttgtacatcgtcccaaacaccagggtatcctggttccatgctcccaaactgcaactcttctatcactcgcagaatgccagcgtgcctatcatgtatcaggcacacatttggcctcataccaacaacttttgttttaaccaaatttcaggaaccagtaccagctgtcggtattctcactctcaacaaaagcaaatgccaagggcaatacctgattgttcccatctacccctattgctgtcaatatctggccccgatactttcctgtcaagaatgtcccatcaatgcagagaactggacgacagttcacgaatgccatcttgcatgcatgtagagctaagaacgccctttgcagcacactcttgccaggatgttcaattgatgggaatttcttcacttcgtaagagctcccagggtttcttccctcgataacaccaagcaggcgtggcaaattgtcatacgaggcttcgtatgttccaaatctcatctctattattttatgtttggccctccaggccttggcatagctaatagtatacttgtatgtctcctcgatgtgtcggattattgaccttggttcatatgtgagattatcgatgacatgcg

SEQ ID NO: 45530 - DNA, 8050 bp, Oryza sativa
attcctgcagccccatctcagatgcaacaaatgcacatgtaatgttcctgtggtatttctgaacaccaggtaaaaaacatgtatgcttggtaacgactgacactgtccaataatccttccatttccccttatacgcgtgcactctccagggacaaccatctttttccttaacacactgaacttcatattgcgaccgattggacttggcaaccgaaaactctctatgaagtgacactgcaaaatgttttaccgcctccttcatatcttctgctctactataaatcgctccctgaataacctcattttctttgtactcccatctcacactatcctctttagagacgatcagcccagaaaaatcctgactagcccattctgctggattaatatccgtctcctcatctgacgaatcaccttcctctacacgctcgttatcagaatcctccctctccatttcatccacaatggctgcgacagtcttcccctcgtcggccactccacctggttgaatgcccacaggagctactacgcccctatcctctcctgcgttgacctcctccacagaagtctcatttacttcagcacttggtccctcgccatcatccatgttcatctgcacacctggatccttcgggtgcacaaacggaaccaaagctagaggccacccacgttgcattgcattttccacataccatctccacacttgagagttttgaactggaattagttcccaataaaaaccctcagttgcccgacttactacaacattgattgttatgtcacttgtctgtggatcaactctcaagcccctcattaaccatccttttatagaaggtacactcctctcagccggtctctcaatttccctttctgatacaataaaatctgacagatctaccccagttggcccgtaacggacgtttcctggtccatggtaaacttggaatattggtttgttcgacatatctgtcaacgaattaactagatcatattactctttcatgcaataaacatctacaacgtaatatcttcttgtgtaagccaatgcaatggtaaagtattgattccaaactagcagatctacgtagttaccgatatctacaatacgcacttctaaattagtacaactaaaaccctaaaaatataatgcatttattcaaacaaatttttaaaaaatacacactatttaactcaatagtcacatataggaactatgaatattacctgaaatcggcatctgaatccggcagggcttcaccccttcttctcttctcctcccctctcttcttttttttttcactggatttgagaggggtgaggaatgagggctgggggctgggcggcaggccttttataggcagcgaggcctgccgcccggccagagggcggcaaggggcctcctgcaaaatggacagccccctgcggctcttttgcattctgcacccttgccgccccaccagagggcggcaagggctttcatgcaaaaaaaaaaccaccctccgtcaccgcccgttcctcccccgtttgccacgtcagcttgccgcccaccattggggcggcagggtctatttttgcaattttgttcgccgatagattatttctgtaaatattaaaaaaaatctaaaaacgaaaaaaattcgtcgccgaacccgagttgggccagaaggatgtgggcttgtccgactgcgaaaagaaaccatcatcatttatccgagccaataaatcttactacttcgctacctaagaggaatcgacaaatcgacacagccaaagccgtcgtcgtcctgcttcctcctcccccgcagtagtcgccgtcgccgccgcgcaatccccaatcccttggtgttcttccccgcctctcgccacccaaaaccctaacccccctctctcactccacccgtgctgtgcacatggaaatccccaatcagatcagcggcggcggcggcggcggatcggttgttatagaaatcccggccgccacggagatcgccggagtggataccgcgccggcaaaggtatgtgacgatgatccccgtgctcaacccctccgcgaccgcgagtgggtgtcgcagctgcccccggaccaccccctacgctacacctgcggccttccgaacggggtcttcctctccatgtccttcgtcaccatcatctacgccgtgattgctccatggatgctgtggcgcgttgctaccgatcatgtgtccctcatgtggacatcgtcgatcctcgcgtgttcctacggcgcactgtggactatagccttgtccgaacggctagcaggtgccttcttggctatcatcttccgcgtctcctatgttgccttggtggccttcgcgtccacgcacctgattggtaccgccaatgggatctcgatcgtgtatctcgacacgttctacgttgctgggatgctcgggtacgccgtcgcggagtatcgtctccgtcgtggtaccgagcaatgccctagcgccatcttagccgccaaacctcctccattggaggaccaagagcgaggcgacgaggaggccgggctctactacatgggcttcttgtttggttcggtatccctctgtttggtggggaggatggcgtggctgcttctctacccctgcggcggcaagtgtctcatctcttacgtcatcgaggagctctcgtttgaggcatcaatgctgatctacatatgggttatctttgtttcccttactcagttggaaggggctctggtctgttacaacactctgttctgcaagatgccaatttgttttggtgcatggttcgttcttggcgtgcttcttggcgtacctgtgagtggtgctattgagatgctaatcttttggattggcactatggctctggctggattctttggatactgtctcgcggttcacgcatattgcaaaaggtaccatctctgttcctggcaagattattttacttttacgtttaattagctgatcagatttatgcagtcaaatataaaactagttgtgaatcatgttcttttttttctatggacaattacatgcaaactatgttttcaacgcttttcaatgtgagctgatgagatttagacaatttgaatatgctgcatgtaccattgcatgtctaacactagacttgttcttggtgggattgtgaggagccaaaatgatatcaatgtttatatcctagactgttctttatactctctccatctacttttgatagccatatttcatcttgatacacagaccaaggataagtaattctacttatcatcaatttaaacatgctactagccattcctcgtaaacaagcgattcattaatatttacatttcttaatgtccatgtagccaatcatgtgtggaagaatgaatagtcacgcattaaattcgagaaaatcattaagatgatagattgttggattgaaatatacctatcaaaaataaaattttcagatttggaaatatgactatcaaaagtagatggagggagtaattcagaacactagacccattcttaatgttgaactgaatatcagtttttgagcaaattgttctgttttttttacgaaacttttaataattagactattgcaaaactgtgcatgattatttatgacattgttggtgtctcttgtggtttttttctgaattttgaacatcatgattcacgaatgccccttttttaataagctgtaagtttgaaaacatatatatgttttagttttcttggatatgttgctatagtaatcttctatgctgaacttaattgttagcgatcatgttgtttctgttcacctaggtaggttgatactattctaaagattttaccatgcatatattatgtgttcaacatttcagtgaatcttgcgtatattgcttaagacattgaaattttgttgtcgacgattgaataggaatcagaagacaccagcttagagatttgcgggagctttgatgaccgttttgagaagccaggctttactctttgttgctcttagagaccaaagagcgattttaaagtatgatcaagatctcattctctaggtgtttggttgagtgctcttagaggcagagtaacgccaatgcctattgtgtgtagtattaacttacattgtatggtaaagtttattgtaaatgttgctgattgtgcataattggaaggtggtgactggatgaagaaatacactgtgttaggttcaggacgaaaaaggttaaggatatgcagaagtagcatatctgatgcaggcgtatatatatattgcaatatccgtcttttgcatttgttgtgttcgatcttataactgctttgacacggcgagaagcacgcaaacacgtttcgacttggctaggctcctagtagttagctagcacgttttgcccggtcagtgttaatttgccgcttggtttgcgtgagtagttaagcatcctggtaagagcaggtacaataatgggcggtagtagatccacgtaggcgcgcgtaattggccgtacatcccacgctattcagagcaaagagatgcctaataaacacatcccctaaagctatattttgggaattaagtctaaatcacaaattgagatcctaatatttcctcacgcccaataccagcccaaaggtgagactcttcaggagctgtccgtgctcctaatcgctgcatacgcaggagaaatcctagaaaatttggcaactctgtacatgtattctgaatgtgggctatagcgtgctgttatgcagagaaagaattgttttgttcatgaaatcagctgtcagttttagtctaattgataatttacttccaacaatcccctatggaaatattgatattttgcttggtagaaaatttgagtgaccaattcctctcaaaggggctgccccgagtagtctctatgcaggatttcttgatttgcttcttggacatcgcatcatatttaagcatgttttccttttttatctatactaatataaaaaggaggagttgtccccctctaatcctataggtgaaatcatccggattaatccgtaccgtccatccgcgcgcaagaggtctccaccgcacgattgagtactgccgcgaagactactctccattcacgcgcggagacttcgctcctcctcctcggcgtcctcactcgctcctctgtactgccgccgcgccgctgcatcctcgccgaagtcgtcttcttctccgtccgccgccggagccgaggtccccttccgccgctgccggatcctaccatccgtcgcggccggcgctcctcctcctcgctcgctcgctcgctccggattactgccgacgcgccgccgcatcctcgccggagccgaggtccccttctgccgccgccggatcctaccatccgctgcggccagcgccgagggcggccccttccgccgccgccgccgacgcagtcagtgcctccctctaccgccgcctaggcccccgcctccgtgccgtccgggagcaggagtttcggcagggtcgtgtggtcgccgtcgtgccgccacagatcgagactcgctgtcgccccgccgcaaatgcctctggatctcgcctcccaccacagccacgtgatcttctctcccaccggccttccactagctgcctgcacctcctcagtcgggtagccgccaccgacccttgcccttcgctgccccgtcatcacggtcgtccaagccgcgtgccgccatcgccagccatccttcttacactcacagaatgtagcgtatcttagcagatgccaatgtgaatgcagtgacatatgtgggcttcagtaattaggaggaaccaaatagcaaagaaggctcctaagctcctggtgcatattttcagttatttcattttctggatctagcttgattgattgacttgaacattccatttttccaggtgacatatatgaggttatgctcctataggttgatttcatatttttttcccctgtgaacgcaactgacctctcggtcaatagttcttccttactgtgattcatgtgcttcaagttaatagtctggttctttcaaaatgagcagatcagtgcttcttgaggtattctactaataacctttgcctttggttttactcacactctgtgagtgtgtaaaagtagctttccactggacttccttgatttccatggatatgcagttagacataggtgtgtgacgcattaacgtgtctttctgcaggttggcacttgataattttgtattgtaatatataaataactcagttgcgcaggtgattaatggttgacagaaaattgccttcaatttagttccgtcaataagatactgtgatctaactcaattctcttccatgcctgacagcattgattcttgctgtaaatttgtatttctctacaaatcaacttttattgctgaaaaaatattcacttcaaatacatagatgtgctttaatgactatttatgatgaaattcattcaaagctttggtttgccatcgtttggccaccagtttttaattccgattgctacagaggaattcgctgttagtttttatttgctatgcttgtttctaatttaccttgcagttgcaattacggagccctcaccaagaacggcaacaacagcaggcaaagctcaacagatttgggtttggcgctgcaagctggaagaagtaggcgcatcaacagcataatcctttcagttttgggatacaagatgcgagtgctcagtcacgaaatgctcttggccaatcaaaggttcgtcatctctaatcacaaaacaacttttgattgcacaacattttcctatataggggtatttttgtgtatatgactaacaaattgttgtattagcttttccaaatatgtgaggtaaggaacagatggacatggaagaattggaggtaaccaatattgttacgcatatattttcctatctgaatctgttgtagagaatggcagatttccttctcacaggcataattgcagacggtcaatactttgaaagggtagcttcggttagaggtttgtagtacctttgctagcatttatctactcatcttggagatattagttaattgtgaatcgatgagcagtggtcaaaaagaagaaagagcatgaattccataactaaatcttgtgggctattttgtcaatccataactaaacctcagtaaaacttttagtacccaacctgtagatcataactgaatattcacctaatattgtggcctacaatttcatttcccaattcgatgctctagaagtttagaactataacatgcataatttcatttttcttgcactgcataattttgtaattacagcatgtattggacaaacctgcatcttttgcttgtatataaagattatgttgtagaaagcagtggaaatgatttttgatgtttcggttcagtatgcagtggataacgctggtgaaagctccaaaccaaattcgtccgcacgaacaggtaatgatacatttacatttattcagctgatgcattcacgtttccagttcactaattatcaatatgtcaactagaccatcctaatatttatttaattgtttctatacatttctgaatagttgtgccaaccctgactaatctgataccacatattgatgggcctgtactgccaacttttttcatgccttgtgatgtgctgtgcttaaaactcctacactgctcctgaccattgaatcaggcatgtgttttgaatgatgactacttcatgtaagcctatggaaaaaaaaacatttcagtggacggttatattactcaatgtgattactcaatgtgattaaggatagcaccccaaggtgatttagaactggtatttttctgcaggaaatgaacatatgcagtctgtaatgatacctatgtgtttccccgtttcagaaaatgacaatgtatcttgcatccagcatttgtttcttcagaaaatgtacaatgcctataccattcagtgtcacaaaatgtttcttcagaccacacaaagtatgggattgccacgattaaatcttctatccctataagctacaattgatgtacaggtaagatacatcaacctgggatttgttaggtgaattatgtccttg

SEQ ID NO: 45531 - DNA, 6053 bp, Oryza sativa
cttgacattctcaagaatttgttcggtcatcagcagcatatatagtacaagactttgagtttgctagaggcagcaataggataatgatttttgtaaaaagtataggacactaagtttgacaaggatgaaacccataaggattgtagctgaatttttttgtgttgtctatgaaatactactactatgtaatgtggtatgatcaaatggttaccagatttaatccttttacattatattatctacagatttattttgccaggcaagatacttttttttttcaaatgctggaagttactctcttagcaaaatataaagagattaagtctgttatatatatatatatatatatatacttttttttttcaaatgctggaagttactctcttagcaaaatataaagagattaagtctgttatatatatatatatatatatatatatatatatatatatatatatatatatatatattagcacaaaggtgctttttagtatgtagatctagctaggttctttcagtatgtagttctagatggtgttatgacacaatctgtgccgggttatcctctattaaacatagtttttcatgagttacatttttttttaatgggaaccacaaataaataatgtttgaatgtgctttcttttaaagagaagaatgtgtgttgcagataattgaatcaacatatacttcttatgaagaagaatcactattggtgcacatttcacatggtttggtaactaatttgattgcggctatccatgggcgtgaagcagcatatacagttgcagttctaggagaaccatgtcatcatgtaaaaaacatggcaagacgcaggaatgttggctggatcaatttttcattgatccattatttggtcttgatatgggtaactttcagtcctattttgcatggtcaagtacattgttcattgagttattctctttcatgcattttcgcaggctaattcatgagtttaaccataccattaagcattctctttctatccaatctgtttcattgatgttaaccataggaaatccatttcattatttgactaaatgttttataaatagaaaatgtaacaagatgctacagaaggagctggatcacacaccaacacacaccaacagtaaaaactgacccttcatactgggtggcaggacgagcagctaccttgaataactctattgatacatgcaagaatgtacagtatatttaattgaaagcatgtcacgtccatgacttttgacaaactagagaatgttgtaggatgaatgtatgtgttgtatagtcttacctgaagctaatttgacctttggtatttacaaaaagtgcctgcaaagagttattaagatattgcaatttacactacaatatatatgtaatttttgaactttggttgttcacatgttgggtgtgatatatattgtggaaaaaagcaataatcttcgggtgattttacatgattagtgtgacatgatgtgggaaacgtgccttgcacgttcacgtttactagtatctgtaatgctagaagatcagcagcatcgacctttttaacctgcatattgtaacgggggaatttcttttatatatatggtacacttttaaatcaaagaacagccatgttctgctttgaaaacacagtaatttctgttattatcctgtaattaagcaatcacaatcagcatatgtggctgttgctcaatggcatatatatatgcacctgcctatgactcgggcggaggtagagtatgtaagggggttaccaggaatctggtcaaaaaaattttttaagctatacttcacatatcttcaccatgtgtgcacctctctcagtgtaaacttaggcacctgcaccaacttaaacttgatttaaagtaaagtaaattaagcaagaggcacctccttcatttcgttctagctccgaggctatgatactactagaaaaacgatttttcatggtgtttggaaaatattcttcatggtggctacaagaaaaaaccgccatcacagaaaattaggggggtggggggtcacgggccgccagcgaaaactgattttcgctggtggccacattaagaggtccaccataaaaaatacttatttttcgaggcgaacctcttaaatgtccgccagcgaaaatcagcgttttcgctggcggctactaaagagatccgccaacaaaaaaacggatctgccagcgaaaagcaaaggctcgctaaaaacttttcacggcatttaaaactatgcgcgcgcgagatcgattccttcacccacccacgcatttaaaaccggttttcacccacccacccagtgcattcatctctcctctatctctttctcatctccacccaccgcatccctctccttctcccccacctctctcccctactcccggagcccccagccctcctcctcctcctgtcggtgacgacgacgactgcgtcgacgacgggcgcggacggcgaggccctcacctctctcccctccccttcctttccctctccctctcccagatctagccggagggagggggcagcggccgccgcggcggcgacggcaggcgggtggcggcggagctgacgcagccgacgacgtgccggacctggcgggcggcggctctcaagcgcgggtggtggcgctcgggcgcgggcggggaggccggcaccgacctcgacgccgttgactgtactgcctggctccctcctctccgacctcgacgccatcgaccatgctgcccggctccctccttcgtgatgatttttgtgatgcttgaatgcttgtgttgatttttgtgatgcttgaatgcttgggtgaacgaaaacagttgactgtaaattgttgatgtaaatttctgtggttttttgaatgctttggtaaatttctgtgaaatttttgaatgctagagcgttgacgaaggcggatggagcggtgtcgctccgtccgccgttttttttaaacttggccagtattaacactcccggctggcacaatgtaacccgccagcgaaaaaatattttcgttggcggccgtcttaagccaaccgtcagcgaaaatggatctttgctggtgactagcttaagatgaccgccagcgaaaatgaattatcgctagcggtcgataaccgctagcggaaatcttgatcttcactggcctttgttttgtggctgctccaaattccgccagtgaaaacctaaaatcatcaccaagaaaaatggttttttagtagtgtgacgagatgtgtatatttgcttgagttatctgctcttgcacttgtatattttgtatatggtgagtttgtttctaaatcctatgcatgtgaagatatatggtgaatggtagcattcctgattcttgtcaagatgaattctactgtgaagtatcaaatatgaaatgttgtgaattatctgtgaaccctgacatatatgcactactgtcaagacgttgtaattttttttctaaatctttcaggttaataataagagaaaattcgacctatagcacaggaaaaaaagcggtaccaaaaaatagcataaaaagttcccactttcgatctatagcataggccaccgtttttttcgcccggtagcacttccgtcgcattttgaagtaacggcgttagatcggagtggagaaaatttttgtcggactcatttacccttcgttccccacttgtttggccgcgtgttcggtgacgcctgcgccggcggcggcggaggtcacggaggagtagaggccgctgcttaggaggctgttcctcgaggaggggcggaactcgtccatcaggttgtcgtcgtcgtcgttggacatcaccgagctggacggcatgtcgccggacagctactgtgtctgggtgtcctcgccgtcgccagcatcctcgccgtcgcgccccccacggaagagcgggtcgacggggtccatcacgtggtggcgctgcatcagcaagctcgtcatcggccgcaaccacagcgacggcaaggagaagttccgcgctgtcgtccccggccagggagcaccccaaaccgaagcccaccgacgaagggcgccaccgccaccaaaccgcgttcttcactgacggcggcaaagaggccgcttgaggacgaggacgacgatgatgacgtgggcggccctagcgtcgatgtggatggatgtgggccgttgtacgccctcgggctcattagctccgtcatcgccgatggcgctggcgaacaacgccatggtggccgtactcggcgtcgcagcccacacctccgctgtcctatccctgctgctactcgccgtcgaggttgctgcctacctccaggggtggaacctcgaggaggtggcgtcactccccgctatcgacggcctcttcgccgcgcctccattgccctcttgctcgggaaaaagggcaaatgagtcatttttcatgtcgactcacatgtttggatggcaaatgtgacgggagtgctataaatcgcaagaaaattagtgtcatgtgcttctggtcgaagtagaaaatttgtcgtgctattttttggtaccgggttttttcctatgctacggatcgaattttctctaataataagcactactggatcgtagcagcgtcatgcacagggagaaagagatcgtaaagctagggatcgtcttcgccttccttctccacatgtgcaacccgacgtacgatgaactgtagcggcaaaaaggaaaatcagatagcggcgacgggcgaggcgtcgaggtactgtagcggcaccggcaccgtatgcacagcaagaaaattagatggatcaactgaactaggcccacctgctgactccagcctctaaacgggttttgggttttgagggaaaaaaaaaggttaattggattcatgccatcgtaaatatgcatacttagataaataccattacaattcacctattcgtagctatactattgaaattttataaaattaggatacaagccactgcccgtcatgtttccatccatctcttttttttccgttttctcccggccggcgacacgagttgagctgtcccccggcgtgcatgagccggcgacgcgccatggtcgcgagcccgcgcatgcgacaccacggacgagagtccacgctggtaacgcacaagtcacgccacaccgagcgccgacaaggctgcagcgccaaggtgccgcccgccgtgcctgcgtcacgctgtcgcacggcctcgccgagcagcgccatcgttgcagagctgctgcggctgccaagccactgggttgcggcgcaccgccccacggcgactggcaccatcaaagaagaaaagaaaacgaaaaaagaaaaagaaaaaaaaaactgagagcagcaccggatgaccgagctactagcctggtgcgcgtcgccgttgctcgcgttgtgccccggccgccgcagccgcacagccacgccagcgccgtcgatccgggcgttccccggccgctgcagatggcagagtcatcaggggagaagaaggaaaaggaaagagaaggggaacgcgggaggcagtgtcgatggcgacgccgttcaccgtcgcccacgctgcgccagcacggaggccactgcacccgcgccgaggccgccgccccccgagctcgcgctgaaacgtaggcatcgatgcaggcgtactcgaccttcgccgcgtcgagatcccgtttctcctagttgcttatggtgacgcttggcttctccgtgagtccgtgtcgaggccgagccagtggttgcaggcatcctccaggtccaccggccggcgcggcgcacgagacaccgtagtcggcgtccagcttcgccgcgtcctctccaacgccaatgcttgcgtcggggcgctgcacgccatgctttcttgtgccatgccattgtaaatcggtagctcaggaagaagacgggagaaaaaaaatggaagaaaacggaagaagatggttggaacgagacggaagtggcatgattctaattttgtaaaatttcaatggcacggttataaatagataaattgtaatgacatttatctaaatacgcatatttacaatggcatggattcaattaacaaaaaaaa

SEQ ID NO: 45532 - DNA, 3738 bp, Oryza sativa
  unsure (1)..(3738): unsure at all n locations
ggggctcgagagtcgagaccccgccgcccccatgctggatccgcccctggttggatcctcgcctgctctggccactgccctccctcgcgacaagctatctatgaatgacaaggtctacttcaggagcttctgcaactaccggactgtttagttggcaaaaattttgccacacatattacatcagatatactgacacacatttaaagtaaccgtagtctaataacaaaacaaattatagatttcgccaagaaactgcactacaccagattctcacacctgtgacggtatatctgtgacggacataagtgttggtcagtgataagggtcacctttgacgggtcctacggaatgccgtcatcgatgagccatccggcggcaacccgtcacaggtaactagtcacctgtgatggtccaaaaatagaacccgtcaaaggtgaggtaaagtcacctgtgacgggccaaaaatatttagcccgtcacaagtaactagtcacctgtgacggtctaaaaattaaacccgtcaaaggtgaggtaaagtcacctgtgatgggtcaaattttttgtgtccgtcaaagatgataaaaaaaaagctctcataaccctgccctctttccgtgcaactgtatcgatccatccttatcctctcccaaacacacacagccacacagggatccttatcctcttctctttcaattactccccctctctctccctctctcatcatcctccctctcagtcatatcctccaaccctttctctcatcatcggcgccggtgggtgcgcgggcaggaggggaaggtggcaccggcgggtgcgagggccgcagggggaggcggcacgggcaggtgcgcgggccggagggggaggcagcaccgacgggtgctggggccggagggggaggcggcacgggcgggtgcaagggcggaggcagcaccggcgtcggcgccagttggaggccaggagctcggggtcgccgcctccatcgcccaccgcccaaagtcgcctccttcacagccatcggcctccaggagcttggggtcaccgacgccttcccccgccttccggccgctgacgccgtcgcctcgaccgccgccttcatcaccgacactaccgtcgtctcccgaccaccggtcgctagatctggccgccgggaagccggatctggccgccggtgccttcccccgcctcccggccgccgacgccgccaagtctagcctccaagacgcggatctggccgctagccgccggatctggcctccgggatgcgaatccggccgtcgacgcctcccctacctcccgaccgtcgtacatgatcgccgcggcctctccatcgattgccggacgttgcttcctcttccaccgacagctgactgcctcctcctcccgactgtcctcctccaccgacgcctcctcctccgccaccgaccgtcggccaccggatttgtttgtgcttgattttgtatgttcattgccaaatttcaaattggggcttttgttgcttgtgtggagatcgatacttgtgtgatgtatattgttagatgtatcctgcatttttttgcttcatgtgtaattgtttgttggatgttggatgctatcagatattaattaaaatgcaaagttgttgtatcgtgtggatgttgagatatatttggtttttcttcatttcgtacgttcggggctgaggcatttcttttttgtttgggacagcttattatctgtgacgggccgaatgtaaggtacccgtcaaaggtaagtcacctgtgacgggttgtaaccacgtgactgacctgtggagacctcacctgtgacgggctggaaaatacaggctcgtcacaggtgactgtcacctgtgacggcacccgtcacaggtgactgggactcaatagtgaccactaatctgtgaccatgcccaaatccgtcaaaggtgatagttagggcccgtcacaggtgatgtgatccggtgtagtgctgctagacaaatttattaagtctaattaatctgtcattagcaaatatttactgtagcactatattatcaaatcatggtggcttaaaagattcatctcgcaatttcctggtgagctgtgtaattggttttatctacatttactactccatacatgtgcctaaatatttgatgtgacagcgtgaaaaattttaaacatgccctatgtcctttcgtcataaggtcgtcataaaacacggcttattatgatgttatctcattggttcttgatgaaagtgcctcgtcaataaaggttagaactactccctccatctacttttgatagtcatatttcatcttggtacacagaccaaggataagtaattctatttatcatctatttaaacatgctactagtcattcctcgtaaacaagcgattcattaatatttacttttctcgatgcacatgtagccaatcttgtgtggaagaatagagagtcacgcattaaatctgagtaagtcattaagatgataggttgttgattgaaatatgcctataaaaaataaaattttcagatttgaaaatatgactatcaaaattagatggagggagtattacggtgcacctacctacccgccaagggagcgagcagactgaccccttcccggatgcaatgagtgtggtgggcacatccatcgacatccccaacagcgtcgatggcggtgacaacaaggcaattagcgtgaaatccacaccgcggagattgttagagatgaggaggacatcgccagagagaaggagaagaatcctccgctcactccctcagtgagtatattgcatatacacgtaacatcagataattttaatccatctccaggttgagtctgcactaattctgcaccatttccgacatccgaaacaatccactctacattcgcatatgctccaaatccattatggtgtaggatatggtatgaccactatccatttgaacactcgatgttttcacctctagatgtgtgacatctcaaacgagtacaaagttaatcttgcaaacatcaattaatcctcagcgcttatgtgaatttcaagtgattctccaaccatggatattgtaacaaagttatgttgctttgttccggtgaaatactcgtgcgttagaacacagactcattaaataaagttattattatttaaacttagtagtatgtccaaaagaattttattttgagttggtatatataataaaattatactccctccgtcccataatataatggattttggagggatgtgccacttcctaatantatgtgtttagattaattngtagnantagnaagtggnacatcccctccacaatcccttaggcaatgtttggctaatgggaaatggaaatgatttccaacccaccaaaaggtatctttaaatcctaaccattcattctccctcttccatttaatcataacccttcattcatttcccaatcccaatcccaccccccatttcccattatccaaacacacccttatattatgggaacgaaaggagtagttatcaatcgttaagtttttcttcacatgttacaaagcacaaccattttgctagaaagaaaaagttagacaacgcaacttgagcctgatgtggttttgtgcattagattgcattcgagattcatgcaaagagagaagctagcgggacagttcatcttcctgcatcggatcacagccaagtcaccggcaactctattttttatagtgattttaacatattgtttctttacttaaatga

SEQ ID NO: 45533 - DNA, 8075 bp, Oryza sativa
aaccattaccccgtcagtttgatagcgataatgatgcagtctataattggcatgtgatagatgatgaaccactgcccaggaatactcgatcctcatcggaggacacaaggccatcacctacacaaaaaaggaagtcttccaaaccaaaacagagatcgcggaaaaaggccaaggctgattcttcgagtggtaacaatgctgaaaatggtttcaagcgggggaaaggattagcacaatgtgatagatcgcatcaaagtgcaggaagcagcagacggagcaaagggccgagagagtatgacagattctacaaataccctcccacaatatactcagcacattagtaggtggtgactttaggctgttactgattgtcatttacagtacagttcgggattgggagatcccacgaggttttgacaggcagaatggcgccttggcagacgtcgaagttcaagcagctttctgtagccatatgtatgatttattatttatttgtttgtctaaggttattcggtcctttgtaacgccgatgaaaccgatatattcagttatattatcatcgtatgaactgcaatttcgccaacttgtctatggcaaagtttcagactattaaaaattatctttggctggaacgtgaattcataattcataacaagacgtcacttcggtgacatccgataaaaataattcataacaagacgccttgaaaggtttaagttttattaaacgaaagaggaacataatttagattgtcgcagctaccaatcacactaaatacatgattggaagttaaataaaatcaagcttatagtcgaatgaaataaaaaggttccaccttcttttcccagtttagaactgaacaagtaaacagctttgtttaccgttaccacaacgacactgcaagcttaatacagctagctaccgtcttttactcgtctttcttctgtgcgaatcctgggggaaaggactccagccttttctattccgctcaaaagaataaggaaatataacgagaattgtatatgaggaatacaggataatcagctatcaagcactttgtgttcaaatatcaagcctcttatacctctgctctattttcctttcgagagctgctcctatgttttttccatagtataacggaaaaaaaaggtcaatcaacaatatgacaggttaaataaacattgaaagtaaaaatgcaaaacaaaagaagctaataaaccgatattgtaaggccacccaacaaacagctgacaggatcaagatggtgtaaactcgtcaaatatattcataccgcaaagacataagtttaccaggttacaagcaggtatgtccattaaaagtgaggacatatgctagcatcatcacttaactaatctaccattcttattcagattgacccttcagctgaaaaaaagtagaaggatttgcaccaatctgctggctaattaaaaaaaaaggaagccagattgaagtggccttatggagagctgataagcttccagtccatattagaagtggagatcctttgtgagaccagtgaaacatctcaatatgactggttcattctgcactaacctgaccattctcgtggggatgtaacattgctacctgcattgagcttatcagccatggcaacagagtctgcaggttgggctgcagttaccactgggagagctacgctctcaactcgatcccgtggataccctaccacactagctgtttcaaacatatttccaaatggctgattatgcacgacttgtggtcccaaatgatgaaatgccatcggaccactcgctggatgctgaggcagaacagcaacaacagtagcagcacagttagaaggattcttgaatgtggcgctgtaggattggccactaccttgaacggcataggatgccacactacagtggttgggcttgcttggttgaggtgggcatgagctcaggccgtgttgctgcaatggttgtggctgctgatgctggatgttaaggtctgtcgatggaagcaaaactgtattgccttggccataaaaagaaggcatggcttcatgatgcttctgctgaggtgaagagtatggcgagtgcacaaccatgtttctcagaagtggctccgttgtagcactggcaggcttctgagaagagtatggaggatacaagacagcgacttgaggagcactttgagcctgaggagatgatgtttgctgttgaactagctgtggtggaacttgctgaatattgtattgctgcggttgcaccacaaggggctgtgttcgccatgcttgtgactcaacctgctgagcaggcagatgtagcctttggtcctggggttgagggtacaattctgtcacctggctagatttctgagataggtcaactgcaaccctggcttcaggattctggatttgtgactgaataacatgtaccgcggattctgatggttcactctctgtgcacttaataggattttggctttgcatataatacacggcagcttgactcggctgctgctgatctggttgtgtgctcaaagagacaggcactagttgctgcaaaatataaccattgctgctttggactggcacagcaggagattgcattgcattaacttgctgaagtggcatgaaagcaacctcatgttttgcaacttgtgtgctgtgatcattttcccttccgaatgttgagaaagcagaggcttcatttgctctagcagggaactcatgcgctatttgaagtttggagaactcgttcggtgtctctgaaatctcatgcttatcctgcagaatctgcacagatttttgaacctgttcgccagaagaaaagatttcagtgtgttacaaaatgatctgaatctcacgagaacagcaagtcgttgaatccattgaattcaatcgtaacaacttgtgaaaaaaattgcactgactccttaagcacgagtgaaaaaagaaacaaattttgaaacgtaaatggcactgttaacaactacaaccacaagctcaagcttcaaatctgaacattgcatcaaaaagttgcaagccatggattaattaattaatttttaaacagctttattactttaccgtgcgagatggatcaatgcgagtaattcgaaaacatcgaacagtttgggtgcaagtaattccgttgaccgtgcaagaacgtgcatggatctagagccagagcacccacctgcctcagattcttctccaggcaccggaagttgaccgtcccctcgctgtggtaatccatgacgtcgctgcgcagctccccgatggacctctcgagcttgtagcagtagagctccagctgcgacaggcggccgccgattccctcgagcgaatgcagcaagccctcggcctgcttcttcatgcactcctccacggccgccatgaccgcctccttggtgtagttctcctgcccaccgtacacgttcacgaacgtcctcaccatcctcttctcctgctgcaaatcctgcccccattcccccccaaacacacacgcacagcatcatcagaaaccccggacaacacagtcgggaaaccggaaaagctttcggggctcctgctacctccgggcggcggcgcgactggtcgaaggagcagcgggcggcggcggggtcggcggggaggccgaacgcgccggagacggaggcggcggcggggcgcgcgggggacgccatggtcggcgcgggcgggaggtagctagggtttttggcctggcgggaggagacgagacggtggaggtggaggaggagggagtcaggaatccgaggcggaggaaggggcgaggaaagtgagaaccgagctgggcgcggggcgcagtgtggctcactggctgtctctgtggagtggaagccaagcaccaaaaagcagagcaggagtagtagttgtagtaaaacagagagagagagagagagagagagagagaggggtaatcagatccggtgaaaaataaaaagtgtaaagtaaagagaagcggaagcagaggagggaagcaaagcggaaggggttggttcgccgggttcgaggcgtttgggaggaataaaaatgggggcggaacggaacgcgtgggttggtggggttgtgtggactcccggggctcccgttgcacgagacgagagagagacccacttggggcgtcgaaatccgcggttgtctccccgtgagatccatgggattcagtggcagacgccactctcctacggtcgcttgttcgcagcctcgctccgcggcctccgcccgtcgacaggtcgagccgggagttcccgcgcggtttggggttgggtttggattgggtcggctgcggtgcggcgtcactatcctcctgaaccatgtgcgcgattagaaaacagcgggtagcgtgcgtgcagcgtccgcgctccgtgtcatgcatcgcgcgggtgtgtaactgtgtatgggcaacgacgtgatgtctacgtaccgagcggtcgtctcccatcggtgtcgagatggttggggaggtgtgttgtggcttgtgggtggcaggtgggacacatccacgactccaccgccgttcactcggtgcacgtttggcacaagcacaacccaaggcgcaggtcgatctcgcaatctgccgagccgatgatggttgcctgccgatcgaggaccgtggccagattctccccgtaggcccatccatccaccgagataagggtaatgacgagagggacgcaatcgtctgtacgagtacaagggaggggaggatagcggcggtgcggcaagtgttgtggggaggcgacaaggaggcaaggacggaaccggataaggccgacccaagtcaagttgcgattatgttgatagtagttgggttttttttacgctctcgccaaacccagtatgctccttccgtttcgtatgattttcttttctaatcaaattttattaagtttgactaaatttatagaaataactaacgatattaaacaccaaattaattttattaaatctagcattgaatatattttaataatatgtttattttgtgtaaaaaatactacaatatttttttataaacttagttcaacataaagaaattcgattaagaaaaaaaatcaaaataacatatataatataaaatgtagggaatacttgataagccgtaggcatcgtgaggtacgttgagtggagtttgtgcgtctacattgtacggagtatacttgcctagtatacaaacaatgcttttttttaagtaaatgtaagttaattggttagaatttttatggtgtaattagactacccgaatttaaatcctagatttatcacgagcgactgcatttgtggctaattattatttcagacactcgttaccagttaggcgaccgtaatgattttgtcaatttcaagatatattggtctagttttctggagatactcgtaggggtcaggtgcgcgtgtgtacgcacgttataagctcctgtgttactaagggaccaaaacattcaaattttttcatcctttagatccaacaccgacatcattgctagcaaacccacggagagtagaaatataataaggattatcccaaaaattaggcaaacaataggggtctaatggtgtagctacacactatacttactttgtaaggggggtttagatctaagggtgtaaagttttggcgtgtcacatcgggtattatatatggtgtcgtatggggtgttctagcactaataaaaaaactaattacagaatacgtccgtaaaccgtgagatgaatttattaaacctaattaatctattattagtaaatgtttagtgtaacaccacattgtcaaatcatagagcaattaggcttaaaaaattcgtctcgcaaattagtcgtaatctatgcaattagtttttttagcctatatttaatactttatgtaggtgttcaaacgttcgatgtgatagggtgaaaatttttggggtgggatataaatagggcctaaataccatgtatgtgttatacatcaatacaagcgctgaattagtggttaggacgggatcgccacatgtcttccacacaattttctgttattttcttccatctagcgcacacttatcatgaatccaatgacttaaaaatcgttagtctcaaattttataacaattccgttaggatgatttccctcacaccatggtcaataacattcgtccgtttcattttggatgtggatttggatcctacgatttaaatgagactggcggagccgaggcctggctaggatgggcaggtgcccgagctcaagccatgcagcaaggcgtagcacctgctgctgattctattgcctattttatgcaccagaccaccagtaattaaacaatagataattgagatgaatattccctccgtcctagaatataaaaagttttagagttagacacgattattaagaaagtagatagaagtgggtggtggagggttgtgattgtatgagtagtgtagatatgtgagaaaagtgaatggtggaggattgtgattggttgggaagagaatgttggtggagacgttgttatattttgagacaaatactaagagttaaaagttatttattttggaacggatggagcactaagtaattaattatcattcttagacatcagcagagccatatgcatgtagacaggtgacactagcagcagccgtgtacagtaatattaatgaacatgcttaaccaaaactagcaaattaccaaagtgccatcatttttttctttgcatgataatacaattaagccctataatcttgtgtactattttttctcaacctaaattagaacatgtcgtttgtcaattttacttgagtctatggtaagtgacatacagatttatacaaatatgtgggtacttttattcgttgttaggcttgctcaggattaagaaaattcatggcactacgccatatcctcacacttttgatggcatatctgtgacgggcttcagcactagtcagtgatgagggttacctttgatgggtcctacgggacgccgtcatcggtgaggcatccttctgcaaccctctgatggcttccacttccagcccgtcacaggtgactagttacctatgacgggttgcatccttatggaccgtcaaaggtgaggttaactcacctcaaacggccctgtcactagagcccgtcataggtgggggaggggggagttgactagggttggactaatgttatatcctctctctcccttatccacactctttctcactcactctccctctcggcttatggcggcggtagaggacccgacggccctcgggcgagccggcggcggtggttcggtggcgtgtggcggcaacggtggtgccccatcctcctcccccttctttctccctctcccccttctcttatttctcgatccggtttttcttgaagtagcaatggcaaggaggtgttgacgatgtgcggcggctcgatgcagcggtgaggagggctcgacggcgtgcgctggcgaggaggaggtgagcggcggtgccgcggcctccatccccgaccgccagtggccaccgcctctgtcccccgaccgtcgggcgccggatccacgtcccccagcctaatggaggacgaatccgtccaccgggcgccatctcctccaaccgccaagcactgccacctccatcccgccgggtgccagatccgtcctccacaaggtcatgggacgcagatccggccaccgagcgtcgtctcgttcatccccgtgctctggccgccgcctccagtcaccgggcgacacatctgccaaccgctaggtgctgccaaccgctaggtgttgtctcctccatccccagtaaccggctgccgcttccaaccaccgcctcctccgagctcctcggcatcaccgtgccattcttcttagtctcaggtcgtcgaggccatcaaggatttttcaagtgttttatatgatttgattttagatattgcaagtgtaaattggaggggtggatgactgattataaaagaaactcttttgtgattgtttttcttggagaggtagatgactgattgcttttcttcttaaaatttcatggatctaaccgatttcagctgggcactatttttgttttttctagg

SEQ ID NO: 45534 - DNA, 1774 bp, Oryza sativa
ccaacagcactaacctttgtggaacaatcacctcatccttttcattcatcaatttggaagaacagatatgtggaactatataattccttcttgctattaataacggatggatgaacctgtacctgactagatcgaacttataacttctaactcacatccttaccatacatgatattctgtccttgctccatttctatcgatattttagtaagttttccctacctaatagttacaacggtgcaggtgattcggagaaactagtgaaagtcttatttgagcttgcaaggcatcatgcaccatccaccatttttctcgatgagattgatgctattattagccaacgtggtgaagctcgtagtgaacatgaagccagtcggcgattgaagactgagctattaatacaggtagcattcttgaggctttgtaaagtgattatgctgaaactttcactgcttcataagtagtatgagtttctcagccctaaattgtgaacataaccctatggaggaaaattaacaaagaacaaactctttagatatcatatatctcagcatatgggattctgttaaaaaggacgcgaatattagggaaggatctaatatcaaataactagaaggggtgaggcttcgaacccaggtcgtctagcccaccatcttgtggagctagccggaagacccttggtggttctcaacatacaggattctgttagtatatgaaacctttcataaattgatatgtataataatcctgaacttgtgtgatttcattcacatggtgataaaagcagtcatgaattctgataatttgttgctgcagatggatgggttaactaagacagatgatctcgtttttgttctagccgccacaaatttgccatgggaactggatgcagcaatgttgcgccgtttggagaaacgtgtatccttttttctcaaaccatcttgtaatttctttgttcacgagtgctcctaaatactactccgtaattgccagttttgctattaggtaaactcccttgttttgtccgcaaatgcttgatgttttggacaaaatctggttaaacttttgaaaccttgactatcgatgaactttaaaaacttagttcaaaaacataaatatgatatgctttgatttgttttaaagtacttccaacatctcataaacttattagattttataaacctattctaataaaatcatggtaacaatcgcaccttgaagaccatgaaaaaaaattcaaatctcaaatatgtttaaccagaagtaacaataccaaagatcattttcttatgtgaggaactactgatttgaatttcagattgagaataagtgattctcttattatgtagtaaagagaatgtttgatgatgaacatttatgtagcctatttccaatgcttgccttaaatctatttgtagttgtaaatgttgcctatttccaatgcttgccttaaatctatttgtagttgtaactgacacatcataggcttcttactgaagttattgtttgtactaaaaactgttaaagaattcaatctcgattcttgtatcttttcttattgcgatactggagtttgtatataggaccacacttgatttttccacataaaaagggaaatccatccttaacttgcaattagattcttgttcccttaccagagcaagaagctagacatgccatgtttgaagagctcttgccatctgttcctggcacaatgaatatcccatatgatgttcttgtggagaaaactgaaggatattcagctctgatatac

SEQ ID NO: 45535 - DNA, 2191 bp, Oryza sativa
ggaaagccactagctagggcattatcgaaatcctcacatgcaaccaacgaaccagaccggtttatgcaaataacgtcacaacgacattaaccactcgaacggaaagcaagcggtcttctggtccaaaaaccagaaatacacggttgtggatcaatgagattgtgagaatcttctgaagacgaatcaagtttcgtgttagcgcaaatcgacgtggaagatcgaccataagaaactaattaactcaacgcaagagggtctattaattctcgcactcgagccaagcttccctctatatataagctcgtagggggctagctcttgatcatcatcactggaagatatacacagataatacaactgtctcgatcgaccgatcgacgtacgcagtagtagctagccgtcgtcgtcaagcacaagcgaaaccgcacgtaaacgcgatcaaagttaactacatatggctaggcgtgccagcattattgttgcggccgtgatcgccgcgtgcgtcctgctggtctgtatgacgacgtcgtccgtcgtcgacgcggcggcggctgcgcctgcacggcggctgctggggagcgggagggacgacgacgccgtggcggcgccggtcgtgaacgtggctgcggccgcggagccaataatgcagcagccggcccagatggtggcacctgtggtggcagacggcgacgacggcggcgtcgtgcccgcggggtccaagaggctcagccccggaggaccggatcctcagcatcactgagctagagatcgatcatcatatactccaccatctcgctatagatcattttgcgttgtatttttgctcgtttcgatctccagctttgtgtgtggcgcagtgtgtgcgtcggtgtgtgcgtgtgagtcagcgagtgtatgacgctgtgcatgtgtgaatgtactgtcttgagagagagggagagagaggacttcgcgttctctttcactccttggtgtcaataaattaaagtgccaaatagtgtactggcttggcatacgtacgttaattccttttgcagagataatgtaaacaaccgagtcacacacatatatatactagaaaaatacccgtgcgttgcaacgggtaaaaatatttttagatcgcatacattatacgctttgttttgggctgaaagctcatttcttcatttcttttcagtcgcagcctagctcgctacctctctgcttgcctacttctttttgacctagctcacaagtaaagttgtaggcccagctcgcatagctcgctgcacttttcaacaacgggtaaaaatatttttggatcgctatacattatactctttagttttgtgccaaaatctcatttattcatgtcttttcagtactagcccaacctgttatctccctctactttgcaaaatcatagggaaaataaatgagaaagtagtggataatcaatttttgtaatcaattgaagaagggaacgcatggaaggcagatcgatgtggcagcggcgctagggttcggcctggcaaaaaaataaaaaagtagggagtaaaaaaaagaacggagaaaaagaaaaagggcaaaaaaaaaaggaacggaaaaaaggggataaaaaagagacgaaaaaaaataacggaaaaggagaaaaaaaaggcggcggaaagaaaaaagcggaagacggaaaaaaaaggaaaatacggtgaaaatagcgaaaaaagagaaaaaaaagagacggacgaaaaaaaatttccggaaaccttacgtattttcttattaggtatatatatatatatatgtatatatatatatatatatgtatatatatatgtatatatatatatgtatatatatatatatatatgtatgtatatatgtatatgtatgtacatacatacacacacacacacacacacacacacacacacacatatatatatatatatatatatatatatatatatatatatatatatatatatatatatatatatatatatatatatatatatatactctctctctctctcactctctcactcacactcacacacacacacacacacacacacacacacacacacacacacacatatatatatatatatatatatatatatttatttatttatatgtgtgtgtgtgtgtggggggccagtgtttctatatatacatgtagctgaatgacacaaccttttggaatgaatga

SEQ ID NO: 45536 - DNA, 1734 bp, Oryza sativa
tacatcaagcatacatgatcagcaatttgagttcgtatagcacgacaagcaacatatggaatggaaacggagttggtatgaagggaaacgtatgcaaacaagtacataaacaaatgcaatagactagtggaacgttctgtagcacaaaagacaaaagaagcaagggaaaacataacagaccagccacagcttattgtaggtgctaactatatagttatatgtgtaaaataatttaattatctatgatctttgacagataaatgctgaggtaaatctactatctttaacagacaaatgctgaggtgaatcccagtagagtatttcaaatggcgattgatgttttttttaatacaaggcagcaataatataaaacaaagatacttcaccaaataattcaaccactatagtccatgatgaaatgtaacatattttaggacagggagaacatagattcattgttatgccaaaaaaataatcttacaatatacaagaaaagttccttgctaagcatctaaatagtacaaagataacaatatagtcttagcatatacactatacaactaaaatgcaatgatctttgtaaggtgcaaacctttcctgttcctggtggaccaaaaagcaatatacctttccaaggtgatagcagacctttgaagtacctacagttcaaaaagaaaataattgagaaccaatggtaggtccaaaatactgatttctaacacaagttatagaagccatcagataagctaatttgggagttttttcctgaatctaattagcaaaaaacgatatagaaagcatgcggtgtaacaactagcaaaacgaatatacaggttagataaataattgcctgactggtaaagattctacatctaacaaaaaactttcttcagaagataccaaaaacacacacatggggcattgtaccatcaaactgaaagagttaaagtaaatggtatgcgacatattatcatgaataacagtggttgcttaaatgcaatcttagggagatctgatctgaccttttaaatatgcaaacatgaccatgcagatatgtgaagcatcaccaatcacaaaattcgatgcaagaatgcaacattcttttgagccacgaatgtcaggtatgaaaatattttccagacatgttaaacgacaaagttacttgttcaaaagtgtttagatagttcgtctgcctatgctatacgttgatgaaaggaagttaggaagagacacatcttcttggtattgcaggtcatatcaagaattttgagattctataagcagaaaagagttaggcttaatagattcgtctcgcagtttacaggcggaatctgtaatttgttttgttattagtctacgtttaatacttcaaatgtgtgtccgtatacttcaaaaaaaaatttgaaaaggaactaaacacggcctatgttgtgagcatatatcatatatattatttctgtgagaagacagaaacctacttggggtattttataggcatcacaactgcttctttcagaagacgctttgcattctccaaacctttaatgctttcccatttgacatctggactcccacgaatgatatccctattggcattacaccaagaaggtatggttataagtctgtatacattacagtaccaaatagataagtctggccacatttaccaaaaggcagtgtcacctcaacaatgtctcagctaaattgcgcatttctgcagattcaatagaagga

SEQ ID NO: 45537 - DNA, 5533 bp, Oryza sativa
aaaaatgaaaaaactaatgtttacatttgagatacttatagcaaatactattttccatagtatatgccagacataaaactgcttaaaatgcatgcatgcagacaactatagcaacaaaatcatcataaggttgctatttctaaggtttggacaactgaaatacaatgcatggttttgatcccatattagctaatgcccaaatcaggatcggatcaaccactttggtcacaattaaatttcatcccgccaacgaaggagctaacaattttacaccagacaaaaaccaaataacttcagaggaagttttcacaattcagatagaaaaaatgcagtcaaactggatgtactatactccatagaaagcaacgagtcttacggaggcccagcttcaattgctccattccgcagctccaccttcctctcctggcaccaaaacagagaaggcaaaaaaaatcacaaaatcatccctgaagcagtaacaacttatcatccagagcagaggggggatatagagagagaagggcggacgcaccagccgctcgaactgctcgaagacggccaggtcggcgccgccgttggcgtgcgccgcggaggggcgggtgctgcccgcggagccggatccaagcggcgcgtagccgcgacctccgccgccgtcgccgtcgccgtcttcatctcccccgggctcgcggcggatgccgaggcgcacctcgtagtagacctcgaagtcctgcgcacgcgaaacggacacgatctcagcacgcgcgacagcgacgaagggtgaaaaagggaacaggacagcggggaggagaggagaggaatcgaatcaaacagaaagccaaagggagagagtggtgcggagtcaggtcacctcgaaggtccagcgggtgatggacggctcgtcggcgccggtcatggcgatcggattcgatcgcccgcgcacgcccgcacgcgcgcgcgcacgcgcggcgcgagagctctcctcctccgcgccgcggttgcggtgcggggcaagcggacgagctggcgatgtgaggaggagcggaggcgctgagttggagttggacttgctacaactgctaggaggagaggggggtagtcgctaccggggacaggcgggcgaatctgcgctgattttgcaccgggcggggacctccccacttgaggctgacaccgtgggcagggcgacccgctaccgaccacgtgggcagggcccgcgtgtcagtgatgctacctgcagtggtgcggctatagctgtagctacagtgctactactgttgaagcaagtacagtactactatgataaactcttaatcgcttgctatgtataaacagaacaactaaagatgagattagacttattattatattactaccaatctaaactactaaaataggtaaaatcaacccatccatactagtactatatttttatattttaaaatgaagatagtaaacgactatatgaagaaaagtgagatgccgctcttcatacaagagggaagagggaagatgagagaataagagagtattgcagatttgcattttgcagtaatggattagaagctagtttactagtactagagatttgtaaactttaaaattgatgagtggatggtgtggataaaattagaggttagctataacctccgtagttaaacttgtttaaaatgctcattgtactgtttgaaccaagtgctactagtagtagcactcctgtttaaactttaaagagtacaagtgaatgaatgcacgagtcgttagttccaaggttgacatagcagcttcagaatattccagcgagagagatgttccaggccttcgctgagttgcagggaagaatggtcgttttctgtttaatttaatactccttccgttttttaatagatgacgtcgttgactttttctcacatgtttaactattcatcttattcaaaaattttatgcaaatgtataagatataaatcacactttaggtactatgagtgataaaacactcgtagcaaaataaattataattacgtaaattttttgaatgagacgaatggtcaaacatgtgagaaaaagtcaacggcgtcatctattaaaaaacggaggtagtatttatgggaaaactggaaccatgctattataattttgcaaaatttaagatatgtcatcctgaatcatatgtcattgactcacatgggtcctacgtgttattgagataccgatagcatatctcaaactttacaaaattataatggcatggttccaatttacccgataaagccacgtttgcagcatgcgcagacaggcgttcgcttcgtgaaggctccgctgcgtgctcacaggctcacagccatccacggttccaatcatttgcgagtgcgtgagcccgtgggcgaccccgtagcttattcccgtcaacatcatcaaattcgcaagccaaagaaactgaaatggtccagctaatggctgctttggatgaccggggcatgaagtacgctgtttggaattttgacgagcagcaattaaggtcaaaatcccctcaaataaaaatcaaaccacaaaggccagaaaaaatataagagaacaataccatgttgcacttatgttcgccgaactgatactgaaaaagaaaaaacaaaacaaaggggcacctgcgacagcacatacagtacatctgccaaatcgaaacgcacgtttggaaggcgtatacgcttatatatgcagttgacaagctacaggcatacaagtacggtagtactttgccaacaaagtggcaagacgatgccacaagtcgacgacaaccgcaaccgattttgccaaatcgtcccgtcaggcttcgtcggaacgatctcccatttcccaggtaacagaaactagagggtacaaagtgcagccacacgaacaaagatccaatttcaacaatttaagttttccaacataaagtaataaatatattggaggagcaccaagttctaccacagatactgattagtcaagggtgccctagggtaaagggaaccaaccacatgtatacagacaaataattcaagcggtagtcatttaaactcccttccactgccaatatctccagtttgttcttatcaagcaaatggcatttgattaaggctaaagcatgacgggttattacatcacgagaggcattgggttttatgcaccgctggcatacaggcgagtccactcctttgctgcaaatgccagaccatcgcttatcaggcaaccaataaaatcagagtgtgaggggagacactgttaactggattgctagcttcaatttacctgtttcaacagcttctgcttcattggctttccagtgctttgcaatgttatcagagagaggatcatcagggtttggtgcacttaggagtgcctggatactgaaaaaaaagagtgttgtcacaaggtaagtatagcaaagtgatacccctaacttccaatagttgacaatgctcaagagtttttgttggaaaaacacatcaagggcagtgataaaattactaaatgcaggtaagctaacaaataattcaaattcaacagaaatcatgtcaatcgtaataagacaacagcttagcagacaaggaatttgtgcaggatataaaaagctaatacacatgtgcaggcaacgggggagagacctcaaaagaactgtccgaatctgaagggctgggctccatttgtccttgagaatgtcaaggcatatcctaccaagctacaaaagtaaacctattaatgaataaacaatgtattacgaagtaaactaaataacaaagaggaatgtgactgcaaaccttgtcaatgttggggtggtatattttggtcaggaacctaacctgcatacgcaacaaagaaaaaatggagactgaggtagacaataatgaattatatagctttacacttagggagactgaagtagacaataatccggtatggttgtataacatatgagtaatatttcttcacccttccaatctatgacattgtcaagccaaacagactaaaaaaataactaatcaaggtataatttggctgaacaccaaacgaacaatgtgatgttaagaacacctttaagaacttgaagcaaaaagacggtcaagagaagcaatggcgtgctgatgctcaggacacagctaaaagttcccacaggaccaaaagtatatcttacaaccttggtccttggcacaggatctcattgcaaattacatctcaaataggcagggtttgcattatccctaaaaggaaatcaagcaaatgtaacaaaactattaccaacaagacatcacatataacatataaaaccaacgatggttccagagcgacacgattaaatatgggtaactaaaaattaggctataaagaataaaaatttttttttgccaaagaatggttcaaacaaattaaatgtttcagctactttcctgtatttggttatatgcatgagtccaatgtcaccaaattaatgctccgcttcacaacacaagtcaatgaatgcagaaatgtcctgacttttaatatgagtatataaccacacgcaattctaaatacgacataattagcttgaaggtatacagtccccataatatcatataaaacataaccaaagtttatctatgtcttgttacctttggagcagccataggatattcctcaggtaaaaagagttcaagcttaaaaactccacctgatagaaagaacaatatcaggaagccaaatgataatagaataaaccatctaaagctactaactgttaacacccattatatatccaacccgaattaacgcaaaaagggtttaagaaaggaaatatttaaattatacaccacaacatgaaaagccaacaatatcaatactcataattagtctaatcaaataaatcgaagagatcaatttggttatggaaaatcaagggcaacctttgccgcacaaagcatcaaacaagttaacacataaaagaaaagcacttataagtcacgtatataatccgagtttagaacattattgctaaaagtcactagtgttttagcattactaacttcatactagaaagggaatatgagacacatagaacatgcaagtgcccgccgcccgagaaactaaaactggtaagtgcaaaagaaccagcctaatcaagcaaaagcaggcttacgaaatgcgtgcccgtccatgactgacacataattaacacttctagtaattgggtttatacagaatcacccaattctgcggtatacctagaaacgccctaatcgaccaccctctacaacaaataacatatccatcgggagccgtaacaccctctacaacaaataacgtatccatcgggtgccgtaccttcatagggggactgtgccgggccaaggatcatgacgttgaagtagcgcatgttctcctccgacggagacgcgctgattcccggcgctgcacaaacaaaccaacccaaaaccatcagaacaacacgaacccaaaccacggaaaaacacaacaccatcgccaaaatccgcgatacataaaaaaaaaaaaaaccggcccg

SEQ ID NO: 45538 - DNA, 4848 bp, Oryza sativa
agatacagtagggtttttttttttaatacacgacaaacacacatgcgcacacacccaataccaacacttacactttatgaatgtgcccaacggaaccagaaatacatctttgatctcataaaaattatgttgaaagatcacctacttgtacataataatatatgttaatcataaataaaatattgaattataggtagcacattttttagaactaaattttttttctcggggatgagattcgtcggttcattgaataaagtcacttaagaaatatctttagcatctcgccgaagtgggcaaggaagaggcagatggagagaacttactagctagggattgtggatgcatcttctacaccactttaactgtgacgaacattaagtgcaaaccaaaccatctttattgaatcagcaatggttgggtttagaaggagactagcataactatgtctcaagttaggcgagagagaatgagggcgatcataagggtataaaataggaactcaagttgattaggaagatgggtgattagtggggtacagaggtgaggaacatggtatcgtaacagagagaggagtggtgaatcaaagagggagcgataaaggatatataagggttaaggggcataagtagcagaaaaaggcttatccactggatctcttcccggatacccaaaaggaacctccctctcacaaataaagaagacaccattgctcaagaaggagaacaaattacatgaagcacttgtaaactagatgttattacaatattgagagagggagggagaatatctcccaccaaacactaatactctctaaaatcttttacataggtgtgcttctccgtcaatataaattaaaccttttatctctttgtaataaaaaaaaccccaaaatcagcttaaccatatctacttttctcaagctacttcatgtgcttttagcaacaatgtgctatggttagagagcgcgcaacatgctaatcacaaaaattaaaggtatcaagatttctttttaaatatagaagtttatctcatttcttgtggattgaactaattcatgtgaaaaaaaaactataacttcattcgtccccttacaaaatctaattgaactattccatgtgaaatcatgggttcctatggagaccttaatatatgttatatttaaattaaggtgaaaaacttaagaattccttaggacatgtgcaaagtgaggtgataagggaggtgtaattaagaagttttcggtatctctagatctagagccaaacattgtgcagggtgaagctaacatgaaaaatcttggaactaaagcatgtccaaatgttgatcttaattaacaaatacgtaagggcacctcatgtcaactcggaaacaagcacagtgacggtgggtgttgtactttctggttctatttaacataacaccatacttttgaaaaggaggttaaacacaataagaacatttgataacctatgtgactatatgagtgagattaaaaaggttatagcccctcacctcctcttatgttggtaaaaaaatttccatgtcttatattgtatgcggcattgtaaatcaatgtatgagattaatccccgcaaaaaaatgtatgagattaataatattaccagacttttttttatgagggaatagaataagggtgtatttgagaggaggggaaaaggggaaaattgagattatacgtaaaacaaggtgagctattagcatataattagttaagtattaatcattttaaatttaaagaatggattagtaggatatttaaaggaaattttctatagttttttttaaaaaaacacacaccacttaacttaacagttcaaaaggcgtgcgtatgaaaagggataatttttcttcctcttgtgcatgcttctctgaaacacagcttaaaattatatatactccaacccataagaaattacaaataaatccatttcttgccggaagttacattgaaagattataaggaagaatctaataaatgggtccttgccattgctgaagaagctgccggttgaaagcaactatggttgggcctccttgctggctgtggccagaggtggagaatggccgtgcctagaacaaattcaccatcgaagatggaaaaaaaacgtgcgagatgttgctctaccacttttgcagtacgagatcgaggaatacaacttgagtcaaatcaaatcaagtggtagtagctcaaaaggtagctaaacatgaacgctcagcaaagttcgtgaaatttgctaagttaattaattagttcgctacttgtttgggagtacttttcagaaacaatttgcccacttccagctgcattggtcaactactccagaaaagttcatgccttttttcatcaaacttgtggtagatggacaagaatctggcaaagaaaaaaaaagaactactatcatttagtaggagtagtatgattctttgccagaggaaagacctggccttaatcctacgctatctctctcctcctctctctcatctgacgtcaaccattgcgtcatttcggttcaacggcgcacgatctttaatttctccccaatttcctttccttggggaggtagagaatcacacccagaagctcacgcaatccaacctccgcgacagcaacaaatcaggcttaacttggaacaataatccaaggaattagaaagataaggttcttttcgtggctactgatagtctgatactactacatcgagtgcagtatagtagtatactaacccggctatcagcaacacaatctatccaaccactgtttccacgtatgcttttgtttattgggacggcaacatacgtaagtgagtaggatttgataaatcctttgcagtctgtcagatttgattaagcgagagtttgactagtcgattcctggttcaccaaccggctaggtaattttactactggagataaaatgataatgttttgtgtcattggcatcgaaatgaatcgggagcgaatgttcctcctgttccgggtaggaaaaggtcaaggtcagtgcctaattgttcgcctaatcttgcagaacgcatatcaaatattacaaaccttagattaaatttgggaggaatttctgttcgagttcatcttcgaccggtgtattgtcctgtaatgtaattattatagggttgcaatcaaagcatctgggtgcattctagaagttgagatcagtgtcagtccttaatactttgtccgacaaacgacaagtgccagcttttcctcatagagaggcctgatgatgtaggaaagccaactgatagacttgagttgactttacacacacaaaaaggaggaggaatattaatctgatggcgctttatactactattacattaggcgcaaattactgctgctactaaataccacggctttaacgagacagcaacccgtctgcatgattggagtacatgccttgctgcagcctgcatgggtggcgacctaacctggaccgacgcgtcacttcggggcttcaccctgtcggctctcgcggtctcacccgtactactggctacacgaacccaacccacagtgctccgcctgacggtacggtgcgtgcccccattcgctgcacttgcccatgcatatgcttgtctcgcagcgcagctagcagctagctttgctcacgttgtgcacggcgttttttttttctttccatgacctaatcaacgaaacgacgcctcggcttgaagattgatttctggcatgttgtgcacgtttcgccgctgaccttgagccgcttggttgccgagaaaccacagctcgatcgatcgatcgatcgattttgggggaaatggggatggaaatctgtcgatctgataggttccatcactcttggccatagaattatcttttctcgtcgtcgcgctcacggagattgctctcccgtatcttcacgtagcagcggacgcgcgcgcacacggcagaaaatctccatcttgagatttaagaataagatcgataggctcacagtgacactcaattccgatcccttcgttcggaggtttgacccgatatataataattagacagtgtatcattcctgagtatccttccaactttattaccaagtgtttcgagtctgttccacacaagaatcattaaccaatcgccacagaggccgatcgatctatccagctttccagctgctatccgttcgaaaaagcttcagaaaagtcaaacgacaagaagggcaataaaaaaaaaagggtttcagggtcaacacgactgagagtggagttcattggctgtgaatgaaacaaacaatcgggtcactttgtgctgcaaaatcttgaggccacatgaggccacgtttcccagcatttccacatgattttccggtggatatatattgcgccacccccatgctccatctctccccctcctatccatctccacaggattttaagcgactaatttaatttgattatagttaagtttagttaattattgctgatctgaaaaaaaaaagtacacacagagtcgtagagggagaagtaaaagcgagtgggatggccgtctcttccgctatataaagggtcgcttcgcccaaccaaccccctcctcccccgcgcatccatggcgaacctcccctccaccgccgccgccgccgccgcagacgcctccgggttcaagctcttcgggaaggtgatccagcccgacggacagcggggcgtggaagagagcgcggcggcgcaggcgccacctcatccgcatccgcctgcgccgccggtgatggaggcggcggcggcggcggcggggacgtcgcagactctgcaggcggcgggcggtggcggtggcggaggagggggaggagggggagagccg

SEQ ID NO: 45539 - DNA, 2041 bp, Oryza sativa
acaaattcatgtgttgcgaaaaaagctgttttatggacatatctaattctatatgcactacagtagtaatagcatgagggggagaggcaggagtattccaggaggaccaggacaaagggaaaacaacaattcatcttccaaataaatccaaataaagggtaaaacatcatagtaaaaactttatagtgataacagttcagctgttcatgatagtgatgatatggtgctagtttttttaatttgttctccatgtcaaacaataaacatacttcaaagtaattgtctcagattccatgtgcagtggttgtgattgtctttaacatgccacttttaaacaagtaggcactggtgcaggtgcgtttttcacacagtacacggagcaatgtgataaaggtcatatatgtactcccctcattccagttaagtacttcaaaagagtctccagttcatgaaaaagaaaagtttccataggattccccaagcttactgaattgtgacttttaaaacagctgtattgacagcctgtgttattcgcattcagaattggtcccgagtcctgaccatatatactgttaaatttaagatcaaccataaaattcggtggtcactgtgctaaaagtttagaggtgtacatgatttttgatgatttacgtgtaatgttggatgaagttgactacatacctatgtacaaactttctattgtgcagctataataaaatttggatcaagattcagatggtatactcgctcctcaatgactgagtgtgcatcttatcttggtaacatccccagatcagattcttataaaaccttggcctgtaaaaaatagtaacaacttgatcaggattagacagacagaaggtacttcacttcaaaaggtgtacaatcatatgcgcacttaaagaaattctgcttcaaaggtacgatatgcgtaaatcttttaaatttattcaacagtcagaatcacatgcatcagttgtaagtacattcatagcaatttaaaaccactgttgacagcaaaagatatgtcatcattctgaattggtgtctactccttcaagtctatggttatgcggcttcaaaggcaccgtgaggacttattactttctcaatggtcacttggacgtaagtacatgcatcggctgcaagcatactcatagctacttaaaaactattgttgacctgacacaggcaactattactactgtgttgaagaaaggataaaagcttgcacctcagtatctccgtgacctatcttcctcagggcaactacctttaattctattcaccagaactatgttcaagattcacgattcccaactgcaggtatagattcttgaattgcctgagcaaatgttgcaatcttgtaggtgaaaaacccaacaagcatgggtatcaattccaggtgcatgaagccataatctggaactaaaatcctgcatcagaccagcaagcacaggtatacatgtaagaaaaccatacgttctactatttgaatattcaaacatcaaaagtttaataaaatttcatctacttactcattccatcggttatacatcatcacaagtgccactggaataagcagtcttggttgggcagcagcactcctgtaagcatgcaagaataaaataagatgcatgtgagcatattttaaaagttgcctagcatttgctgaacatcggtcacattccgttgtaaaatttttaaagaaaagatagaggtgaccaacataattgaagggcattgtataatacatgggaggggaatgttcagatgatgaagttttatcattttagatttctttcaagataaacccctaagcgagatataccaaactaaacgagttctacaagaccttgaattaataaactgcagtgctataaaatattaaaatgagatcacaaagccttagtagctgagccaaactaaaccaattatgagaagaagtctactcaagtgttttatctttttcttttctcaaataccactcaagtgtttatccacaagaccacaaataccaattgaaaaacaacataatgaa

SEQ ID NO: 45540 - DNA, 5523 bp, Oryza sativa
  unsure (1)..(5523): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaggacgagagtcaaatggaaggccttggggataattgcactcgtgttatggtctggaatttcgaactggaacctcctcaagtcaactacccaattggctggctgctgcagaggaatctggatgctgttgtgccaataacataactgtcctgctgctcctctttttgtttgccatcctagtgtgaatgatgccttcctgaacttggtagcgtccaggatcatgagaagctgctctgccaagatctggtccaaataatgtcatactagtaacagttgaaaagtgagaagcctgacaaaagaaagtttttctctctgttgcattcttttctatatgttcattttttccccatattcatccagctagatatagccatgtacatttcattttttttctcgtttctgtccgttatatacatacatatcacctcacagatgtgaatgttcccctccattggaactgttgaagagcaaagcagatactctctttgatatacatgaacaaaggttaaatcaaaaccatagattgtacacacaatggtgtgcttggtcctaactcgcaagttccttttcaatatttcattctcctcagctgcgttgcaccttgctctgttctgatctctgaattcctgtcaatgcaaatatcgtgttgcgtgctaatgtatcatgtattcactgagaatgttcgtggcttggcttcctataccagctgtagtaccgaaatttccctatgtaaagcctcctttggaacggagaaattcgtggtaattttaagggatttgaactaaaatcctactagtataaaattaatgcattgcaaggtatggtcagagctcagcattttcggaaagcaagcaagctcacctgacgtggaaaggctaacgggcgatcgattgctgtcggcgatcgttttttttttctttttctcttttagtaagtttatacacataaagtttacacatctaaagtttatccatctaaaatttgtaaagcgaatgtttataagttaaaagtttatatacccgattcaaattcaaattcgaattcaaatattttatattttcctcttttagtaagtttatacacctaaaatttatacacctaaagtttacacatctaaagtttatccatttaaagtttttacaacgaatgtttataagtcaaaagtttatgtacccgattcaaattcaaattcgaattcaaatatttgatattttcctattttagtaagtttatacacctaaagtttacacatataaagtttatccacctaaagtttgtaaagcgaatgtttataagtcaaaagtttatatacccgattcaaattcaaattcgaattcaaatattttatatttttctattttagtaagtttatacacctaaagtttacccatctaaagtttatccacctaaagtttgtacaccgaatgtttataagttaaaagtttatgtatccaattcaaattcaaattcggattcaaatattttatatataaaatatttctatacacaaagtttatgcatgcaaagtttacggtataaagtctatgcacatgaatgagagtattagatttttttcctaattttcttttactattttttttaaatttatgatgtaataaaaaagtaaaaaagagagatgaaagataagtattaggagggagggatgggtgatcgctaggaggagagggaagcgatcacccgcccactagcaacctcctttaaaaaccatataaatagttaccaattttttttaataaattgataatattcatataatatacatataccgctctacaaaatattaagttccaactcaaacttatacaccatataaaatagttaccattttttttaaaaaaatgataatattcatataatacatataccactctacgaaatactaggttcaaactcaacttatacattgagatataaaaacacaaattcagatacaatatttttttacgggaattcagatactatacagaatggccatttgtgcttgggcccaggagtaatctgaaccaaacgggccaactccaacgatacgagtgggccctttccttctttcaacccacggaaaccggaaccccaccatctggccatctccaactccaatcaggcgtccaaatgcaaaaatccgttaccaaaattatggaaagcctccttccccacgccggctcattctaacaggctgcgttacccactcaccagtcggtatgccgtatgccaatcgggctgcgccctgactgcttacgacgatactatgacaaaataaaagcgaaaatgattatccagtcggttgcgttgcattccattccgtgtcggacacgatgagtttgccctgcgttcgcagcgatcgccctggactccgatcaggtctcgaggcgcatacgcattcgcgcctataaatccagggcatatgcgccatccaaacccccttccatattgagttcccgagggagaattcgatcgaagaatacgagcaaattaaaatcgatcgcgatacttcggtgttgacgaaacagcgtgatctctctgccccgcaatatgccgccggctgctgcgggctactccgccggcatgaagcggcctctcgccgcggtggcgccgtcgtgcgacgtcgacgggcgcaatgccgctgccgctgccgctgcgaaacggcgggaacgacgacgggaggccaagcgggcgcgcgcggcggcggctgcggcgacgggcgctctggtcccgtacgtggcgcccatcgacgcccggcccatacgcgccgtcccgctcgccgccgccgcggccgcgcggaggaaggaggccgacgaccaggcggcggcggtgccgtccgcggagccggcgtggatccgcaagatactgctcgagcggctggggatgacgtacgaccagccggtggtgttcatcgcgaggaagacggtgaccaggaccgacctcgacccgcaccagaaccggttccgcctcccgatcttcggcgtggagcgccgcctcctcccgatgctcaccgtcgacgaggccaaggaggccaacctggtggagaacgacgaggagaagggggttcctcgcccgaggccgaggcccaagaagaagcgacgcacggagaaaggcagcgtcgtcatcgccgccaccgccgccgccgacggggagctgcagaagccgcagggaacgacgccggagacgaacgtggagggagaggatcaggctcctcctcgcccaaagccggtgccgaagaagaagaagcgacgaacggagaaaggcagcgtcgacgtcgccgacggtgagcagcagcagcagcagaaggggagggagaaggagccgaggaagaaggcgcaggggaaggaccacggcggggtgccggtgacggtgctgcacctgagcggcgccatgaaggagctgcggctggtgctctgggacagcagccatggcaccatcatcaaggggaccggctacatggacttcatcgccggaaccggcctgagggagcacgacgccgtgcagatctgggccttcaagcgccgcgggttccgcctcttcggcgccccgtgccggagagccgcttctacctggtgatcgtcggcggttcgtggcgcccgctggaagctccaccgccgcagtgcatgctcccgccatctcacgcgcctgtggaagtatgtgcttaggcaggatgggtatagactgaatagagtagtgagatattttacagtgctggcacctcccaatgtactgtacatcccatctctaactcatctctcgagactacgagtatgtaattttttttaaggataataaattgagatttacaaataaactttaataaatgtgtatttcttatcctatatgggttatttttcttcttagtttggtgttcttaattttatttgaacttcgctcgttttagagtgctacatctatctatctatctatctatctatctatctatctatctatctatctatctattatatagtaaaagtccattaaacttcctacaaacgctcctaagccgtcacgtagcaattctataaacactcctaagtcgccatgtggcgttttaatatattagaaacatctggcccttaattttcatttaaattggtgggtccataattttacaccattagattagattaaaaatagaccctcatacgtatgcctccctcaccgcctgcaagtacgtacatatgagtaagaacgtaacataccccacttttttccttttttattccccttcttttattattttgctttacctaatatacctccataatattattggcgtttgaacatatgtttatttactaaagaaatatgtaattatcatttattttgttatacttttccattaaatttcctacaaacgctctcacgtcaccatgtgtcactctacaaacgcttctacgttgctaagtagcgctataataaattaaataaaataatataaattcttagttaaaataaaacatttaattctcgattttcacttaaagctaagagaccattattttagacaattaaattattatatctataaaaaataatctctccctcctaatatcccgttcaaattattaaatctataaaaaataatctctcgctcccaatatcctattcacatagcctagtggttacaagagcttcagtagcacctgaggtcctgggttcgactccccgtgggagcgaattttccaggatttaacggcgttgtgcttttagtggtaggcgacgtacccgtcgacagcgagacgcctacggtgacttcatcaatctctccaggatttgccggcccagtcttcgaagatgctcataggagtagggtttgcgtgcgtgcgttcataggggtgagtgcgcgtgcgttgtgagtgtctgtgttgtactgtgtaattctcaaaaaaaaaaaatcctattcacatacaagagaaaatcgttgcgtacaattcatctggttaaaaaaaaatcctattcacatacaagagaaaatcgttgcgtacaattcatccgggaaaaaaaaaatcctattcacatacaagagaaaatcgttgcgtacaattcatccgggaaaaaaaggcaaaagctatacgtatgtacgaacgaaataaaaaccaaagatattgataactatgattgaaaaaaaatcactgccaagattaattataaaagcaccagcccaaacgatcagccaagataatcaccatcagctcacggcacaagcacgtatatgcattatctgctcttcttatttttaggttgttgagatatctacagcataataaaatctaaacaacatttgatttatatcttcgattgaatg

SEQ ID NO: 45541 - DNA, 743 bp, Oryza sativa
tgcgatcctcgtaacatatctctacattcctggcaactttggtatggagcacaggcgataagcagataagcttggatcatcaaaccgtgggtactgtactgagcagtacattcagatcaataataaagtcagaaaacacaggtactctgctcaatttggttgcatctcaaggaagatctcaaatgtcaacttttaccgagtaccccggccaaaactttcagagaaacaaatgatagatccgaggacacgcaacggtcctgatgaagtatgacagcaaaactagtcctgcgattcaaggcatgttcttctataagcggagacacattctttttgtacattcatgaaggttcgcggttatacagccgcaatataagaagtcaatatgtgtaccctcgccggtttgcaaaatccacaggctaatttttacaggttttacaggagaaacttatcggcctctgcaggcaaggagtgagctggttcgtcagcttgacttcagctgacggcatattcgcagtcgagcaagcgggtaaggatctcctgacagctcggccgatcttggggctctgcccaacaatctgcatcaaacaaaagcaaacactttgctaagctataactgaagccgatgcatgttggtgcgacatgactctgaacactggaataccccaattgaaacatctgtcatataaaagcaccattacctgcaattaacttgccaagaggtccttcaggaatctcgagccgtg

SEQ ID NO: 45542 - DNA, 797 bp, Oryza sativa
gacacacttgctgtagctgttgttgcaactgaaaatacattttgccacctatagtcatcttgaaaagtaaacgtagatctataattctatattggacttagaacctcagctgcaaactgattcttcatttttttaataaccgatagcagttattctgctggttttaacaatttatcggcattttactgtcattagttgctttcgtgaccataacttttactctaatcccgatttctcactagatagaacatacataatcacaattgcgaaaagcatattcttgttgaattaggcactgtgtgttggtatatgagactatatgcatatatatttttgatagatgaaccaataggctggaatttagttcccacagtataattatcggtgtgagcttcaaatccaattaacttactttttgtaaaacaagctgaaaaaactttatcaaacagccaggcataagaactcagcttgaacttgtctatctgtaagcgccatcacctgtctatgcttgtctcatgcctctagatgctttgttttatctcttaacctttttctgatggcaactgtaatgcaggtcgagaagatttgcaaggttgcaaacaaaccactggttgttacctacacaggactgatccaaacctgtatagacaatggaagcatggaaaatgctaaatacatatttgacgaaatgtgcaaatactgctcacctaataacataacatgcaacatcatgctgaagtcatacactgaacatggaatgtttgaggatgcaaaagatctattggagaatattctca

SEQ ID NO: 45543 - DNA, 2662 bp, Oryza sativa
gaactatgcttagagttcagattttatggacaatgatagaatgcaagatatatgatcattttcccattaaactgcttcgttaattatttggtgtagctattcttagccttactgcctttcactattcaggagcagttattggaagatgtatgggactacatgtgccaatatggccgagttccgcctgcccccatgataatggaaagattttgcctgaaactgagacaaggggacacagtggcggcgatgtcctgcatcaatacctttcaggagagcaagatacgcaatgtttcatccatgtcctggttcaatctgctgaaccgtaatggggatcgcttgaaggaggatattattatcaagctacttcatgaactcaacaaccttgtaagctcaagtggtcactctgattctttgtatcaaaatattataagtagctgtacagaattcctttctgtttccacctctgtagaaaaggcgtcttctgatcagcagatgcttccctgtacgtcatagctactatatattaatatgccattatctaaaagaaaatcagagtttggtcattggtcatttggttcgtgctccaaaaagtttgatcatcaaatccatcggtttgctcactgcatcatactattctacgaggataagtgatcgtatgcatgtagcttggtgggctagttatttgttgggattgcatatcggcagaagtaactaactctgaattggtcgtcatcctgagatgcatggcacttcgcctcgttttaaacatcacctactccgctactcactacccgtgtttctcatgttgatatcaattttctcatgtcagtatgtcagctgcttggttaggttctctttggttgttccgacaaaactttgatactttcagctggtataccaaagaacacatggagaagagctacaggtgtgaaaatttctgggtcaattacacacatagatgtcctcgcataatgaatttacgcatgcagccgattgggaactctcgagcctgacgagtagtccaacaccaggcacttgtttgctcgcacgttcggacaggtctgaatccatcctcttgtctggactctgaagcctccatcttgcgacagtcgcctgattggcgctaccaaccgcgcgagataaggttagctcaactttggagaagaaaacgttgcatctgatcgtcgtgtcagtctccatgagcagtgtctctgtacccctcttgttcttttgataaagaaagaaatttttgaagcttcgtggatatttctattttccgtcaggctagacatatgttaagattaactataagatttcgggaagaattttaaataaaacactctaattttgttagatgtttgaaattgttcctggagaatatatacaggtgatcagacagcaggaggaggatggcgcgcacgacgaaggcggctgcgcgacgtgggcgcggcgacggcgtcgtctccccaacagaagaggaagttatcattaagctggcaaagtggcaactgatgaataaaccagaaaagaaaaaaaaagaaaagaggaaaactaacagacggacagctaggcccgggcatcaaataaaatcgtcggaaaaaatcaccaggaataaaaaaattccccttcctttgcgcgtcccacctgtccccttcgtgggccccaccaccgcacgtctccaccttcccccacctcgccgccggccaccgcctccgcctccgcctccgccgccgccgcctccacatcccattccccgtgccctcttccccaacccccctcgcgccggggggcctctgcgtgaaggaagagggcgctgcgacgccgaccgcgcgccggtaatgagctacccatccaccaaatgcgatctgttcgttcgtctttagatgaatcgatcgaggcttagagccttagacccggttttgctggccacttcttcgttatggaagagagattgttttatttttgtttatcgttttcgagtgcaagcatttggcgccgctaagaccccctgattgcaattggtcactaaacaaatgtcaatgtgaggaggaggagggtattaaccctattttaattccatgtgtgatgatgagcacgaaagggattttttaaaatgcgacgaatccgtcgccggcgaagctgaggcccctcgacagcgaccttctcgggcttcttcttcttccgcgcgtgtccccatccaattctttaatccggaatttcgtactcccggcgtggaattgtcctacagttgtcccgtggaattccgtccccgctttttatttctttaagcaacaatgcaatcttggtgatgggagagattgcaccgtgatttttctttgtaattttcgatgtttttttattttataatcgatttcaatgtgttgttgcgtttctttgatttcgccaactactacttgttcctccaagaacggacgaacgctgtttgggctccatttcctctctgctcatctcctcctccgttgccccaaccaccgggtgagcagagcagccttctcttctcttcttctctcgatcgaatcctccttttcggtttcttgattcgaatcgcgtgcggtgtaagctagataggcagtggtggccaatcaggcagagagaaaaagtagctaaagctgtctccttccttgctttggggcgatgcaag

SEQ ID NO: 45544 - DNA, 3730 bp, Oryza sativa
  unsure (1)..(3730): unsure at all n locations
tttgcgtgcgtgtggtttccaactttggctcgcccctccgggcgcaaacaccacaacacctcgcgcccatgcgaggacgcagccatccatccatccacccagcccccacactccttcggcgcgcgcgtccgtcctcgatcgcgcgcgcgtcgacgagctaagccggcccgggaaacccaaggcccctctcccttcctcaagcgcgccggcgggcctcgccggcgcgcgacattgagctcaacccccccgtcgtagtcgcacgtcgagcgccaccaccaccgccagcgcgtcgcatcgtacgtcctccacgcgcggcgccgtgctaggcaacctcctctgctgatcgcccgcctcctcatgagcgtgtgacctgctgtcgaatggtgcggcggcacctgctgcgcggacacagcctggacaggttcctgccgatcaggagcctcatcatgtcgtccagctcttccttctcgtcgtcgtctccgtcgccgccgccgccgtcgtcgtcgtcgtcacggggaagcagcagcggcaggtggtgcggcgtcagcgtggccgaggaggacgaggacgatgccgccgtctccgcgacgacgaccccgccactgccgccgctgcagaagcgggtgctgtcgaggagccacgggtccaaggccaagccgctgggcggctccgtcgaccacctgccgccggtggtgccgccatcgtcgaagaacgtccgtgacagtggaccgccttcaggtgatcaaccatatgcaaaatcacaattgctcaaatcttcttggatcaaccgcttagtttcgccattgatttgatcgatcgttcgatctctgttgcagagattgatctggtgaaggagaagttcgccaagctgctgctcggcgaggacatgtccggcaccggcaaaggtgtctcctccgctcttgctctctccaacgccatcacaaatctcgcaggtcagtatcacaccactcatcacatgctatctactacaaatctcttgtgttcttgcctgtcatgatgtttttttttcccgttcttcaccgtggcaaaatctgcagcttcggtattcggggagcagcgccggctcgagcccatgtctgccgaccggagagctcgatggaacaaggagatcgactggctgctgtcggtcaccgaccacatcgtcgagttcgtcccttcgcaacagggcggtnccacggngnaatggaannccaaagncatggaggtaggccatccacaagatcgttgcaacctcattactatttcatcgtgcaattcgcttcattttcgtccttgttgtcaaccaggtgatgggtacccagcagcgcagagatcttctcatcaatatcccggcattgcgaaaactcgacgccatgctccttgtaagcataatagcatatacaaatgtccaaattgatcttttccccattagttttctgaaccagcattactttgcggtggtccttttgccggtggagcaggagtatcttgacaatttcaaagatgaacaagaattctggtacgtaaaaaaagacgcagatgagggtgaaaagggcgatgcgccaagacagggcgacaagtggtggatccctacagttcgagtccctcccgagggtctgccagatgcgtcgaaaaaatggattctgcaccagaaagaccttgtagggcaggtgctgaaggcagccatggctatcaatgctgatgttcttacagagatggagatcccgggagagtacattgaaactctgcctaaggtgacttataataccattaatatttgtaaaaactcctttccatactttacgcatatcttttctcgaagtgagttcattttctgcttgatgctgagttgaacaaacttttcctggattttggaatgtagtacggtgttttcctgaaaaacattatgaggctaatctaaccgagactacttctcttgcagaatggaaggtctagtcttggagactcgatatacaaaattataactgatgatcatttcgatcccaatgagctcttaagttctgtagacttgtcgacagagcacaagatcgtcgatctcaaagaccgaattgaggcctccgttgtaatttggcagaggaaaatttccaataagctttcctggggccccggtgttagcttggagaagcgagagcagtttgaagagcgggcgcaaactgtcctactcatcctcaagcaccagttccctggggttcctcagtcatcacttgacatcagcaagatacaatacaacaaggtcaaaaaaaaaaaaccatagctgcatgtttagttacttttttcggatttgctacagtacttatactcatgccacctgcatttgctacttcttttcttcaggatgttgggtatgccatcttggagagctactccaggactcttgagagcttagcctttgcagttttatctcggatcgaggatgttcttcacgctgatgccattgctagagacccaaagcgcacgaaatcaaggagaaggcccagtctagttgacatccccgagatcattgacaatgcactggaggaagaggagactgtgaacagcatagatgccaattcacaagtgaccaacaactctattcactggcaagagcaagaacacgaggacaaaggcgcgaggctgaggaaagtccaccgcatggtcacaaagaaacttttgcacattgagaaagttgataatttggggggtgggttgaaaagcttttctcataggtagctgtagcctgaaaaaatggtcagacagctgcatgcttggttgtgctaccggggggagcacctgtaaatagctcaaacttcagagaggctggatgggttgtattggcgatttggcggtgtaatctgctcatctcagttgagatgaaatcagtatgcatatttcacggcctcattttggttggaaaatttttgcatgaatagatcagaaattcaaaatgtgaaaccgctagtatctgaataacagaatgcacactagcatattttccttcggaatacaaaagcagacgtgcgcgcaccaacagtaacacaaagatatgcaagctacagttgctgtaaactatgcggagtataagtaattggcaagatggcccaggcattaagcctagatttatcaccatatttaccttgtaaatgaaataaccgcacagcctccttattgccatcttcgcacgctgatactaccttcttttttaatagatgacgccgttgactttttctcacatgtttaaccattcatcttattcaaaaaatttacgtaattatactttattttgttatgagttgttttatcactcatagtactttaagtgtgatttatatcttatatatttgcataaaatttttgaataagacgaatggtcaaatgtgtgagaaaaagtcaacagcgtcatctattaaaagagtattaagctgtgcagaggcagtatatgcctgttcagagaacgggcattgctgttgcgatccgatcagtttctaccataaaattctctcttcttgaccaataatccagtttactctagaagtcactgtctaagtgtcaacggaaagatcaaacctttttctggagatataaactgaagattataacttaacatgagcactgaacattactacttgattcaacagtggatacagattcaaacattatcataaagtcctcacaactaggcagctcatcgacaattttattcgcacaagtattttgcagagggggatccact

SEQ ID NO: 45545 - DNA, 1525 bp, Oryza sativa
ctgaagatttctgacaaaagctaaatttgggaatatgaacatggagaaacaaatgacagaaacataccactgacaagcaagatgtcgtctacacccttggctttgagctgctcagcctgatttatgaatcctggcacatgctgattgctatagccatcgaaaaataataataaaagacattatgtcagttcatcaggttttcagaagtgaaaagaagacaataacagggcgagtaacaaagtaatatgacaacttaaacctctgtgatggcaaaatagaacagcgggttcttataaaagggacagcaaaatgagataattggcagctagatatattaaaactgcggtgccaagtgccaacagaggatgatggcaaagggaaggataaaacatttcaagctcacaaatttatcgaaaccaaatagtacaagtaaaaaccaacagcatcagtctaatctaaagaatgaagacaaaagttagccagttaggagcacttggatatgagcactttgctctcgataaaatgtgtactctgtatttgtcagtcatgtgactcgtgtctccattttttctattcgaaatgtttgttttagttcagttagctgcatccaggtttacagattttctgtgggagattaatcaacaagaaaaggctatcagcttacgaaattctgagcgaatctccacggagtaactatagccaaaatctcccttttatatcctgccacccatcttggcttaactgcttctagcatagatgcccaaaaattataacattttctctcgcgtgctcagaagctggggaacaacacatggagtaaaccagaacagtggatcgaagtctactttttagtcatgcaactagcaatatataaacccacatcaagatttttaaccctaactctgacacccaaggaagtgggagtgacttcagagctcgtcaaatcaatcccataaattgtgagtatctgtataataaagcagtaatcttggatttggtccggacatcagctagtacacatttcagttttgcagtaaaatttctcgatctgataaaaagaagtcccattttttaaggaatttttttttcagggaaatataacgtctccaagaaagaggggggagaggaaatcgaaaaaaggaggaagagacctgcaggtcggggtgaaggcaccggggacgccgaagaggacgaccttcttgccggcggcgaggccgtggacggagacctgctgcagcttgtcctccccgtcgaaccaccccagctggccgtcggggagggtgtcgcccacggcaaccggggccatgtcgctctcccggatgattcttgtgttgcctgcctggatgtgtggaggagaggaggaacagaggaaggagagaaggtaatcgacagggaagggagatgagtgatgatgaggagaggaatgcgaataaataaggggcccttccctccccactgattgtgatatgctttggggtttggttggttgttgggagcttcgagtgtgccgccgagtgtgaaccca

SEQ ID NO: 45546 - DNA, 8632 bp, Oryza sativa
  unsure (1)..(8632): unsure at all n locations
agcacactggaggcttggaaggaaagacaaacccgaggagggtcgtccgctatgaatgaatagttggaaaatcttatcaccagcagtttgaattttcatgcttttggctacagatttgatgttaggaccatattccagcatgtatatagtctagctttacttagtcccgttctaagctccaacaacatccagatttttcctcgatttccgttagcacgcttttcaaactgctaaagattgtatttcatgcaaaaactttctatatagaagttgctataaaaaatcaaataaatccattttttaatttttaataattaaaacatcattaaccatgcgctaatgagtctcgttttacatgcgcacttaatcttcatccaataatcagattcgaacggggccatatgtgtttagctatttactatcctatcacacagagggtgatttcacttataagtgggagtttagtggctgaaattccccatgagatgagtagcatagttttgttttgggtgattcgtctacgtaggattttagttgcagtcttgcagaggagtgtcgtagttttgatacacagtatttgtatgcaaattaatcggagttcttacaccttttgtcaagcagccagggccaagggagttcccaatgcaatgtttcattaagcggaataagaagaactctacgttctacctctaccttggtttgacaaatggtaagtgtatgactgtacgtgatgtgatatgagaacttccttgactctcatttattttgtgctgcatatgtgcaggcatcaatttgattatgtgcatctagataatcaatttgatttgccatctcaatgtaaggcatgtgacatgctgttttatgattgctgtgcgggttctgtttttcttggaatttgttacttgtctgtggttgacacttgatgcctagcagtagtcaagttgaatgcttttagatttaactcaaattcgttgtggctttaattggagatgcatcgcttgtttctcctagttgatggcttgatgttgacctatcaacttttggcatgggcagtcccatgcacatttgcttcctggctttcattttttttctatagattcaaattatctgtcaaaccagcagaaatgcacagtatgtttgcattctaggaccatgtgatattttgcatttggatcttttggcataattggtatgggatggtgggaggataaggtggaggattggagcacctaatggattagaacctacagcattttacttgaattaggaactaatattgttttgtacctgcctattttttgtgaaacaactgataagaaattgataagagatgccccttcgggattatgtactatgttatgtcctcatgggccaatgggcctagaatatatgggcccgaatatacttaacactgtttatttatttggattggctagtttggacataattgttgaagggtttagctgaattataccaaagtcttcgtgtcctgcaaatagtgattagggtgactggaagtctacttgttccattacatttgatggcctgcttagtcaagtgttttcaaatttcttttattttgacaatcagatccaacagcactcaaattatgtatctagaagcaacatttttctctccttacaggcttacactcagctgttcaagtgtaacatctaacatgtgcggatatgtgttttttttaaaaaaaagaaaaagaaaaaggatgggggttctgtcagttacaccgtatattttccttctggtttttgtaccaactgcaatgccatatggactttttcaccatcaaatgtgcttgatgattaatatatactttttgtatatgatagcaactgtggataaagggaagttcctcatggctgctagaaggtttagacgtggtccccataccgagtacatcgtatcccttgatgctgatgacctttcacaaggaagcaatgcatacatggggaaactgaggtgaggttctacatggctgcatagttcactcttaatcattcttgcatattctgttattcatcctgcttagtgctaacaaattggttgcagtaatatatttacaattagggaacatgctaatgcactaaaaatatgtatttagctgatctgcagatgttttttttttaaaaaaaattgggtacccataccataagacaatataagccttctgagttctaaatagtatctgtttctttactatcttgtttttcaatgaggtattggactgttttatagttcaaatggtactccctcgttttttatatatgacgcttgttagttcaatattgaattaactaacgtcgtatatatataaaaaggagggagtatatccttatgttgtaagattgaaccccttaacatggtggcatgctgtgatgccccaaggtntgaactggttttaagtctataatctaaattctaaccccattttggatagagtacacactcacaccaacacacttgcactttcatcctttgtgttcgtgttcaagggtttggttgataccttggactttttctgttttgagggattgataccttggacctggtaagcctgcaaaagtaggccttgtttgggaaagacccggcccatcccctgggattttagccttgccaaacaaggccacaaggtgggactaattcacaccctcatgtgtggacttactcaaaccagggtagggtgtcacacatgcctcctccattccttgattttgtggtttgcaacagtaacagtcaacatgaatcataatccttgcaattgactgccgaagtactttgcatcctcataaattgcacttaaaactgccgaatgcttctattttgtcttagcctttactctttggggagttttcaggctcttcagtttttataacttctcttgttcctttatttgtgctcaaaagtatttcatttatttccttgcaattgattgctgtgtaagtctcacggcagttcctttgagacattatttcactgtcctagattaggttatggccttatttgatttgattccccttatggtgtgcagataatttggactggttgggtatctgttgtgttttcgtgcttgtattggatttttgttgtcttaatttttattcattggtattattgtgcttctgtttagatctgatttttgggggacaaacttcaaaatatatgatagcaagccaccatatgatggcgctaaagcatcaagtagtcgatccagtcggcgttttggaagtagaaggataagtccccaagtgtcagcaggaaactatgaagttggacaggtttcctataaatacaacctgctcaaatccagaggtcctaggagaatgtattgtgcacttgagtgcccttcaactcaagagacatgggaaaactgtctaaagacgaagttcagaaaacccacagggaacacagttctaagaaacaaagctccccgctggcatgagcacttgcagtgctggtgcttgaacttccatgggcgggtgacagttgcatctgtcaagaatttccaactagttgctgctgctgatcccaatgatcctgctagctcgaaggatgaggaaacagttctgttgcagtttggtaaggtcgatgacaatatcttcacgatggattaccggcagccactctcagcgtttcaagcctttgctatcagcctcagcagctttggtaccaagctagcttgtgaatagcaacatagtttgatgtcctcatattgccatctggttgtggttgtggatgcatgccgttgtggttgttcccggcatttttcttctttcatttctttcctttttactctggatatcaaggtactattcatatcctgttcttgtgcgggaaatgtaccattttaccaaatggatttagctccgagaaggaaattgtgttgtaaaacttttgctttttaagtgaaagcagaaggcagtctgttgtacataagttcttgatgaagtgatgataccttttttacttttggctggacatttactccgtacctgtatgaatagattggctcgcttatttctgtctttctgttatggctgtgtttagctcgtgtatcaaatttttttaagtcgaatttattaagcctaattaatctattattagtaaatatttactgtagcatcatattgttaaatcatggcgtaattaggttcaaaagattcgtctcacgatttacatgtaaactgtataattagttttttttccacatttaatgctccatgcatgcatgtctaaacatttgctgtgatagaaaaattgaaagtttgaatttaaacacggccatgttatctcgcgtataaaggtgtcggactgtcggaccatgaaattgcacaagcttgctgtaagacgtcaaaggaccatacaggcaaacttcggtgattgtgtgaacagtgcctctcctgaatgatttaagaatattattacatctgaattaatagaagtactaagaattacttctttcgtcccaaaatataagagattttaagtggacgtgatatattctaatacaatgaatctaaacagatgaaatacttactccgtcctaaaatataagggacatcacattcacctaaaatctcttatattttaagattttgggacagagagtattcacttttagatgtggaatgttcggcacaattcgttctatttgcgtacaaatatgtactagtgattgcagacagtggggattagtactggttaatttaatacagagtgtatggttttggtcccaggtactgtagaacattagaagtcagaagtccagcatgcgtggttggaacggtaggctatttccacagaaaatgaaagcgacgagatgaagtgatgaactaacggccatacttttccatgtcagaatgaatcgtaggcaaacacgttagacccaggatcaaatactcacccctaaaacgtggcagaggttccaggcaaaaaggcgctgctccaacgcatcgaacaaaagagagattaagctagaaaaggcgatcagatcatcatcatcatcatcgaactacatatctgtaagactaaagaaaaaagggtgttgctacaaagatgtactaggtgatcatcagtcggcggagctggctttcccgacctccgcctccagcgtctccatctgctgctccagccacctgagcctctggttcatgctgtccagcctcttccgcgccgcctcgtctgccatgccaagacgcacccaaaaaaagaagaaaaaaaaatcaaattcctcaaccatccatccattggttacaacttacaaaatgctttcgctactcgagcggaggcttcgcacatgcctagctgcgcgacgaattgcgacatggccacctcctgcccaccgtcggtggcggtgaggccggcctgcggcggcggaggagccgcacgcgggtcctcggcgtggggtggcagcttggccgacgacgatccccctctcttcctcccgagcatggccatagctcgtcttagctagcttgaccgtaccgatcgattgatcgcgcgagggtgggtggccggccggccggcgataagcttgccactggcgaatgaatgagacggagcttgttgctggaggcgactgggagacgtgctgatccctccggctagctagctagcggaggcccccgcttatgtacgtacgacacgcgcggcgcacggtcagacttggaggaggggttgggccggaggctccgcctgtggccacatgtatgtgcgatgcgggtcgggactggggtcgcgcgcgcccgcggggtcaagcgtctccggtcgagcgacacggacacggtacgacgaccgaaacccaatctcgtcgcggtggcaggctggcagctactaccgctccctctatacttacaaaatataaatataaacaaacctaataacgtatgatattttatactctctctgtttaatattataagttatttgactccttttcctaattaaactttgataaatttgataaagtatatcaaaaaatttaacaatatataaaatattaaattagttttattaaatttagcattaaatatattatgataatatgtttatttttatgttaaaaattcgattatattttctataaatttaaataaatataaaaaagtttaactaagaaaaatcaaacgacttaatataacacagataaaagatcgcacaacgggtcgcactggacaggaaggccagggccgaaagattcccgtgagaaatggataaccgtttacgcgagattctccggtctttttacgtaaccggccggtcgaaagggatcgcctcacgtgaacggtcacagcctcacaggtgcgtatagtaaccacgcagttgcgcgattgcttagccttcaggtttgctgacttgcacgtctgtacgtgtagtagagcgtgaacaaacggacggacgcaaatcatccgaggacaaagtgaagtcattaagcgaaatgaaattaagatcgagtttacactggagtataaacggagcgaagaacaaacaaagctcgtagaatacgtccttgagatggatagtagtgggctagtggcacggtgtgtcagtgtcaggtttaccaaatcttctagatggggttctcgtcacatcatgtttgatggttaccgcgataaatatgtgacttgtggttaccgtgagttatatagtggttttaaaaactgagaatgttgcaatacataataaccgcatggttttttaaactcttattagtggattcccctgccacacccgtgacccggaaatgcgcttctccgtgtggtcactgcctcacgctggtcatcggctcatcgccttgccatgcaagctagtgcacctagacttcatttattttgaagctggaaattaacaaccagttttggtgattaaaggtaaagcttatactaccaaaactgtataaagatagttattctctgcatttcccctgattaactctaacctcaataatggtggaacgtattattcagggtgatttttgccttgtaaccttactagtagtagtacttgcttgacgtatatacaatttgaagataactcatgtacatgtaaataataaacatccatacgtcgtcatttgaaatcatgtgacagtactccgcaaagttcaaataatactagtatcaatcgagggctgtgtttacactactacaaaagtgatttttccgtacgagaccctttgatttttacaaacggaccataactagtggcgtctacaaaaaatcgtaggttatttttgcatgcggcctcttaagtggcccgtatggaaaaatcgattttcccatacgggcctcttaagacggccgcatgcaaaaatgagctcacttaagcgcccgtatagaaaaatccacttaaggaggcgtatgcaaaaataaaaaatttgaaaaatttaaaactagtgtatctcacttatatgaactccaaattagatgattttttttctaaatgtttctaagatcatgctctaccatgttattgtgttcttactgctattattttggccatttttttcttttgactttattttatcaattaaaattttgaatttcaaaacttcaaataatattttgaagcagtaattgatttcaactgaaaaagtcatcaacaacaaagttgtataactcatcaagatatataacttctattttagtcatttcttcatccgataaagatatttgtaagattgtttacaaaatatatatctctcttatagttttataaactatataagagatatgtacattttgtgaacaaatcactttgtcggatgaaaaaatgaccaatataaaagttatagatcttgatgatttatacaactttgttattgatgattttttcagttgaaatcgattagtatttgaaaatgctgtttgaagttgttataatttgaaattcaaattcaaactgttcaaacaaagtcatatagaaaaatgaccaaaacaagttatagatcttgataatttatacaactttgttattcacaacttttccatttgaaatcatttattgcttcaaaatattatttgaatttcttatattttaaatttcaaattttatatagctcaatcaaacttagatggagaaatgaccaaaagaaaattggtagatctcaatgatctctacaactttgtttttgacaactttttcacatgaattcatttaataccacaaaattagatttaatgtttatttttatctaaaagtctgatttgcctcctcgccctctccaccacttcaaaatttcagcagccttatctccaaccttatcttcactccaccattatttctcctcaactccctctctctctctccccctcacacacagcaaggtcgcggcggggtcagcaacaccgaggaggcacgcgggggcggcggccgagggcgacatgtcgcgaggcggcggcacgcggcggcggcaaggaggcacgcggggggcggcggcctagggcggcacggcgcgaggcggcggccgagggcggcacgcggcgacggcgggcgggagcggccgcccgcgtggatctgccgcctctacctccctccgtcgtcgctggcgactcccccgccctcctccaacgcggatccgacggcggcgcccacccccgcggcgacgacgacctcgggc

SEQ ID NO: 45547 - DNA, 8519 bp, Oryza sativa
tccccccccccccccccccgggccgcacaggccgtcacgcgcgcgcgcccgcggcaccgcaaagttgacagcaacgcacatgcgcccgcgccatagcggtacggggctcggcacgacgacggctttggaaacatggcgcttgctatacgcttccggcccctcgctctgctcacgcgctccggccgtgaatggcgccgggcgccgcgagagcgtgtactcgatggcaaaagtgggtcgaggcacaagcactgcacaacacaaagcgcgagcacgtacactggcacacgtacagacgtactgacgattgacaccgtgcacctggctgacctaacaaattgactcgcttgtcaatgatgcgcacagtttgattcgtactcccactgtgcaaatgtggggaaaaaaaatgatggttggacgagggctaaagacaagcaggtcgtacggctgctatgtcgatcgaccagttgacatgataggcaccgtgcattcggtcaaaccccttgccattggtcaagctggtgaacacgtaggcaaatgctcatcaccgcaccgacaaatatcttggatgatgaggatccaatggatgaagcatggcaaaactcttttcatctctgctcttttttattcctttgcactcctgcttttctaaagatggatttgatctgacctgcctattcaattatagtgcgctagaacatactccatctgtccaaatatccagattcatagtcaggtttgccctcttgtttttttttacagaaggaatatatagattagtcctaaaatctgctttaataaaattaaaaatatatttactatatattataatagaaaatcatattggaagactacgttattgtccaaaacaaccagggcggagctagaacggaatggagggtggtgccacttgcttaatttactctactttatatcgaatttaagttgatgcgggtgtctaagtttgtatcgaggaagtgcataggtatagctaaaaagttttcttgatcgggttcctaggcacccccctaatatactctacatccacccttgaaaacaacgtgaaattattaaactggaaagagtgtttaaaataaggcaaaatttgctacatgacactcaaagtttgtggcatttactgtgagacacccaaaaaacatgtattagctcctaaacaatgcaaaaatgtggtaattagctgctggacacccgcctcgttattatattatttccggtggaaacggagagagaaagagcgttgaaagtaccgaaatgcccctggacactattcttcttcctgcttctcttctcttttctttcttctcctctcttttcttctcttctcttcttcagcggcgtcgctctcgggccacctaccgcgagcgctgctccgccctgctgtgctcgctccggcccgtgctcccaggcctcctcgtcgcgctccctcgcagtctctcgcggcggccctcggaatcggcgatgaaggacgtcaccgatgggacactgctgccgctctaccgaccgccgtcccgcctagcatctaccccctctgccgccccgttgccgcgcttgtccaggaggctcaccaaagttattggaagggatcgtcgaggcttggacagcagcggcttcggttggaatggctcgacggcgaggaaaaactccgtgttgacgacaacggctcgatctactcgaagagctgccatgtatgcacacggatggtgttatggacgtcctagggagcttctatgtgcgatggattgaatggtggctcactggagcgggtggaattgaatatggagctcgccggccggagttggagaagatgatgccgatctccaagctcgctgcaccattggctaggtttctttggggcttccgaagaggaggtcgtcgtgatgaagatggtacggtggctcggccttagcttcacccgatcgacgggaacggcgatgctgtcgcggcggcgatgctcagagcgcgctccagggcagcgagggcatgatccgcgttcccgttcaaccgctgcatgggatgggacaaaattagatggaacggagatggcatcaagcgaagattgaggaatgcagaaagtagagggcgatcgtggctcatcggcgctgacggcggtcgtcgtcttcaccgaggggcatgagtaacggcaagagagcggcatgaggaagaagaggaaaatagaaagagatgatatgtgagattgacaagtgtgcccatgggcaaacttgtctttaaccaatgtttctctctctatttctaccggaaacaatatataatgaggtgggtgtctagcaactaattaccacatttttgcagtgtacagcagctaatacacgttctttgggtgtctcatagcaaatgccaccaactttgagtgtcatatagcaaattttgccttaaaatgaaaagtaaatttaagtatacgaaatatcatacatatatctaacattacatttggataccaagagatatgtgtatcagatcaccttacaccattttggtgtttatgatacgaactttatattggttgccttcttggttttattaacaacaaataaaccaatgatttcatagagaatacaaaacctatagagttatttacccgattaccgtagggattctcaaacgtacaatcttcttatcctatctcataatcaggcatctagacccccgtaaacatgtttttccttctttgctaatgcataacatagtctataaacaaaccaaaatagaaagctatctcatatctcatataaaagaaaacactataatgaaaataaactatgctccaaatcgatcgtctataagaacttgtcccttaaaaggcatctgcaacaatagtatcacaaacaagttactacaacgtttcctcaactgtccccactattttaaaaacaatctaaagataaacatgtgattatataaactagaaacataaagtgtcatagtggattgacaggttacaaacatacggtgattcagataaccatgtgtggttcatgattgttgttagctaggtgaatccattgtaaggcgtcaacaattataatgaagtattttgaaagtgtgcacagctctgcacatctattatctattatcctgatgtgagatacaacaaagatatgccttacatatctcttcaatattcatgacgcaatattagatgaaaaaatattaaacaaagtaaactgagtgttacgatgattccatatctgtcgtttcgacgagacacgcaaatcttgttgatattcatgacgtggtattggatgccaactcaagttgataatcaaagacaaatgtattacgacttttgtgattttatcattaaaaagttcttgtcgtaaactctcttgcactattaaaacacacaacggtcaaatactatagctattattagcaaaacatagccagtaatcctattccccaaatacatctttctccctatactaatctcgtgaaatttcacgttctcgctgtcacaaaagataaaaaataatgcaataaaaactaatgtaacttaatattaactactcccctttctcaaatataagtatgcatgtgtgctctttaaaagtaatctcacaaatacaaacccacttaaaaattccgtacttgcaattaaacctacacaaacaagctgcctacgcaggttcatttcatacaacacccaacctccggccggccggttcgtcctccctgtagtctgcagtgctcaccgagtcactggcccgcgggtcgcaagccacagtagcctgccccagtgcgtaccgacgcctcccccaacagctggaggagccgtccgtccttccttccttccttccttccttccgtcgcagccagcattcttctcctctctcctctcactgacccgccccgcctccttctctcgccgcgctctcgttaagtttctctccggagtctcgaactctcaaccacttccctcctcgtcgtcgtcctcctcctcccactcccctgtccgcgtctcggctgactcggcgactgaccgcgcgccaccgccgctgacggctgagcacgccgcgcgccggcctaaccctggtcaagtggcgacgccgcgagcgacgggttcgtcgtggggtgtcgcacgtggcctcaccctccccggtcccttgaatcctctgcctccgcctccgccaccgcacctaccaacccacctaccgccaaatcgcgcgctgcgactgcgagcgatcgaggcggcctagcctgcggggggctgcctgggcgacgtgaccggcccgcgctcctctccgaatccgaagccgcagcgcagagcgcacgcctcctccccgccggaagcggagcaggacgcctcggaatcttcgccagcccgtgctccggtcggtcatcccatctgctggattgtcgtggagcggagcgtgagtggagtggagatccgtcccgaccgctcttccgtgtcggtaagccacacctccgcgacctgcttggattcgttgcgtgcgcctctgatctagcttgtgcgtagtgagctctgctgtgagcaatctgaatccaattccgtggggggtgctccgttttgaattagcgcaaatgcgtccattctgtcgctgatttgtttgctggttcggtgacttcggcccttgtgcttcacaccgcgcaaaagatctctcggcgtccttgtctcgtggcaccgtgggataggatgcgaggcgcgtgacgcgtccatcctgattctgctcgtttttgggggcagaaacagccgctgcagcgagggtgccgggctatagttagttacacaattgcgtcgtaatttacggaattattgaccgtacttcgttactgtgtgccaaggagctgagctactgtagttgttttatgcgttctacttttatttttgactggtggttttactaaggtgctcaattcatggataaggccctgttaatgatcccttggaataattgactgcaagttttggccgacagcaggcacaatggccacatttactgggataacagtgggtgggtggaattgttggccatgcttgctaacaacttgatgtttttgcaacatatttgcatgttatcctggaacattgcgataaggttgaagcggaatcacaatttttcatgttgatacgtttgggactcttattgccttaaggatgcacatcagctgataaagcgcgtatgtgatccactttctgtttagtttctaatgcatcattgtagaccatcaagttgacaactgagccaatgacaaaagttgccctttctcctgggagaaacaaagacctcatgcagttcacatgctcccacttttttcagttagatgttactatcaaatgctcagttgattttgagaaaattaaaaagttgtttttttctttctgaactttgcttgttttactgtattggtaaacggcctaccaggagttaattcatttttattattaagaaaacaatgttctctgttgcttcattaatttaataggcgacaaaatttactgctggaacttgattaaggaagcagagttataaatacattgaaactgtttttttttgttttggagccgctgattagtttggtggtactttaacgaggatgaaatagacaagagaactctttagatggactcactaggagaagtttattctagtggttcataattttctgatattttatattaacatctgttttgtttgacagatacagactagtttgatcagtggtggtgttaaatacgaagtttttatcatataacatttggaaacatgcataaggggactctcacgtcttggaaatgagtaattccattatctgaaaaatggacgatacaccaactagttcggggaaatccgaagtgaattcatgtgaaccgagttggtggccaccagactttttggcaaagatagaatctgtttccttatctagaaaacaaagtgtattttctgataaagaacctcgaagcaatttgcgatcctcatcatggaaggcttctcaattactgtggtcaacagggacttattcagggttcatccctaatggtttctactcaataattccggtaaggaactttctctgaacaattctcttttgttccttggggacatattttaggaaaataaccaccctagattacctgtggcatgtcatagggcattttagttagatgtttgttacttcatgtaagccatgcattttctgtaaaagatgtttagttctccagctaaattgttaacattgggcttgatttgcatattttattgttctgggcctccaggtgtttttgtggttttgtttaagttaacagtttcaaagatggtctattctacatagtttcctttcttgctatgttgggtagatcttggttaacattttttggtagcttagcattgtacaccgatttatcattgccaaatcaggaaacagaacaaatttatgtttcaaggaaaaatctttcaaatgccttaacttcaatgaggaagcaagttcatatagactagggatcaaggaaagaaaaaagaatatgcatgttatgttttagaatggttatcttcttctcttaatcattaaattcagagttttagtgaagtgttgctttgtttcatttctttgtgagctttgatattctcatttttgttgttatgaagttctctgtcctgtgatgcattcatacaggataaaaagctgaaggaaaatttcccaacaataccatcattggatgaccttcaaactcttgaagcagatggacttaaggctgacataattattgtggacgttgagagagataagaagcttttcatgttgaaacagcttagtggcgcacttgtgaaaggattaaactctagtccagctttggtgataaagaaaatagctggcttggtaagtttttcagaaattataaagtggatatagttttctatttcccacatgtgcaatttcccactatgagctcaccttatgaatcatcaatggtcaatattattttaacatctttgggcacttttggtgcctacagatgtgctgaatttatttgtcttaaaacttgcaagttattctggaacaggtttttgactgcttcaagagcctagatcctgatgtaagtcctgcaagatctccaactgaagataatcatttctttggaaacaaagggtcacaacttctagggcagataaagcatggatcatgccgaccccgagctatcctgtttaaggttcttgcagatgctgttggtcttgagagtaaacttgtagtggtatgttgacttcctttacattcttctgcatattccatgttctttatcgtaaatcaagcattcatgtctttcatagggtctacctgatgatggtggagttggatttgtggattcctacaaacacatgtccgtggttgtttcactgaactctatggaactgctagttgatcttatgcgatttccagggcaattaatcccgttctcagccaaggctatctttatatcgcatatctctgctgctggcgagagtgattcagccgaaaatgactcatgtgattcccctcttgagcccaacagtcctctgtatggattatcagataaagttgaagctgaagggtatgagtatatgtcaaatttctcctcttagttctctgattcggttcttctcgaccttttccaatattgtaatttatccattgttgactatgttgatagttaatgattcgatcattggagaaaataatgaatgtaattggtgatggtccatagtaacatttttttttgcgagggtccatagtaacattttagtttccatgttgaatgtctagcagaatactttagaaagaaaacaagtcaaccatggctgaactgctatcttaattattggaaaaacaacagatccatatttttttcaaggcaattttccactatactgaatagtgatcattgtcatttgcgtgcattattgggctggtagaagtgcttctaaatacaaagtcgtgtaataaaactataacatcaaatattcctctagtgctataacatcaagtattcttctagcatatgtgcatttgtttcatttaggaaaaaaatgtttgtaagatatgttgatatatggccctcacttgttttaggtggttgattggaaccttattgatagtttactggctacataggtcaatctttacatcagtgaaataaagggaaatgtatagaacatttgactctgagaattttttgttgccatgatttaagtgtcaacatcaaacatatacagaaattgaacagaacaaaatcacttatggatatttcaagtagtacaactgtggaaagtagtagaattaaaaaatcagacaggtcctgtattttatttatttcttttcttgctgacttccaattttaacattagtttgatagaacaatctagagtttttaatttgagcaagatgaaaatttcccatctcaatctcagtgcagaattgaagcttcatcaaatctatctgggcgttcattgcgcaatgttatgttgaggtcaagaacattttccgagggg

SEQ ID NO: 45548 - DNA, 710 bp, Oryza sativa
atgtgcctaccagggaacttatagacttaattttctttgtttagtaattagtactcattacaacttcagtgagtttaagttctgtagacttgtatgtttgcattcagtagctgaaaaaaccgaacccgtataaagaaacagtagcaacaaaagaagaatttatattcctccatggcgcctccaatgccacataaaagtatgctataatttcactgcacaaaaaatgatcctgctgctcacattatcgaagtcagtgatacagtaggacttattttggggggaaatgttgcagagttgcctgaagttggtccagtaacgacagaagacattgagcttgcactaaggaatacacggccatctgctcatcttcatgtacatagatacgaaaaattcaatcaagactatggcagtcatgtcctcagctaaaggtgagttgcaaaagcaaaggttatttgcacaacatagattgctgaatttcctccttgaagcttgaactgttccctagtattgtggaaatcctcctgacggaatcttgccgataagacttttcatttgcacctagtatggttgatagaatgctgaattaccgctgatgtatttacaactaatgagcattctctttacacaatatttgttcctgtaccatgtatattatcatttgtttgacgaataataagctatttgggtaatccttgccctttcggaatatg

SEQ ID NO: 45549 - DNA, 2197 bp, Oryza sativa
cccctttgtgaaccttcttattcatttgacaagccaagaacacacttgcagatcagatggtctaggtggtgcatcaacatctaaaactcgaagaatacggggaagaagcattagcatcacgcctgagattggagatgacattgtgaggtaattcttattttgaactatcctgacgatatttgagatggcatattgttttcaaagttgtattgtatagctgcgcttggtgctttcaaccaaaatatattgataattttcttttagttgtattttgattctagatatccttaagcatttgtctgtattttgctagatatcctcaatgagtatcaggaattcattgtttcaatcttaaatctttgacagggcggttcgggctatgaatgaaacactaaagcaaaatcgcctccaaagggaccatgttaatgaaggttcaccctcgtatgttggggaggaccaaaacaatgcaagtgattgcccaaataatgtatgttcctgcaaattccattgtttaatcttatctatattggttctttattccttgggagttggaaatatgacttattttgctcataatttcatttcaatttaggatgatacatctggaggagttgttgctaccaacaatggcccaaggaaccgaaatggttccactcagaaagctatgtcattgccttcttctcctcatgaatatagggcgcaaatttctgaaacaatcaatccttgtgattttgtaagtaaagaaaagatggtattggcgtggaacaaggttttgcagagttccccatttctcaataaacctttattgccctttgaagagtggaacatagatttctctgagctaacaattggcacaagggttggaataggcaagttacttgaacttcctcagccaaagttaccgaagtctattgtaaactgtcagcctacctgctatgcttgtgttcttgactcttcatcttgttgctacttttgctatgctgctttctctttctagcatgttttcaaaatgaacaaaaactaaacacaacatgggtagttattttctccttagctattaccaacttcctgtaagaattagatccatcaaacttggtgttgaaaaatgatccaataaattcaatctcccataagatatgacttgctattgttatttgtttccatatccacactttattgaatatgtttggttcagtcaaaatttactaacacaaaaaaattatatattggataccgcaactgcaaagttgaacagcgatttactttctgaggatcatgatgtcaccaacttttgattctatcattctttagaccatttaatggagcttactcatccatggtattgataagcattatgaatacgaatgtaggaatattaatggggatgatgctaaacatgttatgcctgaaccatttgatatgttgtttcatacttcaatgtgtgcttttattttgggaaagctttcttatgaaaattttcctttcttgtttgcctgtcatgttttaacatttttgtcaccttgtcaaattacttcatcaggattctttggagaggttttccgtggtatatggaatggcactgatgttgctatcaaagtatttctagagcaggatctgacaactgaaaacatggaggatttttgcaatgagatatatatcctgaggtacctgtactatgcttgcttctgtattattggcagccttctttttaatcataatatgcacactaactttgagaacttcacaatttcctttcagccggctgcggcatccaaatggtaaggactcactttgattaagtcaaactacaatactcagcagctctgcactagatatcatgcaaatgccataaatcacgagtttctaaagcaaattccatatctgtagttatattgtttcttggggcatgcatggtaccaccacacttgtcaatggtaacagaatatatggaaatgggatcgctgtactatctcatccatatgagtggtcagaaaaagaagctcagttggcgtaggaggttgaaaattgtccgtgatatctgcaggttaaatctttctcattgtacaataactattactactatatattcctattagctggtattacatataaactttcagaagattctgatataattctcttgtcgtgcggacatcatctcatagccctcctttagcattcattctcatctgacaaa

SEQ ID NO: 45550 - DNA, 2842 bp, Oryza sativa
ctcgtcctggtacttctacagggacctcgacatgctcgtcggccctaccctctccgccgccgccgccgccggcggtggcggtagcgccaagaagccgtccccgccccgcgggctccccatgatgcggaggcgcctggaatcgccctcccgctccccctcgccgccgtcaccgacgccggccgtggccctccccttgccaaactaccgccaggcgtcgaacctcccgtccgcgggcctcctcttcaataagatggctgcagcggccgcggcggaatctgattcagaggacggctacaacaacccgaacaacaactatgaggacgatgaagacgacggctcgcagcagtcggcgtcgcggtccgtgtcgtctcgttccggtggcgttgcagctgcaggtgcaggtggtggtggcgtcagcagcagcaagaggaagaggggaggcggcggcggcggagggttcggggagctagcgagggcagtcgaaacatttgccgagatgtacgagcgcatggaattcgctaagcagaggcacgcggaggagatggagaggcagaggatcaagttcctcaaggatctggagctgaagcggatgcaggctttcgtggacgtgcagcttcagcttgcaaaggcaaagcacgggaagcatcctgatggtgccacggagatgctcatgtctctcgccgcgctcccgttcctcagcacccctgcttacctatgataatttaagaacaagagtttaggtaaagatttgtttggtctcagatttatattgtggtggactggtggtcatattaggcctgtagtggatttttcatgcgattcctatatgggtactgttcctttatattaagctgtctcagatattccagcgtgcttaaatttggcaatgcctggttgatatctcctcagattgggaggtttactaagtttgaaattcaactgtcaattagctttcttcatatcatgcttcaattacttggccgtatatacacactataatattagggagtatacctcatcataaaatgcaggcctcaacctcaccattctaaatcagactgggttatgtgtatgttgatgtctgtacgcctttctagttggctgtattttgatattggcaagagggatcttctactcattctaatatgatctctcatctgcacttatgatctgataaattttctattatacagtcgaattgaattcatgctttagctttgccaatttggaatttgtggcaaccggcaagtgggttttcttattagatattcatctgctctaatgatctcttactatgtatgtttatggttctggatttttgacttgtgactcgttaatgttcaagtattttgtgctaggaattttcttttgggctagccctgatcagatggccatacatctctatacttttgtgctaggtttttgtttctgggttttgctttcatttcggtcatatcagttcataataggatttgtgcttaattgtctgaggtaaggaattaaaattactaatggtatgctctcgacttgcgctgtgagatagttcgctggttaaagatcatcttgaacaatacttgtgcttctcaactttgattatatgtgtataatatatgttggtgtgtcttgcggtgtattgtggctttgctttaggcgtttgtagtttggtactgcattgttatctgtcttgttagcttctatggctattcatattttcaacttttttagctatatttaatatgcattgatgtttgttatttgctcttttttacatcctctagaattatttttgttagtttatcttataactgaactataaacataataacaggttttgtgcctttgttgagtgagttagggcattagaggttaggtttatcctgattcctgaagacctgaactagagcagtatgtgcattacttacaagctcagattaattatcatatagcatatctcaccagtcaccagtcaccgttcactacctttggcaaatattgtagtaacgacacatcaattagttgtatttgaataggtgaccaccattgttcttttacccatggtactaagagatctggtttcagtatgattgttccagttttgcaaaaagagaagccaagtttcatcattacttagttcaataactaaaaaaatattaaactctggtatgagcatcgtaaaatctgattgttgcatgaatctgttttgttctatcaaattgaaacttgtcattttgagtttcctcatagttccatccaagagaaaggatgcatgtcatttttattaactctgcagttatgcattatatctgctgattgtcagagttgcttgtagtgttatgtactcctactgccgtttaatcattggtttctgttcttccagtattattcctaggattatcgttgtttctgttcttctgtttttccagattactcctaggattataggagagcagattactcctaggattatcattagtttctgttcttccagattattcctaggattataggagaggagtcaccactcaccagattaggattataggagagtaggagtcaagctcatggagctgacggtgcgagctgctctttggtggagagaatcagctagagtagttcgcatcacaaaagatgctgtgtaactagtgttgcgtgttcccggcaagagcactttttcttgcactttgttgtttagtgttgaccgctattttacctacacttttttttggacagtcaagctctcatgagcttctgtttaattctagaggatgtaaaatagttaaaggacatacgtactgctttgaaggctgtttgaggtctgtaacgaaaatgttagatatggaca

SEQ ID NO: 45551 - DNA, 1575 bp, Oryza sativa
ttgcacctgacatcatttagcatcttcagtgccaggtcacagcaactagtcttacagtatccatcaatgaaactggtatatgttactatgttgggaggtatgccttttgcacacatctgctgatacacagcaaatgctgagcccatcatgccagcttttataaatccattgatgatactattgtatgtcattgcagttggaacaaaaccttcagtttcaaatctcttcagcatttcaccaacttcacaaactcggccaaccacacaaaggccatttatgagagtgttgtatgtataatcattgcaagagactccattctgtttcatttcagcaaggagggcataagccttgtcaaaagcagccttatttatgtgccctttcatcagcgttgtgtaagtgacaacattaggtgtgaacccttttccaggcatctcagtgtacagcttgactgcttcatccatgcacccattcacacaataacacaacaacaagctgtggtatgtcacgatatatggtttcactcctgtttcattcatcttttcccacaagttaagcgcttcgcgaattttgcgacgctgacagagccagtgaattagtatattgtatgtgaaggcatctggtatcccagaatcagccatctccttgaacaagcttacagcatccttccacaatttatcattcaaaaggcccttgataaccatattgaactcatttgtgctcggcaacaatccatgatctctcatctggcggcacagctcataggccttctctggcatcccctcttcagtacaacctctgatcagcaccgtatatgttacatcggttggtaccagaccgtcccttagtgtctcctcgaatatatccagcgctttcctaacctcccgttgcaagcaatagccgtgcatcaacgttgttgcgagaaccacactcattttcttccccgtagcaagcaactcatcctttatgtgcagcgcctcctccatcctccctcccttcacgagcacatccaccacggagttgaacgtgaagtcccacggcacgaaccccgcatcctgcatcttcctcagcaccagcagagcacggttggcgtcacgcagcttgcatagggacgcgatagcgacagagcacacgcgctggtcgggctcgatctcagaggcaggcatttcgtcgaacagcctgaccgcgtcgtcgtacatcccttccttgaagcaagcgcgcatcaccacgtcgaacatccacgcgtccaaggggcgccccttcccccgcatctcggcgagcagcgcgagggcgtccgcggccgacgcgctccgcgccgtgacggcgaggaggtcggtgcgggacttggcgtccggggtgaccccgcgcgcctccatgctggcgtaggcggcggcggccgcgccagcgcggccggcgcggcacagggaggcgaggaggcggctgaggagcgcggtggcctgccgtgaccccgggccgcccacggcggagaggacggcgtcgacgagcgcgtccggcgcgaggcgggcgtcgaaggcggcggacttgaggagcgggtacgcgcggctgtgggaggacggg

SEQ ID NO: 45552 - DNA, 5710 bp, Oryza sativa
tggtagattaacaatttaacatcgatcatggtgaaacatttcacttcgctgacatgtaggcccgagtgtctgtgggacctgtgttagcgaacggtgctgtacacacactgcacattgacatgtggaactgaggatccacgtgttaacgagcagtcctgaccctttctcaaaacattttgttcatattgtagaacaaaataaagggattgagaaacttcaatttatcaatttaagggtagaaacttctcacgaaaaaaatgttcaaacttccttttcacaagaattggctatagctaaacgaatgcagatctactgtttaactgaggtacacggggcaaatgtgtcgtcaaaatattgcctctttgcagaaagatcaagaaagcaaactgatttgagacagtcgaatggtgagctcatgaagttgaagttcagttctaaaccataataacctcgtttcacaatgcgcatgagtcaaatgctgtaacacctcaaacattcaacattattattaaaacttatgcctggggcaaagggaaaatgctgaggaagcttctctactctactaggtaagattcgcgtcagagtttcaccgatacatgccgggccatcatgcacgctgtcttcttcccaccgatgaatcgacaagtccccaagccctatgaagttgaagttgcaccactgtgggaaattcactccaattgggttgcaaggtttgaaccacaaccatcagcttcggggagtacacgaatcatacccacgaaccaacctggctttagggtgataacacgggcaaaggaaggtcaatgtgtttgtcctgtgtagcatcatgtgccaactgattgaacatcactatgtctcagcaaacagataacgcagcaaaggccccacaactgctacactcaggctattgcccagcatagcatacctgccaccataggtaagttagcgataacaaacaattcaggcagtgcggtctggttttcaaaactagaaagtcacattcatgttcttatatatattgcgattatgatgttcctgaagttcattgagttccaacagagtaaaaggtagggattaaaacttactgttgcctaaggcttatgtgattcggaaagtggaaactcgatggaaaagaatgcagattagcaacctgaaaaatcatgaatattgcatgctatgagacaaaacatagatacggaagggtgtggacctatgtgaagttgtcaataagcacatacctcacgaggggtgaaaaatcgtaagcctaactccttcagtgaagaaatttcaaggtcctctttggaaattcgtttgaggttctgtaatttaagtaggtaatcataaaaggaaaaggaatcatgaatgttcagattaagaggcaacaccagggatgcctgaaaacaaagcagatgaaagattgaatataatgagccttacattggacgtagctagtaaggagcctgtccccttgacatagcgataataacttttggtaaaacaacagcatcgttttgattcagggcatacaatatcttgcaaacagtcgaggagacaccacagccaagcatcagtaaaacataataatctatcattaaatgattgattcaggagtcttaaactaagaaaaaaaaaagatacccatagcactcccccaccgctcaatcaagtttagcgggactacataatcttgagaaattattccacttggggtgcatccatcagacccattaactacaaaatatagagtggcattaaaaaatatttttaacctgcatgttcaaatgagatactggtaattattataggcttattgaacttactgtcagagattgtacctgaagaatcctgatcagcgacattcagacttattgtttcaaggaagtcactgattggtttgcatactagttccagctcatcttcatccgggttacatctgttgtgacctgcccttaccaatgttaggaatgtaggtgtccggagcagcttgctgttgtctgatggattttgaaaactcacaggttctcgtttcgcctatagacaaggtactgttaaataaatgaagagttgcttagctgaacaaaaatgaactattgaagaacctagagtttattatccagcaattttttatcaggaactttattgcatgatttctcagttttgtagtgacaccagactaatttcctatggtttttcttttaataagcacttgggcaaatacaatctttttaccaatcttaagcaacaaacccccaagtcatcccttgctgatttccacaatttgtgaactttggaagctatgcacatatgtaatagtaacaataagatttgtgccatgtcatgtcctataacgtcaagtgacagatcacattgaaacaacaggaaagatcctccagaaatcttaccagacaaaagtagcgaggtctagaatatgggataccaaactgcaaggggcttaggataaattcttgtgtgttgaaattgagatctgaaagaacctctatcaactggtcatgtgtatcagacacctgtcacaaacaaataggggtcacaacttgataaaatactgcggtcaagaatagtgctttaaagaaaccaaagattacaccaacctcaaatccgactacgttttccacaaataacatttgtggaggaaagcacatgtttttcattaggttaagaatctttatgaatgaaaatgctcgagcatcagctgaatgcttctgtagtcctacacgatactccatccattagtgaaatttgaaaagtggtcagataatgttgaaagaaagctccagaagaaaaccttgccgtgtgtatggttggcatggaggagaaagaagccatgcttgtgccttatacttatctaggtcactagcagtgagtgtttgaatgtttccctgtatttagataacagtgatacagttcagataatgaaattgttaaagacttagacaattcaatacaagaatcatcatgcaggtagaatgatatgcttaatctgcaggacagggtagatgagccaggagaatgactacatgaacatgaggaaggcaaatgaccaactgttcccttgccatgtgaaatggttatagaaaacaacacaacatactcaaaagaaatcaaccagattgtaagcaattctgtggacagtttaaacaaatacatcaagacagtctactaattgagaaattctaggcagaacataaattctgtggaaaacttgtaagcatactccctaagaagtgcctaaacatctgatcaagcagtttaagttctgaatctcagcctaaacatctggtcgagcagcttaagttctgaatctcacttctcatcacctttgcagttggcacaataataccatgttctatgtgctactcctaaatctgagccgaaccaaatcaaaactgcggaatctaaccagaagctttttctcctaggttccaatttgggataccacagatggatttggggaagaaaccgagcgcacctggtatgggcggtggccgaagttgagctcgtagacatcgttggcaacgtcgttgatgtcgaaggcctccaccacctcggcccgcgcgcccgacgccgccagcgagtacctctgcgggggagggcaggtggcgcaaaaaccctagccgccgttagacaggtgcgggcaagttcgcagtggggaaggtggagagggtgggttgggtgttagtaccatcccgccgatgccgctatagaactcgaggactttccatggcaccgcggtctccatcgtctccggcgatgatggcggcggcgttggcggcgccttgccggcttttgctggacttctgaaaggcttttcggccccccaactaaactgcggctcccatcccattaagaaaaaaaaaagtcaaattttaaatttttaaacttaattttaggattgattttgagattttttttaacgtaatttctttttcagcattggtttttaagttaccaagaacacatatataaaagttttaccaataaatttatttattttctaataaaccattttggcgaaacgatggggcccgcaagtcctcctggttgattttgacacgctggcagagccgaattacactggtctgcggcaccactagccacacccctctggcccacagcataccctcatcacgtgacccgatccagaccgtccatcacgcccgcacgaaccccgaggcgccccctacccgtcttcctcctatttcccctccccaccctaccccgtcgtctccgttcgcgcgcatccaggtcaaatcaaatcgagagagagcccccatctcgcctcgcctcgccgcctcctccctccccccattcccccgccgccgccgctgcgagcgccgcgacatgagagcacgcctccaaaccctggccccggccctgcgccgcgccgcctccgcctccgccacgggccccgcctccgcctccgccgcgggccccgcctccctcgccagcgccgcgccgctctccacggcggccgccgccgccttcccacctcctcagtctaaaaccgcttcacgtatgggtttgttctctatgcccggcggcgacacacgccaaccttcatatggagaccgtctcatggagtcacagcagctgcctcaagactaccgtgccaatgtgccgcgttctggtgacacgatgggagtaggcaaatggtaatttccatgcgcccatatgatttctgcattgttctgctgatgatgattttgctcattcctcctaatcccgagttaaggtccaggatagctggtggcgagaatccctcctacttcgggaccccatcacacatctttgacgaacacaagcaatctctggtgaaagggaagagagattttgtctatgtcttgctcaagagaaacaagacctttgtgaccgtgacagacgttcgggggaacagaaagaccggggcatccgctggttgtttggaggacaagaaagggcgctctcgtctctccaaatatgctactgaagcaaccgcagaacatgtcgggcgagccgcgaggaagatgggtttgaaatccgtggtgatgaaagtgaaaggaactgtgttcttcaataagaagaagaaagtgatcctgagcttcagagaaggctttcggggtgaaagagtaagggagcaatctcctgtggtgtttatccacgatgtgacccagcttccacacaacggatgccgcctcccgaaacaacgcctggtttaggtctcggcgagctggaattgaacctatagagttgagaggagtcgaagcattcgaggtgatctgtggaagctctttttaagctgcatgatgttggtctggttgacctaagacaaatatgtattgtctctcttggctctgctacttgaattggtttcggcatgacttatcttactctttttgatcaaattgcatataggaactaaaaccccaaccgttttatggtatgttatgacttacttcctccgtcccaaaatataacaatttttagccctcgggattcccaaaatataaccacttctccatcaacattctcttcccaactaatcacaatccttcaccattcacttttcccacctacctccactactcatccaatcacaaccctccaccattcacttttatctattttcttaataaccgtgtcccaactctaaaacttatattctgggacggagggagtatgaggaacatatgtttgattctccttcaataaatag

SEQ ID NO: 45553 - DNA, 2074 bp, Oryza sativa
aggatccatttaattttttttcctttttctttttctttaactttttcccctttcttctcctttattagtgacccgtgcagaaaaaaaggaaaaaaaaagaagaatgagaagaaaacgaaaaaaaaagaaaaaaaaaagagaaacggacacgtcatgtccatgtggcattgtcacatcagcgccacgtaggatcttagaggggatgtgctaatttgggatctagatgatacactttaaaaagttatgctacctggatatgtattttgagagtttagggacctatatgatacaaccctacaagtttaaatatcgcaatgcactttactctttaaagatccatttctttactattgttgtaggtactatgtgttttgaactgctagaggtctaaattaggatgccattttaatgctgatggacctgcgctcattggatgatgaaagttttatgcaagatggcgttccattggccttcatttgccaatggtacctgtagtcgctaggtttaaaataaattgatggaactgcataaacataatttatcgcaacgccatcataatagatttataacatgtattcattgcatcctgtatgatttaatggtagagatgttgtttttcctaatcttttttttttctgtagcatttgctgtaccttacacatattctatgcacagcgcttgagaatttatctgtagtgactcctctcaatttagtggtgagcagtggaattgtaaccttgtagtcagttcagtaccgaaacatattctttaaaagaagccatatatgccatgtatgatttgtggtgttaaagcttaatagcaccagtcatgacttcaattactctccatttttttttgaagacgacagcaggagctcagccggaatttgattaagaaggaaaacagaatacaaacagatccttgattacaaaagataaaaatcacaactcaaggaggcttaaacgcccagctacgtaagtctgataacatgctagctgtagtttactgccttggtgctagatcgtagaagtatcagcttgtaactaaataactaaccgggatgtgttactactagtagctcatctcatttcactttgcatctgatacccctatttctatttgcatcagttcctataatttgagaatacttactacggacaccattgagaatgtctcttctcttttgcttgggatcactttctgtatttcttatatccgtgttgaagcggtggggatttgatcgtactttggttctaactcctccgtcggcaccatatcgccacctccaacgtcagtccaacgagaataacctaccaacttgaggaggcaatgggtgacgcccgtgttgatcgagccgaacctattcaccgtcggagcgggtgcatccgcgacaattcactgatggcgtcacgaattgaaaaacggagagaaccgtcactctaaatggcaggaattgaaaaacggagaactagggaaaacacaggattttaataggaatataagtgcaaaacagaaagattacaaaacacagaaacacacaaagaatgaccgtttgattggaccacatgaaaaacataggaatcggatgaaagagataaactaaaagaaaattttccaagatattgaagttattgctaaattttctttaaaatctctttgggattgtttattccataggaatttcaaatgataggacatgattcaattatttgtttcaaagatatttatagaaaatttttcaatgtttttcctccaaatcaaaaggtgtttgttcacggttaatctgtacttcgatattcctactaccagatgatggcccacactttgctgcgggatatatatattacatattggagaaatgatgaaatgatttggattaaaatattataaaaataatttgagaatgatgatttagtatatgtatgtctagttttaaaatgaaataatttatagatataattactatatacttacttggtgagctttacgtgtttaatgggttgatataacatgtttgcatgtaggttataggagtaataataaatactatgttttcatgttgagttttacatgt

SEQ ID NO: 45554 - DNA, 2071 bp, Oryza sativa
agagcgaaaagatatttgcaggcaaagctatacggcctgcacacacacgtactccctcagttctattttaagtgcaaacgtgagtttctatgtttaattttaattgtttgttttatttgaaaatttttataattaatatttttattgttatgagatgataaaacatgaatattactttactcgtgacttatgtttttaatttttttttcaaaaatttttcaaatatgacggacgatcaaagttggtcgcggaaaatcatatatggctgcacttaaaatgggacggatggaatagtcctcttgttctatagaaaactaatctattacatattataatacaacaaatctgaacgtctaaattcatttgtgaattgtgaagaactcgagtacatttgtgtttagattttatacatattatcatattttcttcgtctcaaaatataataacttctagccttcaaaatttatcttaaaatataacaacttcttcactaacattttcttaccatcaatctcaatctttcgccgtttaatttcctcacctatctccatttctcgtccaatcataatattttccatatttatattctatctattttcttagtgattgtgtttaatcttaatgactcgctcccctcacaccaaatcctcgcaccaccggctttgtcccgccgaggagaacccattcccctagtttcccctctcttttagccaccctatcccgccgccaccatcaccttctttgccgccagagccaagcccttccatccgctattctggccatctctctagctccttgtatcgggcaacacattccttgattgagccaagctcggtaacacatttgaccgccggtgtcgccacctcccagccactggagcaccggcgcgccgctcatctcttccttctgctctacatgggaagaaagaaggaaaaaagagaagaggggagggtggaggaggaagatcaatctgaagagtaggctccacgtgtagatggggatgaagattgtgatggcatggttctaattttataaaatttgaatggcatatttataaatatacgaattgtaatagtatattttttaataaccacatttgtaatggcataaatagaattaacccaattttcttccaaacaatagcgtgtcctcctggttgctattgacacgctggcagagccgaatttacactggtctggcggcgccacaggccacacacccctctggcccaaaacacacacctcccccctctccctcctatttcctcctccccatcccaccccgccgtcttcgtccgcatccgggtcaaatcaaatcgagagagagccccatctcgcctcgcctcctcctccctcctccccattcccccgccgccgccgccgagggcgccgcgacctgagagcacacgcacgcccgccatgtggcgccgcctccaaaccctggccccggccctgcgccgcgccgcctccgcctccgcctccgcggcggcatcgggcgccgcgggccccgcctccctcgcccgcgccgcgccgctctccacggcggccgccgccgccttccgccgcaccagccctctcctgtccggtaagggctctcctcctcggatctcgcgtgtttggatgtgcttccgtggggtggtgggggcggcgctgatcggtcggtggttgggggtcgcgctgcaggggacaagccggcgacggtggaggacgtcatgcccatcgccacggggctggagcgcgaggagctcgcggcggagctcaaggtggagatgcctatgccttttttttttcgtttttttttttgcttcttcgggttggagtattgctcctttttgtctgttctggaaatgggtttcgtgatttgccgatctgtctgtggtttcgcagggggagaagcggttcgacatggatcctcccgtaggcccatttggtaccaaggtgaggcgttcgctggtcgtagttgtaggatattttctattgattctgttgatctgaaattctgaatctgcgatcgtcaccatacgtggtggttctattccttagctttaggtttattagagctgaatttaatg

SEQ ID NO: 45555 - DNA, 2389 bp, Oryza sativa
tctatgacgggcaatgtgtttgatctccatgttcattgcctttgcctgtctactaaagcatcaatagttgttccacattattgagcaaatgattgttactagttaatatattggtgcaaactattcttcccccgttggcagtttgcgatgttatgactaatgctacttatgataagttcttgtcatatattgtagggatgctttctttaaacttctatgagtagttggtgcaggatacacaataatgtttacacagtgtgtgctatcttatttgatcagaaacgcagcgctcctttcatataaactaatatggctgacccaatcctattgattaatatgcatattggtggggtgccttttcttcattgaaactgttttttggatatgccattaagttacattcttttgactagctggaacacctaaataaacattagttgctgagaaatatcaagtttaatatgcattttttttgtgttgaaacaattgtcgaagtcgaaattagagactgaatggtgaacattatcttgggaatgttgcattaatctgtttttctatagctatctagcaaaccggtacctgtaactgggaactgtttataagtattgtttggcggtgagagtatgttaacttcattttgttgttgcatttgtgatatggtagtggactacaaacttactgtggttaaatgcttgagctatgcaatgcaaggacttttagtcctgatacttagattttttgttaagttggcaatctatgtctcagattgaataggaactatgaaaacctgtttttgaagcaggggtatttggtgacctgttgtagaatgtctttgtacatcacctaactgcaaatcacctgattgattattctgttctaagagtggtgagatcgttttttttttaaatttggactatcccaaaaacattagtgttcgtgccaaatttagtaggttattacggtaaccgctaggtggtgaactgtgcccttgtgttcctgcaaaggtgtttcgcttacctcttgatgtcagcagggatatttggtgacctgttgtagaatgtctttgtacatcacctaactgcaaatcatctgattgactattctgttctaagagtggtgagatcttttttttaaatttttttttactatcccaagaacattagtgttcgtgccaaatttattagggtaaccactaggtggtgaactgtgcccttctgttcctgcaaaggtgtttcgcttacctcttgatgtataccagaaaaaaataacgacacactaatgtgtgaagtggctcaacaagaaccagcatacatccgctgctgtgccctcaccacacccacctgttctttggatgattttcctcttcctgtagccaagtcttttaacattagtactatgtatgttttttttcttgaattctgatttctgaatgcctattattatcacagcatgttttttttctctaattctgatttctcaatgcctagtattatcacagcagaccacacaagcttggtcaatttatagacagtgatgtgatcattaaatatcaagttgcgtttttaatccgaaatctgtatttcatctgtaaagaggtcatcaaatatttgtaaatgagcatatttatacaccttcatgtatttgtacaataaacaaatgtctgtttgagggactcgtccagtttcccctagtttgctcccttctgtgttacactcccttatatccttgtgacacatcgtactgttacttatttgaatttacctgtcattcattttccccattgctgtttgcttttcctgttggaaacaggtttctatgttacttgtccacaattcttattttgaactgaacccattttaccccctgttggctttccgcggagtcaaaatctaactactcaactcttagaactttgttttatgcccttcagctagcaataccagtccaccgcttcaatcaatccagcccagtttatatcctatcagttactcaatctcttctgtgtacaaagtagtagccacctgcatcatgcccaatcctgatcacctgccacgctccacatcccaaatgtaggagtcaggaggcaagccatgatgacagagactctggtttagcagcgtgcaatggaagtgcaactgaaaattattttttttttcaattctaagacgtagaatatggtagtgagaaaattattgccgatgagaacctggatttctttttgttgagatacagatgcagaggagacaggagagtaatgaagaacattagaggcgggaccttgatttattcttattgacggtttctttcttgcctgtacatcaagccttaagtcctttccttaatttccttgacgctgtgtgtgaacatggtcctttgacctctgcaaaca

SEQ ID NO: 45556 - DNA, 9832 bp, Oryza sativa
tttacagaggatgagcatgatgttgtatggttctggttgaaaaaagatgaaccgcatgagtgcccagtctgttcacaatattttgtggtaattggaattcgttgtttgacatattactttaatttatgtatttagtaactgtttttattgaatgtagctcacagttccaagctgttttgattctgtaatgttctattgttctttaatggatctttgttgctcgccttttgcagcttaggtcattggtgatggtggtgatccagatggacatgatgatgacgacgagcatcaccactaaggacgcccatgcctcgtggttctgataataagaatttgatgaggcagatgatttcatttaaacctttttagcaccagactgctctacggcgtccttgtttatgaatgcacacatttggccatcaagcaggtggtagttttttccttagggattttgtccaaacaaaaaactcatcgaggcttgacctgtgcatttccttcggagcatcatcgaataaaagatgactgcatcagctgcgtttttcttgtgtatcctaatggccagtctggtgtgatggacctgttctattcagatcatgcaacagtttattttcagtgctcagtgagtccctgtttgcaagcagccactaaatctttaacgatcgtctcatagtccccaatttcctcataatgtgacagttatggaagtgcttgtcatgtcttcatgaacttacttacagatgtcagcacagcgacgataaacagtaagataacatgccaaatttcaccggaaagactactggagcatgtgtacaactaacctactttttagactttttacccttacatttcacagcgccgacactgaaaagtacagaaaatgctaaaaccttattatttatttcaaggatcttttgaaaaaaatattccctaagctaaactaggcaaggacggaacgaatctggtttagattcattgttttatgttatgtctcatctttctctaggttttttttttaaggacgggggaagagttttagacatatgtacaaacattaaaaaaaacacaaaattgagatatcgtgtacgagcaatgtaaaacacaattataaatttgatgcattgaatagctcacaaagaagatgcagtggagtcgcatatttcattccaatgtcaagatcgagtgagtatatatcaaacatttcaacctaagattgacagtgttagaataacacaacccaaaacaataggctacagatgcaacctagcagctatcaaacggtctcatcttttcgcttatacgctaataagctaaaatttgaattttcaactttaaatttaaagttgatttggtttttatcatagtttattttttagcctttagattgctaagaacgtgtatataaaaattttattcacaaattattttttttccaaatataccgttacaatggccctaaaacattgcaacccaaatatataccacagaaacacctctattgctatgtctcaactcagatattgaacccaaaatatacctcacactcacagcacgtcagcacatctatcaccatgtctcaaacccaaaatatagcacaaagcacatctattatattgccatgtgagatctcaaatcagatattgaagctaattgccactccacccatcggtattggcgaagaaggccatattttagcctgcaagcaaatgcacacttcattttgttaaataaaaaaaattaagggtatcataaacaaagttacaagtaaacttgcagcttattagcaacatcgattctttttacatagagattcctcagcacggtcctcgagcagctcctgcgcaaccatcattgtgcaactcccactcagcgacgatgatatatttatgccaaaaaattacatcccggatttttctgggaaaaaaaataaataaataaacaatatatatttaaaattcaattcctttcaccactcgaagcgcctaccttggcaaaccctaagagcaagtataatagtctctctttgagagaggacccccgtgtcgctccgctccagggtgacacaggaggcgacctgaagccgccccgccgccggccttctctccctcgcctcccccacctcgccgccgcctgagcagccgccggcaaagccgggcagcggcaaggacggtggcggcggggcattctaccccctccaacacccggtggttggggccccgacgggaaacaggcggaggggcggcgacgcgttgaggcggctccggcgacgccgacggccagaggtagtagtgccggcgtcgccgttagcggatctggcccccccgcggccagatcgagacgaagcggcgtcggccacgccgcattagcgaggtgccggcagagaaggccgccggctgcggcagtcgcggcgcgggcggaggaggcgacgtcgctggcggcggggacgaggcagagagcctggccgccgccggatctggctccctccaggccggatccaacgcccgcagcgaaggaggccggctccggggtggcggggcagaggaggcggcggcggcggcgacgggacggcgggggcggcgctaacggtgggagaggcatgggcctagctgcacacggcgccgccggctatggttccccctagttcggcaccggcacccccagtccggatctggcctctccggcgagggaggccggatcccctccggtggctcctcggcagtggacgacgcgtcgacaagggcggcggttagagggcagcaggaggcgtgggtggccgcggcaggagggccagtgctgcggctggtctggcgagtctgccggagctgcgggcggtagcctaggactgattgctaaagggacgatgtagccgaccggcgacgatcatcttgcgcggactggttgtgtgggtttggacgggaaatcgctggcgaaagcctcgctgtgcaattggccggctgtcgacggcggcgccttttggcgtcattcacctccttggaggcgtcattttggcgttgatctctctcctttccctaccgttctccgggtgaaaacctggctctggcttccggacgagcggtggcggcgatccacgtcgtgtcctccttggaggcaccgctttggagaaactttttcatgcaaggatgtcattaatggtctatgcattggcttcgaagcttttcagtacttggctttgacgaggccttcactgtctagtcccactttttgttttgcggcgggcgaccttcgctccttgtttgtgtttgctaggtgaagtcggagctgctttgtagggtgacgaagctaggcaacgatgacatgttgcattctctttctaggggttttgctgttggccgtggataggatgtggcgtttagatggctttggctgaagttcttcgtgggaagttgaagccacttgaccattgacagcgagttaggtatggatgatgcaaccaatttgaagtcggagctgctgtgtcgctaggcgacaagctcggcaacgatgacacggttgcaaggtcggaacccctttgttgtcttggtcaagcttggtaacgacgttctatgttgggctccgtcaatggtttcagttgctagtgagttctggcgtgtgctgtgcagctgttcagccagccggtggttgttttttcttttcttgtaacccgtctagggtttttactcctgcttattgaaaatataattggcagttctcctgccggtttagtttcaaaaaaaagtataatagtaggctataagccaactataagcttatgtggaggaaagagaatttgaaaaatggagaggattggctttcatgcaagagctagctattcacatactttaagatagatacattaaatacataggtgagagatagagagaggagaagaaaaaaaagagataaccttatagcccatttactatacatgttaactctaatataagctataagctcatagttggctctcttattaaacttgctctaagaaatcgtccgatcccaattcccaaccttcccctatacactcggatctccctttcctcctcccttccttctcttcctactacagtacaccacaagattaaaaaaagtttgaaaaaatttatgtatagaaatactatatataaaaaatatttgaattcaatcaaatttgaaacgggtatgtaaacttttgacttataaactttgggtctataaactttaggtgtataaactttagatgcatagaaatactatatatagaaaatatttgaattcaaattcaaatttgaatcagatataattcggattcaaatttgaaacgggtatataaactttaggtctataaactttaggtgtataaactttagatgtatagaaatactatatataaaaaatatttgaattcaaattcaaatttgaattggatatataaacttttgacttgtaaacttttggtctctaaactttagatgtgtaaacttgaggtgtataaactttaggtgcataaatttactaaaatagaaaattaatgcggtgccaaaaaagaaaaccaggtgaaggaagggggggggggcgagtttccggccaataaggccatacattgcctcctctgcgaagagctgttcgtctaccgctacaaccaccctgcagcagctgctggcgccgctgcggctgatctcaggaggctccccgcttgctctcatggcgtcgtcatcaacatccacgggagcaggaacgctgggatactactgtgccgccgcaacaacaatggatcagagtttcagcttgttgtccagctcaccttgtgttagagctcaaggaagtaccagctggaagtcccaagagaaggaaggacctgaaggggaagacgacaacaaggctgacgacgtatagtctgaaggcgagttggaggaagacgccttaccaaggggaaaacgcatccggcgaaggaacaagaagtacatgggacctgactgggctgtatgaaccatctctgtgtatcggcccatcttggccatgtaagagagagagagagagagagagagagagagagttggtgaggagagaacatcctataaatacgcaaaacaacagttgtaataacttggcttggaactcggcggcggcgttggcgacggtggctcggtccggttggacgcgagagagaaatctatcaatcgagttcctcgtatcatcttgttcttgtgtgcttgtgtgaatcgtgagctagggttctaacaccttggagggatgacttcactagaagatgaaaatgatggctctgcagatctgccgatccctcgcccagtggcagctgagctgtgcaagtatgatggcggcttgatctggggcactaactggttgcgaatccgtcatgccgcaggtgaagaccaggatctgtgctggtgggaaatgtaatgccctcattgtgacctctaggccgcattcaataggcaaggtgtggtgataccgacgggtaccagataaattagagcgattcacatcatgtggttttttacaaactcttgagagtctaaaataatcgattagccatgctcatggtcatgagcggcatagtgtgtgcgccataagtatagttttgttcttttaaatgtgtgaaataggccatgggattgggagtttatgatacttatgatgattatgatggcatgatggtgcaagtgtggatatgatatttatattgttgaaattacttacgtggatcacaatgttttatatcatgtacatgctttaacttgtgttataagttccgttgcaaaatgtttatgaaacaaaatttgctttgtgctgaaaatgaaaccacaaatagccctcctttgatttagagcttgcataggtttgatcgtggctttgccaatacattatttatataatgtaccgactcttgcttgttgattattttgttgcttaggttgagggtttcagcatgattctaactaggggcctacccctagtcggtttgcttgtgtggaagggtagacaagctttctgctaaacttctactattggctggtcggccttatatttatgatttagttctatgtctttaattgttcctaagtttaacttaggcctttgtgttttggtggtctagctaagatgaaagtgtgaagctagcaacttcctgaggctagctgatcacgagtaagagttttgagcaattgcgatgatcgtggaatttagcactttcagtcaagtcccctgagatgtgtaacacatttagtcgccgccttcgtgcggtctggcaggtacatcttaggttgaagttgactggcaaactattccatcgaagatctcctttgttccctactcggtgctttgggttttatattggatttcttatttggcatgccaaggcaacaacgaggttggatggttacagtctatgttacccagatacggggagtacgacattttttgaaaaacacgcatacggggatatgtcatatatatgtatatataaaataatatgaatttatgcataggaaatcagtagcactagtaataaacagttaatcatgtcttccatttctctctatcttaattacctctacaacccactggatggcatgttagtttgccatggcttcgctggtccacttcttgtgtgaatttgcaactacatattagccgtggtagctctttggagtgttagatgcattagcacatgagctattataaaattcattagctctaaactacatagcatgcacttgcacttaaaaaacagaaaagtggaataagaaagttggaaggggtaacaattcactcattcgaactaacctggctcgctgtgagatgaacgaagttagtggtaacgtggtaggtgatggcggagttgtgccctggcccctgtggtacaggggcggagccacatggtggtccgtgtgggccatggaacacagtaaaatctagcccaaatgcctattacccctgttctgatgcaaacgtagaaaagaacgatgcttttgtttcattagttgatttgccttatcgagttgttgtttcagcttccgtccttcccagttcccatcctgactacaccattgatcgtgcgagtgcttctttcgtaactcgacgactcaacgattgggattggggacccgtgtccaacgggggcaatcggcgtctggcgactaggatcgagagcagcgttcagcaagcagctatgtcactatgtcagtttcggttcgattttagaaattccgattagaattggattgataaattaaaacaatgcataatcctattgtagtgtttagaaaatttatgttaagttggaccaccctaatctaaaatcctagctacgccactggttgtcatgctaaactcaatatctagcctaggtatccctacaaacaggaaatatatttttaacatattttgatgtgtaactataacattaatgagtctatatatcttgattcatgattaagaattttatcgcaacaaaaaaaatctgttgtatattactgtagccattatctttaaatgcattatctgtagcaataataatataaatagccacatctgttacatgctacaattatgtcatgaccagttaagaagtatatatacattttattatcataaatcttataatcatatgttaaatcaagtttactaaatttactatgtcccatcatgacacatgatttttagttttaaggtgtgatgaagtagtcgatagcatcaggttaattagctattcatatatacaccgatactcattattattgatacaatagaactagtactgaatactcattgatattcttttatacggtcaatgtttaaggtattctttttttcattttcacatctttgttagcacacatctcatgggaggtgcttctaaaacacccaataaaattgtttgtcttttttttactgattttttctgtactaatccaacggttctccttatccaaatcattcattcaacggttgatatttgtttgatgatgtggctcatcttggtgacatctagggattcccttttcactaatgtagattccttgaaatgtggccaatattttccttgatcctgtgcaccccctccccttcccagcatgcattttatgaccacataacaagcattagacactatctttgtttgaattatcgattgttgttcttatatgcaattaatcaccgtttaaggataaaaaaacatattttagttatagcatctactttatattgagctctatcgttgagtagaaatgaaatagtttttgacaaaacgctaactaaatcttatatgtaggtactcttcaaagtaatatactggtttcggttttgggtataactacaaaggtgtgaagagaaaatggtgattattcacgttgcatgttggaacttggagacaaccgccatgcaaatttctgtcaacttcaaatggagatttaacagtaggattattctttaaataagttttttctcttctttgatgatgacatttattcttgtgtcgtctctctatcctttgttagaaattgttatacttggttttcaaccaaaaattatgtactaagtggctatagctttagttgaagtaaaggccagatattatatgttatctaaagaaatcatcattcaaatcaaggagaccgaatgaaaagcctatatattgttcatagtcttacgctcatatagcttagaatatatgaccgtaccatacacaaatacacaagcaacacatgtacggttgatccaccttgagggatcatgcgcaccagaaagcagtcttctcctgacgtctgaaaccgatcctcacggaaaccgacatgaatggagtgttaggaatggggcctttattatgacgggtggccatcaagacaccaatattcctgagattttgtcctttaattctcaagagaggggaataattctacatcataatatattatgtgaaataaatctcctccaaggcttcaaatccctcttaatttttttatgggaggaattaaacgaacaaggcctgatggggttttccctacggatgaagtgtctcacaaacttgaaagtcaggccgggtccagcccgtgcccgtacacgcacaagcacccctctttaccaacatgacaaaaacacggctcgatccatcgctcgacgctcggatcggataggaataggattccggcactgactaaagaggatagtagccacactattcatcggaaaaaagtttcattccccgtaggttacctgtcgctcagccagccatgcacgcatggctgatggctcgcacgtgccatccatcggtgatctcttcagcaatgcgtgcagggccaggttcaacttttcgtttttcgttttgggtgtttgtatctggcggtgcccctatgacgaaatttcgaaaactttggtccgaaatttagaacaaaatttagtcaattttgaataaataataccaaaattcacgtaaaattttaaaaaaattaaaaatttcggctgaaataatatcgtatcggaagggccgaaatgttgaaccctgtgcggggctgcttgggagtatagtattttttaacacttgtaaaggcaccttgtaattttaggtcaccaagaacacacttgtaatcttttctagttgccttacgaatacccttgtaattaagttaagagtgacaggcagcatataaacacatgtccttgatagtcgatactcaatcataatcacaaaaaaggaaaaaaaacgatttttttaatccatcggattgctagaatataatcacttgtcctgctcttcttgaccatgcaagatctgaaatcctgaagaactgtagggaactgaagaatcacctgtgtcttgggaccattacattgttct

SEQ ID NO: 45557 - DNA, 20750 bp, Oryza sativa
  unsure (1)..(20750): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnncctgtcttgcaggctgccaaacaagaaatttaacaagtgagagggaaaaaaattaccagcacaataaagaagaatatatggcatatcgagaataaaggtactctatacttaaatatgatatgaccctgttttcaggagcttagctttgaaacagttattttttttaaaaaaagaaaaaaaatagtacatcaaacagccaattaaccgacaaggtacagcgcaggacaatgatttttttttcttgcaggttcattgcttatgcttcccagttgcctaccaaacaggcagtgcctgtattacagtagaactgtagaaaggtttggtcaatcttcattagatccaatgataaaacattaatttcaaagccacatgtattaatcaacatcagattcatctattctaaaacatcaaatatctgatcccataattgtggagttacaatgatttggttcaacttttgtgattgataacaagcttcaacagttcaacagtaattatcttgacgaaatgcaaggttaagagtaaatcagaaaagagatgataaatcatgcatgaagccaaacattaagagctattccagagaaagtacaaaaggcgatcggaaacattaagttaagaaataaatgtaccatatgtgaaaaagaatgaaagcaaaaaggcaatatgcactactatagaaacattatgaatttgaacagccctcactgaagtaccatttcatctgctgaacagctagcatcatctacaggataatgtttgattgtggcatcagataaatttccataacaagcaacatcacgataccgcacaccaccatcgcatggcgaggagcacttcatccatggtccagcaacccaatgatagatttctgcatatattagtatactaccaatcacttattctccaagtaatgtatcaacaattgacaactgaatcgcctgtgaacaatttcagcacaaattatgaacggtaaagaaaaactgcaaaatggtctccttgggtagtactaaatttgagtgcgactctagtgcaaagaataaaaaggtagaggaaacattttaatggtaaattgagcaagaacaattgaaggacctaagaacatgaaaagaactaggaacagccaaatatctgaaagataaatcacagaatattttgtaaacatcaaattattccatgcaaactgcaggattcacatgttcatgaacagttaaatataccgtgtggttttaactgcattgatagctcagcaccactcttacagtaacccatttttctatgcttgatcagaatggttgggtcagagcaatcagagcagcatacaaattctttgccaaaatccagcttgttcttgcaatgcccacatttgtttgttagctttggggtgcctgtccttcagaatataaacaatgtattagaacaccagagtaattcattacaatgtttctgtaatgtttgaaaaggatggtctagattctgcgcctacttatgctaaggatggatgcagaagactaatgtagaatatagtagatgattgagcaactttccaacaatacatatacccatgcacacacctgttatgcagcaatggaaatgtttgtggaatggaagacatggcgggctttttgactccgtgcaaagaccatcacaatcatctgattgagaatctaagaagtggccagcagaacacactctagaccatttgctttggcacccagtccagtagcaccctgcatgttgaatgttacacttctatcataatgcggtattgctgactttaccatgagtccatgaacatgcatgacacatatatttagcataacttaaaattttccatgccatgaccaagcaacttaaaaattcccaagaaatgccctgaaaggatattttaatagcataactgtcactaaataaagtgaccgttttttgttcaatttaccaatcaagtgagtcatgcagggtttataagtattccaatcatttcgatttcgttagctggacataatctccagtctttggaattctgagttttaggactacgcatcctggtttgcgaactgtgcagttattattagctcatcagtgtcacgtaacaaagtagatcgaagaacaccgctagtccactactcttcaagcaactggacactctaagcaatttggcaaatttaagcagtcgactcgaaacctgggccaattcgtccaggaaccaaattattcatttcctgaaaaataatactactaacgtaaagtcgaatctcgaaaagccccaaatccaaatccaagtgcccaactagagtcctccagtccccctagtcctcctaacaccacatttcgacttctcgagctctccggagcaagccagttcctggctgggcttccgaggcagatgcattcggttaccgtgggacgggacgtcgaggcaggcggcgacggcgaggaaggggagcgccagcgcgcacagccgcggcagcgccgccgccatctccggcggccgccccgccgtcgaggaggatggccaagccacggcctcgtttcgttccggggtggcgcgagaggtggccggtgggggttggtgactcggtgcggtggcgcgtgccggcccgcgccgcggtggggaggggaagggttagcgagtcgctcgttcgctcgctcgccgtgcgccccccgtgtcggtgtcggtgtcggcgccgggcaggcagctgttttcggggggggctacgggtgggttgggcggtcgccgcgtcgcgcggtgatcctcctgcttcgggccttcaacgcgaagccggcgagcttgggcgagtacttcttttgcctgggccagaacagcactgcgacggaaattcggcccatgcttgatgggctgggactggactgagacatacgtgcggcccatgtatattcgggccggaacggtattaccgcgtacgtgaggccgaacaggtttcggaaaagctaattcgtgtgtacgtgttggcggcgcgcacgccggcccactaaggcccatgcacgcacgagctgcgcttctctctttttttttctttcttttttagccgccgtttctttttttttttgctgttttttttcctgccgtacggataggagaaaaaaatcgtaattagtttagattagtttcatatttttactagggattagtttactagtaattttaaatattaactttaaaattttcaaatttagatatgaaaattttcaaatatcgagttgaaagtttttaaatatcaagttaaaagtttcaaaattttcaaatctagacttgaaagtttttgaatcgagttaaaacttttcaaatcttgagttgaaaagtttcaaatctcaagttgaaagttttcaaaattttcaaatatagacctgaaagttttcgaatctgagttgaatctcaaattgaaagttttcaaatctcaagttaaaagttttcaaaactttcaaatctggacttgaaagttttcgaatctgagttgaaagttttcaaatatgagttgaatgtcttcaaaatttgaatttaaaatttaaatctttaatcaaaagtttctaaatctaacttaaaaaatcgaaaagaacacgtaaatgaattaaaacatgccgaggagaagggacgtgaaaataggagaaaaatcaaggaaaaaaagagagaaacgtataagggggaagggcgtgggccgtgcgcacacgcgcaagtcaagaagccccaacaggtttggtccggaacgggaggccgacacgcgtgcggccatgtactatggcctgtgggcgtgtagctggctgtagccggttgcgacaactagctgttaacgaccaaatttggtaatcgtcatcggagatgaagattagactgaagcagaatccaaaacagagatcgtcctggaaacagagcgggaatcagctagatcagaatcggctgcggctttaattggcagagttcgagtcggacaaggttagcgattgagccgaatccgacaatgtgacacggtatacgttgtcaggttgagttaatgtgcttcatgaagattgccgtgcacggattgagtcctgagaaggcaactgtatctattaattaggatattttatgtaatttccttagagatatgtttgggcaaaagtctgccgcaaagacttgtggtatcttagagtttgttagagataagagtcgtgtccgacatggacgtattttgtaatctcgggtataaatagaccccgagccccatttaatcaatcgaacacacgttcaatacaatctcgacgcatcgccaccctttattttcgttttgtttcgacgagttcttactttcgggttgagctacatcggtttcgatcttcaactagaggtaaaacttattatggcggcttgcgttctcgggattagtgcttccatctttatgacactctaatattgtttatgtaattcgtcgaattatcatatatccaatataatctccggcaatattgctatctaacctccaatcggctaacgtctgttactagaaggcaaccgatcaggttaaatactgacgttgacttagattatataggatatctaccactctatgaaacatccaacggcttgattgtctagatattgtccttcttttcatacttatagctgcatcagttgagtttgaccttataagtcgtgattagaatctcaatctctagtctgcttttggttgctgattagggtagcatcggggtttcagccgatcttatctgatttaactacttttatcttatatacttgattgatatattaaatctgccctttatgttaaaatctcgttgcatttaaatatattaggcttttgtttggtatattccacttgctttgatatcttaatatggagtggtatcggagtattagccgatacatgctatatctatctgatcggctatgctatgaacatatataatcttgttgttaatatatatttcgatctaagtgatttatactatctcggcatggcgaccgatctaactcaatcacttgatttaagtatatatcgacataagaattatatattgctaatatctacagccgatcgagtagatttagttctttcttacttattcatgactgccgatcgatctacatatgacatcggctcaaagataaatgatacgtcatcggcaactagccaatcggctatcgtttatgaatttaaccgcggtttctttgtctttgtttattgttgattgcaggatcaaatcaactagcatgctcacacacctaaaggcaagcttttggacctgcattggagttaagcagatctcctaggcctcgtgtttttacatcaacactagcgcacagccaatcaacttcgagcatgtgcaatgggtatccctgatccgtgcccctactcatgccgtcggggttttactccggagctgtctcccagcagaggggcacaacccagctgcgaggcgccacgcgcctccctcctctcttggccccttttcgtcgagccacggaaccgggctccgcgttgggcgcaccgtggctaggggagtagctcgtgggcactgctcccaccctggatttttctcttccacccctcgccctagtagatccggcggtgaagaggagcatcatcggcgacggtgaagagagagaaagaggcagcgacgggcggagggagagaggcaactttgtttgtttagagggtgtttagattcaggggtgtaaagttttggcgtgtcacatcgggtattatatagggtgtcgcagggggtgttcagacactaataaaaaaataattacagtttccgtcagtaaaccgcgagacaaatttattaagcctaattaatccatcattagcataggtttactgtagcacccgtattgtcaaatcatagagcaattatgcttaaaagattcgtctcgcaaagtagtcgcaatctgtgcaattagttaatttttagtctatatttaatacttcatatatgtattcaaacgttcgatatgacagggtgtaaaattttaggttagggtctaaacaggcccttagactgtttgaggtaacttctctttaaacggtgtacttttttaacagaaaattttcaatatcatttggatcgaactaaacctaacgtcgtgtttggcagatcaggttgtgaacttctcttccacgtacgtaaaacggagtgattcattagcgtatgattaattaaatattagcttaaaatttttttaaatagattaatatatttttaaagcaactttgtagaaacttttctaaaaacacgttatttaaataattcaagaaccgtgtgtgtgcggaaaacaagacattaaaagttaggaagttacacttaaaacacagctttttaaactgctaaacggtacgttttttacaaaaagtttatatacgaaagttgcttaaaaaaccatattgatccatttttaaaaataaattagcaaataattaattaatcacgcactaatggattgcttcgttttccgtgccggaaggatgtattcccaacccaaacaaaagaaccgagccttagccatgatcaagacagcagatagggtgttactggttttctccccattcttcccaactgcaaactttcagccgaagaccatataatttgggaattgcaaagtcggttttaggagccagtcctcttccacacaagtctataatttgcatactcgagacacattactttgcatctgggccgcgatacgcgccccttcaacaatcaacatggcgaagctgatcatatctcagcgtcattgtttgactggctcttcgagactctctgtccacgccatgcgagtatgcgacgaggggcgacccggtgagatcgaagcttgagtctgttaccctgtaatgcccgaggcgccaagtgcccgattgagacgaatggtgatatatgggttcttgttctcacatctggtcgccgtaacacgacaccaaccatgcatccactctgccatcggtcgagccgagcatgagttctccctaatagtacattattgcttgtgaccggctccttaattcccaaatcatggctttgttcccgggtaaaaagcaccattccagtaggtaaaaaatattctaaactcttaagggacattcactccttgtttcactccttgtttgtacgtcatctaaatgattataatgaaactttaaaaaaatcaacaaaagatattaatatgtgataaatcactctagaaacatacaatgtcagatttaacttatacaagtaaaaaaccaattttgattgtgaatatgtgttaactagccatagtttaatttttttttcacagcgtgtagaatgaattttatcttgcatgtttgtggagtgatctatcacatattaatttatcttgttgaataattttttataactatttaaattacatataaataacgagtaaatgtttacttgaggtattagaattccctcctcgttcaagtatcgatattcgtttttagcgttattgtacatccgtgttagcttcttttatctcaggccttatttagttcgtgaaaagagaatttttaagtgtcaagtctgacgtttgaccggatgtcggaatgggttttcggacacaaatgaaaaaactaatttcataactcgcgctggaaaccgtgagacaaatttattaagcctaattaatccatcattagcacatgtagattactgtagcacttatggctaatcatgaaataattagactaaaaagattcatctcacgattttcatataaactgtgcaattagtatttttattttatctatatttaatgtttcatggatatgttcaaagattcgatataacgtttttgggaaaaaaaaattaaaaactaaacaaggcatcagtaggtcccccaattggctctattcgtcagatgagaaaaaggctaatcttgagctggcacggccatccatatcggaatcgccctgacctttcaagggcaatcagtagtactacctccatcccaaaataggtgtagccatgagtttctgcgtccaactttaatcatctgtcttatttaaaattttttataattagtatttttgttgttataatatgataaaatatgaatagtactttattcgtgatttatgtttttatttttttttaaaaaaataaataagacgaatgattaaagttaagtaaaaaaactatggctgcacttattttagggcagagggagtacttccagtagactactactcgtagcacaattacatgtaacatggtggatcgatctcggagaggggtccctactttggggtgatgatgacggactctttccatgcatcttcccttctagatctgacagtgacaccggtacactacaggtgcggggagagtgagacaaagacagcgaccggtgacaccgatcaatatctaacacacgcccgtccatcctccagtgccaatgccaacatttgcacacaagaaaaatgcaagtgtccacgcaccgcgtcaccgcgcgatggggcgcgcagagcggacatcagagcaaggataatggtgaactataagcaagctaaatacttacgtggaagagagagataaataaaagtggagagtgttggctctcatgtaagagctagctccacacaagttctaagaaatatatattaaattcatagagagataaagagagaggatgaaaaaataaagctaacctattatatatgttagctttaacattggcttataataagtagtgggctatactactaaacttgctctcagcgcactggcgcgatgatagcccgaccatttcgatccccgcgagtcacgccgcccctcgccaccgccggggctcgctcgctgcttggctcccgtcggtggtgcattggcgcgtgcgtgcgtgttcgtgcttcaaaaacgcaaggcgaagagaggtaggcaccgcgcgacggctttgcactgccttgtgtgtcggttgctgcacgtctcgctcacgctgcatgcgccacgccggatcagatcgcgcgcggggcgggacacggaccgggggggggggggggtgggtttggcgcgcgcggcgcccatcggggtcaggcacacatgcccggtgtcgatcaggcgcctagctaggcccccacctggcagagcaaccgacattgagctggccggcctagcttctcctctctctctctctctctcgccgggggccctcggccaccgcatcacgcacgcggccacacatcgatccgcagccggccggcagggcccgccaggaacgttcctgcactgcaggcgatcgatcatggccctgtacaattcctccctcccatcaccatttttttgaattatgagatgcagcaacaacttgtccatctgcactgcagcagcaacttgtaaaaacaattcgattgcacgcgcgtacagccaaattaagacagcgagtgcgaggtgtgcagcgtttctgttcttccatgccgtaaatccgaagcgagacgtgccgatcgacaaagatacgacgcgctatacacgtaccagcgctatctcttgtcttatgaccggcatacaggcacttcgatggacggacgcatccatccaaaactgacgaaggattcaatcaagtgagcaagtccaaagcacacacagaagacggacagaacagaccacagcatgaaagccggacgacgcgcgcggccttggattttttttttttgttttgcacacgcgtcgatcgacgcatcgaggaacggaaagctttaatccccagacagttctgcatgtgcttcggtttggtcgatgaaacaagcagggctactgcggaattttgcctgtcggtacgttagagcaagtttaataatatagctaactactagcttaaattcatttatagccaatctaactactatcacacttcgtcttagagtccgtgttataactggctacaaatctatagttcgctgtccttctcttttctcatttatctgcttaaaatatatttacagctggcttatagtctgtgctattgtacctgctcttatgcggcgcgcgctcgccaatactcctacatgcgtgatcgcgtggtttttcctggcgcgcgcgcccttcccggtgccgtttttactcgcggcgccgcgggtgatcgatccgccagctccgggcggtcactttcacatcaagaaacggagggggaaatagccagataggagtgcacggacggcagctagcttagcttctcgatcgatcgtcttctcgagcaatgccttatctcgggtgccataccatgtcgacacactcgcatcgcattatcttcgccactgaccgtcactgacatgtgggccaacgcattaagttagaccgccgacagcacatgcaggcgacgacgaccgttttcctgacggttgattgaaacggatcgtccgtttccgttcgttaattggtactactacctacgcgtagcgtgttgctccctaaacaactcccagatcaggcaaaggaagcatcgtctcgtctgcacgtactctaccaagaaaatgatcagcgccatggaggccagaacatgcacacatgcggtgcgacccctcacatggggcaacagggcatgctgcaaactgaagagtcgaagaccacggttccctccccatggataaaagatctggtcttttcagttatcagtgtccggcatatgtatggggatcaagtggtgggggcaaaaaaaaaaaaaaaccagtggcatgatcgggcacagctcgcgtcggaacaaggcatcgtgtcacatggaagaaacccatcgcttgttttatggaccgcgcggcgcgcgcgcgcatgcggaccgcgcggtgactcctgtccctgtgcaggttgacggcgagcacatgcctagctacgtcgtggtagccccctgcaacgtcccacgtacgcgcatgcaaattgcagcatcacgattggtctggaattgtacatttgtactctctgcaccagggaaaaattttgtccagattgcaggggagagatacggttggtgctgtgcgccgtgctgcgaatactgcgtccagtcaggcagactcgagctcggtcggtcacacgaacaggcgtgcatgcatgaggcacgcaggccggtcaatcgccttgcacgcacacacacatcctcgggtcgatctggccatctgggtcgcgtgctggtttgggtggaatcgagtttctagttttgtcttgcgttacgatttcccctgttcgggtgtgttgtaatcttgttgcggactcgcggagtcgcggtatatactcggtacatgtatattgcaatttgcgaggggggtttgggtttcctcgcgcaatcaagtgcgtatatacttaagacgcgcgcacacatgggcgccatgtgtcggttgagtatccttgtcagggtttgatccagatacatgatgctgtccggccttccagcctacaacatgatcctggaaatgatgtgatgacatgatgacacgatctgaacctacgatttccatgattaaactgagcttcacaacctcgggccacaagaattttcacgtgaagccgttcgaattgcatgcgagtatgcaacttactcctacatcacgaaaaatggtccataccgcaaagggaaaaaagaaagttccaagtgccatggtaaccagctcactcagtgacaaaagtggtgaaagattcctaaacaccggcacgccacagcgtccagccggtgcccggttgtgcgactacgatgcttgtcccctcgcaaaatcccatgatgaacgctaaccattaaccaacttgattacatacggcggcatctgtgttatcacgggaaccgcagaggcatacgtaaccgacgaaaaaaacgcggacgagatggcgaaactgcccctcgtcgtgcaccgcctcaccgggccgaaagccagtcgcgtgcgcgtgcagagagacggcgcgccgcacgtactgtacacgagccggtgcgcgcggtaggaaacggaagcggatcagggggccatgtgaccgcacgcagggcgtgtctcctacgaggccacgagggcagagggagcccatcatccgctcagccgaatcgccgatcggggacacgcgtacggcggaagatcccgtggcatttcgtggtagtaatcgaccaaccctaggcccgtttcgccggcagcttggtctataagttgctgctctgccctgctcggcctcatcatcccaagcggcacagcagcctcgagctgaactgaagcaggggaggggaggagaggagaggagagagcaacgcgttcaccgttgagagaagagaaggaagtaagacgagcgcaatgcgtcgcgtcacggtgctcgttctgctcctcgcctgcgcggcggcgcgcgccgccgccgccgtcgtcaccgacggtgagtgcctagcttgctcgctaactctgctcgataatcactgcgcaggctcagctctaatttcacttcaagcatccatttatgtagcatactgttaggaagttactgcggtttctgtataagctgttttgctgttctgatcgatcctatctatcagcggcaatgcggcatgtgccattagtgtctaaaagctcgtaatcaagctaagctgcctgccccgtgatgatttacgatcttggagtcatggagtgaatagtaggatagatcacccgggtccctccattatccatatactgacgaaatgtttcccccggtcgctgtcatagcatgaagccacgaactcgatcatgcgttgatcattggagtaccatatacagggtatactgtagtttggttaaccccacacggccaaatcgcattggggcatgcatgcataatcacaatctacatgttgcatggctggcaaagtaaactgaagtacacgtatagttaatctcctattaaggtgtcgtggtgtgcagcaccagatgccgaccgagcaaaagtagtagtagtacaactatacaagcattaaagcatatgcagctgcagcccatttgcaagaaactattcttgctttttagtactagtcgtgaacgtgttagatgcataatcagatatgttctctggtccagtgttctggactagtagtatgcaataatcagatctggagtatcatcgtctgccagcattaggcaacgtttgatgcgagagtgcttttgtgcgctctcttgatttggtttctcgtttgttttgccggccgcggccctggttgcgttgcatgtggtagatgggatggtagtgaatgcacctgggccctggccgagccagaggaactgacacggtcatacagccctactagctgccggagcccagaacatgcatgttacactaacatggaccctgtcagcttagcagtataccggtcgcagttccattaattaacagaacacgagatcagacagacagcctgcgtgcctgatctgatgctctgaatcgatctctgctaaccgcagcatcacctccaacaactttcttcagttgcaggctcgcagtgcagcggccgatttgaatatctgatttagtggattaatctgattaaattaatggtgactaaaaaaattaacgacgtgtgttgtgcagggctgttgccgaacggcaacttcgaggagggcccacccaagtcggacctggtgaacggcacggtggtgcgcggcgcgaacgccatcccgcggtgggagacgtccgggttcgtggagtacatcgagtccgggcacaagcagggggacatgctgctggtggtgccgcagggcgcgcacgccgtgcgcctcggcaacgaggcgtccatccggcagcggctcgccgtgaccaggggcgcctactacgccgtcacgtttagcgcggcgcgcacctgcgcccaggcggagcagctcaacgtgtcggtgagccccgagtggggggtgctccccatgcagaccatctacggcagcaacgggtgggactcgtacgcgtgggcgttcaaggcgaagatggacgaggtggcgctcgtcatccacaacccgggcgtggaggaggacccggcgtgcggcccgctcatcgacggcgtcgccatcagggcgctgtacccgccgacgctggccaaggggaacatgctcaagaacggcgggttcgaggagggcccctacttcctccccaacgcgtcgtggggggtgctcgtcccgcccaacatcgaggacgaccactcgccgctcccggcgtggatgatcatgtcgtccaaggccgtcaagtacgtcgacgccgcgcacttcgccgtgccgcagggcgcccgcgccgtggagctggtggggggcaaggagtcggcgctggtgcaggaggtgcgcaccgtgcccgggtggacgtaccgcctgtcgttcgccgtgggcgacgcgcgcgacgggtgcgcgggctccatggtcgccgaggcgtacgcggcgagggcctccatcaaggtgccgtacgagtccaagggcaccggcgggtacaagcgcgccgtcctcgagttcgccgccatcgccaaccgcacccgcgtcgtgttccagagcacgttctaccacaccatgaccgacggctcgctctgcgggccggtcatcgacgacgcctccctcgtcggcctccgcaagaagacggccggccggcggctgctcctgtaagacgaacggccgcgtggcatcgaacgccgtcgcattccctccattctatgaatatatgaatacaaggcgcggttaaacttgggggcagttggcacgaccaaagttgggtgctaaaatgggtagtattgctaggctcgtttttttggttttggtgtgtactctggtatatgtacgcgtgtgcgcgcgttgcatggttatactttggagctgcgctcgtttggtgttttgttgtgaagaggagaggtgatacgtggtgcaaggtctgtcacaaggggtttggttgatcaacttaaccggaggtgccaacctaaacgcaccatcagacattatgaatgggaagcattactagtgctcacttttttataagtcaattgtgtatttttaattctgttctaaaaagccagatcctttttgaaagttgagtcatacatttgagctatgctcgaaaatcaatcggaaacgaacttaaacatgtgtaaatgatgtatgaaagtaagagtaagttttatatttagccacattttcttattagaaaagttttaatttggatcgcttgtttagctatacttttacttcggaccagataacattttctttgtttgcatcttggaccaccttcactatacatctatttcatccccacccaaaacccgggtaactggaaacaagaggggacacacgccactggcgccgagtggcttgagttcagactttgcgcaagctccatccatgttgcactgtggtcaagcttggcttgctcggtttggttcggctctgcttggctccatcataagtggtgtcgatttttctatctcttcttatatgtaccggtttatcgtaaaagcaggtacaaatatttactacaccgttttgtcatagattttttttaataaaccggcacctataaagagctacatgtattggtttttaattttaaacccacatgtggtgttaggagttcggggaaggcttataggtgttgggtctagagttcccgacacctatagggccgtcccctatttgttgtttgtagtaatagatacatgaataacagaagtaggctaagtccctgtttgattcagcttaggattattataatctagtttattaggagtaagctgagacaaacaagtagattattataatctataagtcagattattataatctgataagctactctagaggagcttttttcagattattaagtggctaaagacccactacccctacatacttgagaaaaattacccacctatgccatcaaccgaacagatagctgagggcattatagactttagccattcaaacccaataatccatgccttcaataatccagacaaataaacaactcacagcttattctatgccagcttattataatccagcttatagtaatctggcttaataatctagattataataatcataagttgaaacaaacagggcctaagaaactttggattgtattatggagtaccagtttgctaaatttatcacaattgatttggtcctaagattttttttttttacttttgagacaattggtttccttttccgtaaaaaagagaaagaactatgattttctttagagagaatccactcattaccactgagttcggcatagttcaacaatatgccactgactttgtcgacatccataatataccatcgcctttcacttaacctctacactttaccatcaccgtcacacactgttagtttgcaacgaggaaaagacaagtatgcccttaggaacgtgaaaaccattagcactgagactatgccatgtagggcactgagagtgataataactatacaaagaataatctacaacatgaataaacatgtaaaaaatagggatagctcaacatattttaagtatgaattatgtacagcacgtgtgcaatataaaaattgtgcaactaaatcatatgagatctcacatcataggacaaagtagtgtatcagtgaggggtttggaaggaaaatcatccatggaaggtgcatagcacaatttgacagaacagtgcataaaatccaatgtccaagtttggcataaccaagttcgaccacaacatgttccaggacagaaaccaacacatggctaaataaacaagttaagtggcacagcaatcggcacgacctctttcgatgacgacgacggcaacaccagctcttcagaagggaagccgtcccttagttgcgagttgcgacggcggcgctgatgacgacggcagcaccaacggctgctctccacaaggggcgtcttctcccatctgcgacgacggctcttcagcagggggcggcactgctgggaacggtgctgggggcgtcgctggggacagtgggttgtggcgacgctggggatgatggtgggggcgacgctgaggacggaagtcgaggcgctgctgggaatggtgctgggggcgccgctggggacagtggtcggggcgatgctggggatgacagtgggggcggcgctgaggacggcaggggcggcgctgaggaaggctgtcaaggcgacactggcgacgacgaccgcgccgacgatggggacggcggtcggggtgacgctggggacggtggccgcgccgacgatgcggacggtggtcggggcgacgctggggacggcggccgcgccgacgatggggagggaggcggctgtcccgtaggattagggctggccatagcggcgaggggtcggtgggggcagccagcggatggggcgtcgcggtgggcgctgatgcggcatggcggcgggcggagaaaagccgcggcgtcgctgggaagatggcggcgctcgagaatggttgattggggcggcctggtcagtgctagggttagatggctcaaagggtatttcggtcattacgggaaaaaaataacagtacaaacggcgtataactgacagactgtggacggcgatgataaagtgtagaggttaagtgaaaggcaatggtatattatgaatgttgataaaatcagtggcatattgttgaactatgctgaactcagtggtagtgagtggattctctcttttctttatcctactatctctgtttaccttttctcatagatttttattcgcgcatacttagatcattcatagtgcaacaacatgacgagatcctcacaccccatctatgttgtcgctccacataggctaggcccatgtcccttagaggatcctcgcatcttgcagaggacacacgtgcctcatcaggggattaatgagcaacatgatattcacccacatcaaaccatcatccatggaaatttccttagttaccttattattagtggatgtacattagtttgtttatcttttttaagaacttatgtactttatttgatagcaagaagtttaaaataacatattatataagtgatggtaacttctcccatagaaagattagaaagatcgcctaaagtcaggcgactagggaaataacaagcatgcatattagtttagcccgatataatctcttaggtatttcgtatcaccaaaaaaaactatactctctttgtctcattttaagtgcagtcataattaaaaggcaacaaaagtaatgtactcagattattaaaaggcaacaaaaggaaaaacggaattaaaaaaaaggagaaaaaggcctccaaagaaaaaaagggaaaaaaaagaaaaaaaaaagccctttgacgttggaacagtccaaacgtcgagaagctactagccccgctagggttcgccgccgccttcccctcccccataaatcccaccaaccccccctctcctcgtctctcgccttcgccaccttcgaatcgaaactaatcccccacacctccgcgtgcctccccccaatctcgagcgcacggaagccgccgccaatggtgatcgccccgctcccctccatggcctctctcgccctatcaatccttcgatctccccccaatctcaccctcaccgtcgttgcgtttgttttttttttacttttttttaggcgctcccgaatcagcagacggtggactaccccagcttcaagctcgtcatcgtcggcgacggcggcacgggttagcctcgcgatcgccctcccctctcttacgatttttttcgatctgtttggttctaggttgcggtataggtgtggtgatgcttggttgatgcgaccttgataatggttcgctgaaccctagatagattgaacggagagatacagccacggttgttttgatttgtaaattaagatcgttgtagtggttgttttgatttgtaaataaattaagatcgttattatagttagagatagagaaataaggctgtgttattatagttttgatctggcaccgattaatctggcagactcgctcctcttcgagtacatagcattgggactcgggaaggggatggtggggaagggaggactgtgttagatttgatttgtcacggatgaatgtgaactctctggtttttattttcgaaaatttataggattaaaaatttcttgtttcctgtgctcgaaattgccaggctcgaaaatttctgtctgttctgaaaccaggcaatctttttgatttgcaggcaaaaccacctttgtgaagaggcatttgactggcgagttcgagaagaagtatgagcgtgagtatctgctcctattttgcattatcatgtattcttatggtggatcattgtgtttttcgtgttaatttgactgtggttgctgcagctactatcggtgtggaggtccaccccttggatttcttcactaactgcggcaagatccgcttctactgctgggatacagctggtcaggagaaatttggtggactcagggatggttactagtaagtattattacatcgattgaatttgaagtttgtctcattagttatttaggatcttcagccattttgtcattctttgctatgcctagcctagtacattgtaatttgtatgaggaatataagcactgttagaattttactattgtgtgagactatttctgtgattttagttgatcctttccaatcctgtatttaactattgtattctcatgacactttatgtgaatcctggattttgttgatagtgccttagtgggtgaattagaaagatatatatagttctttgtttagttcttgtgttctataacaatttgtgatgcacacgatgctgatatatgcttatggagagaattcagtttagctttgactcataatatgcatgaatgctggatttgagcatcatatgccatgcattttatacaactttagtactactaaatttgtgagaagacttcttatcttgtggcattctgctgtttgattgcactcatgggtaaagttactgtatgctgtgtgtaacaaagctctgaaattctatttattttgtactaactgtaatcatgtattccgcattgtagtatccatgggcagtgtgctatcataatgttcgatgttacttctcggctgacgtacaagaatgtcccaacttggcaccgtgatttatgcaggtatatcagtggaactgagcaaatacatttaccacaaactgatggttgaaactaataggtcttgattaattacagggtctgtgaaaacatcccaattgtgctctgtggtaacaaggttgatgtgaagaacaggcaggttaaagcaaagcaggttaccttccataggaagaagaacttgcagtactatgaggtgtcagctaagagcaactacaactttgagaagccattcctgtaccttgccaggaaacttgctgggtaacgacctcagttatcatcaatctttaattattcagcaacccaattactggattaaaccaactctgttctctgtctttgtcagcgatggtaacctccactttgtggaaacacctgctcttgctcctccagatgtcacaattgatctagcagcccagcaacagtgagtgttcttacgaaattgctctaccaggggtgtttaatttatgccttcaaattgttgaacgatttctgattgctctgtaatgtgcaggcacgaggctgaactggcagcggctgcagcccaaccactgccagatgatgacgatgacctgatcgagtagatttgcaatgtgctactttacatcgtcttg

SEQ ID NO: 45558 - DNA, 2347 bp, Oryza sativa
ctgctagtctgctactactaattctgttcgaaggagttaacctgatgagaaactaatttgggatttctttacaaccgcacgtgtttgatgagtttgggggattcccttgcaatataggcgggagatgatcgatatcgagtgagaggtgtgtggactctggacgggagcccaacttggcaaaaccttttgggctttcaaagctgctcgacgggccactgccatcctctacaagtgatgaagtgaacacgataagagagaaaaaaaacatgataaccccccttaattaagtctcaaaacgtttatgcaatgaagtgcgatacgggcttcagcgagcttctcctccaaacccaataaccttgatatcttcgataatgctatcccaataagttaagtgttcggggtggggatggggggagtaagagggtaagatagtgttcggggatgaggagcttagaggtgagcacctgagcaaaggtattgtggggatagtagacagagaaggatggtggggtgagaggcacctcgtctgacgagtggttaggtggcaacaggtggtggtgacgaatccaggtataggaatcgttggagaatggaaaagagcctagaggtgagcacctgagcgaaggtgttgtggggatagtagacagagaaggatggcggggtgagaggcacctcgtctaacgagtggttaggtggcaacatgtggtggtgacgaatccaggtatgggaatcgttggagaatggaaaagagcgtagaggtgagcacctgagcgaaggtgttgtggggatagtagacagagaaggatggcagggtgagagggacctcgtctgacgagtggttaggtggcaacaggtggtggtgacgaatccgggtatgggaatcgttggagaatggaaagatggtagtgaatgggcatgagaagtgatagtggcacgcggaaaagctgctgctggaaggataatacggaatgggctggcggtagagatcgttgaaggaaggataataggaaaagggatggcggtggatgtgcccatcagcagggcggtggctagggttggctctttacatagcaaggtggagatgaaatctgggcggtggctagggttggctctttacatagcaaggtggagatgaaatctaggtttagatggttgatccaacggtcaagaatttgcaagatttgattgggcattttcatgtaaatgtactaaagcgtaaaacactatcgtaccccctttgtttttttaaatgtacgacgctattgatttttggtgcgacgtttaaccattcgtcttattaaaaaattatataaatgttatcggttttgttgcggtttgttttatcaataaaagaactataactttaacttatatttctacatatttaacttatatttctacatatttgtactatatttttaataagacgaacaatcaaacgttacgtgaaaaaccttcgagtcttatattaaaaatcggatctagtatatattatcatcactattctcaaaacttttcagagttaatcacaaatgaacccaacactatttacatgatgttcggggacatccccactccctgtcagcatgtagaaaatagatgggagagaattcatatagacatctatacacagaatctgcaatgcgaaactgctgataatggcagcttcaaacaagcaagcagcagcgttaattctcaggctttggaagccgcctcctgccaccgttgagggcccgtatcagctgcaggtgctcatcgctggacacgtggagctgcagccggagctgcgtcagcagctcctccttctcccacgtcagcgcgccggtggcgtggaacaccctcatcagcgcgccgtacgcgtccacctccaggcggtggatttgctcgcctaccgccgccgccgccgccgccagcggcggcggaggttgctcgttggccaggcgccgctgcattattggcgcaacggccggtcgcggcttcattgcggtggcggcgcgcgacttcgtcctgacgtcgtcgtcgtcggcgcgctcttctttgatgtgtggttggcattgcggctgcaatggcggcggcggcggctggttcgccgccacttgggcgtcccccggtgggctcctcggcgcggcgcggtcgccgttgtcgctctcgctgctgctgccgtcgctgctgctctcgctgttgctgctgctgccgctgccggccgacgagacggacttggcgtcgtcgtcggtctcctcgtcgctcatctcctgctgcttgttgacgaacacggcggtgggtggtggttcgttcgcgcgcaccacctccacgttgccgtatcctacgagcagctccccctcctctt

SEQ ID NO: 45559 - DNA, 7412 bp, Oryza sativa
atccgcttcgagttggcctcgaccctccggacctcgccggcggcgtcgtggtccgtcgcgtggcggctcctcttgatcttggcccattggtgggagggggccggcggcggggcgaactgatcggcggcggggcggtgcttcgcggcggcggcgggggcgcggcggtttgcggcggcgttggggcgcgccgtcggctccctggcgcccgggatctcctcgccctgcagggaagaaggcgcggcgaggtgtcaggctacggaagcaagattccaagaagagaagaagagggttgggtggcggcggcggccatggataccttgtaggtggcgacccagatgtcgccgtcagtcagcacctggcggacgcggaccatgctcgggggcaccgtgatggcgctgggcgagccgacgatcttgacggtgaactcgccctcgccgtcgccgtcgccggcgcgcacgagctcggccagcttccacatgcggtcgtcgagcgcctccaccaggtcgccggcctcgaggtcggtggggatctcgaggtgcggcggcggcgggcgcaccgagacccgccgtatgcggccggagacgacgtcgccgccgtcccaccggatgttgtactggtggccgttcccccacaccaccacgccgaggcgccacccgcccatcgacgggtccccgcaccacgcctccaccttgttccccaggttgatcctcatggccgccgcctccgcctcctccgccgccgccgctccaccaccggcttggttgggatcaagaagaagaagaagaagcccttgtcccttaccaacgcaagaacacgagaagaatcgatctcacgacgagtcgacgacgtccgactagtatataacgacgaatcggcgaggagacgggcgcggctcgatccgtcgagttcatcggcgagtcggattcgcgcccgcgtcgagtgcgtagatggaaacagattcgtgttcgagttcacggactagaactcgatcagggcacgacgaccgatcggtcgaggcggattcggcggcatcagcacagcatgaatccgagccgaggccaccccccgtctctcacatgttttttctttttttttccttcttttctttctgggccctaagcccaactagcagcgtgttgggccggtccaaaatttgttatgcacacaaaaaaaacttagggatacgtatgtacaaattttatagtgcaaactagcaaaattcccgtgcattgtaatggttattgtaatgggtgaagaaaattgtttcaatgagcatggtggctacgatagcgcaaatttcttgggagtatacattgtatattttgtaatattcatagtgtaggtggaattagagctaaaaatggttaagagcatgtccattcgataatcctctccagtctataataaaaatgtcatccgtatggtcaatatgataagcgtaacgttggggagagcagccaaccagccacgcctcgctctcgactcttgtggctcatgtagtaacggagctcgaagatcgggtcgcgggtcgatttacatggatgattataagaaaactattaataccactttaaaataaaattatttatcatagactaaagtttgaaaccatatatagtatttaattttatcatgtattattatgagtcggttgtaatgcatggttatttttttaattgatattaataaacagttttttcatatcgtaaagagtagccatagtagaagaaatgtttttcgctagctatcacagcaagctcactgcactcaaatagcagaatcgctttcactaaaaaaaatcagaagtaaattgtatgatgaatagaaaaaaaaggtgatcaggttaggtgtcctacgacaaatgagaaattgacgaggaaaacaatcttgatgcaaacacaattcgttttgttgatgattgtatttttctttaaaaaagaaaagcatgcttgttttattttttgaaaaagtaattcattttgtcggtgaatagcgtctacttttatctgatccctgtatgtgacctcctatttaagctttagtctataataaaaatgtcatctatgttgagtaaaccatttcgcatgcatgtataagaaccaacacgtgtatacagtatacgtgtagagtttgactggtcgtgtgatgtgtggacaatatatagcgtgcggactctaatataacatgtctcgtgaaaaaaatctattttttttcacaattattattctttatttcaaataaatattaaagtagaagtttaggctattttgatgccaacaataaaaagtcttaataaaagaaaatatttttgagcggaactgaatcccattgattagcacattctagatcacagtggcacttgacagtaattaattccagtctgaagctcctatttttttttttcaaaaaagaaacaaaaaagattgtactgttgtacattacgggacctatgtggtggttgagatccttatcctctcgctctcacggtctctctcccattttatccgtttacggggaatttaactatttgccactattagatttgttaattatttaaataacttcttatattttcgtagagagaacttctccactttttaccacttttgtatacgtggtgcactaactaggctgccccgtcatcttcttcctcccgacgatgatgaaccggatggtgctctgcgttggcggtgggctctgtgtgcgggttcctgatgatgacgctcgtcggtgttgtgtaggtcaagctcgtctacatcggctgcggcgccggcaacgccaccgcgtggggcgccgtcgtgcctctctttacgctcgtgcccaccgccatgttgatctacatcagcattgtcttatacgccttcacccactagctcaaccaccggatcttcaacaagcacaccaatgctagtagtctatactaatataaaaaacatcagttgtttcttttctacatccacccagaaaagtgtacccagaagtttcctaaccattggatccctcgatctaacgtctcacattgtaagttggattagcacttggattaatagatagattggattagcgcacgccgtcccccacacccatgtcccaatctcccacggtccaggcaagttcgatattttttggggccactccttttccatcgcgctaactcccgtcggctccccatcgccgccgcggaacaatcgcatcgctaccgccgtctccaccgcaccctcgccctcaccgccggctcaaacctccgcctcgtcgcccgcttcgcccatcgccatcgcgccgccgcctctcccctccaccccctaaccctaaccgcacctcaaattgcgtgaatattgcccgtctcgctgcagaatgatcctcttgaacgttgtcgcccgccgtttcccgccgctgtctcccgccggagccgcccctgcttccctgctcgcgccgcgatgaacaggaaggagagctggggtcggctcacaccgccaccacctctccctacggtgagcatactgtcacttttagtttttcattcattcatcagattcatttttcatccatctcatttagtttctccatctatatcagtccatgttcagctggtcacattcaacattgacacaaacaccttaactgatcgacatagtaatatagtatggatcaagacagtgttattttcaggaaattggtatgtcgagaggtggttctctcacctgaccatgcagacatgcagtacacattgaatccttcctctaaattatacgctgtgtgattctgatctgttaactttatacaggtcaattattcctgacagcagttgcttgaatgcttcaaagacttctggatccaacctgaagcccttattgtttgaggtcaacaagttcagggaacaatgaagaatcgttaaatacttcttttcaaaaagaatagttaaatactaaaagcaggaaggtttcatgaaaggtttcaacgagaggggaaccatgaatgagctttggttgcttatatcagattgctccttctgacgtaaattttgttacagcctttccacaacgtattatgcagctatcaaatttgtagctataaattcgatgttgtattatatacaagtattgaaatgaggtatgccctcatcttgtttcttggggaggaatagaggcaaatggcaaagggcgaaaaattggccatcagtacgtcaaatatcattaatttgattcttttcataaggaaagttgttgcttcagttgaaagtttatgattggccgttatggcctccacactagactgcttgttggatcttttctataggtttttcatattctggtttactgcacatgctacgagaaaacccaataagtatagctatccatatgtttcttgacgaattcagccaatagtaataactcagtcttaactggataaaactatgttctcactcttgcatgataactatagggctaactgaataacctgaaattttcagggcataatagtatgttgcatgccggtaaccctaaagtagcaatgaagaaactcatatgttacatactacaaatcccaaattcacgaatacgacaactttgggtaactttgagaatttaatcaagaataagtaccgttaatgctatcctgtgtttgtcaacgacaattatatttctgaatattttttaacctctgagtatatatacaggttatgtaaaaccctctgctactctgcttttttaggatttatttgtggcttgttttccccattgcccacaaagatcctgatttcactgttgaaaaaccatggccctgtttagattctaactgttttcttcaaacttctaacttttccgtcacatcgaactttcttacacacacaaacctccaacttttccgtcacatcgtttcaattttgacgtggaactaaggctgtgtttagatccaaagtttggatccaaacttcagtccttttccatcacatcaacctgtcatacacacacaacttttcaatcacatcatcttcaatttcaaccaaaatccaaactttggatctaactaaacatagcctaaacacagcccatgttttccagccttacacctgcatgatctggctagaatggaaaaaaacgaaaaagggttaattggaatgataaattaacatggatctatgggcctcgttgacatcgggcctggtcacgcataacctcgctctccctgaccgttaaactgaccgttactctcgctcgcacccgcccttgcttctcgggcggatccggcggcctccagtctagtccagaccacgcctccctcctcgagttggaacgccgccgccgactcccctctctccaagccagcacgtggcagccggcgaggagggccacgggcggagcgaagcggcggcgacctcctcccctcccgcacgcatatccttcaccaaaacttttgcaaaatcaatgtaatttgaaaactatcacttggaaaatgtttcaaaaggtttcctatatgttttccaagcctcacattgcaagaaaaatgatatttttgaatgaaaatgcccttttggctctcttttgaagaaactagattcttagttttggccaaaatgagattgagaaggaatttgagaaatgtttcaaaacaaagttggtagagaagaaagtttgtaatgtttttggtattcaaacctatttcaaaaatcaaatatttcaaaagttgtttgaaaatcaaattcgaccaaaaacccctatagaccataaaaggtcacctcctagcacttgagtgagttttgttgcaaatcatcataatcttcaaatattatgggtggttagcaatatttaaaaactcacacatttcaaaaattgctccaaaaatcaagtttttattgaattttattgtgtgggttgccggcttgtgcaaggactgtgcacagccagcagggggcctggcggtctgaccggcgctatatgcgcggtctgaccgaccaggtacggcggtctgaccggccacatagggccggtctgaccggccgaggtgggcctaggcagcttttgtcctttttcttgtcctttttcttctcccttcttcccctacccgactccatctcctcccattcagttttttccttccccaactcgaaaactctctctctcacctcccctcaaaccctaactccttcctccaccaaatcccctcggtttgaccgtggatttctcttcggttacaccgtaagtgattctcctccgcttcctctctctattccatggattggtttgtgtttttgttgagtttttgatccatggcttggaaccctaggtgaagcacgaggtgttcttccatttgcaccaatagatggtagtttcttggtgtgattcatctcctccaaccggtaaatcactctccctcttgtgcattcactcaaatcgatctatttcaccctagggctatgggtagttgttccaatcttgatgaaataggttcaaccctttgatgttcatgttccaatcctgtgctatattgttctagcaaattttagactcaaatgtgtagatgtgaaaatttttggatgcttgaacttatgggaggaggtttgcccggagccacaggccttctgaccgtgggtcagccgccggtctgaccggccggcaaccgtcggtctgaccggccaccagtgggcggtctaacttggctgatgccgtcggtctgtccggccaccatgggtggtctgaccggcctgatgccgtcggtctgaccggccaccatgggtggtctgacttactggctgcggtctaaccacccctccactggatataggcaaattttcacctctccaaattgtttctagaattattgctaatatcctatcatcctttgctctttttacaatgatgcctccccgcacttgccatggtcgtcgtgcgcccactccggatcccgtgagtgagcctaaggaatcgagcggagaggattacgctcacaatgatgaagaggttgaggcaaatgttgagggggctagtgaggtggcaagtggagatgatgtcagtcgtagtggggaggatgaggatgaagaaagtgatgatatgcactttgatcccttcatccagtttgtggtgaacatgaggaatccagtacagtataccatcttgaggcatcatgatcagttcttgaggcttcgggacactccggatccccgttttcacaccgctttccagaagactgtgtatgagcaggtttatgcagggaaagcatttgcagagcataagtggatttcttggagagacatcaatgagactccagagtttgagagcttgcattatctcttcaagactgttggcattgaccggattgtgacccttaagcaagactacaatgaagaattgattcgacagttttatgctacagtgtgggtggctggagactatagtgagatgaagtggatgtct

SEQ ID NO: 45560 - DNA, 3440 bp, Oryza sativa
gcacactcacaattcattctccatagactatctctctcagttctatgaagatggagcacggtacacacatgggaaggttgccggcttgaggactatccccagtgtggttaacatgattgtgagagccattatcctccctcgcattggcaacaatgatgacattaggggggtggcttggcacgtcatcgatgcaatcattcagggtcgtcagttcgacattgtgtctctcatgatgcgagagattgctatctccaaagggacattcactcagggaatgtattatgccccttacatcatgaggttgattcaagacaagcttggggctacttggcaaaatttgaagaagcacaagcagtacaagccctatcttcatcttggagctccccgtgctcctagggagctagctcaagctcagcacctcctcctcctcatgggtatgatccaaatgctttcttccatccatagtatgcttactttggaatgcaacccaatgaatacttctacccggtacttggggctattaataccctaagtgaaagcattcaacgcttgtctaccgggcatgaagcattgcatgaggatgttcgtggcttgcgcaccgatgttagagacttgaatgctttcgtgggaagattgcacactagagtgggtgcattggattctcgactacaaatgttggagagcacccaagcttttgtatatcatcgtcttcagctcgtcctccttctcctccataagaatgaagacctttttggtacttgatgccaaaaggggaagaaaaatgtccttaggtgtgctttatgtcttgtcggttgggactagtagtagtgaggttagtgtcctcatatctaataggttaaggtggtttgggctatattttgtatgggtatgggctattactctatattgtgtgttctttatcgttttgttggactctgtgtcatttggacccttcgtggtcttgtaatagcctatgtttattagtgagcccttttaggatgatttgtgacttatgtgatttgaatggttaagtgatgtgaacttgtgcgatgatggatggtgtatgtgatattgatatatgtgaccatcttatgcttatggatgaatatttcttgaagttcacattgaaatattgcttatgtgtttgtgcttgttgaaatgtgaaattgaaatttgcattggctccatatttgttgtctatgattgatatgcacatgtttaggggagcttttgatttcctttgcaatatatgtccatatgttccttctttgtttatatatatttgttgtgtttgtcatcaattaccaaaaagggggagattgaagcatctaggccccgttgttaattttggtaattaatgacaaacgctaattgtggactaactgttgctattgagatatattttaagttaggaccatgtcatgtatgcgcatggatgactatcaatggattaaaatttgatggcgcgaagcgaaaaaaagaaaacggtaaaactagtgctttagttttaaaattgatcgaggtgaagggcgatcaaatttgctagtttattttttagtttcgccgtactatcaagggggtaatgacctagcaatgagatgattttaattgccacattaggtcattatgcatttagacttgtgctcacattttatctcacacacacaatcactttgtatttcactgggttcggcctgaccaggggcggtcagaccggccgctgtctaaccacatagtggcggtctgaccggcgtgccccggccggtctgactggccacaaaacggtggtctgaccggcgcataaggccggtctgaccggcggcacatgcgcgatcagaccggccccttggaggccgggatggtgctgctcggggtggccgatacagagccgacggagccgtattcggtcagaccgagctgatggcggtctgaccgagccgaggccggtctgacccgccactcaacgtcggtctgaccggtcaggcctatggggccctctgacagagttacaatggctagttttctagccgttgcagagtagcacggtctgactgcccacatacctccggtcagaccggcagagcacagaggtgggggatttcgccctccatcagcaagggggctctcttggcacccaattcaattgcatacaccccttgcacctctctcacacccacttgagctttgtgttcatccatctagtgtgttagagggttaattagccaagagtcaagtgcattgcttccatttgtagagctagtgtggcacttgattgatcatctccacgccgggtcattgcttgttactcttggaggttgccgcctcctagatggcttgtggagaagttgcccagtgacctctccgagaagattgtggaggagggccggcgctggttgtgagtggtttggagttcaccaccttcggagtgaaggaagaactaccctagtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctccttgtctcatttacttgttgcatctacatttgtgcaatttacatttctagagacatactagagatcatttcaccctaggattgctaaacattgacataggagtgtgatttactttcttagagatataattgagccactatcaccctaggtttgcaaaacataacttagttgcttagttagagttgaccctcaccaagcctagcaacttaggttagttttgattaggtgtcatttagttttaaatcgtctattcatcccccctctagtcgacatctcgattctacagagttgctcggtgacctctccgagaagattgtggaggaggcctggtaccggttgtgagtggtttggagttcaccacgttcggagtgaaggaagaactaccccgagtgatcgaggcttgggtagtcctctccgtgggcggcttctgccttgcccaccccttgacgaagggtgcgtgcggtggcttcgtggttgagcggtggagttgggctcgcctcaacggggagtagaaaactggcgagttttccgaacctcggtgaaaaatcttttgtctccttgtcttatttatttgtcgcatttacatttgtgcaatttacattcctagagacatacttgagaccctttcaccataggattgcaaaatataactgagttgcttagttagacttgtccctcaccgagcctagcaacttagattagttttgattttgtgttatttaattttaaatcgcctattcaccccctctagtcgacatttcgatcctacaagtagtaccatagcttggtctctcttgattgggcttcaccgcctagagagaagatat

SEQ ID NO: 45561 - DNA, 17623 bp, Oryza sativa
agatgtcgactagagggggaggtgaataggcgatttaaaaaataaatgacacctaatcaaaactaacctaagttgctaggcttggtgagggagtctaactaagcaactaagttatgttttgcaaacctagggtgagtggctcaattatatctctaggaaattaaatcatactcctatgtcaatgtttagtaatcctagggtgatatgatctcaagtatgtctctaggaatgtaaattgcataaatgtaaatgtgacaatcaaatgaaacaagaagacaagagatttttcaccgaggtttggaaactcggcggtttcctactccctgttgaggcgagcccaactccaccgctcaaccacgaagccaccgcacgcccccttcgttaaggggtgggcaaggcggaaccggcccccggagaggactacccaaacctcgatcactcggggtagtttttccttcactccgaaggtggtgaactccaaaccactcacaaaccggcaccgggcctcctccacaatcttctcggagaggtcaccgggcaactcctccacaagccttctaggaggcggcaccctctaagagtaaaaagcaatgacgcggcgtagagatgatcaatcaagtgctacactagctctacaatggaagcaaatgcacttgactcttggctagaacaacctcaaccagtacaatggatgaacactaagctcaaaggtgtgtgagagcaaggggtgtatgcaattgaattaggagccaagagagaccccttgctgctggagggggagtatttatactcctaccaaccaaaactagccgttgggggcgaaatcccccaactctgtgctctgccggtccgaccggaggtatgtggacggtcagaccgtgctactctcgcaacggctagaaaactagccgttgtagccctgtcagagggccccatcagcttggccggtcagaccgacgttgagtggccggtcagaccggcctcggctcggtcagaccgccatcagctcggtctgaccgaatacagctccgtcggctctgtatcggccaccccgagcagcaccatctcggccactagagggccggtcagaccggccttatgcgccgttcagaccgccgtcttgtggccggccagaccggccagggcacgccagtcagaccgccactatgtggtcggtctgaccgcccctggtcaggccgaacaagtgaaatacaaggtgattgtgtgtgtgagatgaaatgtgagcacaagtctaaatgcataatgatctaatgtggcaattaatctccattgctaggtcattacccccttgatagtacggcgaaactaaaaaaaactagcaaatttgatcgcccgtcacctcgatcaattttaaaactaaagcactagttttaacgttttcttttcttcgcttcgcgccatcaaattttaatccatcgatagtcatccatgcgcacacaagacgtggacctaacttaaaatatatctcaatagcaacggttagtccacaattagcgcttgtcattaacaaaattaacaagggggccttgatgcttcaatctccccctttttggtaattgatgacaaacactcaaacatatataaacaaacatggaacatatggacatatattgcaaaggaaatcaaaagctccccctaaacatgtgcatatcaatcatagacaacaaaaatggagccaatgcacattttaatttcacatttcaacaagcacaaacacataaccaatatttcaatgtgaacttcaagaaatattcatccataagcataagatggtcacatatatcaatatcacatacaccatccatcatcgcacaagttcacatcacttaaccatccaaatcacataagtcacaaatcatcctaaaagggctcacaaacaaacataggctaacaagaccacgaatagaccaaatgacatagagttcaacaaaacgataaagaacacacaatatagagtaatagcccagacccatacaaaatatagcccaaagcaacttaacctattagatttgaggtgactaacctcactaccactagtcccaacccacaagacataaagcacacctaaggacagttttctcccccttttagcatcaagtaccaaaaatgtcttcattcttgtggaggagaagaaggacgtgccgaagatgaaggatgaggagcatcacggcggcgatgatatacaaaagcttgggtgctctccaacatttggactcgagaatccaatgcacccactctagtgtgcaatcttcccacggaagcattcaagtctccaacatcggtgcacaagccacgaacatcctcatgcaatgctttatgcccggtagacaagcgttgaatgctttcacttagggtattaatagccccaagtaccgggtagaagtattcattgggttgcatttcaaagtaagcatattgtggatggaagaaagcatttggatcatacccatgaggaggaggaggtgctgagctttagctagctccagggtgagaagaaggcaccgtcctaggagcacggggagctccatgctgaaggtggggcttttactgcttgcttcttcaaattttacccagcagccccaagcttgtcttgaatcaacctcatgatgtaaggggcataatagattccctgagtgaatgtccccttggtgatagcaatatcttgcatcatgagagacacaatgtcgaactgacgtccctgaatgattgcatcgatgacgtgccaagccacccccctaatgtcatcattgttgccaaggcgagggaggatagtagctctcacaatactattaaccacactggggatagtcctcaagccggcaaccttcccatgtgtgtaccgcactccatcttcatagaactgagagagatagtctatggagagcggattgtaagtgtgctcctcatgcaaatcatctccaaaatctaagcgaatattgaggagccgtcgaaactgcctccgagagatagaacactagagggtgtcagacatccacttcatctcactatagtctccagccacccacactgtagcatagaactgccggatcaaatcttcattgtagtgttgcttgagggtcacaatccggtcaatgccaacagtcttgaagagatcatacaagctctcaaactctggagtctcattgatgtctctccaagaaatccacttatgctctgcaaatgctttccctgcataaacctgctcataaacagtcttctggaaagcggtgtgaaactggggatccgggatgtcccgaggccttaagaactgatcatgatgcctcaagatggtatactgcgctggattcctcatgttcaccacaaactggagggattaatgtgcatatcatcactttcttcatcctcatcctccccactaccactgacatcatctccacttgcctcctcactagtcccctcaacatttgcctcaacctcttcatcactttgagcataatcctctccgctttactcctcaggctcactcacgggatccggagtgggcgcacgacgaccatggcgagtgcggggaggcatcactgtcaaagagcaaaggatgaaaggatattacaagaattttagaagccacttgattgaagtgaaattgtgctcacatccaataccgtagactgcaggccggtcagactgacggcatcagtcccgtcagaccgcctacacctgccggtcagactaacggccaacgtccggtcagaccacgtgcatgcggcggtcggaccgcgcgcatcggccgattagaccgacggcaaggccgcgatcagaccgtcggttggctccagttagaccactactgacattggcctaagcatccacaacaatttcacaattacacaaatgagtctaaaaaattgctagagcaatattgcacaagattggaacatgaatatcaaagggttggacctatttcatcaagattggaacaaaagaggaaactacccttaaccctagaggttgaaatagatcgatttgagagaatgcataagagggagagtgatttaccggttggaggagatgaatcacaccaagaaactaccctcttttggtgtaaatcaaagaactgcttcacctagggttccatgccatggatcaaaaactcaacaaaaacacaaatcaatccatggaatagagagaggaagcagaggagaatcacttacggtgtaaccggagagaaatccgcgatcaaaccgaggggatttggtggaggaaggagttagggtttgaggggaggtgagagagagagagttttcgagttggggaaggaaaaaactgaatgggaggagatggagtcgggtaggggaagaagggagaagaaaaaggacaaaagtcctgggaccacctaccggccggtcagaccggccctatgtggccggtcagaccgccgcacctggccggtcaaaccgcgcttatagcaccggtcagaccgccaggccccctgccggctgtgcacagcccttgcataagccggtaacccccccacaataaaattcaataaaaatttgatttttggagcaattttaaaatatatgagtttaaatattgctaaccatccataatatttgaagactatgatgatttgcaacaaaactcacataactgctaggaggtgaccttttatggtctataggggtttttgggcgaatttgattttcaaataacttttgaaatatttggtttttgaaataggtttgaataccaaaaacatttcaaatcctcctctctaccaattttgttttgaaacttttctcaaattccttctcaatctcaatttggggataaatttctttttggccaaaactaagaatctagtttcttcaaaagagggccaaaaaggcattttcattcaaaaatcattttgcttgcaatgtgaggcttggaaaacatatagggaaccttttgaaacattttcccagagatagttttcaaattacatttaacttgcaaatgttttgacttatgttgacttgggcattttaaaaacactactagcacttttagttgatttgctcatatataaaaggaagtagtgcacatgcaagagtgcaaacctccccgtaatgtgatatgctctattttcgcaatgaagaaccaaatgacaataaatctaaagcataagagcaaataggagcaaatatacacaatgcaaaagaagcaaccatggtgcaccatctcaagccacattagagaaatctatgacatttaactcattcctcaacttgcaaaagcgggttttatcaagaggcttggtaaagatgttggctagttgatcctcggttcttatgtggctaatgactatgtcacacttggcaacatggtctcttaggaagtgatggcgaatgtcaatatgcttggttctagaatgttggaccaggttattggctatctttatggcactatcattgtcacataggagtgaggttttggtaaaggatatgtcatagtctaacaaggtttgtttcatccaaagcaattgggcacaacaactacccgccgaaacatattccgcctcagcggtagagagggctacggagttttgtttcttggatgaccatgacacaagggatctaccaagcatttggcaactaccggatgtgctctttctatccactttgcaaccagtataatccgaattggaatagccaacaaacttaaacttaacaccttttgggtaccacaagccaatagtagaggaatgctttaaatatattagaatccttttcaataaagaaatcatcaccaatgatttttgtgaaaagggtggtgtcaacttttccaattttgaaatcctttgataaaagaaaatctctcaatctttcataccaagccttaggagcttgttttaaaccataaagagcttttgaaagtttataaacatggttaggatttttaggatcttcaaaaccgggaggttgttcaacaaagacgagttcgacaatttcaccatttagaaaagcacttttcacatccaagtgttggagagcacccaagcttttgtgtaccatcgccgtagtgtgcatccaacacttggacccgtaaatccaatacacccaccctagtgtgcaatcttcccacagatgcattcaaatttccaacatccgttcgcaaaccgcgaacatcctcatgcatcgcttcatgcccgatggttaagcgttgaatgctctcactaagggtattgatagccccaagtaccaggttgaatcactcatttggttgcaacccgaagtaagcatattgaggattaaagaaagcattaggataaacaaacccatgaggacgaggaggtgccgtgcttgagctagctccagggtgagaagagggcatcgtcctaggagcacggggagttccaagctgaaggcagggcttgtactgcttgtgcttcttcaaattgttcccggcacccccaagcttgtctagtatcaatctcatgatatatggcgcatagtagatgccctgagtgaatgtgccattggagatagcaatttcttgcatcatgagattcaccacatcaaactgacgaccttgaatgatagcatcaatgacgtgccaagccaccccctattgtcatcattgttgccaaggcgagggaggatggtggctctcacaattctgtttaccacaccagggatagtcctcaagccggcaaccttcccatgggtgtaccgcactccatcctcagagaactgagagagatagtcaatggagagcgggttgtgagtgtgctcctcatgcaaatcatcttcaaaatcaaagtgaatgttgagctgcctccggaactgcctccgagagatagagcactggagggtgtcagacatccacttcatctcactgaaatctccagccacccacactgtatcgtagaattggcggatcaagtcttcattgtaatcttgcttgagggtcataatccggtcaatgccaactatcttgaagagatcatgcaaactttgaaattctggggtctcattgatatccctccaagagatccacttgtgatccgcaaaagctttccccacataaatctactcatacactgtcttctgaaaagcggtgtggaaccggggatccgtggtgtctctaggtctcaagaactgatcattatgccgtaatatggtatactgagcaggatttctcatgttgactacaaactgaatagagggatcaacttgcaactcatcatcttcttcctcctcatcctccccactaccactgtcatcatctccactttcctcctcactggccccctcaacatgttcctcgacttcttcatcactttaagcatattcctctccgctcgactcctcatgctcactcacaggattcagagtgggcgtatgacgaccatggcgagtgtggggaggcatagatgacaaagagcaaagaggataggatattagcaagaattttagaagcaattttggaagcggtgaaaattttgcctatatcctgcggaggggtggtcagactgcagcttgtagggcggtcagaccgacggcatcaggccggtcagaccgcccacaggtggccggtcagaccgacgggtgtcggccggtcagaccgagagcacaagtcggtcagaccggcggctgacccacggtcagacggcctgtggctccgggcagaccacctcccacaagttcaagcatccaaaaattttcacaactacaaatttgagtctaaaattttctagaacaatacagcacaaggttggaacaagagcaacaaagggtaggaactgtttcatcaagattggaacaatggggaaactaccattaaccctaagattgaaatagatcgatttgaagtaatgcacaagagggagtgtgatttaccggttgaaggagttgaatcacaccaagaaactaccctctattggtgcaaatagaagaacacctcgtgcttcacctagggttccatgccatggataaaaaaaatcaataaaaacgcaaagtaattcatggaatagagagaggaagcggaggagaatcacttacggtgtaagcggaggggatttgatggagggatgagttagggtttgaggggaggtgagagagaaggaaatttcgagttggggaagaatggagatgagaaggagagagtaggggtcgggttggagaagaaggggggaataaatccctgggcccaccttggccagtcagaccagccctatgcggccggtcagaccgccccacccggtcggtcagaccgcacatatagcgccggtcagaccgtcgggtccctgccggctgtgtacagcccttgcacaagccggcaacccccacacaataaaatccaataaaaatttgatttttagagcaatttttgaaatgtgtgagtttaaatattgctaaccatctataatatttgaaaattatgatgactaaactcacttaagtgctaggaggtgaccttttatggtctataggggtttttgggccaatttgattttcaaacaacttttgaaatatttgtttttgaaataggtttgaataccaaaaacatttcaaatcttcttctctacaaactttgttttcaaacttttttaaaattctctctcaatctcattttggagataaatcccattttggccaaaaataagaatctaaattattcaaaagagggccaaaacgacattttcattcaaacaccatttttcttgcaatgtgaggcttggaaaacatatagggaaccttttgaaacattttccaagagatagttttcaaattatatttattttgcaaaagttttgacttatgttgacttaggcattttgaaagcactactagcacttctagttgatttgcccacacataaaaggaagtagagcacatgcaagagtgcaaaactctctcttaatgtgacatgctccattttcgcaaagaggaaccaaatggcaataaatccaaagcataagagcaaataagagcaaatctacaagatgaacaagaggcaaccatggtgcacaatgtcaagcgacattagagaaatctatgacatttaactcattcctcaatttgcaaaagcaggtttcatcaagaggcttggtaaagatgtcggctagttgatcctcggttcttatgtggctaatgactatgtcacacttggcaacatggtctcttaggaagtgatggtgaatgtcaatatgcttggttctagaatgttggaccgggttattggctatctttatggcactatcattgttttggctcaagacaagaaacaaacgagtaatgttcacaaattgaagcgacacgagattgagtttgaacacccttactaatgtcatccaaaacttggtcaattggatgatccttggaaagagcggtgtgtatccttagtggcataggtggatcttgtgccttctcctcctccacttcaacttgagcttgacttggcgtagcggaagtagatggctcatcttgagtggaggtggatggcttgtcttccacttcaataggcttgacatttccaatagacatgttcttcatagctctcatcaagccttcatcacctacatcatccaaattctcgtgtccctcttgggagccattagtctcatcaaattgaacatcggtagtttcttacacaatacctttgttcttgttgtagacccggtatgccttgctatttgagccataacctagaagaaacccttcatcacattgactttcaaatttggttagtctaacaccctttcggtaaatataacacttgcaaccaaaaactcgaaaataggcaacatttgacttcctcccaacaattagctcataggaagtctttttcaagagacgatgcaaataaagcctattggttgcatggcaagcgatgtttatggcttccgtccaaaaagaatcagaaacatcatattcaacaagcatagtccttgccatctcaatcaatgtacgatttttcctctccactacaccattttgtcgaggtaagtaggtagcggaaagctcgtgcttaatacatgatcatcacaatagtcctcgatattggcattcttaaactcggaaccattgtcacttctaattttcacaagagtgcaactaaattcattttgggccctttttgcaaactttttgaaaagctcggcaacaatagacttatcatgcaaaaagaacacacaaatataacgagaataatcatcaacaatcacaagacaatgactattaccaccaatgctcttataggttgttaggccaaacaaatccatatgcaagagctccaatggtctagatatggacatgatactcttagtaggataagagcatgcaacttgcttgccggcttgactagcactacaaagcttatccttctcaaacttcacatctttcaagcccacaactagatcacgttttgaaagtttgctcaattgattcatgccaacatgggctagcctcctatgccaaagccaacccaatgatgtttttgcaactaaacaagttttcaaatttgcttcactagaattgaaatcaaccaaataaagatttccatatcaaaaacctttgaacacacaagacttgtcatgaagactagaaataataacctcttgggggaagaaagcacatgactagccaagatcacaaatttgagcaaccgaaagcaaattgaaatttagatattcaacaagagagacattttcaattcacaaatcattggaaatagcaattttacctaacccaattacctttccgttgctattgtctccaaatgtcactttctcttgttctttccctcttacttccaatgtggtgaacatagccctatcaccagtcatgtgttgagtgcatccactattaagcacccaatagctcccaccggtgtggtagttcacctacaaaagaagatcaaactcttttaggtacccaaacttgtttgggtccttggaggttagagaccaaagctttgggcacccaaatggcattctttttaccaccaagtataggggaacccacatatctagcaacaatactaccatcatgagtcttcctaaacatataatgagaatcaaacatgcatgtcttagaaggcttaccaccggggccatcattcatcaaatgcccaacctcacgacacttggagcaatacttaccattgctcttgacaaaacgagtggcatggtgagaaggtttcttacccttctttgaaatgaatccaagtccctccttgttaaggatgcaccattgttcactcaaaatcttgtcaagagtgttcttatccttgaagcatctctccaaactcttgttgagcttggccacttgctccttaagctcattgttctcaacaacaagtgagacatcacaaatagaaacacaagacctagagctaggcatatctataagatcatcacaagaggtagaaatgctagatgatgcaacatgaggaatatgacaagaagcactatcatcaagcaaatcacaagatatgccaacatcaatgtgagctccatgttgagtagtggaaagaaggttgtcatgagctttcttaagcttctcatgagaaatgtggaaagcaatgcacttgactcttggctataacaacctcaaccactacaatggatgaacactaagctcaaatgtgtgtgagagaggtgcaaggggtgtatacaattgaattgggtgccaagagtatttatactcccacccaccaaaactagctgttgggggcgacatcccccaactcagtgcactgccggtctgacctgaggtgtatggccggtcagacagtgctactctatggctagttttctagccgttgtaggcctgacattgggccccattgccctggccggtcaaaccgacgttgagtggccggttagaccggcctcggctcggtcagaccaccctcagctcagtctgatcgaatacggctccgtcggctctgtatcgcccaaaccagagcaacaccatcccggccaccagggggcggtctgaccgcacaagtgccgccagtcagaccgaccagttacgccggtcagaccgccactaggtggctggtcagactggcctctgacctgtggtcagaccggcttggagcaagcggtcagaccggccctggtcaggccgaactcagtgaaaaggtgtgtgttgtgaaatgtgagcacaagcctagatgcataatgacctaatgtgacaattaaaattatctctttgctaggtcattacccctcttaatagtacgacaaagctataaataaactagcacaattttgatcgcccaacgcctcgatcaattttaaatgaaaacactagtttaccgactcctcttccttttgctttgcaccgtcaattttaatccatcgatagacatccatgcgcatacataatgtgaacctaacttaaaatatatagctcaaaggaacggttagtccacaattagtgcttatcattaattactaaaattaataccgggggccaagatgcttcagctgtgatgctccccgcccttcatcttcgacccgtcctccttgtcctccacaagagtgaagccttttttgtccttgatgccaaaagggggagaagaactctaggcttgcattttattttgcgggatgggactaagagtagtgaggttagctacctcctatctaataggttaaggcggatgggctataattatgtatgggtatgggctattaccttatcttgtgtgttatttttttgttttgttaaactctatgtcatttggacccttcgtggtcttgtaatagcctatgtttatttgtgagccctatatggataaactcttgtaagttggatgtttatgatctatggatgaacttgtgctatgatggctggttgatctgacattgatatatttatgaccatcttatgcaattggttgatccctatgtgaagttcacattgtatgttccatatgtggttgtactatgttgaaatgtgaatgaaagtgcatttgtttcatatttgctatttgtgattgatatgcacatgtttcgggggatcattttcatttcattgcaaaatgtccatgtgtttcatgtttgatgttatatagttgaagtatttgtcatcaattaccaaaaagggggagattgattttgataattaatgacaagcgctaattgtggactaaccgtttctctttgagttaattattttgtgttagtaccacgtcatatgtgcgcatggattattatcgatggattaaaatttgacggcgcaaagtgaaggaaaagaagatggtaaactagggctttatatttaaattgatcgaggtgtagggcgatcaaatttgctagtttaattttagcttctccgtactattaagaggggtaatgacctagcatagagatgatcttgattgccacattaggtcattttcatattcacttgtgctcacatttgttttaatacttttcacacacacttgcattcactgtgttcggcttgaccaggggcggtctgaccggccccctagaggccgggatggagtgctcggggttggccgatacagagctgacggagccgtatacggtcagaccgagctgagggcggtctgaccgagccgaggccggtctgaccggccactcaacgtcggtctgaccggccaggccgatgggccctttgacaaggctacaatggctagaaaactagccgttgcagagtagcacggtctgaccggccacatacttccggtcagaccagcagtacacaaaattgggggatttcgcccccaacggatagttttggttggtgggagtataaatactcccccaccagcagcaaggggtctctcttggcactcatttcaattgcatacaccccttgacgaagggggcgtgcggtgtcttcatggttgagcggtggagttgggctcgcctcaacggggagtaggaaaccggcgagtttccgaacctcggtgaaaaatctcttgtcaacttgtctcatttatttgtcgcatttacatttgtgcaatttatattcctagagacatacttgagaccctttcaccctaggattacaaaacataacttagttgcttagttagacttgtccctcgccaagcctaacaacttaggttagttttgattaggtgttatttaattttaaatcgcctattcacccccctctagtcgacatctcgatcctacagccataagcgtagctcgcacagtctactatcatcttcaacctcccgaagatagtcccgtggccgtacggttgtctgtcccgtggccacgtggacgtacagctgccggagcaaatctccctatcaaatatggtcgaatctttctcgatcacctaaaattggtcgatggtttttatccagtcgatcttctcttcccgttttctccaaaatcagagtgtaaaactctttgttcccaattaaatccgaatctttctcgatcaccaaaattggttgatggtttttatccactcgatctcctctttctgtttttttttccaaaatcagctcgagataaaaacaaccaaccgggaagatcgccgtcatcattagcaactgatgagggaggagtggggaatcgatttttgcaatcaaattggagtagaaaacacacaatcgatatggcagcggcgcgacgtgcggcgaacagaacgaattgacaggaggcgcgatcagattaaaaaatggacggaaccaagagcctaagcgcgtgcgaaaaaaaaactctttcgtgtgcaaaaagatcagaaaaaaatacccgtgccaaattaaaaaccaaacggactttctttttggttttttactggcgagactttttttcttcttttttaagacggacgagatgttttttttctactagataaaatatccgtgcgttacaacgagtgaagtctattttaaacttattattgttatatggtttagttaagatgaaactcactgtgaaaaatcatttggatatatatatttttagaaaatcatgagctacagttaggagtctggtcgtctcaagttatcatgcgagttttttttaaaacaaatttcttatatgattccttctgtattaccaaaagcgaacaaacaaatttaaaaccgactcaaatacggatatgtattttaaaaacaaacgaacttaaaaatcgactcatacacagatgatgtaccaaaatgccacgtaggatcaaaaccactttgaattgagtcgggggggggcagggggggtaattcatccggtatcaataattcgaggtttaatatgtctggttttatggttcagtggactaattcatactgtcgtaataattcatacgttttccaaccttgtatatatatgttccatattgtgtgttagagtggacatggtgaaaagggacaacaggtgagcgccatatataccaaggctgcatgcatcgttggctacctcgaggacttcggctacaacaatactggaccttgcctttgtctcccacgttctttggttgcatgcttaattaatcaatcgtgctggcgcatgtgggaggttggaatagagacagaaagcttgggtgacctcgaaaaaaaaaaagaaagaaagaaagcttgggtgaaacgtgaacgaaattgtttgtgcgggcttgctagctgttcggacgatggaagaaaaaaaaatcgaaatccgattgcgctgtggatcaaccgatcagatgagttacggagtaacgcgatacaaactcgagacccaagccaacagcgggcggcgtacaaaattatttgacaaaaacatcttaaacttttataatagataaaaataaagataaagataaagatttttactatagataaagatttttactgacgacagattttttttatcgcttttgagttggacctttttttttattatttttttacctttttgggtcggacttttttttttaacagacaacagaaatttaagtagtaaagataacataaaattaaaaaaatcgactcatgacgtaccaaagtacgatataggttgagaagattttttatcctacttgggccttggccatgtaattcctattcttggactctgtatgtaattcctgagccatgtaattgtaattgtatctgactatttgggctttcagtccttccacgtgcgctcgaaaagaactgatcggaaacagtggtggaaaaaaacctgggcccacccaaaaaaaaccgcaacaaaaaaaaattgccacccactaggaaaataattggactgacaaaaaaagggacaggtggcgatgggaaaaaccagccccacaaataaaaccacgtgtggaaaaaaatgacgacggtcgaaaaaaactattagaagcgcgtgcgaaaaaaaacaatcggacgggaaaaaccgggcccaaaaaacgtacgaaaaaatcgcgcgtgcgaaaaaaaagatggaccaaaaaagaaaactaccagaagccttattttctaatttggtatatactagaaaataaatgccgtgcattgcaacgggtgaaaacatttcgatgacaatatacgctttccacgcataattgtgtcaatgataataatcgtatcgatcgttgtagctaagacatattataagaaaaattgaaacatcttcaatataatgacccgatctcgacgatgacaacctttctaacgcatgttttgcctaaatgaagtggattatttatgtatgctgtacacatataatctaaattactcttttaatctcattcttacaattaataattggatcaataagatcctacattgtctcatatggtaagtctagacaaatagagcctcactgcactatttcttagtaacaattgtttatttattattgttgtttttatatgataagctatcaagaattagctatactgtccagtagtatgataattacatacataaatataaatatgcagggtctctaatatatgagaatataatcgcggaacacaaaccatgtaggagatggaaaaatcgaggatcgtatctgacccaaaacctcgaccaatttgatctcgttccgagaaaaccaagcataaccaagacttgttttagatccgcatacctgaactttcgatgaccctttggaaaaaccaaaaaccaagacttgttttagatccgcatacctgaactttcgatgacactttggaaaaaccaaaatgacatggtagacgatggatgatacaaacaatacgaatcatttttcatgaaatcggatgttttttttttctgaaatcatatagttttttcgcataacacagtactgaaccagaattttttataaacgcgggtttttatatatatggcggctttttctcgcgtggagtcagacaattttttatatctttttttctcgcatgaattcggatggtttcttggatcttttttttaaaaaaacaatgtttttttttctgacggtttattttggagcggttttttttatctcgcattgagtcgaatattcttttaaaacattttttgtaaactatgttttttctcttgttgagtcgagtggtttttttcgaacggtttcttttataaacgggatttttttttataaactgcgtttttcttgattttgggtcggacaatttttcttttttttgacaagacgtttttcttccttttttttttgggagtcagacttgttttttttacggatgag

SEQ ID NO: 45562 - DNA, 12307 bp, Oryza sativa
tccccccgcggccccgcccccacgcgcgtgcatgcatgagcctggccctacaatggtctctgccaccacctaccatgtatcttcaccatatactccattgaaacaaatcgtccacatattttggaaaccatctattaatggaattcgtttcattttttttttcaccaaaaatgtttcatctagcttactcacaatgttttatttctttcgctatttgctgaaacattgtttttatataaggtgaaacaatgtccgatttaaacgagtgaaacattttcaatctaattagtgaaacaattccgatatacttggtggaacatcgtgtaacatatccatgtgtggacttgttttaaagatttaattacaacgaatttaatggtgtaattggatcatgatttggataaataatttaagagaaaaaccagtttaaagtggtattgcacgcatgtgtggcgctgacgcgtaggcccctccgctttttcctcccgtgttttcttttttctttctttttctcgcgcattttttaccatataatcggactttttttcgctgtttatttattttgtactggccacgaaaacactttttttacgtagtagagataggtataatatagatatagatataaaatttgtgggagctacaaatcagacgttagatgttgtaaaaaaaaatagaggtcaaatgtttcagttgactattagtataatacatgatgtaacagagaaatctgcctcgggaatatataaaaaatatgcgaaacacaataaaaacacatgacacgtggtgagacatattgctatcacgcatgaaacattatgtttttattgtttgaaacgtatatttttctttcataagaatataatcatgtgatatcttattgtaaagaataaaataaatatatgatgccaatacaggatatacaaataacatatttgatctcccaatttattaaatagcaacaaaaaaaattatatattaccaaactcgatagaagctcaagctcggctcgcgagctttgggataggctcgggctcatctcgtttggagctcgagccgagctcgaatcgagccttgggcaagtcgagctcaagcaactcacgagccccgagcttttttaatagccctaattgtcagtaagccatctgcgattttctgcgttaggtagcatgacagtgtgagaaagtttgttttattttccgcacgcacgcttctcgaactactaaacggtgtgttttttcaaaaaaattctataggaaagttgctttaaaaaacatattaatccatttttaaaatttaaaataattaatactcaattaatcatgcactaatagctcacctcgttttgcatatcttcccattcttctctatccccttctcctcaaaccgagcaaaattatcttccatatttgtttgctctgtgtgttacctcttatttgcgttatgcaggttgaaacatttttaactcgtgcacaaagctacagctggctgctgtatttcttctcctcttgtaagtcggtggtgaagaaggtgctaattgttactccctctgtcctccgtcccaaaatataagcatttttttctaccctgacacggtcttcgagatactaatttgatcaacaatatcaaataaaaagagttgtatattatgatagtttgtttaatgataaatatagtactccctccgtcccataatataagggattttgagtttttgcttgcagcgtttgaccactcgtcttattcaaatttttttgaaatgattaattattttatttgtgacttactttattatctacagtactttaagtacaacttttcattttttatatttgcataaaaaatttgaataagacgagtggtcaaacgttgcaagcaaaaacttaaaatcccttatattgtgggacagagggagtaacatcaatttcacatgattgatcttttttattttttttattattggtcaaagttaaacaatatttgacttgtcactatactaaaatatttatattctgggacaaaaaaataactaattataccgattacgtgtaaattgtgagacgaatagcctaattgttctatgatttgacaatgtggtgctacaataaatatttgctaatgacggattaattaggcttaataaagtcgtctcgcagtttacaggtggaatctgtaatttgttattttattagtctataatactctagatatatgtatatatccgatgtgacacgccaaaacttttcaccctaattaaaaaacagcctaaattctgcacaaagctgcaagatacaagtagtttttaatccctgcaaaagctgcggtttgtctcttcctgatgtggacagaatggaagaagaatccctgccatcatcttgacaaaagactgcaaattacatggtcaaatcctctttctcatttgtttttcttgctgttatactgttggtgcacaagggattgcccttgctgttgactttaattgaattgattaaatatcccgaccaaagttgcttgtaaattggaggtaatgcctgcaaattttgccttccaaaagtccctctatcccacaaatttcttttcaccacgccaacaatccagttaaagtgttttaatttcgtgctgcaactcagttggtggactctgaaattaggcctccctggtggactccgaaaaccaggttggactgccatacgaggtttgttgtggatgagtgaggacattagagcatacccactctctaaatttggtactccatatctcggtttggatggccatctaaaaaaaatttctctagattttgttcctttccaacagatcatccatattacattctctataacacctgtcatatatttaaaaataatttttaaccaactttgctatgtgtacgtttttttagcctggattagttaaaagaaatattgttattcgctaaacatgtttcacctgatagttactaattaatctctcacgtatatcaatataaaactaccacgtttattattaaatcaaagaagaaaaaactaaaattaaaaaaaaagaaaagaacaaataaacatcgttccccgagaccccaaccccagccgaacagataaacgatgcggtcgggtgggcaaagagcgcgggcatagcgaagcagcatggcatggaggtggagcggcggtggaaagcgcgtgttgaagcagaggcggtggtcggcaggcgcggacgtggaggtaacagccgaggggcacagaggcggaggcggaggaggaggccagcgggcgcggaagtagtggtggcggccgaggggcggaggtaggcgacgggcacggaggggtggaagggagcatgattgccactagcgacactgtacttctggatctggtatgcctctttctctccatcctccccttccgtccggtgacgacgacgacggaggggaggtcacggaactctggatgagggcgggagctgcaaccgttgtgatatggcttttggagagagaaacgctatatttggccttactctctccgttttggcgcatcctctatttttggatggctcgatggcgtgtccgctggagccccgtttttcactttcgtacgctaaatctcggatggagttctgaatggaggatctcctagggatgctcttagttagtgctccctcagttgcaaaatagtactatggatttcttgagttttgcactggtatatatttaaaaaagtgagtaaattttattttgcacagggtatattcaacagttttactttgcatcatgtataagttgaaccattttactttgcaccacgtatgttagtgtgtactccttatgtcccataaaaaatttaattctagagatgaatctagatatggtgtatgtctagatttatctttggaattggattttttttttcaagacggggagtaccaattagttttcgcttaccactaacccgtacggttcgattcgatcgatgcaactcatgggcctggcctcaggcctagtcgaagatccacggtggcttcgccacgatggtagggcctcccacgttgcccaggtggttgctttatccatcgccttagctgaagtcatgtgacaatagaccttgtttagatggagaaaaattttaggtttgattgtcatatcggatatacggataagtatttgaagtattaaatatagtctaataaaaaaataaattatagattctgccaggaaactgcgagatgaatttattaagcctaattaatccgctattagcaaatgttcactgtagcaccacattgtcaaatcatggtgcaatttaggcttaaaaaatttgtcacgcaatttgcacgcaatatgtgtaattgattttttttcatgcatttaatactcaatgcatgtgtccaaacattcgatgttagagcgtgaatttttgtcttgggaactaaacagggccataatctcaccaaatatactccctccgtcctaaaataagcacaacacatgagtttccgtgctcaactgaaaaacataagtcacgcataaagtactattcatattttataatctaatatcaataaaaatactaattattaaaaaattttaaaataagatggacgattaaagttgtatatggaaattaatagttgtacttattttgggagggagggagtatgcagtcagatgttgccactgaaggtttatcccgtgcatattagcaacaaaatttaatgagcatcaccaacggtttaccaataatctatccctaaaatttaatttttggtggtttcctaaactgaaaatagatggtgaaaaaaccccttcctccaagagatagcctaaattcaatcctcaaaaactaaaaaaactaaaagtgggcccttctattaaactaccaacagaaattctatttttttttcctttcccgtgcgcagaaggagatcccttacgcgggaaggacaggagaaacgcggaaggaggggagaaacgcgcggaaggaggggattgggagtcgttctctcgccctcaaatacacgtaccgagaaaattggagatgggaactccaaggaaaaaaattgaaaatatacttttatttttcatattttgcatttatatacctgtctgagattaatttgcaaaaatatatctgatccgcagaatggttgtgcgggagcgaggacgaaccgcagaattcgagtcggtcacgtagaacccgagtcggtcacgcggaaccgagatgcgcgaccgaaccggtcccgcacggctagactgcaggaccgagtcagtaccgcggcaccgatacgcgggagcgatggggacgtcagctccgcaggtgagcgcggcggtaccgcataacagcggcgcgggacctgcgcggtcccgtggttccagcgcgcggtaccgagcgagtctcgtgttattcggtattaatcccctaattttttccaactcatcttcttcattttccacgcgcacgcttttcaaactgctaaacggtgtattttttgcaaaaagtttctatactaaagttgctcgaaaaatcatattaatccatttttgaaaaaaaaaactaataattaatttatcacgtgctaatgtactgctccgttttccgtgcgggacatgtattcacaatttggaaaggacggagtggcagtctcgcgcatccgccatgcgggagagaggggccggtcccacgcatccaatatgcggagcgatccggttctgtattattcccctaatttttccaactcatctccttccttttccacacgcacgcttttcaaactactaaacggtgcatttttttgcaaaaagtttttatacgaaagttgcttaaaataattatattgatccatttttgaaaaaaaaactaataattaattaatcacgtgccaatatactgctccgtttttcctacgggacatgtattcacaatttgggagaagacgcgtgtgggagccacggtcccgtacatccaatatgcgggagcgctcggcatgcaaacttcctgcgggacaggtgcgataccgcatccccagcctatgggaccggtcgctcccgcgcatctaatatgcggattgggtatatttttgcaaattaatctcggacatgtatataaatgcaaaatatgaaaaataaaaatatattttcaaatttttttcggaactccaaaacatccagagctcttttgggaatctgttggatcagttttttttaaccaaaatccaaaaaaaataggattggggatggaatagatagactgttggtgatgcttacctactttcagtttggatgtcacagttaattgatcttgccattctgtgtgaaatttacatcatacaagttttcttttttaaacgtagcgttgatacaaatcatacaatgaaccatatgcagttaagactgttttcggtttatatgataagttcaatgtaccttattacggaattgcatctttcctagtgaccatgcatatagaactcatataataattaacataaactgtctacttttcgggctggcggaaaatcttgctgacaaatcaccatgggaagcttttcaaaatctcagaagaccctccatccaaaattctagtgcatgatttttcgccttttctggaacctaaacggcccccattgtttggtttattcgtagaatggtatatttacaaatgaaaagtaatttgtgaataaaacttttatgtacgtgttcttagcgatataaaagtaaaggctgaaaaataaattttgatgagaaaaaaatcgcaaagtttcaaatttaaagttgaaaatttaaattttggttgataaatataagtataaacgaaaagatgagaccgattatcttgtgcatgttagcgacaaatttaatgcttttaacacctacctactgtcagttttgatgcactccagatgtccggatgctgtctaccagatctaacacagttgattgacttgccattctgtgaaatttttacatcatagaagttgtctttaaatgtagcgttcataccatgaagcatgcagttaagactgtttacggtttatatgataacttcgatgtaccttattatagaattttcgcttatgcttatgcttatcagctaaaatttaaatttttaatcttaaatttgaagatgatttggggtattttcatcaaagtttgttttccagccttactttgagattgataagaacatgtatataaaagttttattcacaaattattttttatttgcaaatgtgccgttctccttattccacgaatatgtaaaacaatggggccgctaatctgttgtgcgttcgacttgcaaggaaataaacacaatacattagttgaggcaagaagcaaagaagggaacttgctcacaagacgtttcatttcattcacgttgggtcttccccccaccccccaaaaaaaatatatcagttcatttctgttgataaaatttggtcgaattttatatgcttcaatttttctcaatttaaataaactgataatatattaattgactgctaattatttatagaccaattgttgccatagtatttatacgtgtgatcctatgttttttaatgtttaagacacacggtcatgatataactacctttccaatgcttccttttgaagtaattaaactaatgaaaaacacttgacctatgtaaactaagcgctaaatgaaattacttttgcactcaatgttaacgacgccgcgcgggcctttatcctgatgattgtgagatgaataaaaaaagaagcttcaatgcgcgatttaaatacttttatttccgaatccgacggatccctccacacgcgcactagccagcccaatatatcatatcaattcgtttcacttggtcgagaaacaacagaagtcttccggctagcttcacaaagtagcgagctggacgatctggtttgaagtcttaccccttctaattatttaatattaggtcattcttttttttttcacttggtctctcatcgactctttgagatcgatctgtgggggatgaccgcagcgatcgagaagcacgtacgatcattccaggaatccaggtatacacacgctggtcggcaggtgctcgacataagcttagtcctctcacactgagaacgaagcaaaggattagcgtgagattaattattctctccatctcaaaatataagagcccagaatcaaataagatattttctagtactataatcattccaggtgagagggggtgcttcctttcccccacgcgtgcgtctcttactctccctcacgcatctcttcctctctcccagccagatatagccccgccgccgccagagctgaccggcgtctgcgcggcggctaggacggtggcagtggggaggtgggaggcggaggtgcggaagtggtggccagaggcagccgggcctgcgcctggccgtgtgggttagggatggctggaggtggtcgggagggcggtggggagcggcaaggcgtcagcgatggagtctctccggatagcggtaggggcggtgaagcacggcggtggcccagtggcggcggcagccctaggggcagtggtggcccagcggctcccgtcggcattggcaacccttggggcggcggcagttcccatcggcgctggcggcactaggagatgcggcggaggacggcggctcccgtcggcgccagtggccctaggggctgcggcggtccaagaggacgacggctcctaccggtgtcgacagccctaggggctgcggcggcctaggacagcggtagtctgagcactgtgaatccgatgaagtggaagccgatcccgtcggttcgtgtgtggttggctatttccggctaaacggcgaatgccgacagttgaaagtaggctaactggcggcgtgtggcgtcagcttacctgaaacagataaagatggcaccaacggaggtttgcatcgacggcgcactaggggcggcggcgactagacaacttccacttgtaatatctggccgtttcaggagaatatggcaggacgcagagaagcagggatgtcacgaggttgtttggttttctttttgttttttggttgtgtgttttcctctttgttgaggtgggagtgtaagtactcatgtatccttttagctgtgtatatccttcgtggatatagagaccggattaatgaaaatccattatctaaaaatgatcattccaggaatccagtacaccgtacacacattggtcggcagatgctcgacataggcttagtcctctcacacggagaacaaagcaaaggattaggagattaattctctccgtcccaaaatataagaatctagaatcagagaagatattttgcagtactatgaatctagatagataggaaatgtctcattcggttataagttattatattttgggacggatttagtaagtattagttaaacaaaacttaaaaaaatggattagtattattttttaaagcaactttcctatagacaaattttgtaaataacacaccgccgcctagtagtttgaaaaacgtgtacgcgaaaaactcagccatagacgcctctccgaagtgaagctgacgagatgaagaaaagcgactactcacctacaacggattataaaatgtaatgcttgttaacgataaaagaaatagataaaaacttttatatttgttctcttagtaacataaaagtaaatgctagaaaataaactacattaaaaacattaaaatcaatttgaaatttaaactcaaaatttaagaacatatattagagctcaaaattaatggagcagttatgtactccctccgtcctataaaaaccaaatctaatgtgacataagttggtactacgaatctggatatactccctccgtctcataaaaaataaatctaggaccagatgtgatacatcctactacgatgaatctagacatatccggtactaggttggttttctgtagaacagagagagtatatttgttcagattcgtagtagtaggatgcgtcacatccgattatagattcgttttttataggacggagtgactgagtgagcatttttcctgagtgagtatgtatgtattgtactgcacagtatatatcttgatctgatcagtgtgcagtggcctgttgaacaaagaaaagttgtcagctatcttaggactttattaccactagttgtatgaatatgatcagcgaagtgtagaagcacgtgtactttgtgttaatcacatttgtgcgtttcaacaaacaagaatccaagctgaagctggccggcataagtcgtcggtcaagtataccagaggtgtgatttccacagttacaaacgaaagcttctgttgctatcggatccggctacattggggacatcaacaatctctgtttggacccaaaaagaaacacacgcaagcgctccagaaaacgaaggataatgtcatcttcaagaattttcaagtcaaattatcaaaaatatgacattagaatcattaatttatcaggttttctaaaaatccttataataaaaattagtgatcaaagttagattttccaatatccaaaacgacgtgttttcataattagaacaaaagtaggtccatgattatgtaacaccagaattttcctgagctaaaatcgaaccgtgggcgaaaaaaccgaacacagcacactagagaaaaaaaaaatcaaactccaaaaaggagaacgatatgcatactaatttgttttacgaactttttacaaacacgtatgagtcatattgtggttggatcttaactttttataattttcaattaacttaatcaaacagttgagatttttgttagtaataaatttttagtatgttacacgggaggataacacgggtgattgaaatattattttttttacatgggacctagatgtgaaacgttactgaaccaaagaacgcgccttaagaagaaccaatattttttactaaaaatatattttctttattacctggttgatataccagatagaattcgttactgcaccacagtagtataagcctgtaacagaaattcactgtactaacgatagaaacaacctacacatcaaaaaaagctcacgagtacgaacggtacaataccgcaggagccgcataaaactgacatgttaaagcccacaattttcccaacaattttggatatataccagtcgatgttcatttgaccctataatcgaccatatgtagtaaaattatgtggtgctaattttcgtaatacccagtttttggtttgtaggaatctatttatataaatataacagtatttgatcatacaaggatgtgtgcctaacgatttgtcacatattctgtatatataaagtctcgggtctttcacgttttcttgactggatgaatagtcggcaagagcaagaaactgatcaattagaaagtctgaccggatgaataataaatagttcatgctcatggaaagagccaacaattgagtagtgaatagtcaatagctccaagtacaagatcagtggtagagatcgaattttcgacgcagtcaggctttctacgttttcgaaggacaattgttgagtcaatattgactcaaaacaattgagacagacagtgaaaattagtggaaagtctctgactggatgaataatagtccatgcatggtagaaatgttgccaccactgactgacagtgaaaattagtagaaagtctctgactggatgaataatggtccatgcatggtagaaatgttgccaccaccgacttacagtgaaaattattctttgactgccgtttttccccaaaacggattttggggtctgttcaattataccatttttttttggtaaagttgctaaaattttggctacgtttagtttgttgccaaattttaataagcacatataaaatcttgccaaaatttgataaccttgccaaaattttggcaacattactaaaatttggcaataccaaaatttgataaggttaaaaatggtagcaaagtgaacaagctcttcatctctggcggggcagagtttgggccctcactgatgcattataaatagttttgattttttttaaatcaaactttgtagagtttaatcaagtttgtacagagataaaataacatttcaacacaaaacatactattatcaaaattattcaatgttacatttaattaagttaatttgatgttgtagatattgttaaactccatagacttgatcaaattaaaaaagtttgactagaaagaaatattaaatcgacttacaatatgaacggatgaagtacagtagcaagaaaaccttaggatagataaaaggggaataatacttcttttatttggttgcctctctctcttcctccct

SEQ ID NO: 45563 - DNA, 2398 bp, Oryza sativa
ttgcatgtagtatatttaatgatgcttatttactttttacatataaataagtaaagagatatttgtgaaagacttcaaaaaccgtaggtgatgatcaaactaggataaatggagtgtattttctcgatcgatgcctttttctttgagaactttcttgacggctacaaatcgtattctcttcatcctttaaaagccaattagaaaattgtggctggatccaacaagcaagggtttagtacaacaaaagcgattttgaaatatctttggtcgggttcagttaacaagcgtccggttttgaagccctataaaaagacatctcctttgaaattgcatctgccaaatcagccagcactagctaggtacactaaggcataatactcgacagtgtacacttttgctctaaacgggatgaagagccacatggcttccctcttgctgctgcccactgcagctccagcgtggcctaccgcctcctgctggcagcgcatgtgggttcatcctggcccttcgtttcctcatcggatgatgatacgtcatccactgctgtcctccctgcacgccgcccgcctcatgccttgcaagtgcacagcgccgtcatctcccattgctagtaagatggcaccgactttccacccaacgatattcggcgacttcttcatcgaatacaaccaaccactcaaggcatggacatgtatacatatatgtgcacacacgttatttaatccgtgctagatagtttggtcttgttataatctttttcataacaaaatatgtatcgtgctgaagttgtatcaaagtaacaattttaacgaaataataatagttttatgaaatccactctatgtcatgtttgttatatatgcttccatgtgtctagcaggagtcaaatgaatggatggaagagagagcagaacagttagtagagcagataggtagaatgtttgaagcttgcagggatgatgtggtgaaacaaatgaacctggtcgatgtactccaacgtttgggaatagaacatcattttgaggagcagattaacaccactctaagaaatattcacagcattgaattctatagctctaacctccatgaggttgctcttcggtttcgcttgctgaggcaacaagggtattgggtttcaccaggtatgtatttatgttcgggaatgaaataactggcatacataacactttgactacgacttatttaaaacttggggatcttttttattcttaatggaaaaattctttgaagttattgttttccatacaaaccttgaatatggtctcctatagattcagggattagcaagaagaaatatataaatcaagatataaaattaattattctaaagtactcgtatttgaatttttatggtttatgctatacacagacgaattcaacaaattcaaatgtgaagatgggagcttcaagagtgacataaataatgacccgaagggcttgttaagtttgtaccatgcagcttaccttctaactcataatgagagggcactcaaagaagctatcttatttgcaacccatcacctggaattattaagtggtagccttgagttcccgctggctgaacaagtaaagcgtgccctccaaataccattaccaaggaccttgaagagagtagaggcgctaaattttatcttcgagtatactgcacaagagcatacatttaacccatccatttcagagctagccaagcttgattttaacattttacaaaaacttcaccagaaggaactcaagcatatttgtcggcaagtcttctaatcactctataatgtcattactaatcataatattgagaaaaagaattaatttatatttaatatattttttaggtggtggaaggatgtttccagtgacattaacctagactacacccgcgatcgtgtggttgagtgttacttttgtgcttacattgtgtactatgagaaagagtacgcacgtgcacgcatgatgctcgccaagaaaattatgctaatttctctacttgatgatacctatgatgtgcatgcgacattggaagaggctcggaagttcaatgaagcactgcaaaggtcaacttcttattcccttcattttgagaactaatacatgcatgtataaggatgttgagatgcctagtttggaatagggatgtaagtgggacgggctagcggtattttttttacttgcttatcccacttgtagtttattttttcttccaaattttgtactagcatatataaaatgagtaagcggatttttacgtgggtagcgggattaaccatttgcatctctactttagtttggaagggaaaagtcctatttacacatgctctacctatgataccacaagcttgatcctcctaaactcctaatatcagataaaatacaccatgagtcc

SEQ ID NO: 45564 - DNA, 6496 bp, Oryza sativa
cggcactgatgccactaaacctcagtttaatagtatagccaactgttggctccaaaacaactatagctaatttaatagccattcatacaatagttaactataaaaatatactataccattaatactcggtcccacctctcatccacgcataacgtcttggagttcgtgttgcagccggctataaatctgtagtccgctttcttctctcccttctcttttcttctcgatatgagattatagcttgctattgtacctgttctaagagggacaaccaaaggatcttcttctgttgttcatgagcatgagctcatcaaacatgcaatctggcacccatgtagctagccagtagaccatgatggaaggtgagggaggaggggatgaagagcagcagcaatcagattcgtctcctccatttttggcccactttgaccccctcctatgtaccatagggtttatagtttttttttttctgggagtgggaggagggcgctaaatccgatgaacacaatagtttagaggggcaaatcagttttttttcccattgtataagaaaatcatcaactatcgttatagttttctaagatactacccaaagtagtagcaaataaccaatagttttgataaaatcatcatggttttctcatattttctcaaattgacaatgcagatgggataagaatgctgtttcacttgtaccggaggggctgaagaggttctttctcagtattatgagcaactttagggactttgaagatgagttggaaccacatgagaaatatcgtaatgcttacaacattaaagcggtacgaagcgtcgtatacaacttttcaacaaagttatgtacagcttataatttagaaatggataaatagataatcgtccataacagaaatggacaaaaaagaaattgttttttcaatcaactcctacgtataaaaatctgaactagcaactttaagaattaatacatacatcttcaaaaatatgtatttatcttaattatactctgttttttttgccacatgcagtttcaaatattatccaacaattacctccaggaagctgagtggttccatcaaaaatacattccaagctttacagagcatgcgaccgtgtccctcgtaaccggaggtgctatagaattacctgtcagtataatcgtaggcatgggtgacatagctaccaaggatgcctttgattgggccttgtcttacgctgatgctggcagggcctttggagaggtgtcacgtttcatggatgatttggctgtatcacaggtactaattaattaatacttactagtactaatatgcatgcatgtatgccagctagatcgctcactcttgggtttataactttatatatgaatgttataaattttggttttcatatttggttgagtgttgaaattccattggtcagagttcatcttatttaggaaaaaaacatttaagtaatttttttccttgatgaacttcccatatggaaagttttcagtttagatgccaggggcaatgtggttattttgaataaaaaaatataagccaattcatggtgaactaataatgcattgttattttctctactccaaactataacttactcgttttctattattatgatttttaaattgttaaattgtgttttttctagaactttttatttttaaaaaaaaatcaaataaacctctttttaaaacttgtaataattttttcttagttgttttatagagtttttttttcatgattgatctttatttgcactagtgtcaaaattatcacttgattttctcggcaaggaaactatattttctttttctatttaactatatgttttagtagtggtgtaccctatagctaaaatcttgtgttcgccattaccctatagcatacttataatatgtggcacgcagaatgggagggagaagatggacgtggccaatgccgtggagtgttacatgaaggagcatggcgtgacaagcgatgtcgcggaggcggagataagtgaaatggtggaaggcgcatggagaaccctaaaccaggcgcgctttgaggaccgcgtgtacctcccgttcgtgcagcggatcgccaatgtgtccatgtccatcgccctcctcttccatggcaagagggacggctacaccaatagccacgagttgaaggatatgttcgagagtcatttcgtcaaccctattccccttgatcatttagatacaattgaagatatgtaaacttggtgctgaagtggcacggaaaatggccatatatatgttaagacaggcgtacaggtacaggacatggatgtaatcaaatcacacgtacattggagaattatctgtatatccctctgcttgtgcatattagacggctcatttgcacacatgaaaaaaaaatcctttagatttgaggtaccgattcaatacattttttttctaacaatgaattaaactggtctctacatctaacatggaaaacttgcatactcggagacaaaagggaagaaccactcaaattatgtaaagcgggaaaggccattccaccaattatccccatttcccacatggaggaccgtgtgtgctgacatgtggagctaaacacacatttatatttagccttacagctttgctagtcttaagatttaacccacgggcagcataccagtaagggacaaagggaatacgaaaatagtatggccaagtagcagcttattgagattcacttacaagaaagtagtagcttgttgggaatattccttaagttgtactactatgcaacaaacttaaagcaatactcttactatcccaatatgatcatcttataagcaaagaacaccaagacaaagacaccaaaacattcatcattgtgaaattaatcctcatcgatcatcattgtgaaattaatcctcattgattaaggtgctttgtcgtttcatgtccaacaaaaattaattcacactttaaacgttatatgcattgaaccaatagaatgtttgttgcatggcatttcacgatgcggatttactctttgcacaaataaacaaaatattttttgttatgatgatcattttgagaaaacctaaaaaaatcttatgtgatgatcaaactgggatggagggagggagtacaatatatacatgaacagtattgaagatttaaaagcaccatgaaccatccgtagaatatattgttgaggatgtaatttaaatacttaataggtgtcaattatgcaagaaacaaaaaccatttttacaacaaccaaactgcagatggtcatgagcctacttgaatttcctggtctctagagcagatattttttttaagcagcagcactgatctaaacaagggccagatcatcaaataactcagcatgcatgcaacagcccaaaaggagtgcttttctcagtaatgggtttatcagcgtatactgcgtccaaagcagataaatagcattacctgggttatgtgcaaacatccaggtgaactgtacagtcacaaacctcagacgattgttgtgaataattctattgatttgtaggcaacagtaggcaggtgaacgatagtatagacattggcaattgcaacgacaaaccataacctttgaagctttctagaatccttatatttggtaaaatcgttatgatttggacacgagtgaaaagctgtcaagaatggagatgtgctgcataacaaaatggtatagcaagattttagaatcacaacaaaattctggatgcctaatttcttctgcggtgtcaaatataagagaagaccatttaatttgcaaacagataaataagttcaattggaggtacctcccagagaagcctggcagatgattccaatattccatatatttgttcttctttagccagtacagcgttttaagactttgtcccattgtcaaacatatcctcctttgattagcgttcattgagcatctggcataagcaagttaacatgatatgtagttactgacaaaaaagacagcaatgaaggagtttaagttggcacaggtaagggagcacacacacacacaaaaaaaaaaaaaaggactactctttggcgaattgagagaaaccatcacgacagcaatgcaggctcgtccgcaacgcccagcgcagcgacaccttgctactcacatgcatccgtcggcagctcagctccacaggtggagcatgccgaagatagcacaacgcaaacataaacataaaaacaagcacatatgctcactggcagacggggttagagaaaacagaagaaagtaataacccacagtaacacaggattaatcaggaaaaaagaggacgcaatatgaatcatgtgtaggaacggcagtgaagttaaccaggatgagggtgatgttgacttttaagaaactgtaatattctctcagccactgtgtccttccctcctcaatctatataggtgagaaaatccttaataggtcatgtctattttcacgtacacgttaccatattgttattatacctgctaccagacagagagttgtactgcacagtttgtttatggaatttgtcctgtagaaaatctgagtccaatagatgacactttcttttatggaatataatgcaaggcaaggtagaaataccttagatgttcattgatcatcctctactagttacttctcttggcagccgccccttgcctctccgaacaaccagtagaggaggtaatgtgagtgtagtgagcatcaggtgaatcaagacatgagctgctccatctgtctccatctccatcctcttttatgatgaatttctggatttggtgagggagcacactgcaagcaagggtgatgttctacaacatgatcaacagactcgcgcaccacagcaacacgcccctcaccatcctcagctcaatcaacgcttgccctcccctcaaggttgacagtgccgatacaacagcctgagttatgcagactgcacagataaatccattctgctaattgtaagcacaaatcatgcatgcttttagaaagattacatcattggctggttaactgtaagcatttgttcacaacaaaaacctgaggacacacatcgtgttttaccttaggaaaatggcagaaatttgaaagtctcaatacaatttacctgacgaattgacctttctgaaacaccagaagtcaatgacagtacaaaacctagtattttttaaatttatttggcatagaagttagatcgatgtcctgttcattgctctattggtgttaagcaaactttctaggtgaatctttcctctattgtcgggttctacagcccagaagagcattgatccattctgctaattctatgaggaaacaaggttcatccctttatctatgcaagattaggattcctcataagtctccagtctagttagtaccctatattaatcattatggatctttgaggtccgacaataatgccatttctcttatcttgtgaatgcagcaagtaaataggtaatagatcagaaagtacaactagaaacaactcatgcagatattaaacatgtcaaaattaccaaggtcatgaatagcaatcaaacttatttctttacagaggatatattgagttattgaccattcaaggcaggcccaaccagacgccattacttgagatgtgttgggcatggtcacataaaagataaatttatcagttgcagtttataatcaagctctaagtgttttttttttttgcgaagttcaacaataataccaaaaagggaaaatcatgtacattgattggacacaaattaatgtatagtacagaagtaatcacaaagtgccaatggtaaaatagagattacataataataaaaggtgaattcttgttagtaactgaatctcaatgcttacctttgcttctatttgccatagctaagatttcactttatatatagcaaaactcataatctgacactggccatacaatggaaagtttaatcttctcaagccagctcttgatccttatcctgtggaacttaaattaggattctccgcgtcaatgggactgtcacttcccaaagatttcatgccaactagtatgtcatatgttgtatcatctggcataattttcctttcaagcatttcatcatgcaaccggaacgcttcttgcagctttccattacggaggtatccgtttatcaacatgttgtacatcaaaacattagggcgtatatctaacctattcatttcatccaataattttctagcatcatcgatatctccgttgcggcaaagaccatgtgttaatgctgtgaaagtaatatgatcaggaatattacccttagccaccatctctgagtatagtttcaatgcaaaggttacattgccatcttttgagaacccatcaattaaggtagtgtaggttgctgtatcaagatcaattccttctttaatcattttctcgtacaatctcaaagcttcttccatcattttcaaattcttgtaccctgtaatgaaactgttgtagactgaaatatttggtaaaagac

SEQ ID NO: 45565 - DNA, 978 bp, Oryza sativa
tatataatccagaacaaagacaattctgtttatcttggcgcttctgagttgtttaataaatgttcgtgcttgtgaaggaggggaaaagaaatatgagatgaaaagttacaacaatagtagcatttgtcaactttaatccatcttttcacatgagcacacatgctaaatttttttctttataaaaatccgattttattccaatccattggtgcagccactctgtcagaattccatgggtttcaaggtgcaaaaacccaccattacaagtcctattcgcgcttgcggtaactccgtgcctgggtgcgctgaattcctgaaagagatgaaacagaatatgatgatctgtttgcaacaattcttttacacttttttctacttttttcacttgtaagaaaccatgcgtagggcacacttccattaactacaatatcatccaaagaaggagggaatgttatctgattttaccactaaagtttctggcatggcttcttctctcaaaagtaaaaaaaaaaaaaaaagaaaggctcccaagtgtctgaaatgacatgatagatttcatatgaattccttggcggtgtgaagctctcaaagaaactacaggagcacaagttttctcctgtccattcaccaattgatgcgtgtcaacatcggccaattaaaccatgtcacgcgagatgctgcgggaattcctcgtgttcttggagcccttctttttcgcgatcaatttgcgactgttctgaatcaccagaggcattatcttgaagcttatggagaaggggaatccaagcataataatatgttcttgcctttttcttactttttttttctttctaaaatgtcaatgcttgcatgtacatggtattgcatttacatcttggcatgatgccacaaaagttgaatgcaactgaaaagggagggtaggggtatgtagaaagaagaacatcaaacagctacgcagtactaccttttccttttcat

SEQ ID NO: 45566 - DNA, 1343 bp, Oryza sativa
ataaatggttcagaaacccacatgctgtgcaagggaatccaccgaaagcagcaacagggcgtgttggtgcagtagggcaaatccatttgatctgcataaggatggtataagcttgagagttaataaacttagaactagcatgaacaatgctattgctaaaaatctttttaaaaaattgctatggctaacctagtgattcagataagttacattaatttgaagagataacagaatgaacaagtctatacatgcattattgtgcccatttggaatagggataggaatagaaataagattgtaggtgaagatggttgtgtgcatgattgattcaactgcaaagtgagagtgcagtatggtatcttacattaggcagaggaagagaatccagtagctgggaccagctgcagaagataaaattatgaaaaagaaacaagaaacaagattaggccagtgtttcaagaaaaagtacatgttacagctagtcagcaacttgtgtagagatatttcagtgctgtgctggctttctatcaaaactatagcttcatctaatgacattaacatgtcaacaaaagaagggttatcagaaagtaatggagaataaaagaagtaaagagtgaggaaagaataaaacatgacatagcacaacactggatcaaactaaggcagctaatgagctggctagagcacatatgtatatataattaagttttttcttgtgttctcctgaaagttccaggtagtagtacaatcgtcttattaatgaaatatgccattgtaattcagtactgatgggaaaagcaaagaagtgggaagagaacatttgaagcagacacttgacagttgacacatgcatattgaactcagaaaaagaaaattaatggctagcatattctatgcttttgctgccaaaacccatagaagagaaacaatgccaaaaaaacttatgttatttaatgcaacatcacaaaactgaggtgctccatgcatccttgttggcagacagaaccttgcatgaagcatgaggtaattaatccacatctatctcttctatatttaatcaacatattggtccttcaacaatggattcttgcattcgtgtttctacaccctttcgtggtaagagaaaccaaagaaactattttaatccctcaaggttatatgctattattattttttgcatgtggttcagatagaaacaagatattttgaaataaaaaaaaagagagaatataaccgatcatcttacacacccttcacaaacatgcaagttcaaatgtttatatctacatcgtttaattttctaaagaatacaatgtttcataactgttaatttgaacggtgtg

SEQ ID NO: 45567 - DNA, 1618 bp, Oryza sativa
tggtgaatatgtgaatcgcgcgggcgcgcacccggtaatcaacagttggcggcggctggtaggttggctcgctagctgtctgtcgctgggagaggggggaataataatccatgacctctagcatacgtaatgcgtgccggaatgagataaacgttcattcagttatttgccaacttaggatggagattttacaaatatacctgaataaaatgtcttttctaacttgtgttggtattagtattagttattgtctagtcatttcctggtttttatgcgctgtctattgagcgcatcataagtggtagtagcttctttgaagtaaaggccgggattctttgcattattaaagggagtagatatatttatggcgccatatttttcaacaaaaaatagtcggcatgtatttacattgtaagtatctaaattatatatgtaattttattgtatttagtatgtaagtctcaaaattacctatgtaagtgtttaaattacatatgtaattttagtgtatttaggatgtaagtcccaaaattacatatgtaagtgcctaaattacatatgtaattttagtgtatttaggatgtaagtcccaaaattacatatgtaagtgtctaaataacatatgcaatataatcgcaacaaaaagaagagggaagctcacaaatcataggtccgtttggagaaaagaaagaagctagcaaagtagaaaataattactcacaaaatcacatgtccctttgagtatttgtaacaaagtaatcaagtgatgaagtcatccttgatatacacctcgacaaaatcaatcagcgtgggaagctaagcacggacatcaagggagatcctaccactagaaaaaacgactgttttttcctcaaaaaacatgcgccataaatatagcaataccgttattaaaaagttagcacacgtacacacgagggagggcaaaaaaattttaaaaaagaaagatcaggggcttttgccttttgctacctcaggatggggatgggggaggtggcagcctgcaggcattggcagtggagggtctcttaatgtatgtaaattcattggtgtaatggtgtgtgggtggcgtgtaagtagggatgaaaaacggtgccggaaattcccgactgagcggctattattcccaattttgttttgctgatcaaaccatcttgaaatcaaatggctaccaatcaacaaaaatagaaaagcaagtggtaaaaatgaaatgtgcaaactgaaatggttttgatgtttgaccaaccatttacttggtttaccgtatttttcacagatattgttaccgtgtttataatatggaaattgtcatatttctaaataaatcagttcatgtagttcaaggcctataggttttactctaactcccccactaaaccctatatatttttagcacacggttaaaagcgaggcaactcacaattagtgttgtaagcatgaactaacgtggtatatagtcattctaaattacatatgtgattttgtacttcagaatttcttctgattgattttccgtttttgatttcctgatttttctatatcattttcatttctagctctactgttttcaattatgtttctaagaagaaaatgttacgga

SEQ ID NO: 45568 - DNA, 849 bp, Oryza sativa
acagcctaagatcccaggtaggagtaaaattttttacctcgtcacatttaaagtctggacacatgtatgaagtattaaatataggaaaaaaataattacacatattgcgtgtaaattgcgagacgaatcttttaaacctaattgctccatgatctaacaatgtggtgctaccgtaaacatttgctaatcacggattaattaggcttaataaattcgttttgcagtttacatgcggaatctgtaatttgttttgttattagtctacgtatagtactttaaatttgtgtccgtatatctattgtggcacgcctaaactttttacccctagatctaaacacaaccataaaatagaatagaattgaattgcgaaagggcctgtaacttagtgtttacaagagccttagtagcaccttaggtccggggcttgactcctcatgggagcgaattttataggatttaacggctctgtgctttcattggtaggcgacgtactcgtcgacatcgaggtgcctgtggtgacttcgtcaatctctaggatttaccggcccagtcttcgaagatgctcataggggtagggtttatgtgcatgcgttcgtaggggtgagtgtgtgtgcattgtgagtaccagtgttatactgtgtaattttaaaaaaatagaattgaatttagagggtatttagatgcaaggtgtaaagttgttcatagggtgtttgcttcagtaaaccgcgagacgaatttattaagcctaattaattcgtcattagcacatgtttactgtagcaacacattgtcaaatcatggaacaatcaggcttaaaagagttgtctcacaaattagtcgcaatatgtg

SEQ ID NO: 45569 - DNA, 11845 bp, Oryza sativa
gaggaaggcgaagtcgcgaagacggcgtcggaggagacgccgaggacgcggaatgatgcactcggtgttccacccccgccgtgcccgctcgatcatccgctccagcaccggcgacgccgtgcccttcacaccaaacccagaaacagaaaaccatcagcctcaatgcaaggtcgtcaagaacccctgatccatccagaattcaccaccagtaacagagaagaaccagaagtccatcttacaagaacgaaggaatgtgtggcgatgctcttcccatccgacgtgacgacctgcacgtcggcggccaccgccggccggagcacgtccagatccgcccaccgcgtcatcgatcagaaactcccaagaatacccaaattctcttgatcaacaattcgactggccggctaaccaagaaacgatctactgaaataagggagggaaaaaataagagggctgccgccgccgccgaccccgagggctgcgacgggcggtccgccgcccgcggacgccgagagccaccgccgctgacgccgatgaccgacgccgcgcggccgcgcagagccgccgccgcctgctccctgctacgctgcccgcgccggccgccgacaagccgagagccgccgccgcctgctgggccgccgccgacgcctcggctgccagcctaggccctatggttctagcctgacttgtgctctgcaagtctgcagtctgcccgataagtgaaaaagtaagaggggaaaaataagagagggaaaatgagggggaaactaaaataatggagggaaaaataagatagggaaaatgaaaaaacaatgagataataatgtatatggcttaatgaacacaattagaattgacataatatcataaataacttgagacaataaaattgggggaaatatatatatatatattaataatctgaatatatagttgttgcctcgttaaaaaccttacgccctagagtagggttcccccgtaaggaaaaaagagtacaacaactattttacattatagcatcaattactccggatcaacagcaccatcatctttggtaaggcaaatttccgccaatgcgtcttccactgcatcggcaagctcttgatcatctagacggtgttgtgttcgttcatctgctttcatccagtctttaagacaaaagattgactcaaccgtctcgggtgttaggcatgaccttcgttcttcaataattcttccagtagcgctgaatgcttgctcggaagaaacggaggaggccggaaccagaagaatatctcgagcaaagtgagctaacataggaagagttcgctctttctctttccaccacccaaggagatcgacatcgtcgccatcaagcgtcggatcatgctcagtatgatcggtgacgaggtagtggttaagctctgaatccgggttccatgttgatttgttctgtgaggatggagaggcttggtccttgcctgtatgctgcttccacaaatttagtgcacttgacttgcttgctttcttttgtgaggtctgctcaggaactcggggagtaccaccaagcttggttcggtacagacggaaaaccctatagagctcattattgacatgttgaaaagcttcagaataatcaagccccactgcatcacctattgagttcatggcaaccttggcaatttccaactttttgcgaggatcaagtatcaaagcaaagcaataaaggtgaggtatagcggtgaagtatttgagaaatttttcttccatgggtttaacaatggaagacagaatacgatcagaccggttttcatccaaaacaagtgccagcttccaaatccactcaagcaccaaacaagatgtaggatagtaaattcctgataattgaactgtagcattataaaagggcttcagaaatttacgcacacgtgtagcaatctcccaatcctgatcggtgagaatcaaaatctcaccatcaccgtcgtcatcggtatccttcattctgacatgcatcgaattgatgaaaatagaaattaactcctcatacccttttaattgtcgcagcaacaggtatgttgtgttccacctatgtttgacatcaatgccaaacatccgtccaggtttattcttcacaatgccaaacatccgtccaggtttattcttcgctttacagtagtcttggaacctcgctttgaccactgtgttacctcctatgatacgaacagaacggcgaattttgtttaacaatttatccagaacaatcatgcctgcaaaaaaataggtcgcatatattaaaataaataagcaatatgccgcatacactaaaatcaataaattattaataacattagtacctggttgaacgatgagattgatgacgtgacaaatgcatctctgatgaatgacaaagcctccaacataacttcttagatccggctccaaaatcgacatggccgttgtgtttgctgatgcattgtcaagagtaatggaaacaaccctagattgtaaattgatttctctcaatacctctaggattatcgtggctatggcatctcccgtgtgtgacgtcatgagtttgaaccctatgactctcttattcaacgaccgattgttgtcaagataatgaagaacaacactaagataagatgttctttggtgttgggatgtccagatgtccgatgtcacagcaaatgaaaaactagtagtactcaaagtttgcttcaacacactcaacttagaacgatatatagctgtaatatcgttcttggtggttttcctagaaacttttttgtactgtgggcaaaaagctttttggatcattctctcaaaatgtttgctttcccccattctaattggtagatcctcagcaacaataaacttagcaatctcttctctagctatttttgaatcataggtccatgtacttactgaaccgtcagggccgaaggacaaatgtgtctgtcttgctcctgccggcgccttgttcttgagatgcgccaagtaatgccggttgagatggcctgtccctgaagaagtagctgcagacaaaattttttcgcaatatttgcattgagcacgaggtatacttttaccgtcaaccatctcggtgaataattcgaagtgtcgccaacactccgctcttctggcagatggctggttatcggaatttggtgtgggcaacgtcgtggcgtcgacgtcgacggagaagttggcctcgccaggagatggctgatcaccgtcatcgccctccagaccatccatgtggcgatcatccatcccgtagtcgtccatgcccggggatagctgccgggcatcgaccgacctctggtatggaccggttgtcgactcgtgttgacgctttttggacctccgcatattttctatgaaaaatagatacggtggggagatgtgttgaaagaagaagaagaagtgtgttgaaatcagaaaataggtatggtttatatagggtatgccagggccggtccgccggccggcgacgcgtctgaacactgaactgatctgaacgactctcggcggctaccgatcgactcttcggttcagcggctcggttgaacgcgtgacgtcaggagcgcaggagacggctgcggctagaagcctggaacgctgcggctgcgtgactcctcgcgggtcgcggcgacgcggccggccatatctgaagtttctgaacgactgaacgcgtcgggcgtcggccacgcacgcacacacattgaactactgaagtctgaacggctgaagtttgagtgtcagtctgagtgaccacgcacttagttctggccttctgggcatgccgcatgcggcacagcaacaggcaaggcgaccatgcacatctgcatgagtgcatggcactgttcccttgagaaattaatcaccgcgtctacatgagttaaattccattcaaaacaagaggaagaaattaatcaccgcgtcgcatgcagccatgcacgcgctcggcgctcctgcggtgacttacgggccgactcctgcgctcctgactttcggccatttttcgtgctgggccggccttcgggccttcgggcctttttcgtgctgggctggcccaggcactgcccaatagcctgccgtgccgcccagcgtgcctcaacttacggcccaggcacggcccaactacgggccgtgccggcccggcccatagccgtgccgtgctgggcgtgctttctctcgtgctgggccatcgtgccttgggccggcccaagaaagcacggcccaagtcccacctctagttgaggaggagccggagatcaccttcttcgacgtggagacctccatgccatggggtcctagggagaggcgcacgctgctcgagttcgggtccatcttcctctgcccgcgacagctggttgaggtcgcggagcccttcgtcacgctcgtgcgcccctccgaccttggggtggtcacggaggcgcttgagcgtaagggcatcacgcgtggcgccctcgaacacgccccgcccttctgtgacgttgctaataacatccacaacgtcctgcacggtgaggggagggggttcttgtcattgtatttcttgacatgtctccttccttgactttcaggaatgaggaatccattttctttccctttccattttcttttctctcaaggaaatatgtagtttactactgcagccatatactagcaagcacgttccaagcatgtacattgttgggtgagtttgaataaaagcttttattatctaaaattcgatacatgcacatggttcaatgccaactaaataaaaaaaaatctttctttccaactccaacttactatgctgcatgactcaacggttatcaattctaatacatcaacagtcactgctttgggcctgttcttttgatactattttcaaccttaccaaattttggtaaagttgtcaaaaaaattggctacatttagtttgctgccaaatttgggtaactatataaaaaatcctgctaaaattttggtaagttgccaaaattttggcaaaatttggtaatgtttttttttatcaaagtgaacaggcctttaactccgttttcaatttcaatcagagccactttttacaatacaagcacaatatcatatcgatgccaacacaccatagaagaagaataagatttaattagcacttgagtgacatgatagtttcatcaacgctagacgaatgcacaatatccattttagtgttctataatggttaattttttaccactgtaaagatttttttttaaaaaaaaactactttattttggcccttttcgtagtgctctctaacgttgttagttctggacagggcgaatctgggctggtcacaacatcatttcgtttgactcagagataataagggaagcattcgctgaaattggacggtcgcctcctgaaccaaaggggatgatcgacaccttacctctgcttacccagacgtttgggaggagagcagggaacatgaaggtgatgaccttgttgtttgcataaaatcacttacaatttcaaactaagaatgctttaggttcagtttgacattgcggcatatggatcctgatcataaactcgtttgctgcaacaactttttgacattttggtgtttgttaaactgattttcttataatcttgtcaatattattatggtatgaaaatacgaaacaattggaagagacgtgaaagttggataatatatataatcataattcaatctataaaccaaacgaccaaaattatatgttcaaatttttagagcaattttaaaaatgagcacagcgcaacaccaacacaacaaccacaaaccgagccttagttatagatgtaccataaaagataggaaaaactacaaaaaccatcccataagtcacttgaagtttgataagttattttgtaacaaatgtccactccatgctctgttttgttgtaaaaatcaccctagtgcgcatgtcacaccccaatccggcaccgccgtacaacggcacctgataggagcgtgtcgtaagaaaaacggcgcgaaccgctacctacgaaaccgcgatctcggtaccagtcccaggacatagtgctggtacccacggtgacaaatatgaatcattgcaaatccttaaaataaatagaggacttatttaccttaacttaggttgcagctcagaacaacccgagaatgcaaccgacgacacggacgagtaaacaccaacaacagcagcagcagcggaaccaacgaactaacacccaacaccacaggcgacggctgggaacaaggacgaaaccctaatcttcacttcacttcatcttcacttcaaggcggaggaactatatatatttatatagagcaagggtgagtactttcgtactcagcaagtcacgggaatttaggtgtttaatgcaagcttggaagagaggcaaggttgttttgcaaatcctttgtttgaattcattttgaaaacactaagtgatttatttctttttgagtttggatcgaaaagagacttgtgtctcgatttgacttaagaaatgcttttcaacaactcaaatggtaatatatcgacctccagggtcagatcattacttatcggctcccagagccttttcactcgattaagcggctcccagagcctttttcattttctcggactcccagagtccagctgcccagcagcaaagcaatccgcttccactcgggaagcctagtctatgatgcccacagacatcccgaatcacacagattcgtttctgactactcaggtcatccatctgccacgtaggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcagaggttcgcaacaaagcctttcccaagccgacccagggttacctcatgccacatagaaggatcaattcctcacataaatataggccattttagttttcacaaatcaaactccaaccacctcgatcggtaatctggcaagcttcgtgttcttgccttaccaggaacccgggttggctccaaccgaccccgccccggcgttccccaactattggcatgcgaggtttccctgaaccgactagttacttagccagggtgtcccattccaccttgtggttgcactttgattatgcttgatgagtttcccacaggaatcggtccttatatgcgaatacgggacagcgccacgcaggcaccacccccgcatcgcgagttttcacaattcattttatttttaaacacaccgacaccacatgtcgggttttgaaggcttcacaaacccatttcccaatttttcgacaatcaacggtgtatgtgggacaattggtatacacgctcaaagagcacggataccaaagtaccacaagggtggagcgacaaggaatcagggtagtacagcctacaggaattagtgcgactactgggtaggtccgtcggtttggcacgcaaaccgaggccaagcatgttatatgtgtgtgactctaataatgcaagttgcaaacaaaataataatgattttccaattataggagcaattgatcaaagggtgacttgccttgctcaaggtcttcgcgaagcttcacgaatcttcgagaaaacccgcgatcgacgaaaatccggtaaccgcaactatacgcaaacaatcaaaaacctaaacaaaagaccaaaagaaagatcctattaggctaattaatagtgccattaaatagatctcaattttacggaattactggatgtggaacggaatcaatcggagctacggatcgggagatacgaattttggaagtttaattggattttctggacaaggaaatgatttatcggaattttctggaatacgagaaatggtttatggaatttatagaaataatattctcaagaatattattgacattcactgacgtgcgggagcaaaggaaatgattcatggaattttgggaataaggaattgatttatgaaaaagggaaaaggatttattaatccctttggataagaaaaggaaggagggataggaatcagattttaccgagcggcttggcgcggcccgagaggatttgcgcggctcggccgagcttattgggccggcgcgggctacggagaggcggcccaagagaggggcgtggggagagagagggggaaggggagccgggtggaccgggctcacctcgcggggtcccgagcgggcccgcttgtcggtgaggcggtgcacggtggaagcggcgcacacggggacgggcgctagggtttcgggtgcgcgtggttcgggcgcggcgcgccgggtggacggatggtggcgggcccacgtgcagccgcacggcttgccgtggaccgcgcgcacgggagggaagacggagggagggggcggctgaccggcttggcccggtcaaagccgaggtggcgccgacgtggcgcctacgtggcagccacgcgggccggcgggaggaggaagaaggggaggccgagatggacggcggacggcggccaagttcaccggagctcgtcgtgacgattcgagagagagggagtacaccggaacgatgggacggacaagaggaagtgagccaccgggtcggattcgccggagggaggccagcgacgacgaatcgtggcggcgcacgccggcggcgcgaaaaggggggaaacttcaccggagcaacgggggttcgattcaaaaggatgggagcatctccggggttcaaggagttcatttccggcgttggatggggtagagcgacgccgtggaggtccggcgacgagaggcggcctccgggagcgggcgccgacggcggcaaggccatggcgagcggcagcggggcttggggcggcgcctacgaaccacgcgagttaaaggaggaggagggcgagcgaggaagaggaacggagggctaccgcgtcgggacagggcaccgtgacgagcggcggcggcgcgggagcaagctctccagcctcgggccggggaaggggaaggagaagagtggccggagtccgcgtcagctcctcgtgcgcacgccggcttcaccagcacgcgcgacggcggagggaggcgaggacggcggcagcatggtggggatggtggtccggcggcaatggcgctgtgggaggaaacgagaggaaacgagtgggaggtcgagacgctgagggggggggctcgggttatataggcgaggaggagaggtcggtttggaggaggaaaaccgacattggcggtcaagggatgcaggggcgatgagctggcggtcgtcgacgcgtgcagccaaggcggcggcaggtgatgatgccggcggtgtcaggcaaaagtggaaaaggagggggaaaaggggggctctgctctttgccgagttggggcgggagagggatgggagcgggagctcggcctcacggttttggcaggacacgcgtggagcggctcgggcacgcgctgcagagctcgcggcaggcagcggggccgagcggcagcgcggcgcaggcgctgacggtggcggcgaccgggcggtcggccacgaccgacgcgtgcgcgggaaccaaaggcggtggcgggaatcggcgacggggagagaggaagcagagagagcgagagagagagagggcggcgctctctctcggctcgggcacgacgctcgtgctctgcacgtgcgaaggggagggggatcaggctgagaggagggatgggccgagggaaaggaattcagcccacaaaacagagggaggaaaaaatagacttttatagggaatttgagttggagagatttggggcttgggtttaaatttcaaatttgagattcgatctcgggggtttagggaggaatcaagggagactcaaggaaaggattcgagatgggaatttgatatttttcggaaatggggacaggtatttggcggggattcaaagggaggcgattgaatttcggagtttgatagccggaattggaatcttgaggtggacgatttgatggcgacgagagggaacaacgggaaattgaattgagatccagggcacgacttagactcgcacacaaagaacgaaattttcgcaattaggattttgccgaattagtttttaacgtctcacgagaagcggagcgttacagcgcacgtgcttaattaaatcaccctagagctaccacatgatgctaagctacccgagtaaattttattcaattgcttgcattagatttatccttcatgtttcattgaactttctttatatagcaaaacacagtgtaagaacatctaagctctcatcagcatttctatttgtggaatcttcaaaaattattttatcaaaactatattctacgtgtatctaagtttggtaaagatcacattgacggcttataatttattaaaacatgttgattcggttagacatacattcactggagtggtttttcaataaaattgagtagctgggtaggtatttgcaataaaataacttatatggtgaaatgtcaaacttcaagtaacttatgaggtggtttttataaatttccctaaagaaaaccaagatttgcatgctaaagaatccagaccttcgttgaatgttctcatggatatacatgatccttcttgtcatttgaatgaatatggctgatttctgcagatggcaaatttggcagattactttaatctagggccgcaaattcacaggtatattatatagagtgtaaaatccaaaatttatattcattgcatctgaattccaaatgcgtcctttctcaactttggatttttcttatcctttcctatttgaattgaaaacacatatacccaaggcatcatgttggtaacttagcttgacattcattaagtgattatttcattactggttacctagcccgctgagcagtttctattaatattaccttcaatcataaatatttgatatttatgacaatatttggtcaaaattttaaaattctaacaagaatctttctaaagaggtgtggtggaaacaatcactgttttttgaatatatatatatcgcccatcaacatttactcctgctaccaaacataatacgaatcaaaagtaatgattaacttcctcatgatcccacttcagtacatatcatgttcaaattgttttgtttagtttcattggcacatacgcacttctccaagtactcggtatttattgtcaattagagaagtagattaggaatcgttatttcaccttcttttattcagttttaagtatatatatatcctaaaattaatagagtaaatgatcttccactaatttgctttgcaatttaagccatgttcttttcatctgattattcattggatcattgaaacaaattattttctacattcttcaaaagatgtgctttcctaataaactttctcctgctacattgtttagacccttgtttttaagctattcgttaagtttaatctatgacaataatctgctcaataatttgcaggagtctgtatgatgtcaggatgaatcttgatgttctcaagtgttgttctacagtgctgttcctggtgtgtttggattacctacctcctgtttttctgttcctattaacttcatatgatctggaaaacaacattgttcaagcaatgcttctttgactgaaagtctgaaacaactacttgtttctatcatttttttccacgcatttggcatctgatgcagcagagtgagaactagtgattgcatagcatgatatgtcaacaatccaacttcgaagtgtgtggggtcattcatagatatctattattgaaattaagaatatttaaat

SEQ ID NO: 45570 - DNA, 4576 bp, Oryza sativa
gaattcattaatgtgtctcactgtctgatagtaggtgtgtaaacgggacgtgtattacccgctatcctgaccgacccgaggcttatgagactggtactggagagtgaaatgaatacttgccattatccatcagaatttgaacctaggagaaaaataggataggttatgttatgagttgtagccgtactattaaacatacaccaaaatctattatgactccacttatgaacatgataaaagatataaatagtccttatatatttatgaactcgcaaatgaatccctagatccatccccatttaacagttgacatgcccaactaatcgggttctctaattgtccctaggcttaatatcttagtactagagataaaaatccgttcttggatccaattccgagggaaaaaaccgggataagtaaatcaatgcttggttttggctctgaagaaaatacaagataggtcaaaaaagagtgctatccgatcatatctgacctgattatacccctatttgatagtataatttattggctaaaccatgaaattcttttgcaggaggataattttccagaactgctaagcggcggtttcctcaacccaaatgatatttcactcgagttcatccaagtttctatttctttttcctcttgtttgggcaaaagaagtctaacttccggccttcgcaccaattctcttccataccaatttgaatggagcttatgtatcgagcacaacgataatccgctacaacttcgttgcataggtttgagggtccgttatgaagtttatctgtatcaagacagtgaaggtcgaccaaataagttgagcatagtggttgacatccctgagaatctcagacaagttctagaattttgtgatgaaatagctgagataacattccggaagtttgggagcaattctgaatggcggcaagtgattaaggaatacgggaatcgtcctagtgtacgcctaaagtgagttacattgctctctgattcttttaaaatgtaaaaataagtgccaagtgttcatgcttctgtgatttttaacaacaacaacgatacttcctctgtttcgtattatatttataagtcgtttgaatattttcctagttaaacttctttaggtttgactaaatttatagaaaaatatactaatatttttaacacaaaacaaatattttatcaaactatagtcaatgttagatttaataaaactaatttcatatattagatattgttaaaattttactataaatttagtcaaacttaactaagtttgtcttaaaaaaaagatcaaacgaattataatataaaaccgagggagtaacaacaaccacattcccttttcgcagcatccccatcgtaggcagcggcgacgatgcgacctatgcgacagagatatacctgaaagaggctagcggcaacatccggaagaaggatttcagcaaggcagatgtcgcagagctggaatttatgttttttcgaggggacatggtcgacgcgttcttctctgtggaactatacgactacaaaaataatgctggtattcggctggtcgccaagaagttggttgtacactgcaggtagcatgcatcactaggctaaacagcagatagactgattattcctcttccttccctctctcctctatttcatcatctctctttatcttccggtggttaaagtggcgactggtgggattaggggtggcatgagttggagacggcggtgacctcgttggtgggagagacagtggccaagagaggtaagaactagccaggcagaggtttgagttcatgcttatcaccgtgttgaggaagtagctgggaggaggtgatccggcctcgagctccactacagcaacacacgtggtggagatgggtcaatgtctagaggccgagcttcatggcggtggtgtacttcgtcccccacaacatggaggccactgagagcgctagccctgtccttgctagagaaccagtctggcgaagggctagctgcctctgcccctctcccttctccctaacaacagcttggtgatagctacacatgcaatagcaccacccttggtttcctagtggaggagaggtttgtggtagcggaggcgaggtaagcggtggcagagttggatcccgttgtcattctcgtggcagcagatgacatgaacaacgacgtgtatgtgccggtggtcttcaagtcagggtgtccaacctagtaggccacatcgcgatctcaggatgccgactctagattccattgctctcgaaggcaacataagcgaaggtggcaactagagttgtcaacaagccaaacttgagcgagcctgcctgtataggctcgacctcgacacaagctcgagccgagcctaatccaccttcgagtcgttaagcaggctcgactcaaattcggttaggtttgcgagctcgaccgagtatatgataatgtatattttgatgataatttttatgtaaaacaataatttcaagataacaatattaaagaaaaggttaggagaacatacgattaatatatgataccaaaacagactaattattttacatgaatctgtactcatttatccttaacctagtcacttgttacacaagacataaaaatcaaacatacatctaggctcatgagaagctcaagctcaacttgacgaaagctcacaagcttggggttgggctcgggcttggctccttaagagctctagctgagctcgtatcaaatctaagacgaaccaagctcgagcagcccacaagccttaagctttttttataggcctagctggcaaccactagatctcgcgctctctttagccttgtcaagctctgcaccatcacccctaccagttgagcaagtcatgggaattgggaaagacaccaccaccaccgctgtcttaggctccagagtctgcggtcctctctttctctccctagtctcctctctctacctcaaagcttggctcgatgcttgccgagaggaagatggcagctagagaggaagaaagcaaagatacttactgatacgtgggttccattgcatttatactttttttttcatatttttcttctggtgctacataagcaccacatgccctagacttagttggtttgaccaaggtcaacatgtcacatcagcgagaaccacaaatcaacgtgccataccatcaagaaagtaattttacactagttttaataattgaatgggttgatatacctgattttacgatatgcatgggcatataaatcagattcaacctacagctgagggagtcgaattggactctttccgcgtgaaacgcaaggcagcaactggttccctgcacgtgaatcctccttaccagaactgagtaagtaaaattttttggcacggtattttctataaagaattttttaatataagtcaggtataaagatgcacttttaaaaaaattaattacttctagtactccctccgtcctagattagagggtgtttattttttgggtttagctcgtgccattgagatacgttgtttctaaggttctatggatagtttcattctggtaccattttcgtttcaaatgttctactatttcgattctattcccaataaacaatatatatgcttgtggaaatagtttgagcatttttccgaccattttcatccataatttgaagccagctgtagagttgtgtggatgccaaccgtagaatttctgtctgttcgatcgatggttgagtcttgcaagttctcttctagctatatatgctgctatggtacaacaatcggatggttaattgatgaatggatgacagggatggatcaagatatggccggaaagcttgattttggcaaaaaaataaggtaggcgatatggatccctagctggctagatccagcatgcatgccaccccttttcatcatctagtcccattgttctaaaaagaactcaatcctgactttgaatccggttacagtgtatgttcaaattaaacctaggattgggtatactcagggttggaaatttcggtcattttggatcccttcgatatgatattttttgggccaaaatttttcaatttttcatgaattttgataatatttgttcaaattcaactaaattttgttcaaattttggaaatttccgaaatttcggtgacgccagatcaaatcggctaaaccgaaagtataaccctgggtatactcacattcaaatctaggattgagtttgttttgggacatagaaaatatttatcaagaaagccaaatacggtactctgcttttatagtactcaaggacgaagaaagccacctccaacgactttagctttacaatgtgcgaaaccacgcaagcagcgtactacgttattaccaaacttttcgatcgaaaagtgaactctgatgagtgagtgggaagaagcagacaatgcaaaacaacctaggcacagcatcactgcatgcagcttctatcacaagccacaacacaccctggactcagaacccaacagctaattcctccgattaattactcccttcgtagtttttttttaccaatttttgaccattcgtcttactcaaaatttttgtgtag

SEQ ID NO: 45571 - DNA, 17386 bp, Oryza sativa
aacttttaagtttttcatcacatcaaaacttttctacacatacaaattttcaacttttccgtcgcatcgttccaatttcaaccaaacttctaattttagcgtgaactaaacacaccctagatatggagttgatctagagctcctgtgtcgaaggtccagtttgagactgtcgagtggattattgccgaagattttgatttgaaaactactaaacatttttttaaaaaaactcaacaaataggtctgaacaatgcagtagagtttttttttcttgagaacacatggtttttaaaaattatagtgcaaataatttgtttgaataatccgataataaaattggtgtttttgtctgattgtacagttttctcctactctattcaataaaattagtgctcgttgattcaataaaataaaatccgataaatgaaatggtgaaaaaaaaggggacggtgcatatgcatatgtatcctctttgtttatttgttgccactggccgccgtcctttcggagcgagataaggcgatgattatgctagttgcccacgtcctccatggaaacttaagaccctgtttagatgggactaagactttagttttaaagtccctatcacatcgaatgtttggatatctatctatctattatatactaaaagtccattaattatcctacaaacgctcctaagccgccatgtggcgtttctacaaacactcttatgttgccatgtggcattttataatctcaccatcgattttcatttaaattagtggacccattattttagaccattggattagatctatttgctttctattgatatcgtgtgaattcgagtgaaaccgttttataccggaaattctcacgttcatacgcacaatggaaaaaaggaaaaatctcacgtacttacgcggaccttaaaaaaaaaacctatatgtactgttcatttaaagaaacgtacttacgtactatataaaatctattaaaaaggtactgtttcagttgaaaaaaatacgtacgtacacgagtaaaaagaaaagctataagacctaaaaaatatatttacgtcgctagaaaaaagatggtttataaaatagtatattttatagtagtaaaacaaaatttattactccacaaatatgataaaaaagtataatttaaaaatatatgtttacagctgtgcgggcattgttcttacaaggtgagactttaaaaagtagatctatctaacaatatatatagtcacttcctattttatttatgcatgcaagtgaagtggtacaggataaaataatatgtagtcacaattttatatatatatttttatatatgattgaatgaatagaacttagaagaatatacattttacgagcgaagtagacaacatatgtcataaattctaattatgatttttatcataaataacacaatggtccaaatagataaagagtgaacgtgcgatttaaagttaaaagttatgacgatctaaaaaatattgttacaaatatttaatttagaaggttgtggttattcaaaaattgttattgcaaatattttcatgaagagaaaagagagaaaaataatcaagaggataatcttcctacgaactattccaaaattattgttgcaaatattttcataaagagaaaaagtaatcaagaggataaacttcctacaaacgcttctaatccaccacatattaccctataagcgttcctagaccgccacgtggcgctccaataaatcatagaaattgtaagaaaaaataaaacatccgaccatcgattttcatttattctggtggacccattatgttcaaccattagatctatcttaaaaattaataattaaatttatttgtaaaaaggctcacgtcatactgccactaccagccaatatacatgcacatagctacctaggtattcctccttaagaaaagtacgtacctacgtacgtacagtacgtacgcaggtattcctccttaagaaaaaatatgtacctatgtatcgtactatgaacgtacacacaccgggtctcacatccttattttttcttttttcttctcatttagattagatggaaaaccaaaataataatttaaaccctttattaattaaatatgctttaagttgtaaaaatatgtgcaatttcgagttgtattcaaattaggctctaatacttggaagatgccatgtgatgctctaataaattggagaaaatgtaaaaaaaaattgtaagaaaaaacaaaatatctagctatcgatttgcacttaaaccggtgaatccattattttcaaccattcaattagatttattcaggtaagccctcgctcctaaaaccagctaatccctctctatgcacgtacatacacaagagatgccaaaaacaaaaaagaagagtgcatatatggttcatcccatctggtagttttctgtttctttcttcgtagccctaaggtgttcctcaaattatacatgtatgtagcgaccactctttacgaggttgacgaagaagccacactgccatagcgctgcttcatgacaccctcgccaattttcttgaaaatattgttttaactaataatgtaaaaggcaatcctaagcgagcatataaacgtgtgcacacccacctttgaatatttcacggtacaaatacttccttcttttacggtaaggatatgaggtaatctatggttagttatgatgatatatgactttttttcagtagttctttaataaataaaaaataaattgcccgcgcaactgcgcgggcttccttcctagttaaacaaacagctcagtgggcaaaacattcgccgtcgcacaagcaaggagcgagactgcggtctcgcagcgcagtgtcgcgccatcctcgcgcaagaccgttcttgacgtcatcgccacctaatttttgtgcaatgtttctgcgggaccgatggtatatttctgtcaaaacaattgcatcccgaatattttttaaaaaaaccaaatgaacagtatatttttaaatttaattcaccaaagctcgactagttttggcttatgtgacacttgcatagtattttacacaacaaaaaataaataaatagtcaaccgtgatctactcacgcatcactcgactaaatgttttacggagtaattctttttctacaactacacaggcaagaataaagataatttacataatggattgtaaattgttaattgccgttgtacgttgatgatgtaataatcggttgcagtttcttatagcttcttgaagcaaagaccaaatgttatatcccaacagagctcatgagtagtactacatcaaaacggtccagacatgagtattaccgagttgaatttgttttacaacttgaatgcatatgaaaccatttagagctaacattcaatctatgtgggcatttatgcaaatcgatcttcctcgcgtcggtatttctttcatataacatagcttttctcacacttttaaaaatatatatactccatccgtgttccacgttagaaagaagatgtttcgatctcttcatcacttagttccattttttcttgtattgacaaactctcctagtcttgggaactccacacatctacaaattccgctatagccttttatatatactgaaattatcgtatctcgtatacactaaggcttatttaaattgaagcatttttttttgttgtactaacatttattttaacgatttaatagtatcatatgggtgatatgtgttgatttgctatcaatttttggccacacactaactaaaattctgtattaattgggcaagccaaaagcttgccaagtgccaaacattcttttcttaagtaaagtatcaaaattttggtatggtaaaaattgactccaaaccaaatctgccattccgtcggggagcacctccggtcgggccccttcaccgtgggaggccaccgctggtacttctatgtcaagcccaacggcgacggcactgatgcgaccgccgttcatcctcattaagaagaggctcaagcacgcaagcccctttgttctttgtactactccctccatcccaaaatgtttgacgtcgttgactttttttaaaaatgtttgaccgttcgtcttattcaaaaaatttaagtaattattaattcttttcctatcatttgatttattgttaaatatacttttatgcatacatatagttttacatatttcagaaaagtttttaaataagatgaacggtcaaacatggtttaaaaagtcaacggcgtcaaatatttaggaaaggagggagtataacattgagaggccgaggttgatttgcgaggaaaatctcggctagtacatcgatgtcggcacggtggtgaccatgctggtgctagctgatcggcacggctgcgatgttctgaagaaggcgtagtgcttcggttttctcaaatctccagcaagtctcagggtagtcattgccactgatggcttcgtgcatctgacatggaactgcacctctgttttgttggagttgactgccatgaactcagcagcttagttgagtggtactcagtgtcttatttcaatggtggttcatgtggtttcttgactgatgttgtcttaaggtagctatcctgttttcgcaatattctccctgactggcttactccctccgtaaaaaaaaaacgaatttagtattagatgtgatatattctatatatgtttagattcgtaatattaggatatgtcaaatttagtactaggttggtttttgatgggacggagggagtaggttttattatgagatagttatatgtatgtggagatgcagcgatagtttccgtttttatctgttctgttatcaattaaggtatttttttccccactaatgaacctgcaaatttgtatagaatgcttactaaggaaatgtcagaatagttttatgtttttcatgctagttaattgcatctccactttgatgttagctcatatttccactagacctgcaaattgttactttctttcctactttccttcactctatgtgtcaataatcaaaatttatatatgatagatggaactagagtctaacgttatataacattgttttcatgaactcgtagtatgacggtgcaaaacagtttgttgccgtcagaggggggcttctgtttggaacaaggaagcgtcacgaaattctctagaaataattcttggtaatagtagttcaactttctttcagggaagattcatggttagctgaactgctgaacatcgcattagttctacattcgctagattattaataaatgtgttcctgttctataagggtacagttgctggggatatctttaacagtcatatttacaagtacaaatctgaaaaaaattgcagttggtacttggtgttgaagaactgaaactgagatgcatccatgagtgcttatcctggattcctgataggctgcattcatacttggtgactctgggcaggctgctgatatacagaatcaccttatcgatctatttgcaatgttaagattcctttgaaaatacaagtcttcctttggtatcttgaacaaatgtagcctagtggctaaaatgacctgagtatagggatgaaaacggtacggaatatttctggattctgggcctgttttcgaaaacgtaatcatccggttggaatatttttggaaacggaaaagaattcggaaatttttttctgaaacggataagaattcggaaatattttgtcggaaacggaatcgaatatgataagagcagtttctgtcagaacaaacaatcggtcggactggaaactttttcggaatttctgaagttacaggtccatacaatacattagtccataatacgtcccaaaccagcccaattcagcataacacctcccatagtctataatacctcccgcaaacctagaaacttttagagtagagagtgagggactgagagagacatcgaagattctaaagccgggtggcagagtgacgcgtccagatctcacgtcgcctcatcccccatcgtctgtttgaagtttttgtccattgaagtttgaagctcagtttgagggttttttttatcccgataaatttttgttatcgtatctgcaccggctcgtttttgctccattttcggtttcaataacactcaattccgttttcgtatccggggtttccgattccgattctaattccgaaaaaaaaattgaaaacggaaacgataaaggtcgtttctgtccgtttccgtaccgttttcatccctacctgagtagtaccccaaggttttgagttgaaatctccatagaagcgaatttcagattggattgtttgtggggctaagttcccaatttaaatggccgcatatattcggtttgatgtagaggccaggtaagaaaataccattatctaaaaaaaaatcttgaacaaaaataatttgctgagtagaaaatgtcaatatgttggattctgtttttttccctgaaaagactattgacagtcaattctttcattggccccattgccactgtcacgtaaaactagcgacagaagttcataacctaagggagaatacatgcataggattggtagaccgattcagccaacaaaaatcaggctcatgaagctatagctagctagtttattatccttccctcctctattttaatatttttttcctaaactaattatttggtcgcaccgttgtattcgttgtaattaaatctttacaacaaaatatcatatgtttcatacgtgataaagacatgtttcagcatgtgtctaagtgtcttcattatgtttcgtaaaattcacgcaactaactacacctaccctgtctcctctccatctatccatgcatgtatgcatttagcaaccttcaaaacgatttttcttttaaactacttatctattcgatcacactgttgtattcgttgtaattaaatctctacaataagatatcacaagattatattttttatgaaacaaatatctttcaattctttaacactcaatgtttcatacacgataacgatatgtttcaacgtgtctccactgtgtttcacaaaaaaatattacttcatgtctagattcattaacatctatatgaatgtgagcaatgctagaaagacttacattatgaaacggagggagaaaatgtttcgactaaattatttgtctagccatgtataactcaatgtttcactagtggtcaactaaaatatttgaccatccgattttttaagaaacaatcaggcacccgatttggagtttcttcctaaataagctaggatatattgccacaactcaccaagcataattatgtgaagttcctagaatgtcaacaagctccttcataagagaggggaagctcctgctcagatgctcgaagctttcgctgccggtgacggcactcaggttcgccggcgacctgagaaaatcgaagcacgccttcttcagccccttgcagtggtgttgatcagccagcgcgaggatgtccatcaccgtgcctatgccaatgtacttgcacaatctttcctcgcagatcagcttcagcctctccaggttgtaccgatccgccgcgacgagcagatgctcgcacatggtgtcctccctctcctccatcgtctccggcaacgagtcggtgtacacgaagtggagcaacgccttgaacaccggcgccgccatgtcaccgatttggatggcatcgttggtggtggtgtcgctctccatcatcatgccaaagagctccgcgttgaagaccggtgaccgtgccgcgagcacgcaccggtgcgctgtgaacctctggccggcgacctcgaacactacgtcggtgcccttctcgttcttgaggaggtcgccgaggtggctatggaggttggacgggggcacggagacgaagccggcagcgccgctgctggcgtcctcggcacggtaattgtcgaccacgatgatgtcgcaccggatggtgaacgaatcgtccctgagatactccgatttctccaaatcttctctcctgatgaacttggggtaaccccaggaagaagacgaagaagtttgcttattgaacgctcgaacggtcttccatgccaaggacggcgcctgcttctcaacctggccggcgaagcaaatctggaactgagccttgacgttcctgacgacgatctcgtcgagcacgaggaacatggagatgtagtccgcggcctccaggacattgccgttggggtagtagcagatgcgccagcggtggccgccgacggcgaactggcaggagaagagggcctcgccggtgggcgtggccttggtgtgcgagtagccgtcgatcttgaggtagtggtaccctctggaggtattggcgacgatggcggacgcggacacggcggcggcggttgtcggagacaatgctccatggctcatcaccggcggcaaagtaggcccgtcgcttgttgctgctgctgctgctgatttgcaaagtttagcgtggggtggggaagattagctgcggaggaggaggaaccgaggaagccggaaggagaaggaaacgcgacgacgacgacatccatggttcttgatgccaatgcaggtacgcggtatataataacgtctttatccgctgctgtgtttttaaaatctcggaatttgcgttgtcgccttgtcgggctctgaatcatggtctcatgttatttttactgtgccctgatatgtttgcgatggaatatgagagaaatacgagttaagcttttgtatttacaagttttctatcccaatacctatacatctttcgaaagatttttatgatcgtatcacacagatttttaatctttggattaaaatctgatagatataataaaaagcaaaaagcaattaagaaacatcataatggacactaaattaccatatccttaataaaaagaccaaatccaatacaaaatttaaaatttacatgcgaagattcaaaaattacagtgtaacttacaaaagttaccgtgtaagtttcataaattacactgtaacttacaagaaaatgcactgtaaatttgagtgagaaaatcgagtgagagataaagaaaaaatctttcgagtgagatatagcaaaatcgatcccggtttatcttattgtaggtttaatggagagttggagactaatagagaggttggagggcaaaaactccccttttaagtccatgttttaattgagaccgatgaagaggccatatggactgcgggccgacggcccagcccatggcatggcgctttggcacggcccaggcacggcatggtctggcccgtgccagccgggcctgatagttggaccatgcttgggccgctgccttggcacggtgggttggcctggcacagcacgaaagtcaggagacgaataaacttactgtcagccacatgtaaagcgagaaatttgggattataccatcgcaaaagagtggtttcgctggaatcccatcgcttcaaactgattcactggaatgccagtttaggtgttcactaaaataccattttcttttcgttcttatctatgaatagaaatgtttttctcaattttattttcggagaagataaatcagttcaaagaaggtaaaaaccaagcaacgtgcagtctatgtggaggttcaactgacataactatctgttggctaatggctacagtaaagttattgctgatcaaatggcagagttgtagtctcgcagatatatacaatgaattaacaaaacagagagaaattttgatgactactgcataaagaatcttagaaacatgatatgtttgtcactgaactaagttactgtcacgtcctatgggccgggcttcaggcactgggctttggtccaggcaaacagggtgcatgcctttaaaagagaaggaacagcaacagatgaggcatcgatgaagaaatcaacagaactaaagccaaggcttcttcctcctccaatttcctctcatctctctgttcttccaatcctagtttctgttctcttattcccagtcccctgcttctcttcccaatctacattgctaattcctctcaattgtatccaaattacttgagtgattactgctatgaattatcggttgcttccggtgttgggcattgatcggtgggtgggttgaggatcgtgacagttaccgagcatggcaaccaactccgtcataagagaagggcagctcctactcagatgctcgaagccgtcgccggccatggcagctttcagattttctggagagctaaggaaatcaaagcacgcatttctcaggccatcacaatggtgctgctcagctagcgccaggacggtcgccaccgagctcacatcgatgcgctcgcatagcttctcctcgcacaccagcttgagcctctccatggcgtacctgtccgccgcgacgagcaggtgctggcacatggcgccttcgtctttctccttcatctccggcaacgagtcggtgtacgcgaagcggagcagcgccttgaacacctgcgcctccatgtcgacgacgcggacgacggccttcctgcggctctccttcattgagcctagcagctcggcgccgaacaccggcgaccgggccgcgagcacgcaccggtgagcggtgaaggtcttgccgccgaccttgaacaccacgtcggcgcccttctcgccgaggaggagctcaccgagatgccggtgaagatcggacggcggcacgctgacgaagcttccagttcccctcgcaggggttcttcttctcgccgccgtcgcggtcgccgcctcgggcatatccttcgcgacgaactcggtgatgacgacgacgtcgcaccggacggtgaaggaattgcccttgagatgcctcgatttctccaattcctccttcttgatgaactttggttgcccccaactggcatggctgaagaacttgttcgcatccagcgacggcggcggcggcggcggcggtaatttgtcacccaactcgtcgtcgagcagacgaaactggagctgcgcgtacacttccctggttacttcctcgtcgagatgaaggaagagggatatgtaatcgccgcagttgggcgtgttgccgttggggtagtattggatgcgccatcgatggccgccgatggtgaaagcgcgggacttgagggcagtgctggtggggaagagatcccgggtgcgcgagtagtcgtcgatcttgaggaggtggtacccgctggccgtgccggcgacgatggtggaggcggatcgcgacgacgacgacgacggcgtcggcccgccgccgctgccggcggtggtgccagagcgtgcgggagacatggcgcactgacccatgattgctagtgctactcgcgacaagggtttgtagctttttaaaaaaaaaatcaagaaatattagtaacaatgttcctttcttagattagattgatccgtgactatgcttcttcttttctttaattttcaccagaattatatgtgtctctgtttaccgtgtacaactgcaacattggtgatttttccgactcggccacgtgaattttccgactcggccacaaagtttcccttgtgtattactcccttcgtattttaatgtatgacgccgttgactttttaacaaatatttgacatttcgtcttattaaaaaaatttatgtaattatcatttattttattatgatttgatttatcatcaaatgttctttaagcatgacataagcatttttgtatttgcataaaaaaaattaaataagacgaatggtcaaacattggttaaaaagtcaacggcgttatacattaaagagataatccatgaaatgcaattgacaagcatccaaatcccagaaatgccatcgacaagtgtgagttctaagaaatgccatcgtacaaacaactttgtcccaaaaatgccatcgccggacaaaatcgtttgtacgatggcatttcttggaactcacgcttgtcgatggtatttctgggacttagatgcatgtcaatggcatttcttggattatctctacattaaaatacagaggaagatgtagttagtccagcatattcccaaccaaatcctgtgtctttcatctcgttcgtctcgagcaggcggttaaccttgcctgcctgcctgccatggctactgccgtcagccgcggcaccgcctcctccattgtggccgacgcggtgaccgggtaccacctcctcaagatcgacggctactcgcgaaccaagggcactcccaacggtgcagccctcacgtccgaccagttcgtcgtcggcggccaccgttggcgcatcagatactaccccaacggggacatcgccatgttcgccgattacatatcatttcacctcatgctagatgaaaatgccaccagcacgaagggtgtgaaggttaaagcccagtttcagatttgtttcgccgatcaggtacggagagagattctaatactcaggtggacgtccactcgagctgttaaaatagttttggtgacgagtaagaacttttggtgacgagtgctgtcatctagaccagtaagaacttttggtgacgagtgcttgacttggggtcatgtgaagttgatcaaaagggacgaatttgagaagtccgacgatctcagggacgattctttcaccattcggtgcgacatagccgtcgtcggcgagatccgcaccgagaggacgacggagatcgccaccgaaaccttcgtcaccgtgcctccgcgtctgacctgaaccagaagctcggcaaacttctggacaccgagaagggtgcggatgtggttttcggggtcggaggcgagacgttcgccgcgcaccggtgcgtgctcgctgcgcagtcgccggtgttcagcgcggagctctttggtccgatgaaggatagcgacagggcaggcgttgtccgcatcgacgacatggaggcgcaggtgttcaaggcgttgctccgcttcatgtacaccgactcattgccggagatggaggaggaggaagacaccatgtgccagcatctgctcgtcgcggcggatcggtacaacctggagaggctcaagctgatctgcgaggacagattgtgcaagcacgtcggcgttggcacggtggtgaacatcctcacgctggctggtcagcaccactgcgacgggctgaagaaggcgtgcttacattttctcggctcaccagcgaacctgagtgctgtcctcgccggcgacggcttcgagcagctgagcaggagctgcccctctcttgtgaatgagctggttgccatgctggcgcctccaatccctccatcgagtcatgcttaatgtgttcttggctattagcaacggagcagtggtaattagtggtttctgtttaggcttttgttctcaggcaattgtagtatatactgataataattatggagacaatgtccctggattatattggtaagagcttgcattgtggaacatgggtgttatttttgtaattcttttggtattcggtaaaaggtagacaaatatgttgccgtatattcagaatagtgtttgcaatttcagcccaaagaaaaagagcggactcggccccgtatcgtcctttagggcgacacgggcggcaaccctcacccgcgccaccacccccacccttccctccctccctccctcgctaccgcctaagcatgccaccagaaaactgcgtggctacaacaacggcagcagcgacagggcctccttctcctcgagttcgcagaggatccagctgcagtggctacaacggcggcggccgaccatatccagggggccatggcgcccgggtggtctcttaccaccgacagtccagctacgatggctgcacgggcacgaagtttcttcaacgcggctgcagctagggtagcttcggtggtggtggtgatggggggtgacggggacgacctcgatggcgagtttcagtgtcatacaatggctggcggtcgaatagcctcccctccattccctcccctcatgcttggccgcctccagtagggagcgcagcagggaatgcgtgtgggctagctaaatccaagggtttttggcgactgcaattctgcggtggcgatggcgtcagctaatggtagtgtgcagggaagcagttgagtttggtggtgacttgtccccctcttgttagccaggcatcattctctcctgggagcacctccccttcaatgtccggactaatctagatctggtcgtggggagctccaagggaagggtggaggcacaactgacacagcagggaacaacgatggcgtggaggcggcagcttcctattagcccgcttgtgatagcgggtggtggcttgggctttggtggaacgattttttggtttgtcggtgataattttacggattggttgtgtggggctagacggtgaatcgccggcaaaagccttgctaggccattggctagcttgacaacgacgaagtctttaggtgtcgttttccttcttggaggcgttgttcttcctccccctacatcgatctccaggtgaaattgttccgatttccagacaagtggtggtgatgtttcacgatgtgtcctccatgggggcaccactttggagaaccttactcatggtggtcattgtcggactgttgcatcggctttgaagctcttatgccctagcatgcttgacgatgcctttatcttctttgctctgcttctttactatgcggcggacggtcacctccctttgtttcactctgctaggtggagttggagctattgcattgggtgtgacgaagcttagaaacgatgacaccctgcaacctctttctaagtattggtgcccgtagtgtgtaggaggtggtgctttgggtgctttggctgatttccaatggaaaaggccggatctgcttgtctatttacacgcctattgtgaagtcgaagttgttgtgtcgctaggtggcaaacttggcaacgacgacactttcttgcaaagtcggagcagccctgtcgcttatacaacaagcttagcaacgatgcccgcattgggttccgtcgttattttagttgttagcaggctagtgtgggtgttgttggtggagtttcgtggtagtcatggttttcactcagttttccctaattaactgtgcattgtgaggttgggtctcgtttctccttaaaatgggacatcttcttttatataaaacgtctgcaacggctaaaccgttcgacaagaaaatttcaatcaaaaattaattttggcaattttggacgccctatgaggctatgccccctctcctgtgcaagacactatttcgcccaaaattttcaatttttttcaatattttgtgagtttagtcaaattttagtttgatttgttcaaattttttttaaaaaaaactctaaaatatgcaaaacgaaattgcagaccttgatccagaatagctgcctacctcgtgcctacctcgtgactcgtgaggtatctatactataccccactaagtgtaaagctcaacatgcatgtaaccatgccacatcgtcactgactagccataattacatatttacttccataaaagcatatccaatcatcacccctcacatatttgcacaatattttaacaaatctatctataatttttataatatttaacataaacttttcaatatgtttcccataaaagcgtggatttcatttgtttgtttcatgataagttgataaaccctgttggttcttttttttcttttttactcctaacttgattgtcgaaaaaaatatattgagaattgctgagtaattgtaacaccctgaaaattcccaacaataaaaaaaatcactaaaatttcaaactctttaaaacttttgcatcatgctggttgttatgattgctattgcttgccaaactgtaaataattacaaagaaagcaaatccaaacaaagggaaggttaattactaatttaatttatagatcaaatattaaatattcgaaccatgttgatagcttgatgtcatgattagctaaaagaaacagtaaaatcaaatctaattcatttgagtccaatctcacatgaaatataggaacacatgaaatgatgatcaccactataatgatcgtgtttataaataagtaattcacaggaatatatagattgatacttagaacatttcaccgagttcctcatgacatgaaaatcactcatataaaataatggtcatgtagataaattaagctttatatataaataagaatatgtgagtgtttaattagacaattagattaatgttgtaccgagtctcaatttatatttatagaattactagatccacgtaaaatatattattgtacaaataagttcattcaatgtactattgtaataataatggccacattaggatattttaattaattttggaaccctcaaagcctccaaaattatctaggttaattttggaattatacctcatttaaataatgcaatagaaaaatatatataaaaataaaatatgggtaatattagaaattgagtaaactttcatctaaattaacacatctattgggtaaacatcaattgtgtgaaatttagaatttatgggacaagatttgaatagcaaatcaaccaaataggaaaacccaggaaaatatataataataataagaattaaccctaattaaaaattcaaataaattatataaataaaatatgagtaatattaatctagaataaatccattggttggaatgacacaaacattgagtaaacttcatttatgcaagatttagaaattatagaatcaaatttatatgggaaataaactaaaatcgggataaataggaaaaagacactgttcattgcactctaggtgttcgacgaggctccctagccccttcccctcccctgccatgcgcgcctcgtgccccgagccgtcaccatcgccgcctgccgccgtgccgctgtcacctgccgcgccgcgcgccgctcggccgtcgccgtcacgcctcgcgcctcgtaccaccgcgcgccatcgccgttgctgccgctcgtgtcgccatcgtcgtcgcccgcgccgctgccgcgcgacagctcgcgccccgcgccgcgcgccatcgccgtcgccgtcgagcagtcgccgtcgccgccttgagccccgcgcgccatcgtcgtcgccgtcacgtcgtcgcctcgcgccccgcgcccctgccccgccgcgcgcccgtcccacctccctctgccgcctacgcgccctcgcgccccgtgcactgccgcgccacgtgccgtcccatcgcgccgctgctgcgtcgccgtcgttctcgccgcgccgagccccgcgccgacgtcgcgctgtcgccgtcaccgtcgcgtcgccgcgtgtcgccgtcgcgtcaccgatcatctcgagccccgcgccgttgccgtcagctgctgcgccgtcgccatcatcgcgccgagccccgcgctgcgcctgcgctcatgtcccgtcgccgctcgcct

SEQ ID NO: 45572 - DNA, 13686 bp, Oryza sativa
atggaaccctcacacgtcatagatgctcacgcccgcaccaatttggtcggaaaccctccgtatcgccctagcacctagctacccgtgcccggccatggcggccgtgcggcgccgctcgcccccgcgccgtcctacgccgtgaccgccggcaggtggacgccggagccttgccgctccctcccctggtcgccgtcgggtcgccctccgccggccttgccgcgcgcgctgcgccgcccctgctgctcccgcacggtctggaggtagaagacgataggaaaagaacgagagagagaaagagagcagccgagccactgacaagccgggccactccccatttttctctaacaaaaataattcggtagaaaagataataagacccctgaccccacccgtcagtgactctgagctgtagataggtttcggattaaaataaatcggatgtgaacagtactgtttcgcaattattcgaatttgaatccttacactagcataacttattcattttaactccgatttgaatgaaacttgatcctaaattcatctaaattcataagctttccaatggtatataattcattatttaagaaaatatattattaattactaaataattaatatcaagatgatgcatagtagtcaacttaaaaatgtgctaataaatatatttgataatgtacaatagagtagatgtaataatataggcctttaacatgctttgtcactgtagcaaccacacaaactaattttaaataatgtctcaaactaatgtattggaagatactagcactatttaatggttgtattattaaacccatgacttatagattatttaaataataaagttagccttataattaggtaaatcaaacatgaatacacatagatgagtctttaatttatttatgaggaataggaacagagttggtatgatagaaccacccaaataaggttgagtcggttaacatccaataattacccaaacagtaaaatcacttgtcaacccacttagatcacatatactgtacaatccatttaaaatcatacataggaacaataacccatcttttgacaaacatgtatattagataaatactagttatatattttgacctcatataattatagttcaactgtaaattaggattgttcattaagggataatatgtaaccacaatatgattaacctaaacaactctaacatagaaagcatggataattattaaccttttataatttattgcgacaagtgaaatatgttcataattaaagtaaagcctccatcaattaaataataatacaaatgattcattatttgattgatcctaaatccatccgacaacagaacctctagtatacgaccattttatttagatagatgcatgtgtagccataatccttccatagccattagctagactacaccacatattagccagatacgtatctcatttatactacattggctagctcctgaataggccacgttgacaatagaaagattaagaaaccttagcccctagcgagattggaatccattagcagacatgaatagtatattttgttgtgcatatttggttgttatttgaatattggtttttcttgcgtattatagaatttatgtatcggttagtcgtgaggcaacgtcagcaacttccaggaggtgaaggttgatcaagaattatatcaagaataaggactagactgagcaaggcaagtcatcactattcctcgaacatgctgatcctaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgtttttgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccaagaggcgtgccctacatcggtgtcgccattggtaggactgccatgagtgtgtgagagagagaacttaacttgaaccataatttaatatgtttgtgagacttctctttcccgggagcgccagaactcctctcactgctaaaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattgcacttggctagactccaaattcttaacttgtgggggatgggatattgcatgatgaattttatgctgatggagccacatcccgagaggagggaaggtggacatcctcagaaaaccatgacgattcaatggcgggaagctatccttgggatcacaatggatggtggacagaactgtcgttgtttaaagtgaacactggtactaaaatttgatcagtctatgctaggttttaggcttgtgaaaagaattgtaaaaattagctttatgcaaaagaacctgaaaccattccttgaataccctctatcatatgcattgttgttgtggttgctgagtacggttggtactcacccttgttacttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgtcttccgctattgttctctgatagttgttggcctacctggccctaatgtaagtgtttaactcttttagcctaaattcattcgtgatatgttgtgatccaactatgtatgtgtgtaccaactactgatccagggattggtacggataaacacagaagatttccgattttcaaaatcgggggtctacagtaatttctgcagcaaagcgcagggaatagagctttgtgtccaactgctatcatagtaatcgtttgattgtattattgtaggattataaattatttacgcaaatatgttggcagtatatctatgagaatacacaaaagccagcgctaactaatatagctatattatgagtaacaataaagtcattattcctgatttatttttgacaaaaacaagtcattattctcgattaattgggatagttgtagatatgccatgaaaagaaaacagagaatttcttaatacttctactgaaacaggaatctatttatctatctattatattattaagacaacttgaaaggaggcaccacattcactgttgaggctagaaattctcacgttaatcgaaggaaaacaaaaaatattaaccattagattgtgtttgatctagatttaaacggttaagatttaatagtacttgaaaagttttggaaacttgtaataagtttgacatataagaaacggacacacgtattagaaacggacaagtacgttagtccattatttacaaaggtagactcacttttccatgtcagattatgtttagacatggctacagcacaacagcatgacactgatacaattcgtaaagataaaagttgacagtaggagtaaaaaacagtcaatttgtattcgttgcacattatgtcaccctaatttctatggactatggtgatttaaatattctcatataaataccaggcatcaataaaattgtcaacacaatatataactattaagaaacaatacaatcagcaaccgacaaaataaaatcctaatgatgattaaaaggaaggacgatgggcgggtcgtaaagcaatcggtcaaggcggttggtggaacttctagaaagtaaaaaataaaccctaattacaattatatatgatttttaaaatttcaatgacaatataaatgagaggcagtgggcaggtcgtataggagtacaatgacagagctgccgatggttggtgggacttcttgaaagtaaaataagaatttcaacgatagttatgtttaactttttgaatttcatgataataaagagtaagcggcgaacgggtcatagaggagtatattggcagcgtttgacgagatttctaaaaattataaaaaatgaaacccaacgagacaataaactcaaaaaactataaggtccaatttttaaaggttcaggcttctaaaacgtaaaaaataaataaaccctaatgataatcatgtttgattttaaaatctcaatgataataaagaagggatacaacgggttagccgtagaggggtacagtgacaaagtcgctgacgttttggcagaacttctagaaagtaaacaatgaacctaaataataattatgtttgatttttaaaataccaatggtaataaagagaagaggcagtgggcgaccatagatgagtataatggcagcatttgacgggacttctagaaactataaaaacgaaacccaacaggataataaactctaaatactataagattcaatttttaaagattctaaggagaatgaatagaaacagtgagaaggatatgacagaagtaaggggtaataactggtgtgacttttaaaaactataaaattagaagcacggggatgataaggtttggtctttcaaagttttaagataacgagataactatttaataaattttaagtaaaatcatattaaaaatatataattttatatgggtgctagccgcgcaattgtgcgggccacccagctagttatctgatgatgacacaaatgctcagaaatccattgacaagaatactgatgtcactgaattaagttgccgagcgtgccaatcaactcattcacaagggaagggcagttcctgctcaaatgctccaatccctcaccggccgtgacagctttcagattctcctgagagctgagaaaatcaaagcatgctttctttaggccatcacaattgtgttgctcggccaactccagtatagtcgtcaccgtgcccacaccgatgtagctgcatagcctctcctcgcacattagcttgagcctctccatgttgtacctgtccgccgcgacgagtagatgctggcacatggcatactcgtcctccttcttcgtctccggcaacgagtcggtgtacacgaagaagagcaaggccctaaacacttgtgcctccatgtcgtcgatgcggatgaccaccgtggtgtcgctctccttcattgatccaaacagctccgcgctgaagaccggtgaccgggccgcgagcacgcaccggtgagcggtaaaagtctcgccaccggcctcgaacaccacgtcggcgcccttctcggcgcagaggaggtcctgaagatgccggtgcagatcggacggcggcacggtgacgagcctcgccacctttggctttggagaggtcctcaccaccaatggcgtctcctccgagcggatccgcttggtgacgacgacatcgcatctgacggtgaaggagtcgttcttcagatacttcgatttctccaactcttcccttttgataaacctcagtcgtcccaacccaatgttgttgccaccaaaggtactgacctgcccgaggtcagcgatggaggaaggctgcagttcatcatcgtcatcattatcaccggcaaactcgtcgaataaacggaacccgtgctgcgcgtacacgttcttgtcggtgacaatctcgtcgagatgaagaaacagggagatgtactcgccgcactcctccgtgttgccgttggggtagtaatggatgcgccattggtggccgccaatggtgaacgcgcgggacttgagggcactgccggtggggaagatgtccctggtacgcgagtagtcgttgatcttgaagaggtggtacccgctggccgtgtcggcgacaatggcggaggcggaggacgtcggcggcggcgcgatcggcggcttaccgccggcggcgccggcggtggtagagcgcgtgtgagacatggcgcattgacccatggacggcaaggtgggctcgtcgtctattgcttgctttgctgcttgacgctatagctgctggattcgcgtatatggttaagcgctggagataagaaaggaactaatgttgcaaattaaggtggaaggagacgcaacgagagagacgagacgacggattcacgacagcaaaagtttttcgatatccactgtccagtgtgtccacgcatcgtatcacaactctcaggtttcccccttttgtttatttaaaaaactcctctcagctttccgggttttttctttttttttgttaaacaactcctctcacgttgatcggtaactctagttccttttcatactacaaaagagctttctatgatttgtgaatgcggttttaccactatacgtaaacaatgtgggaatgttgattttcaaaggcagttcagctgtaaaagtccaatttttacatgccgtccacctaaggaaccgttagggaaaaatcaatttttatgtgcggtccggcctaaagccgtccgtctgcacaaattacttttgagggatgggtggcttattctggaaatgattttagcaagaaaatagttccatcgcaattaccaattgctaaaaaatataattcaacaactttaattcaattcaaacacacaacagtttggatcccgttacacaaattcaattcaataatttggatctagttcaacaatttttggttcatacgtatataaaatcagatcgcaaactcacatatacaatcgtggtggaaaaaagggaagatctatgcacccaagcccaccgtcgtcacggcatcaactgctactggagctctcgaggcctgctgccaccggatccatcgctcgcagtgcccgtggccaccagatctgacctcctaggcctcgctacatcccaaccttgcctttcttgatgtctcttcttcactgctattcaacccgtcaacaaagttggatctgcctgacggttgaacaggtggaagaaccccgccatgcgaccctggtccattcgccgctgttcgtcctcatccgcacccatcaccatcgtctctctccccacctgcttctcgcctccttcgtctcctctcctctcccgctagcccacgactttgacatcgatggctgcgttgcgcacgaccatgtggggaggaggagcgacactgaatcagctatcagcagctcaacgtcgaacatggcaacgacctcctcgatggtgtcgaaggtgccgagccacaaccacttctggctaagttcacggatctatgccgagaacctgcctcacagacgccgccacacgccgcattttccgtttcaggatgtataaattatttaataaattattaatagaatttatattaaaagttcattaatttacaagtgaagttaaataggggaaataatatttcctaaataaaaaacttggctggacttaatttttattgaattctccatgattaattatactatctggaattttctcggattttttagagcttaattattaattttaataatacaaaagaagagttcagcaattatttcatcaataaattaatcattaaatgatctggttttaattttgttaaatactttgagtgtccaattattttcaggatttttcttgaaattatttgagtattggaagtatttttaacaattgaaaaattatttcattttggttaatttaattggaacagttaattaaatatccttttccttttttggctgaaactggaaaagtctatatgtaatcctcagccatccgtcctctgcgccgtctgctctatttccgggacgattttgctatatatttgtcgacaaattttttctcaaaaatttaacagatgtaattgcagtacaatcgtagtgtaattacactgtaacttgtatgtaattacactgtaactatagtgtaacttgtatgtaactttcaaaaatctctttgtaacatattattttggtaaaatggaggtcgtgggaacaaattcttttacatatgtgtgtgctatgatttgttttcttcctcaccaaaacaaatcgtgtaatagatcaacgattcaaaattatgtgaaacttacatataagttacactgtagttacatacaagttacagtgtaattacatataagttatagtgtaattacactatgattgtactataattacatttgtcaaatttttggggaaaaatttgtcgtcaaatgtataggtagtccctttccgggaagtctatttcttattcctccacttctttgcttttcagccagacaaaagtctgttttgcctccctgtcgctacagtaccttcttcaacctcccgccgcctctctctcccgtgcgtgtgctgtgcagccgccgatctccttccaaaatccggtctcctcgttgctcctctttccaaattagttgcgggaatggaatcctctcaatctcctcttccttttccccaataaatccccaaaagtttctatggaaatcctttctaatttcgcggatcaatctttccttttcccgggcgaggatcctaaactttcccggagtttttcccgtcgatttgggcccggacccgagctcgcgtgcctatataaaggacccgctagtcgtcctctgcctatcccctcaagtcccgtccttcgccgagccctagccgcccctgcccgcgagctccctctctctccacctccggccgccgctccagccgccgtgcgccgtcgcctcggccgtcgccggtcagcgccgacacctccctcggctacacaaagtcgagctctaccccggcctctggttgttttgcgccaaatcccaccggaggttgcccgtcgacgtgaagtggagcaccgccgtcgccgccgtgcctccagccgcgccgttcgtcgtcgtccgtcgtctccactggattcgcagctgcgaggagaacaccgtccaccacctcttcttcgccaaagatcgccggaacaccgtcgccatcgttgaccagtaccacgtcgcccttcggagctcatcgctggccatctccttcgcggtccgtcgtcgcgtaagtgttggtaagaatagccgtcgccttctctacctcatggtgctctccatttgcatcatcatgctgtggttcgccagcaaccgctgttctcgtgctcttcgattaagatcaatctaagccattcaatcttggtcactttatgtcaagagtagtctaagccgtccaaaatcgatataaatccgttttttcttttcagtggcatattatttcttcttaataaatgtcatgtgccagcatctactcgtcgcggcagatcggtacaatctgcagaggctcaagctgatctgcgaggaaaggttgtgcagatacattgctgtaggcacggtggggaacatcctggcactggccgatcagcaccactgtgccggtctgaagaaggcatgctttcattttctcggttcacaggcaaatctcagtgcagtcatcgctgccgatggcttcgagcatctgagcaggagctgccccactcttatgaaagaactggttgctgtgctgtcacttccactgaatcatgcttagtgacatagtgttcatgtgttctaacaatggtagcatttagtttctgaatctgaacctttgtcatcaggtatttctgttctcttttagcacgtgggcatgcagcttaactccttcagataggcttttcttaccaacttatgatgtacatatcaaattatgactacatctatcctaagcagaagctaaatcaaaatcgattgtcacttgttacctggttttaaacttccatttggcatgcttgatttggatgactggaagggataatgaaggagtagccaatttcatctctgttttgattttaatttatgttatctatatgattattttgatattagatacctattctcagtttttatattagagacctgttctcaggtactgcttttgtctgataatttcaataagttctcctggtcaggatgggactagattcatggtaggtccataaaaaattgtcatgctgatttaccttctaaatgttagatacctgttatcggttgtatctgtttgatgatttaaataagctctcctggtcaggttgggaccagattcatggttcagtcttgtacaggtacatataaatgagtcatgctaatttcctttttaactgtatctgggaaaccaaacttccttaaaaaataatggttttgtcatggtttctacccaagagtagtgtatcgactagagataatttgaaaaaataggctagcagaatcccggcacttgtgtcttctgtggttctgaagacagagtatggatcattcattctccaggtgccctgtatatgttggaagatatcccctccatcctaaaaaaaatccaatcctatctacaaatttggacatatatgtttctagattcgtagctaagatttggtttttttctgggacagagtagtagcttgcaatgctttcgatttttgctcactttctaaagtgtggtaaacttgtcaggatcctctttctccaaaacaacataaaaaaacctaagttatcgttggctttacaccaatttgctttggtcaatcggaacaaagaaacggttattttttttcgtcctaactttttttagggagattaatctgatcatcaggttgtatctcccctctgcacgtaatatttttgtcatgctaactactacctccgtcccaaaataagtgcagccatgagtttccgcgcccaactttaatcgttcgttttatttgaaatttttttataattagcatttttgttgttacaagatgataaaacataaatagtactttcctcgtgacttatgtttttaatttttttcaaaaaattttcaaataagacaaatggtcatagttggacgctgaaaactatggctgcacttattttgagacggaggtagtattttgtaaccgtcacttcattaattgtcttatgctgtctatttctccctctggtcattaacatatgacgtgcagacatcgatatattgttgtccagacatgtatgggagaagcttcttccaatctgagatttaaggggttcttgattttggaaaagcctacacagaaccaaacattggttttcagggggatggggacttggaatttgggagcttgaacacatataatattcttgtggtctgataaccggttgggctcttgctctcttaaaatccagtaccctgccatttatctgatctgcaatcagcaaagcatcctgtttgctgatgccctttctctgtagcctgatagcctttcttttaggagatcatttcttttagctgggtaacattatttctagggcttccctttctagtgagggaaaaataattctttggtccctgacaaaaataattgcgacaccacaaaacccaatattgtgctctctgcttccgtggggctgaggatggtagacagcttgacatttggctggctagtagacacaggatcctgtcctgccttttgcctgatttgcaatgacctggaaagtgacttatcttattatctttgatgtcctattgatgttttcttgggtttgttaagagatgcaatgggggtgggctcagattcccagctactttgaaaagtttgatgttgacttctactcttaaaaatcctaagatttttaaaacaaaaactgctttttactccactaacaattgcttttcgtgttgtcttttattttaagcagagtagcatgttgaaacctggagaagaaactgtgatgaatgaagtggtcaacaagatatttcgggcaatgcagcaacttcagagaggtcagtgttgttttgtcacgtcagcttgccggacgtgggaaatttaactataaaccactcttgtgacatggcaattaacgatttgccacgctctgtcaatgacacgtgggccctcatgtgtctatgacatgtgggcctagtggcaaatcgttaaggaccattcgtaagagtggcaaatagttaaaagccccgccggacgtagctgaaagattcagattttgaaaataagttttggagggtttatttttaaaattaaattttaaaaagattaaaaaaatcatgtttatcagctttttgcggtggtactgataactagctgatggacactagcgacattgttttataatatccaaataaaatgaagagagaaacagtcgcaaaaatacgatattgcccttgcatgccaagtccagctcgcatacagctccgacaccaccaccacacccgccgccgcacccattgtcaccgtcaccaatgaggtggctcttccggggggtttgagggtggcccacgccgccacgcgcctgggctcgtggctccgtgtcattcccgcactcgtcgctgctacagctcgaggaccgcgccgatgctccaccatacgccacgcttgcaagcgagcacaacgtcgaccacctcttggttcatgtcaagcagggtgtcaaagagcgcaggcggtcatagtcggtctggccatggcgccgctgtcgccagcgaggtggctctctggggattcaagggggcccgcttgcctaggcccgtggctgccccattacataggcccgtggctccatatcgtttcagcacttgtcgttgctacagcatgagggccacgctggcgccggaaatgtcgtcgcctccatgtcgtcggagctatatgcgagccgcacatgacatgcaagggtaaaatcgtactttcacggctatttctctctatttccaacagctaattaccagttttttgctgtgggacagatacatggtcttgcactgtctcctaactaattactttgctttttcgatgtcctgtaggaaattttgccatggtaaaagtccataatctgatagaaaagtgcccgcatatcttaactaataaaaaaattgctatccttcctatcgtcaacaatttttcgtccgtatgtgcgttttttttcactttccacctttttttagcgctgctttttttaatcatccaatcggacagaaacacagatcgagaaccctagaaaaaaggggcaaaagagaggaaaaaatcacacaaatgggcaagcttagagtcgccagatacggttgttccgagctcattgccatcgtcgtccactgcgctcgtgtcgtgcccgaaccagccgggcacgaccacacttgccacctccccaaccgcgctggcacccctttcctctaccacgacgccccatcctctggcgctctcctcttgctttaaggcagaggagaagaaagaaggacggccgtcgccactgtctccgtgcctagccctgtcatcgaggttgatggggagac

SEQ ID NO: 45573 - DNA, 12932 bp, Oryza sativa
gggagggggagcggcatcgtcgatgggtgagggggaaggggagcggtgccgccggtggggagaggcgctaccagtgaggtagggagagaaggagcgacggagggggataggtgccgccgacgccatcattttcagagagagagaaggggaggggaaataattttataagatcataaggcggtttggatggtggttttgcctaacgtggcgcctacgtggcgttgatgtggcacaaaaattcaaaaaaaacccaggagtatccgattaaaaataaaaaaatacaatgggaacaggggcggggttaggtttttcaacttgggtattcgaaattgtaggagagaaaattttccaacccaagatctaatagttgtataatatgcaacggtataagcatgatttcataaagtcataaatggatagaattgaccataaattgaatgcgttaaacatattagagtacattactaaactattaattgaaaaaacatatcaaatttatagaccatacaaaatggcaaaatgataagaactcttacaatatagagaagaactttccgtttcttgatattttgaaaatgattgatgatgtcttcattcttaacttgcaagaagaaatatctttcaatgaatataaccaagcaatcattcaaatattcttgccccatcttgcttcttaacttgtttttgatatagttcattgaagagaaaaccctctcaacactagcagttgcaacagggagaactaacacaaatttcagaagtttgtaaacaaggtcatagcgagaaaccttgtttgttttcacaagcatcatagacaggtctgccaaactcatcaaatttgtgaaattctcatccttactcacatcactaatatagcggttcagttgaaaggtgagttggttcatttcttcaacatcaaaatcattaggatagaacttggcaagcttaactaagttgtcaacattaaaatcagagaaggatttagctgggctaaatgatgacatgcatctaagtaactctgggtttacctcatcaaatttgttattgagctcttgaagttgcctatcaatgacacccaaaaacatatcggcatggaatcgatggtaattaatagcattttgaagaacttcttcgacctttgtataggcttataattcccatccttgtcaacaactttaactttgtgcttcacacaaaaagaagtgaccctcttaagaaagtcttgccatccagaatcttctctcaaaacattaagttctacctttgtgaatctttttacaagacatcccaaggacattcaacaaatatgcaagttgcccaaagaaccatgcacaatcagtattctccttagcaataactacaagggttagttgaagttgatgagcaaaacaatgtacatagtaagctcagggggactcatccataattagtttcttcaaaccattaatatgacccttcatgttactagcaccatcatatccttgtccacgtacctggattttccggatggcacttaataagcaaggacttaattgcctccttaagagtcaatgatgtagtatcttcaacatggacaagaccaagaaaccattcaactagttgccccgtcttattgacaaaccgcaagcaaagagccaattgttcttgttggtaggcatcactaggctcatcagcaagaattgcataacactcatcatgaagttcctctatgacaagtttagttgtttcatgagcacaagaactaatgagttgtttctgaatcttgtggcctatcatctgacaactagttggagcatttcctagaaccaccttattaacttcttcaaagttcccagctatccattgcacaagttccctaaaatttcctttgttgttagaatcctgactcatcatgaccacaaaaagccaacccctgccgcaaaagatagcttatgcacttgagtgaccatgtcaagtgagctaaatattgagcctaaacctctgcggagtttgatgcgaaggactcacgaattgatgtcttaggttgtatgaacaaattgtatttttcttcagcttcacaatatgcactattgacagcaccagcatgtttactaaatctaattttcatgttctaatttctatgccttcattagcaaaagcatctccaccatgattgctagtgctatctttgaacaaataacaaacaaagcactatgcagcatctctgtgcacactatactcaagccacttaaactcagaaaaccactttggcaggaagcgacgcatacctccacactcatgctgcggaaaatcctccttcttcatctttggttgacaagggcccaatgcaatatactcccttctaactgaatcttggtcattgacatcatattgtgatataggaatcctcaatccaggatcatgctttatgtcatatgcaccaccattattgtcttcatcacttgatgactcatcatttggccctcctccaatatcatcggtctctacatcaggcggtactgtgcttggactgctttccccactagcactctcattctcaggctaaccttgatatatcactacttgcacctgactctcaatacacgaaggttgacttggaccaatggaagaaggttgacttggaccagttggttcttgcttttttgttttgcagcagcattttctaaaaattaacaatgggacccttttttctcttcatgtttcaaacctacaaacaacaatatcaaagagcaattgagcaaagcagcactggttcagtggttcctaaatcctaatctagttagtcattcacaaacaatgaagctaaaataatcaacacacttcagttcaccgactcggcgactcaccgttgcaaccgcttgctatcttgctgactattgccgaggtctcgaggacgggaggcggcgaggcgcgcaggcggccgccgggcgcggggcgccgccgcgctggctaggcgcgaggcgcggaggcagcgagccggcgagggggctgtggcctgtgggcgaccggcggggcgacgccgcgaccggcgactgcgaggcgcgcatgcacaggcggctgggcaacgagttaggcgacggcgaggcgcgcgcatgcaggcggctgagctagcacggcgacggcgcgtgtgtaagcctggagggctggcgacagctggcgtgcaggcatgggcgtggcacctgggatgggaaggaaggtgaggagaagagatagggttagagaggtagtgggcttttctttgctattgggccaatgggcctgaaatagtgggtggtgggagggttcagtttgggcttcttttgagttttgaatgggtataagcatttttccttttttcctatatatacatatggaatatatacttcatatatgcatttttttttcaaaaatcttgggtattcatttgaatacccatgaattgaagtgggcccgcccctgaatgggaacgcgtcatcactcatcaccccctccctttttcttcttctctcccttcctcgtctctctcccatgggggtcgcataaaaggtaggcaatctcgaatagtctaatcccaaaccgaagaaccataaaaaaatcatctgtaagtccgaccgagcgacgacctgcgtccccgcacgcgtgatgtgttcgtcacatacgccgcccaaagggaaaaaaaattagagatcaaatcaaaatcctaatcacgtacagcggacaaatcccaaaatcaaatatcgattaaaaacccaattgtggcaaataacatccagagtcatcaaataacacaaaaaaaaaccaaaccaaaattaagaagtttaatgtatagtgatccagacattttttttctggttggtataaaaaaaggtatatatataggacatttagatggatgtagagaatttattccaagtgagaccgctcattagagcaagtttaatagtgtagccaactatgggctgcaaatcattcataatctattatatactaaaagtccattaaacttcttacaaatgctcctaaactgccacgtggcgctcctacaaacgctcctaaaccgacacgtggcaatttcaatctaaccgtcggttttcacttaaatttatgggtccgttattttaaaccattagattagatctatttaaaaggtcccgcttcagattattatcagatatatacaagatatttttacgagaaaaattggcatgtatttcgatcagatataaaccctgttcgcttaaggaaaacaaatcaacatatgtacgtacagctgtagagcgaaaacaaaaatactacaccgtatgttgatagaacctataatagacagtctctaaaaataagattttctatacatggcactttctaatctaaccgtcgattttaacttaatttggtagctccgttattttaaacattagattagatctatttaaaaggttctgcttcacctcattgtcaagtatataccagatattttttttagagaaaaattgacctatttcgatcggatataaaccctgttcgcttaaagaaaaataaatcaaaattcgtacgtacagctatagagcccaaaaaaaaaatacaccctgcatggatacaaccattaaataatagatggtctctataaaaatattttttatactataaaataaaacttattacttcacaaatatatacggttaaactagattaatataatatatcaaatcaatcgtctttaaatatccatttttaaaattatttttgaaatatatatctaacttataatctgttgtattcctttaattaaataaactattgatcacatataatagttatattatagtgctaaatacatggggccgacatataatatttcacgtcataattatttttaaataacttagccaatatataataattaatgtcattataatcttttttaaatagtttcacatgatagaaaggatcaacatggtctcaaatatagcttgacaaataacactaattcaaatccacatgcagggagagtggaacaacattgtggtttttcaattagatttgatttaattttagtcaatgtgagattaagattctcattttttttataactttttagaataatttgattggaatttccaaactatgatcttgccataatacaaccccttaatccatcacgggaattatggtcatatatatcttttctttgccaaatagatatggtaacaaatcaacaatcctattcattcaacttttatcatatattttcttatagtagatgatctataccatacaccctaccaaagtgactataagtgcactctaacgaatcaattacttcaaataattttggaaaaaataaatactcattctttggcattagcaaagatgtctgtcgcgatcatatatctgttgtagtctataactttttagtgatcagcctcgctcatttcaaaagcagaacattgtatctatatcataaaaaattaagcagtactgattaacaccgtaaacgattgtgtctacacaaaattaaaagaaacaatttttcattggaaaaatactttcatcacgtaccttctctctttttattccttgaaggtcaccaagcatgctatgcaaaataaacccatttctatacttttatatgctcatatttttttaacaaatactacgaatatattgaaaaaaaaaacaagtagaagcggatagatctttttttaagtagaagccgatagatcttaataaatcaataaagctcttaactgagacatattaaacttataaagcacaaacaaaagataatggtaatattgtttcaccaaatttacttaatgcgatggacctattattttataccatcttaagaactcaaaaccatttatctatgttaaaaaacaaactcccttcacccaacccaaccatatggatcctctccactgctattatatgtgcatgtactctctccgattcaacttcttcctcttcctttctctaactaacaacttgtaaacataaaaacaatcaataacgagaaagctgaaaaatcataattattaatcctttagtttgtttgaactattgatttatttataatcaaataaataatttaagatccatattaatcatattttttactttataaaaaattaaaatatatcatttgaacatagacccctgtcctttgtatgccaaccaaataataacaacattaatgaaacaacataaataaataaaatgacagcatgcatcccgtgcatcataggaactagaaaacatagattctttatctttcgtatacttaggattattattgttgtaatttactttttggtttggatagttttcgcaactattatatctatttacacaaatcactctaaatcctttgcagcgctcttaactcaccacgtgtcaagtactaaaaattagaacaaaaaaaattccaagggaaaaaaacatttgacaatgggttttcacttaagtcagtggattcattattttcaaccattaggtcttcctttagaaaaaatcttaagccgctatgtgtcacgtcttcaaaattagaaaaatcttagaaactataagaaaaaagcaaaacatatgatcattggttttagttaaattatttagaaaaataaagtccccaatgcatcgcccttcccagaacatgcattcacacaacactgaacgcccccttcccccttggctcacactctccactctccactactccccccttctaattttaagctatcaaactaaaacacaaactattaataataattgcaaagatcgtattcttaagctataaatctaatttttaatttaattgttgctcttttaaataatcaaaccaaaaatacatgatccataatgtctgtatttttaacctaaaatgtctgtattcataagtagaaaaatgtcaatagggattgaattaaatcaattggacaaaatataaaaaatttgtaaaacaaatagttattacttttcaaaaactggataaccattgtacaatgttcgattgccataaccatctttaagtgcttagatgttaatggccttccatccatcctacaccatggcattacgagtttctcaatgtattattgcatatacaagacacattaaggtagcagtgcgtagaagtacgtagttgtggttaaaaagttatgcattgctactattaactttaaatttaggactcatattggctagatattttttttagaaaacgctatagatcacatatataatagggaagcgaggtatacaatatgtatatctcctatgtatttattgacacgttctttccagaaaatgaagaattattgacaattgcttgtagtaatgaattaaatattatatagttcaaatcttacaaaaatattgtaaaaattatctaagcaatgtagatggagaaaatttatgaagaaattaaacttttcaagcgtgacaggtgtcatccggtagatattccaccttacaagttagtcaagcgtatcctattttacgtgcccgcgcgaatgcgcgggctaccttcctagttaatttaatagccaattcatacaattgcctattatctggtcccacatgtcatgcacacatgtatattggagtccgtgctgaagctagctacaaatctatagtccgcagctcttctcttcctctttttatctccttaaaatatgtttgtagctgatttataccctgtacttgcttttagagcaagtttaatagtattccaattcatttatagccaatctaatagccaattcataccatagttgcttactatactactaatatatggtctcacctgtcatacacacattgcgttttggagtccgcgctgcagctggctacagatctgtagcccgctgtttttctctctcattttttatctcataaaaatatgattatagctagctaatagtgcgtcccacgcaaaagcacacgcacaaacaaaaaaaaaaagaaagcacacgcataaacaaactacacacacaaaaaaaaaaaaaaaagcacacgccgttatattctccaccaactaaacgccgtggtcgtcgtcgcttcgtattccatttttccgctttcctctctcccccgaatccccaattcgccctaaaccctgctagaacagcggcgagcagtgtcctgccatggccaccgccgcctgcggcgagagcccttcgcggttgggctccgcctccgccatcgtcgccgacacggagaccaggtaccacctcctcaagatcggctgctactcgcgcaccaaggcgacgacccccaccggctccttcctcagttccggccagttcaccgtcggcggccaccgctggcgcatcaattactaccccaatggggaaagcgccgactccgcggattacatatcgctttacctcttgctagacgacaaggccaccaatagcagtgtgaaggtgcaggcacagttcaagttccagattagttccaccgaccaggtgaagaacacaccttcattggcatccacgaatgtaaatacatatggtgaggattctagctggtcttggggtcacagaaagttcatcaaacgggaagatttcgagaagtccaatgatctcagggacgactccttcaccatccggtgcgacgtagcggttatcggagagatccgaactgagaagacgaccgagatcccatcagccacaacattcgtcactgtacccccgtctgacctgaaccagcagctcgtcgacctgctggagaccgagaagggcgccgacgtggtgtttgaggtcagcggtgagacgttcgcggcgcacagatgcttgctagcagcccggtcgccggtattcagcgcggagctctacggcttgatgaaggagggcgacaccgccggagtcgtgcgtatcgaagacatggaggcgcaggtgttcaagctgttgctccgcttcatgtacaccgactcgttaccaaagatggaggaggaagacgtcatgtggcaacatctgcttgtcgcggcagatcggcatgatctacagaggctcaagctgatctgcgaggacaggttgtgcaactacattggcgtcagcacggtgttgaacatcctggtgcttgctgatcagcatcactgcgacgggctgaagaaggcgtgttttagttttcttggctcactggagaacctgagtgctgttgtcaccggcgatggcttggagcatctgagcaggagctacccctctcttatgaaagaactatttgttgtgatggcacttccaccgaatcatggttaatattcttgtgctctagcaatgatagttgttggtttctcaatctgaagttctgaacctttctcatcaggtagatatgttatcttcttttagcacgcaggcatggtgctgtactccctgtgtatatatgcttttgttatcaggtatactatgaaaaccaaaacttcaatgttttactgcttttgatcaagaatagtgacttgactggagttaatttgaagaaaacaggctggcagggcccgtcacttgtgtctgaatatgatgtatcatattcttcaggtgccctgttagctgctgcagtttatgtttgttggactactagctatgcttttaagttcagttggctacctttaagtgtgccaattttgtcaggatcctggctagcttcttttctgaaacatgataaactggttattgttatcaacttgtcatgcattcatgctaactagttctgagggagcttaagctgagcattattttttttctccctgctgtatgagggttcagaaacttttggatgcttattaattatgtaaccgtcacctatcttatgttggctatgaatacacgatgctaagggttatccctcccctgtttccttacaaaagttctttactattgttcatgttaattcaagaaatatttttgctagtcgtcagataaatttttgatagctcattgcatttcaacaagtcctgaaattcttgttgcatatactccatatgcatcaaaacttgaaatttacgcaaagttagtactcctaactgctgttgttgcccctggaagctaaatctggcaacatataaacaatggacaatatcagtgtgcattgttcagcgaacatgtgacttagatcatgaatagtggaagtttctcactatcctcagcctacaacctgttcttcctggcgcgcacgcattctttgtgtggcgagctgatctggcagacgagggcgccttctctagtgaagtttttcatgtggtcggcgacaaagggaagatgtatcacggcggataatttgcagaagcgtggttggcctcaccattctagttgctccttgtgccaggggatccaggaaaattgccaccaatcgagcgtgtgactgtggagaatgctcaaggggtggatcactgccccgtttcagcttccggcagagagtggtgctcagcttgtggactggtggctgatggcaaggttggtcttttgagcgagctacaggaattaaagctctcgtttcactcttcgtgatggtttattggatgatttggaaggagcgtaatgcccggatcttcgagcagagatcgcgcacagcaggtcagctatttagtggcatcagagagatcatgatctggaaggaggctggaatttttcggcaatgtgattagctgctaatttttctttctctttcttccttttggggcggcaccgcggcagccatttgtgttgttgcctgaatcggcagcctaatttagaacttgtaaggttcctaccaaactctgttaaccatttaatctttaagtgtccccctgctcttttcctttggtgctgtgtgagggatgcgttaggctggaaagtagctccttgttcttgtgaggaggtgcaaaatttgattctagacaatgttgtcacgataggaagtaatcttactgtgattgcagctggaatgtgggcgatttggaaagttaggaatgactgggtgtttaggaatgttttgatgaataatgtgatacatttgccttagaagatgctttcgtttttaaaatagtggagtcctttggtacccgagaaacgaaggatctgctggaggaaatcaggggcttgctcgatgccaaaatccggcaatccacgtagaagcagatggatgatggcgatgaagaggatgaagactggaggctttgcactgaacctggattgactatagtgcctggaatgtttaggcttttcggtcttttgtgtgttgaacttgggcttttctgtttcaagctggtgttcccagcatctgtatcgagcctattaagcttttgagtaaagccgggctcccagagccttttctctaaaaaatttagaacttgtaaactttgtaactatctattattcttaataaaatttggtcggccgacctggcaaaatcatgaatcaagtcaaactgcactctgataacagcagcatttgattcttcagtagatgacatattgacaagtaccctgttcttttctccaacaagagttggataaagattatgattttcgtggcacacttttcacactgctaaacggtgtgtttcgtgcgaaaactttatatatgaaagttgctctaaaatatcatattaatctatttttcaagtttgtaataattaaaactcaatcaatcatatgttaataccacctcgttttgcgtaaaaaacttaatctgcatctttatcttcaggagaaaagaacaccaaaagaagtgtgtgtgtatatatatatagagagaggctctattatacacccttctcttagaataactattctacacccccctcccaccttccatccgtccccacctccctcccgcgctccctctccctctccctctcgcgcctccccccaatctctccttttcttcttttttttcttctctccctccttctatcttttttagaaaaaataaatttgcgtaaaaaacttaatctgcatctttatcttcaggagaaaagaacaccaaaagaagtgtgtgtgtatatatatagagagagagagaggctctattatacactcttctcttagaataactattctacacccccctcccaccttccatccgggcccacctccctcccgcgctcgctctccctctcgcgcctccccccaatctctccttttcttctttttttcttctctccctccttctatcttttttagaaaaaataggaataaattggtggattcaagacttgatcccatgatctcatggtttatggtgagcacttctaaccaaatcaccatatgatgatttgtgaacaaatcagttatgtacctataacaatcataccttgttactatgattcggctgtaacattatcccagaagggtagtaacattatatgttactgcaaaaatgtataggttgttactgcactttttacagtaacaatatgatgaaatttgcagtaacagagaacatgcatagtaacagtggccctatagtagtaatgttttttagatctagagtattttaaatctcaatctttagagagtactaacgtacatgtgtcatgtcttatttttctaacccatttgcatcatggcgttcgtaaaaaaaagtgcttaatgaaactagaaccataataactattttttaacgttgttactgtgaaaagcagacgtgttactgcatattagccgtcgtgttaatacgctgttccagtgagacgaggactaaaaaataggtaaatctcaatctttagagagcaatatctctcacattatatcttgtatttccaaatcgtttgcaccatgaagatcataaaaaaacgcttaacgaaactagatccatcatggctactttttgacgttgttactgcgataatgttgtcctgttactgcacgatgaccgtcctgttactgcacgattcctacaagacaagagcagcaaagtggtaggtgggggaaggagtggtgggcgggtttgaccggcgggaggacgctttgaccgagg

SEQ ID NO: 45574 - DNA, 16971 bp, Oryza sativa
tattaacgtatgattgattgagttttaattattacaaacttaaaaaatagattaatatgatattttagagcaactttcatatagaaagttttctcacgaaatgcaccgtttagcagtttgaaaaacgtgccacaaaaatctttatcttcatccaactcttaaaagaaatgaacggaacgatagtcaatgtccctttgacaggattgttttgcttcctttatacagtttccccttgtttgatggagaccaggcagtaatcaagaacggccgatcagtttgagtcctgaatcttcacatattcctaaccacgcaagtcaaccaagattagtactaattcgttataaaataagtaatatggtttaacaagcaaaattgggattcttatgggactccaaagatcagtactaatcctattctagtaattattaatgcagtaattttgttaagtacatcccttcgtctctttgctccgtgctgtccgccctaaacctatacacaagagcatcgacaagctcgccatcaaaacattgtcctgcctgccatgtcctgttccgccattgtggccgacggggtgaccgggtaccacctcctcaagatcgacggctactcgttaaccaagggcacccccactggcacggccatcaaatccaacccgttcactgtcggcggctaccgctggtgcatcactactatcccaatggggagttcgtcggctccgctgattacatatcgttctttctctctctagacgaacggactaacccaattttgaaggtgcaagccaagttccagattagtttcgctgacaaagtgaattaattacaagcaacaacataacataatgtccacgacagtaaggacttttggtagtgactagtgagtatacgacttggggttttcccaagttcatcaaaaccgaggatttcgagaagtccgactacctcaggcacgactcgttcaccgtccggtgtgacatggtcgttgtccgcaagatccgtgccgagaaggggaagactgacccacctcgccgagaccttcgtgtccgtgcccccgtccgacatgaaccggcagctcggcgacctgctggagaccgagaagggcgccgacgtggtgttcgaggtcgccggcgagaggttcgccgcgcaccggtgcgtgctcgcggcgcggtcgccggtcttcggcgcggagctgtacggcctgatgaaggagggcgacgccgccgtggtcgtgtgcatcgaggacatggaggcgcgggtgttcaagctgctgctccgcttcatgtacaccgactcgttgccggagatgaagaataaggacgcaggcgtcatgtgccagcatctgctcgtcgcggcggatcggtacaacctggagaggctgaagctgatatgcgaggagaagctgtgcaagcacattagcatgggcacggtgtcgaacatgttggtgctcgctgatcagcaccactgcgccgggctgaagaaaacgtgctgcaattttctcggctcatcggcgaacctgagtcctatcagcaggggctgcctctctgttatgaaagagcttgtgttaggatgctggtgcatccactgaattagtgtgttctagcatttggtttaacctttctctcatcacgtagttctcttctcctgttttatcatgaagacttgcagttgtacacactgtttgaaaataaaaaaagaaaaataggagaaaaaaatatgacagaaaagaaaaataggagagaaaaaaaaaaccgagagaagcaaaaattactttcgagggtttagttatggaagccctacccaacggaattttccacgttcgccgagagaatgacaccatcatcctgggctatatttcaggaaagatccggtctagttctatacgaatactgatgggggatagggtcaaaattgaagtaggtcgttatgattcaagctcttttgtgctaggtatatccgtatatgatgttcgtaattccataaaatttatatgagttactccctccgtcccatgaaaggatttcgactttttacttacactatttgaccattcattttatttaaaaaatttgtgcaaatataaaaaataaaaagttgtgcttaaagtaatttggaaataaagtaagtaaaaaaataaaaaaaatttcaaatttttttaataagacgaatgatcaaacagtgtaaacaaaaaatcaaaatctcttatattagggacggaaccggctcctgtgacatagagaattctacgtcagagggatgttggacttccgatcgccgtcgcttgcgcatccaatggctcctgtccgcgtgtgatgatagccttctcgttcggcccataagcccattcgtcgccatcagattgctctagcatcgtctgccggagccgcgatagcgtgacggtgagcttgggcacacagctgagcaactggacgcagccctcccatgcgctgtccttgatgggctccgtcttggccaacaggtcccctgacgacgcggacgatgagcacctgcggttcggcagcgccgagagaagcgccaggtgtaagtgtcgcccgatgaacacgatgatgtgttagagtttgtgtcgaatatgtgtacgtagtcggttacagtttagaacttggagttgtaataggtattaggattagagtatgagtcggactctatcctaggatctctcataaatagaggggcgtgcctgttgtaaccgcatggtgacttagcatagcgagagggagcggctgccggcgtctaccggccgtgagtcgttgtaattctgatacgctgtatatggtggatcggggaggagcgcccgtaatcagtgccccggagatgtaggctacggctgaactccgttaccaaatatcgtgtctcggtgtcgtcatcgttttggatctcctatggcgttttcttccgcgtttagctaccgatgttgatttcggggctggttttgtaacaagtggtttcagagtctgcaggaggtccatggtagaggcgcgatagaggtgctccacacctcgtagcctgctgtaatgcccagggaggggcattggcgcaaggtggagcacgccggcgatcaacggagtcttgattggtggatcgaacacttctggcggcggccggaaccgtcgatggctgctttcaacagggagatgactagacgtggtgctcgggatgatggcggcggaagcgattggcaaatcaatcggtgggtcggacacttcgggcgggtggctcggactttccggtgagctactctcgacagggagacatgcggccacacgctcgggttgattgaagctggaggcgatcggcgttcttgatcagtggattcgaacactctgggcggggtggcccgggcctttcgatgagttgcgttcgacagggagacgtctagacgtagcgctcgggtcgttcagcggctgggaagacagcatgcgacttgtcggcttcggctcgcgactagattgatggcgatcaatcggaagtcggagcaggtggatcctataggctgttttggaggtgttgacgaggtatttgcacgatggaattgcttcaaaggcggcgtattttgtggcatatggctgaacaaagcctagggcgaatagaccggcatccagtagcggttcaaccctggagaggcattggttcaacctgtttttccctctagcagacaagaagaaaaccacacgggctgtagatcaatgacaacagttgttggtggagtcatcggtggtgcttggcattggtgctagatgttgtcagagatatgaagaagcccaggaggttagggtcacggcggtgtgcgcgtcctgcgtcaaagccgagccggcgacagagatcagggcgatgccgaggagctggctagggtttagctaggtcgtgcagggttcggtcttaagggtttgtggtgtggaagacacggacatggaatcgtctccggttcgggcatggcacggacacaattgaagacaaacagtggataccaagtttcaacacgaaggggaatcggacgaggacttcgattcgttcaggaatcagactcaatttttcccagataaaagtagcagaggaccatgggattgcaacaacgcaatcgaaacaaatcacctagcagagggcgagagtcgtacccgattttcgcagaggcggaggtggtttgggcggcgaggtcacgggcagctggagacacgtcattgcaggtggcgcgcggcggcgtggtactcggcggcattcgtcggagctcgggcaggagcttgcggcagcggctgcggtggttcccggcgaggaaccggcgcaggtcttcggtggaggcggctcccaggcgggttcccaaggccggcgacccctcggctcctcgtggggtcggcacaggcgcgcgacggcggagggaggcgacggttcccgaggcgggcagacgatgctgagattccttgcgggggccggcggcggcgtgaggagcagggcgcaaagtggcggcgcatcagaaagaagcgccgcaggcacggtttctaggaggagcgaggaggccgaatgaggaggaaaggagatcggtttctatctgattccctttgaccgctgttgactggcttattgactagaaaagaaaaccgaccggttttttggaggaaaaaaaagggttggttttgtccggctggtgactgtgcaagtttagtcggtgggtcaattaatcagagcagatcaatttaacagggcaacagctgttgagttgattatcgtcgatggcggcaacagcggtttccaaatttgaggtggtgaagttcgatggcaccgggaatttcgttctctggcagatgaggctgaaggatctgttggctcaacaggggatatccaaggcacttcaggagacgatgccggaaaagattgatgctgacaagtggaatgagatgaaggcacaggcagctgcaacaatacgcttgagtctctcggattctgtcatgtaccaggtcatggatgaaaaatcgccgaaggaaatttgggacaagttggcaagcctacatatgtccaagtcgctgacgagtaagttgtatctcaaacagcagctgtatggtttgcaggtgcaagaggagtcagatcttaggaagcacgtggacgtcttcaatcagttggttgtggatctaagtaagttagatgtgaaactggatgatgaagacaaggccataattcttctgtgctcgcttccactgtcgtatgaacatgtggtgactaccctgacgcacggcaaggatactgtcaaaactgaggagataatttcgtcgttacttgcacgagacttgagaagatcaaagaaaaacgaggcaacgaaagcttctcagggtaagagtttgctggtcaaggataagcatgatcatgaagcgggggtgtcgaagagcaaggagaagggggcacggtgctataagtgtcatgagtttggacatataaggaggaattgcccgttactgaagaagaggaaaggtggcattgcaagtttagcagctcgtggtgatgattcagatagcggtagtcatgagattctcacagtgtctgacgagatgtctggagaagcgtggatgttggactcagctagttcctatcatgtgacatcgaagcgggagtggttctcttcatacaaatctggtgattttggtgttgtttacttaggcgatggcacgagttatcgtgttgttggagtgggcgatgtcaatttcaagatgtatgatggaaacgaggtgctactttcagatgtgagacacgtgccgggattaaggaagagtttgtttcgcttgggagcctacatgagacaggttggttgtatcaggtggattctgataggaagaccatgaatatcatgaaggacggcaagactgttatgactggtgagaggacaagctcatgtttgtacaagttacaagggagtgctgttacaggtggagtcatggaagatgggtatgttggtgttgctgtgcatgatcctgaaggcggcgagcctggcgtaggctcgtcgggtggctcggcgtgagctgcggcagaaccaactcaagtcctggtacatggaggttcgagcaagtaacagattcaagttggcatggcatattcgccaaggtggagtttgttagagtttgtgtcgaatatgtggacgtagtcggttacagttaggacttggacttgtaataggtattagtactagagtatgagtcggactctatcctagaatctctcataaatataggggcgtgcctgttgtaactgcatggcgacttagcatagcgagagggagcggctgccggcgtctaccggccatgagtcattgtaactctgatacgctgtatatgttggatcggggaggagcccccataatcagtgccccggagatgtaggctacggctgaactccgttaccaaatatcgtgtctcggtgtcgtcatcgttttggatctcctatggcgttttcttccgcgtttagctaccgatgtcgatttcggggctggttttataacatgatgtacctgctgccggacaagcacaggatgtgcggcgcactcgaggtgtctgtgctcgcgcacttcgccgcacgagaccgcgtcaatgccctcctctgcctgggaaaccagattcggagagatcgccgtcctttgacagccccaatcgatgacttggctcacaaactctagattgtctggaggaagaagatgaacagtgcactcacaaggtgtttgacagagggagttttggtgctgtgtaagtgtcactggctcactgaagctttttattttctcatccttttatttgcagaatacaaaaactcaccatgcatcgtggcctcctggatgcgcgccctcacctcgctgccattgccgcgaatgtgttccatcccacacaagcgaagcggagcgcacgacgcggacgcgccgcgacatgaactaagcacgtccgaaggaatgcgatgccaatagaaattgaaacctgatgcaatctactctaggatgctgctaaaaacaaggacacacacatgaccactgtcggctacggcgacttcgtcccgccagcgacgctgccaagctgctcgcctgcaccttcgtcttcctaggcgaacggagcttaattctcgtcggccgtcgctaggctatggctcgagcgacggctccggcggctggtgcttccctttggcgtgagctcccggctgcgattctgcgaatgggcaccgtacggaaaggctatacatcgggcacgcgcggaccggagccgttggatgcgcaagcgacggctatcgggagtcgaacgtccctctgacgtacaattctctacgtcagaggagccggttcctcagagggagtatgacttatgagcatatatccttaggaggagtcgtgaggaggtcaaaatatttcagattcatataagttttttgattcttcaatagatgacacattgactacttcctccatttcatacgagtcggtttgaatttttttttcttaggactaaatttatagaaaaatttagcaacatctagaaaagaaaattagttatttgttttgtgttgaaaatactactacatttttatataacttagttaaactttactagaaaaaaattaaacgacttataatgtaaaacggaggggtatttttccgtaaacttagtctacattaaaaagtttgattagataaaagtttaattaggaaaaagtttaaaacaatttataatatgaagtgaataaagaaacagttctttattcttcaatagagacgtattgatagttaatgtcattacttattgagctattgacttattgagcttccatgtggaacatgcccccggtagaatccaagcgaaccataagtggcgccgtctagaaaaaccgggcgaccagcgccgggccatcgcccgcacgggaaaatgcattatcccgtgcgggcgtcttaatccgaccgcacagcataatggggaatattatcccgtgcggctccgtaacatgactgcacagaaaaatcgattttcacgtgcaagcatattaagtggaccgcacgcgaaaatacctctccctctcactcactaccaaattttcacacattctctcccttcctatccttttttattttcactcctctctctctcactttcctcctctctatcccttttttgatctctttctcttctcctctcctctcctctccgcgggaagcggccggctcggcggcaccaacaacgaggcagcggccgagaacgggcgggaggcgacacagcggcgggcgacgaggcagcgaccgggtgggcacggcggcgagcggcttggtggacggcggtggtgaacaactcgggcgcggcggcgaggagcgacggcaaccggccctcgcccggatccgcaggcggcggccgtcccctgcctggatctggccgctgtggtagtcccctcctcggatccgtgtgatcgggcggcgggcaggttcgacggcggcagcggcggcatgaagaccgcaacgacgacgggcaggcgtgacgaccgcgtcgatgacgggcgggctcgacgacaagtggcggcaaccgggagcggcggcggtggccgggtggggagccggcgcgacgacggcgacgacgacgggagcggcggtggccgggtgcagtggtcggcgattctagggttagggttagggtttttctacttttatttttttgtgttttttttttgcgtgcgggcggtataacttgaccgcggtccacttaacacgaccgcacgggataatcgattatcccgtgcggttgggccgcccgcatacgaaaatattgattttcgcaaacccctgaatgcagacgggcgctacctcccgtacggaaaaaatgcagacgggcgctacctcccgtacggaaaaatcgattttgaccgcagaaaaaaatgaattctgtactagtgttcttcccgtacagtttccctttgttcgctggagactggccagtaaccaagaatgggcgccggccagtttcggagtcctgcatcttcacaaatcccacacaaccaagccgccgtccgttgtaaactaatacggtttaaccatcaatgttgggaattcgtttgggactccaggtgaacattgacaagaaggttagtgtactgatcctaatctaattcttaataatatactactaatttcgatcgtcccttaattttcttctcatcgtcctctgcggctctgcccttcccctacttctcctaatacgccagcaattagtgcccctgcctgccatgtcctcttccgccgccggcaactcgtcgcggtcggcctccacctccaccatcgtggctgacacggagaccgggtaccacctcctcaagatcgacggctactcgcgcaccaagggcacccccaatggcacggccatcgcatccagccagttcatcgtcggcggccaccgctggcgcatctactactatcccaacggggaccacaccgacaatgcagattacatgtcgttttacctcttgctcgacgaaaagaaaaacaccaagaccaagagcgtgaaggtgtggacgctgtttcagatttgtttcgcagaccaggcaaaggcgctgcctacactaacatccaaaacagtgagaacttttggtgatggttcttcttggtcttggggctattcgaagttcatcaaaagggaagatttcgagaagtccaaggatctccgagacgactctttcacaatccggtgcgacattgccatcgtccgcgagttccttgttgagacgaccgaggtgctcccgcccaaatcgttcgtatccgtgcccccacccgacatgaacctgcagctcggcgagctgctggagaccgagaagggcgccgacgtggtgttcgaggtcgccggcgagaggttcgccgcgcaccggtgcgtgctcgcggcgcggtcgccggtcttcggcgcggagctctacggcctgatgaaggagggcaacgccgccgtggtcgtgcgcgtcgaggacatggaagcgcgggtgttcaagctgctgctccgcttcgtgtacaccgactcgttgccggagatgaagaagaaggacgaaggcatcatgtgccagcatctgctcgtcgcggcggatcggtacaacctggagaggctgaagctgatctgcgaggagaagctgtgcaagcacattagcacgggcacggtgtcgaacatgctgttgctggctgatcagcaccactgctccgggctgcagaaagcgtgctgcaattttctcggctcatcggcgaacctgagtcctgtcagcaggggctggctctttgttatgaaacagcttgtgttaggatgctggtgcctccactgagttatgcttaattagtactatgttctagcatgtggtttagagacctttgtcatcacatagttctcttctatatattttagcaatgcatggagacttgctgttgtacaccctgtctcggtgtcttggcttgtactatcactatcaggcagagctgcagaggtatatgaccttagtaattccatgaaatttacgagtcatgaacatcatcctaaggaggtaaaagtaattccagtttgaccgtgtgttgttactaccactgtaactttacatgaaaaaattacttcttgatttggatttggatgactggttgagttatgtaagcacctgtgctatattctcactactggaaagatgcttttcccagaaggccaaattgaatttttgggttctttcttataaaaaattgaatttttgtaggcacgtggagcaatcgcctgagcataggtgtatgtgaaaatctgagattttcctagatggacaaaacaactgcatgtgaaaaaggattttcataggcaggcatgttatgctgcccgactgcaaaagttttttggtgaaacaaataaaaattctaaaaagaatattccaacaactctaactctaatatacagtgaataattgtctccatggttgtccccgcaaatggacgccgctgaccatactggcattatctccgattccctcgacactggatctgtcgtctccgacctccccagtacctaatccacacctcctgatcagtccctaccgcgacctctggcggcggattcgcggtatccgaggccaccgccgtcaacgagaagggaaagaggagctgatgcggcatcatcggtgctgagcagtcgagaggaacgagaaggagagccgaggaggggactgcgtccttttaatttaactagtaaaagtatccgtgcgttgtaacgggaagcgtacagatcagaaaaatatgcaattaattaaaatacaaattcgctgaaatatttggaatttttaagtaggtatttgtataattaaataaatttacaagtaaagcaagtgtgagaaataaaataacatggttaaatttaattttattaaattctccatgattagtaacgctctttggaatttttttgtaattttcacagcttaattgctaattttaataatacaaacatcatttaacaattatttaattggaaaaagaaagaaaatctccttttaggtttgcttcgaaataaatacattacattcaataactataattataaatgcttctgaaaaaatgaagtactaaaaatgaactttttctctttttcttcggcccgagggacctaaaatagacttctttccggcccttgccggtcggcccatggccttttgcgcatgggcgggcgcactttccctccccaggccgcaacctgggcttaggccggaaaagtggcatcgctctcgatccctcttgggccgagaggagcttcgttttttaaaaggagggtcaaataattaattgcccctaaaaataaagatgtgacggcgaaattggttttttaagtgtttatctccttgttttgagttaatttatgttatctccatgataactttgttgttagataccttttctcatgtgtttttgcttgatgattcagcgtttcagataagtggaacaacattcaaggttcagtcctcgactccttttgtgctggtccataaaaatgagtcttgttatcatccgttttaaatctatctgaaagccaaatttattttaagatttaaagtgttcttaatgtctcttgatcaagaataattaatgtctggactagagataatttgaggaaaatgcatcttttggtggttctaaagatgtgaagagtatatgaatagtttgttcttcagcgtcacgttgaagtttgtacctactatttccaaacttgtcaggatgttggttagctagtttcttttccgaaacataaaaaactggttacttgttgtctgtgcaacagttttctgggtcaaacagaacatacaaaacaagttatttgttcccggagaaaactagttattgtttgtcatgctcatgctaactagtttagggagctcaaattggagcatcagctcagatttataggcttacagcaaacccatgattaagtcatgtgtcatgaaaccaatgattaagtgatgaatcaaatcaataggcagtctttaattcttcggtcgaggttcatatatatactgagaatggaaaatatccctaacaactgtgagcatgaattgtggaacatggggtgcagggtgctatattttttcctcttcttcctttttttttttgaaacaaggcaattttgctcctgaaaattgaattgagttgctaattcaaccgcatcgtcgatattgtagagctttttgtccagctgctgcaagctgcataacattgagggcgaccacaacgtgggaatagagggggtcttaagcctcctcactagtctatatacatcgtgggagtgatctttatagaggtcttttggttgagctacccatatggctaatgcctggccataaggaataaaaaaataattttcatctctctcctagcacactcttggtagttgagatggtagaaggtgggacccatcttaacaccccctcctagccatatacattgtgagaggggtgctatatctcaatgggacccacctggggcccacttgagcattatacattgctcatgccctgatcaacgccagcggtcattggtgacgctggccggccgtccttgtatagatgaacagggttttacatttcgggaagcaagataatttcagcggccatcaaaattccgaaatttcggatactttgaacggttttttttaaaaaaaattaacatatttttactgaatttgaacaaattatgaccaaattcataaatatttgaaaaaaaatctagaaaattcgctcgaaatatttgcttgccggtggggaggggggaggggggatttcggcaatttccaaaatttccatccctgtagatgattggaattggattaccgatccacattccagggctcccatcagttgccattttacctaaaatggcttatttggcttattagaaaattaaaattaatttataagtaaaacttttgtagatttgttcgtagcgacttaaaagccaaaattaacaaaaattacgttaaaagcatttcaaaatcaacttcaaaattaagttcaaaaattcaaattttggcttattctttggctgtttaggccaaacgatggggctgcaggtcatgtacgctgggctataaacccaattcgactactattaatttcggatttttctttacatgttctttttcatcgatcttttgagaaaacaagggaagaccggaagagtacgtgaaaacactttccccggtctaaaccctacaggaccagctagcgtgctgccatgtcccccgccgtaggccgtggcaacccgccgtcgcggtcagcctcctcctccaccatcgtggccgagacggcgaccgggtatcacctcctcaagatcaacggctactccctcaccaaggccaccacccccaccggctcgtttctcccttcgagcccgttcaccgtcggcggccaccgctggaacatcaaatactaccccaatggagatgacgtcaagaccgccgattacatatctttctttctcgtactagaagaagaagagaccaacatgggtttgacggtgcaggccaagttcaagtttagtttcgctaaccaggtgaagaagcaaccttcgctgaaatacaggcccataaagacatttaatctcgaggattcttgtggttggggctatgtggagttcatcaaaagggtagatctcgagaagtccgatgatcttagggacgattctttcaccatccggtgcgacattgtcgtcgtccgtgagatccgcaccgaggagacgaccgagatactccccgtcgaatcctttgtacccgtgcccccgtccgacatggaccagcagttcggcgacctgctggagaccgagaagggcgcggatgtggtgtttgaggtcggcggccagacgttcgccgcgcaccggtgcgtgctcgcggcgcggtcgccggtgttcagggcggcgctctacggctcgatgaaggagggcgacactgatggagtcgtgcacattgaagacatggaggcgcaggtgttcaagctgttgctccgcttcgtgtacaccgactcgttgccggagatggagacggaggaagacgtcgtatgccagcatctgctcgtcacggcggatcgatacgacctgcacaggctcaagctgatgtgcgagaacaggttatgcaagtacattggtgtaagcacggtgtcgaacatcctggcactagctgatcagcaccactgcgacgggctgaagaaggcgtgcttcagttttcttggctcaccggcgaacctgagtgctgtcgtcgccagcgacggcttcaagcatctgagcaggagctgcccctctcttatggaagaactggtcgttatgcttgcacttccgcctagtcatgcttagtgttcgtgtgctctttttttagataactagttatcgtgcacgtgtaaggcacgttttgacattatatacacagaagtagaataataaatgctacttttttatgcaacactccatataaattcttcacgtaaaaattgagtttcatagaccatatggagctttggaatttctgttaataaagacggatggtgcattgcatcttatattgtcactctaggaatgctcccgaggacaaaaagataactacacagaaatatttcactaatataaaaacagaaacaactttgaagtatctttgtctgagagtcactatgctcactacttatgtgagattgctagcatctctaactggaaaaaaagtgatctgctagcatctcatttttctcatttgtagaattgcattgcagagtaatactatagcctattatcagatagatctaatggttaaaaataatggctctaccagattaaatgaaaatcaatggctagatgtttgttttatagaattcctagtgccacatggcgacctagtagtgtttgtagaagtgtcacatggtaacttatgagcatttgtaggaagtttaatagatttttaatatataatagatagatatactcactccatcccaagagttagccatatttcatattttagtttttctaaataatttgttcctatttgtagtttctatgcaagaaaactgaaatagagaggtaaattaaatctttgattagaacccaaggagcaatattaatattcagtagctgcatacgtgtatacgctccttaatttttgttatatgcatgattaattaagttcttcttggtcatggtgataaaagtaataggtgtaactttagtggatggagggagtctatgtaactaaatatacaattacattgacatcatgtaatccttgctttatataattaactttcaccacattggatatagaaaacaatttggttatacagctctaatgtccttacacgttcatgtttattcagttgatacagtgacacattgcacgtgcattaccccttgacatgcatatacttaattaaaatagcacaatagagtattcatttgaaaaacattcaataaatgggagtgatataatcttccaacttcaaattagaactgtacattaccatagctgcatttaacaaataccgattgtagtgacacaaattaaattcaaaaccaaatatcagtacagccgaaaattgataatcatgcccaaaccatgtgtaagaacaaaccagatttcatgtcattctcgatgatattgttttccaaaatctcagtgcccttaccttagtcaaatcatttttaaaattgaaaaagattgaagcagtggtaaccaaataagaattggaacaattattcataaatacacagatatgtagaaataaattaaaaaacaggagcctggttgacttcttgagaattggataaatgaatgctcacaagaagaatgtagttgtgcaatacaatcataaagaaggtcacatgcaagaaacaatatgctaaaagtacatgtggaaaaccatcaagattgaaatcaatgactgaataggtatcgatcggtgaaaaacgactgaaaacacttaataacagtaccagtagcacttttcgcccacaaattcttcttcagttcgatttgtcgtcaactcagtcctaacaagcaaacaacaaaccaataagataaccgaggagcctaggaagaaaacaagattagattcattcaacttctgaggcaattgcaaggattaaatagaaagcatatgaattaggtacgggaagggaaaaggactgcatttgcctccattgccgaatcaaatcttcattgtcatatgtcattactgcacctgtgctagcattgcgaacaattgagagttaaactcatgattaattcttgaaaatatgcctcatggtaagttttataggggagtttatagcgctgaaccgatgacaattaaggattctcaattcacacaccatcatctcctagtagttgtaaacaaaatcacaattgttaggcaatcatccaggtcttgaagagcctcatcaatagtctctgttcaaccaaaagatagtttgctgaataatgctagagagtatgta

SEQ ID NO: 45575 - DNA, 8764 bp, Oryza sativa
catagatacaagaccaaaaaaaaaaaatcagagaatgtggattctattcaagaaacagagttcagaaaggaccaagaagccagtccgtgaacggatcacaaccgatgcagacaaccacattcacaacaggcatgagatccctggggccgaagaggtagttcatgccgtgatgccagaactcgcgcacacggaggggaatcggagcaggcagcatgcgactcaccctcttcctcctctcctctccacgcgcttattcatcttctctgtctccggtgagcgagtttgagagaaggggccgggcttctccggtgaacttcgacgggttagggaaggggaaccaccacggcgcctgcaggggcacacgatgcggtggcgtgcggcggggactcacgaggaggcgcgcagcgattgaggtggtccggcggtggaggcgcggtagcggcggcgctggtccaacgatggactgcgacgggcattcacacggctgagaggaggagggaggaggagcgaggagggggtggctggtccggcagtggactgcagcggcattggggaatcaggcggagcgaggcggcggggattcctcgctcggctgaggaggagggggcggctggtctggcggcagcggggaatagggtggagcgagtgaggcggcggggattcgcgtggatgagatgagaggagggaggatgcgtggagcggagagggggcggagattggtgcggcggactcatcgtgcgctcgggggcggaatcatctcgtttcggaggtcgaatcgctggtattggcacaacgattgagaatagattagattagatcagatggtgaatggacggatagattagatgagatgatggacggacggatgagatgggataggatgatttcaccagtaggattgtaagggggcaactcctcctttttatattagtatagattagtgttcgtgtactctagcaatggtaattgttggtttctgaaactttacccagaaaagcaggagcggatctagaaaagattaacaggagggtctgaacaaactatacaaaattataacccctcttctaatagatgtatgacaaaaaaaaaatagtgaggtcttcatgggatctcccatggttacaatatggttagtggggtttagagaccccatggtggatccgtcactacccaaaaagcaggtgatgctgcagtactccttgtgtgtagatttcggtttagctaaaatcatttttttttcagcaacttgatcctctgatctgcaaatcgtgcaggagcagcgttaagctggctagctaattaaagctagctaggtagacagttatttatatattcatacgaatttatacacatcatacttacacaccacttacgtagtaaaacccacttgcacgtcacttacatatgtaattagtatgtaattttaggatttacatatgtaattttaggacttacatatgtaatatttagagttacattgtaaatacaatgaaattgtatatgtaatttaagaacttacaatataaatatataccgattattttttagtgaaaaaaaaatatagcgccataaatatagctactctctccaactgattttgctataaggtacatgacattggccatccacaatgtagtataaaaccagtccataagcaataaaatattctattcaaccacctaacaacattgtggaactagtacatagcaagaaaatagcaaaagccacccataagcatatgggctgcccatagaggataaaatatgttatttatctctatttcctctctcctcctaatactagttgctatccatatacattgtgaagataacaatagttatagtctatatgtgtgggtcccatctatatggactacttttgctatatacattgttgttgccctatactgagcaggagttagcgattgttactgcttaatttgtctttttttttatgctatctctgcaactgcacttttagatttcgaaggattgtcacttcttacctggtgttaaacttccacgtggcatgtttgatttagaggatttggcatagtcacaaagttcccagatcaatgggttcaaggattaggatcgaggaacgtggtacgctacttgcaaagaggtttttataatgtgaggacaaaaatgtccccatgtggaagtaaatgagttcgactgagggatgagagtgtgagagagtgaaagtgtgccagtggtcactccggccgcagcggccactccggcgccggcggccacttcccctgtctcgctcgagccaacatgtcgcatttgaggaggttgtcgtggagtgatcaggttgtcgccaggcagccgacatccgaggaagaggacgtggatgcgggtgggcgttggacggaggttcggcgcaaggtcagaccgcattcatggtggtcgagcaacgccccaaccaccaacgcttggggcgcattcacggcgccaaggacggtgccccgctggctccaaggatgttgcttcaagtgcttgggcctaaggggtgatgctaattggcgcgtacgcgcacttgctcccacgcgactcgctcttcccgcatgggacgcactttccgagcctgctgctaatgtctgtgttagtgctaatttttagcggtttgcacaaattgatttttttaataaaatgataaataaaatagttgggttgaaaattttaaaatacgaattgaatgttttgaaagtttagttgaaattttttgaatttgagttgaaagttttcaaatcatgacttgaaagttttcgaatttgagttgaaagtttccaaatttcaattgaaagtttccaaattcgagttgaaaattttcaaatcttgactgagttttcaaatttaaattgaaagcttcaaatttgagttgaaaatttttaaatcttgacttgaaagttttgaaattagagttgaaagtattaaattttcagtagaaatttcattctaatttcatttttttcatacactgtgtatataaatgatgtgaacttaatcacgtgaaagatagagaagagatgctaactgcacctgctagaaaagttaatcatcgtgggtcgggtgatgctaattgacgcgtacacatgctagtatcccgtcaaacacgttgctacacttgcgaaaattttttgaaaaaatactattcatcgatctttctttcataaatataccggatgtggtttgattagcataaatataccatcgaaatcgcgtttagaaagcgcgataccgaggttcgctacgggaaagcgcgatatcgccacggtatcgcattaccaatgcgcgagagcgtgacggtctcgcgcatcgaatgggcgaggagatttaagctggcggtgtcgctggttggttatgcgatatcgacgcggtatcgcatttccacggagcgagagcgccacgttgtaccgatttgggtgcgacgcaggtggagtgacgccatcggtctcgcttattggcagcgctggcccgcggtctcgcacccccgaatcgcgagagcggcatcggtatcgctctttcagagcacgatagcggttgtggagtgggccccacggaatttttttgctgggagatcaggcagccgtggtatcgcaaaggcggttgtggagtgggccccacggaatttttttgctgggagatcaggcagctgtggtatcgcaaagtgggagtgcgatgttgcgcatgggggcccgcagtctcgcacgttggttttgtgagaccgaaggcaatgtgacgtatcggtgctagagcctacggtgtcgcacaaacaatgtgcgagaccgcacggcatggctgccacagggccagtgattaatgtgttaatcaccttgattagcaactaattgatcattaataatcattaaataatcactaattatggtaattaatcactaattaccgctctcgtgttcctgtagcgtgagactgcttgggttgcagtcgccggccccagggctctcgcatctctcttgcgtgagaccagcgctctcgctttcctctcgtgcgagatcgcgcatcgcagcagttccgggacccaccgacttgctctcgcacttttagggtgcgttcgttcctgggggattgggtgagaaagcccatcgtattccgcgcgcatgcttcccaaactactcaacggtgcatttttttaaaaaaattctattagaaagttgctttaaaaaattatattaatctatttttaaaattttaaataattaatactcaattaatcatgcgctaatggctcacctcgttttgcgtatcttcctaatcttcttaatcttcttctcctcaaactcacccttagagtgcgacaccgtgcgctctccctaattagcaaagcgatattatatgaccgcctaggccatcgtgtgcgctccgtcctcgcagaccgaacgagcgataccgctctcgttctcgcgcctcgatcttgtgagaccgtggtctcgctcaatgaaaccgcgacggcggtatatttttgcaaatcttcacgcgttcagtattttcttgcaaattctacagaaaatgcgtatatttctaaaattttttcctacacttgctagtatcctgggagtagattttaatcctcgaggggatgtcccttcgttatttgcacgtcacttaaatagttatgaaaaaaattatgaagatgtattaacatatgatatatcactccacaaacatttaagttcaattcaactttcacatcaagctaattactataaataacatgtagatggagggagtattaaacataaataacatgtaatgacatttaaatagaaagagtaattagagtcgcgcgaatgcgattaataggttagtttggttgattgagcattgacaatatcagcgttacaggcttacagtagcaaacccatgattaaaattataaaccacagtccgaaaaagttttgaggcagtgttacatagggttttcttttttaaaacaaatttatacgaaagttgctttgaaatactacctctgttctaaattaattgtagttttacgttgttatcatatattaaggtttgaaaaaaaaaactataatacccgtagcaatggtttatattaagagtggagggttgttgagggtaaaatagagataaatttggatgagaggtgattaatgctatccttagtattctattgtgacaattattttggaacaaaatcaaatattagaaatacaattattatgggatatcatattaactcattttttattttttaagcctatactatatgctagccaagtaaatatgcaaccttttattctccagtcgaggccttttctcctgaaaattgaggcatatggaaactactcaccttttgctgcagcaagaataactgcgcagatcagttgctaatttaaccgcatcatcatcacgtatgtggtaaagctggcataacgttgatcgacaattcgccatagcaagcatgggccgtccgtccattggaccgaatttctcggcccatatacacgggtgagcccacaatagccctataaataggtgggcccaaggaaaaacgcaatgctctctcgcttcgtctcttccgcgtcgtctcccgactctcccctttcttccccaaatccgcgctaaaccctacctgcctacccgagcggcgcggcgagcagtttccggccatgccgcccgccgcccgccgcccgccgcctgagcccgccgcggtcggactccacctccaccatcgtggccggcacggcggccgggtcccacctcctcaagatcgacgggtactcgctcaccaaggggacccccaatggctcgttccttatctccagccagttcaccgtcggcggccaccgctggcgcatcaggtactatcccaacgggttctcatccagctccgccgatttcatttcgcttttcctcgtgctagacgagaaggtgaaggtgcaggcgaagtcggacttccagatcagttacaccggccaggtggatgagccaccgtggttggcaaccatgaaagcggatactttcgatggtgcgggctttcggtctttcggctatgaaaagttcgtcagaaggtgtgactttgagaagctcatcagggacgactctttcaccatccgttgcgacattgttgtcatcgacgagatccgcgccgaggagtcgaccgagatcaccaccaccacagccgccgtcgtcaccgtgcccccgtctgacctgaaccagcagctcggcgacctgctggagagcgagaagggcgcggatgtggtgttcgaggtcggcggccagacgctcgcggcgcaccggtgcgtgctcgcggcgcggtcgccggtcttcaaggcggagctctatggcttgatgaaggagggtggcaccgccgccggagccgtgcacatcgaggacattgagccgcgcgtgttcaaggtgctgctccgcttcatgtacaccgactcgctcccggagatggaggaggaagacgtcatgtgccagcatctgctcgtcgcggcggaccggtacaacctcgagaggctcaagctgatctgcgaggagaagttgtgcaggcacattagcgtcggcacggtatggaacatcctgccgctggctgatcagcaccactgtgacgggctgaagaaagcgtgcttcgatttcctcggctcactggcaaacctgagtgctgtcgtcgccagtgatggcttcaagcatctttgcaggagttgcccctctcttatggaagagctggttgtcacgctggcacttccagggagtcatgcttagtgacttactgttcatgtgttcttgcaatggccagtggtagtttttgttgctgagtttgaacctttgtcatcaggtagtttaatttgcttatcttcttttagcacactgatatgcgggtgaattccccgtgtttaggccttttaccatctatcctaagcagaagttagaaatcgtctcagttttttttactatccctacagcttcactattaaatctctatggattgtcacttgttacctggtattaaacttaactagatgctggggcgcgccaatggcgcgccgcctacacatagattggttgattactgtagactaatcatttgttttctggctgaatcaatgattatgtaaggagaaaacccacgaatacatttgcaggggatgctgttgatgagtaattttgcatacatcgttgtacagattctgctgagaacaaaactcttacacattacaatctaaagatgaagcaccaatgcatataaaaaatgaaaataaagttttacataatgatcggaataatgtgtccatggtgatggtacaactatatttgatcatacaaatctaccagtcaaaagaagacattgtggcaataacattctccgctgaaaggttcacatctggagtactaattgcaatggacctgttcaagcacaatccatcagcattcaatgagttttaaaaaaaatgtttcggaggatattttcaaatcagtatcaatggaagctcataagacacttgttaattggatttaggaagcgtggcaacataatatttccattttacttctcaatacagatagttatatcaagtggtacagcacgatactacagatttgtgtttatcacatggaaatgcagtgagagcaaaagaactctagaatagattgatatggaattaagcatgaagggtaagaaatttacaggataatcaactaataattatccttcactttttcctacactaaggcaaaaaaaatgtgtaaatcaaattgactgtcactgagaagatgatattctgtcagtcaaaaacgctaaaaaaaatacaatagcaatgcaaaagtaaacacctttcatcgcttgagttgcctgaagctgaaagccattcaagatccagaaagtttgaatcaccagaatgaatgcaactttcagtttcaacacctagaacatgatgtatctgaggtaccatgggagtatacctgtagcgaattttgagagaggaatgttagtactccactatttaaaacaccatgctttttcatgattttctaggaaaatacttgtatgagaagaatgaaggtcaaaaccctgaatgaatagaaaccaaccttaagtttgatacctcactttcagaggtcaatgaaatttcattgccatgtactgaattagattccaacactggaaattgtgacccacttttaacatcaagcaatactgcattcaacagctccttgtctccattatggcaaccactacatccagatatggatgtgttgctttcacaaagaatgttgccatatgatctcactctttttactgtattgtggaattaaagaaaacagtataagaaccccttactgttttacaatgtgcatatttcaataaggattatttttgttttcttcgaacgtaatcagcagggaagctacaaaaggtaatacatggctaaaagctctagtttaaataggaacatcctgctacagttcaaacacgttttggaatagcaaatcaacataacatgcaactcctaactatgttttcactactgcgtaccattgacgcctgtaccatgatttttttttgctacttactgttttttaacaatgcttcagatgacctctctttgcagagaatattttcagaaaaagatcacggtacagataaattagacgaatgtccatctaaaatgagaaatataacaccatatgaagtcaagcaaaagggcaaatatattctatactgaagttaagtccatagaacagcagtgcagaatccaccaatgtccttg

SEQ ID NO: 45576 - DNA, 879 bp, Oryza sativa; identical to SEQ ID NO: 41870

SEQ ID NO: 45577 - DNA, 882 bp, Oryza sativa
ccaggacctctcccccctcgccgtcgccgtcgccgccggcaggtcgccgtcgccaccgcacggaactctcccccctcgccgttgccatcgccgccgccaggtcgtccccgccgccaagtcgtccccgctaccgccggctcctccccgaagtcgccccgcccctcgccgtcgccgacgccactgccaggacctctcccccctcgccgtcgccgtcgccgccgccaggtcgccgtcgccgccgcacggacctctcccccctcgccgttgccatcgccgccgccaggtcgtcgccgccgccaggtcgtccccgccgtcgctcggtaacatttacttttaaaaaaagaaatgtgaaatgtgcaattgtggattgtggattgtttaattgtgcatcgtggattgtgatatgtgcaattgtggattgtttaattttgagaatgtttaattgtggattgttaaatggagatttatgtttaaattgggacttatgtttaaattgggacttatgttaaattgggatttatgtataattgggactttgttaaattgagatttatgtataattgggacttttgttaaattggcagctatgttaaaatgtgacttatgtttaagttgagacttatgttatattgggatttatgtataattgtgatttttgttaaactgagatttatgtataattgtgacttatgttaaattggcacctatgtcaaatggagatttctgtttaattgtgacttatgctaaattgggacctatgttaatttgagatttatgtataattgggacttatgttaaattgagatttatgtataattcggacttatgtcaaattgggacttatgtcaaattgagacttatgtgaaattgcgttaaattggg

SEQ ID NO: 45578 - DNA, 1104 bp, Oryza sativa
cttgttccaaaatgaagctatttcttcacctatcttctcttctccaccaatcacaactctcatccaatcatctctacctactttcttaatatctgtgactacctataaaaatgcttacattatggcaggggtggacccaaggggggtgccgggtatgcactagcatacccaataattccgaaaataagttaacatgtagtaggtattaaacatctctgtattagtatgtctaaatgtttgatgaaagctttctcgtgtggcaatacaccaaggctcaataggcccagctggtggtaggttttcaatttctggcgttatctccatctcgctagcctcgaccgtgccttgtggcggcacagagtgcagacgaaagcgacgagcgaccatcagctaataaccatgtactccctccgtttcataatgtaagactttctagcattacccacatacatataaatgttcatgaatctaaacacatacatatgtctagattcatcaacatctaaatgaatgtggacaatgctagaaagtcttacattgtgaaacggaggaaatagtatttcacttttttacttcctctgaatcattgatatatcctctttctctagatgactacatttgaaattgaaaattgaaatacgaaatcattgaaggcgtgtttcatgatttgtaggattaggtaaattgaatcagtcaattctgattaggaacatgggcatttctttattcagcaagtcaccgaaaacttctgattctaccagttctacattacccatgtcttcactcctgtcacggtgatgaggaaattccgaacagggaggaataataagtaaagaaaataggaattaattggaatttgtgctgtccattcttcttcaattccatctcagggtgcattatcgatccaatgctaataatactatttgtactaatacttttgataacctgatgcctaattgtattagcgtgtagggaggctttaatttggcttgtcacatgggcacaccgacgacaaaaaacctgggtctgccactgcattatgggacggaggaagtagatgacaattgacaaaccaacaaagccagtcgcacattcaaacaaatc

SEQ ID NO: 45579 - DNA, 1194 bp, Oryza sativa
caaagtcagtggcaaatcgtagacgtgcgacaaagtcagtggcatatcatggattatctcaatttgaatttggtaacacggtgtaaccatccaagtaaaatgcagaaaaactcaatattaaattccaattccaaatgtccacgtatacaggccatatttgacaatacaagcacacagtcaaatatacagaatcaaattaaatgtccaaattatacagtcccattacaattacacagtccatttataaatgtacaatccatcgtaagtccaaattaaatacagagccaggataaatgtcccatttaacagttcaattacaattctaccgtccatgtacatgttcgaatacatatatcacccctattccaatccatgcaaattacaaaagctcctattacacttgggccattcctctctcttccaacccagcccattcctcacagcaagtctatgtttacgccctctacatgccagcccactccctctcttcttctcagcccaaaagtttactttgcgtccctcagccaacacagcatgcatgcacagtaggtgttcgatgaatgcttacaagccggcacacacattcgagtgagggtgttgctgccatcaagtgcctgggacccctcccaacaacattccaacaaccatccatgcacccctgctcccagcccatcaaaaacatccccagaacacaagccaacacatgcaacagtgagaagagagtccacatcgaatgaagaaccgagttcacagggatatgcccaccaaaggaagttgcatggcttgcctccagcagtcttagggatggcaacgggttgggtcgggcacgggcagagcgaaaccatgcccgacccgagatccacgtgccagtgcccgacccacgcccgcaaagcctatcgggcaaaaccccatacccgtgtccatgcccgacgggtactcatcggcggccatcgggcttgcttgccgtgcgccgccgtgtcgccaaccaccgccacgccggcagccgccgccgtgcacaatcgtgtcgccggcctccgctcgtgccgtcgtgtcgccaaccaccgcccctgccgtgcgccgacacgccaccggccgccgcttgtgcgccgccgcttcgctggcctccacccgcgctaatgcgccaatgtgtcgccagctgtcgagcgatggtggaggaggaggccggcggcgaca

SEQ ID NO: 45580 - DNA, 1775 bp, Oryza sativa
ccttgtgttggtatttaatgacattgctaaaagtattcattcccaacaatggcgcagaaatagtcctggtatatttattgttagatataccattgtagtatttcacccagaagtattccaaggtaacatatttgtttaattccaaaggaagattgtgaaagagagaaccttgccaagctatacatattacttgcattcattaaagtctaaacatggattaattcaatatgtgggtagagtgacacgaagtgaatcttatagaattcctcatgagaataattctaactaagtgagataagaaatagaaagaactcaattcctatacttttaatatacactcaaactttactctacatttgctagtatattatcatgtggtcaataccccataacagtgtcctcctgttgtttcgagagaccaccccgggttgccgagttccttacgacaacctgtcatgaccgtccaaccggggctaaatacggaggagtaccctccccaggaatttgtcttaggaatgtatactaacatggaggaatacccgtactgagctgtcaccatcaacggcccatctactatcctgcctgcagtatatatgcccaattaatgatatttactatcctaagcatcatgcttacattaataaatactactctacatctctgcagatgacacagagtaactgacgaattagacattaaacccacgccattgcatctctctggtaggctacccacacaattataccgatacgaatgtaaagtaagagcagaacttatactaaatagaataccgagaatataataagagtagtatttcattaattcggaaagtattacagaagagaatagaaaagctactagagccataccgaaactcttccgaggactcagagaactattctatactacttccacttagctctaaactactaatacaaagtatgagaggaatcttaaagcttacttgagtgtgttgagaagtgaagtgagctccttcttttatagggttggtataacggttgtagacaaggtgaaatgaccttcttgccccttaaccatcattgagagtgcatctggcgcgaacacgtggagggccaggctgattgggctccaccagggttccggcgaactcctagttcggacgaacctaggctagcccaacaggcctccagcttcggtacaatctctaacaggtgggtcctattgatggttttaacagttaaagcggtttccaggccggttacacctgacttgtgggccctcttatccataagcttgcttaggagtgagattttctttattttctctttattttattgctcaattcctacaacatgttattctctaagcacaagtggaactatattattctgaagtaaatacgcattgcaagcatagttaattctatattattttagctatattgacggttgaaatttgtatgtaatgaccgtcaacaccttgccactgccactgccatcctcctctctgcgcattcgcagccgcttcgccgcttgctccgccgcggctggccacgagctgagccgagcctcggttgggcaaggggttgaggttggccgccgcgccgtcccgttgattcccttgcacgatcaaacgatcgaacgatgaacgattgaacttaaccaaaacttgcgaatgaactcaaaccttggacgtaatcaactactccctccattcctaaatatttgacgccgttgacttttttaaacatgtttgactattcgtcttattcagaaaaatttaagtaattatta

SEQ ID NO: 45581 - DNA, 4651 bp, Oryza sativa
gggactacgaatctgggactaaagatagctatctttagttccgggtgaaataatcgggactaaaggtcgatttttagtcccagttcgtgttaccaaccgggactaaagatctgtcagccacgtggccggccgaaccatctttagtcccggtttgtgttaccaaccgggactaaagatcggtgtaccattttttttattttgcatggcgctgtttgctgcaaggttgattatatatatatatatatatatatatgtgtgtgtgtgtgtgtgtgtgtgtgggcgcgcgcgcgcgcgtgcgcatatgtgtatatgtataaatacatatattacacacatatgtataatttaaagcacttaacattttatatgcatatatattaccaaaatatatattaacactaaagtaaatgtgtacatatataaatatatatatacacgcatatatagtacaattcatttgctcgatagctatagatacgacttcgacgccggcgttatgtcagaagaggaaggaccgacgttatgaattgtcgatccatcgtagtagaattcaccatcgggattaaggacttcttcgttgatgaatcccattagttattcttgaacagccgtgataaaatccttgtgtgggagattatccctcatgtgaatacgctatcattcgaaaaataatgacatatcaatatatgaaattaataaacaacttaacaaatcgatacgcaatgaaattttgaatggtttatgtatacgtacatcgagctctcgtgtggtgtatatttggtttgataggcagtgggcatactcgcatatgtagtagccgtataagttagttccttggtcctgctttgcacacttcatgagaaacgatgagagatttaatataatctttatatttaactgtaattagagatttaattaaatacaattttggatcatgcatatactcaccggaaaatgaaacctccatccaagtttttctttccaagtcccgcggaccaatttacggaaccgatcccaagccctacatgtgcagttgcaagctatgattaattaattattacccgagatcaacataatagcaatagaatccccgcgactttggaatagatggtattatattacctgtctatcagttggaagaccttttcaaaaatcttctcctctttattcattgagtcatacacagtgactctgcatgcgtccaagtcgaagaataacaggacccagtggaatctggaatatgcgtgagatgagatatatatgaaaatatacatgctatatgtatgggaacgaaatttgttcgaacgacaataaaaactcactctgtgttgtacggcagtagtataaacgtcttgaaatgctgctgcgttaggagatggacgagattgtcctctgtgtctttctcgtacttgtcgatcatttcggtgttgattttccgagggtcgatgaacccagtatcgtaaaccccccgccgtcgggccctttgaatctccattctacaacaataaaatgaaattgttattgtttacatatatgacaggagctagttattgaacgaaacaaatcgaactcaaagatacttacaaaatccatgcgctcaaaagagagacgtcgagggcgtccaaatggtacagatcgaagacatccttgaaatggagccagagaacatcttctccttgcaagaagtcggggtttctgatcctcgctccgaacatctctctacccttggcgctcatttccatgtaccgttcatggaatttgtacatctgtgtcggtagggactgcagctgctcaggcgtgacaagcggtttaccgagttcaaacttgtatgccacttccgcctttaggattggtgtggctccaatcagctgatccacagttagaccggtatctgaaatgaaatccgttattccaaaattttcgccggtcaccaacggctcgacctcttggtttggttgttctccaagctgagggactggtttggacttcttgtgataggctttctgaagtgttcggtcatagtccgatatctttaaggcctccttgtttgctatggacattcccttaaagaagttcttcacgcttgggtcaataggtatcttcttttcattactccgaggcttgagttgcttcttcacttctcctgccacataagcatcaagctcctcttgactgcaatcgtacggcggctccttgtttgtggtggtgtcaactttcgccttcttcgttgcccttgtgtaggcaggcggtggagcttggtgagaccttgtcttgggaggtgcaggcagacacggtggaggtggaggaggcggaggagccggaggagatggtgcagggggacgtggcggaggaaccgaaggatatggtgcaggaggagatggtggagccggaggagatggtgcacgagacgccgcttgtcgcccagggaggatgatgtaccgcttgcaccatagtataatggcgtggcttgtgcctcgtagatgcgtctcaccgtttcctcctgggtagtccaactcgaggtcctcatacgcagcttccactagctcaacttcgaccctcgagtatcctgctggaatcggcctgcagtggtaagtccctgaaatgtccgttgggatggccattcccgacaccaccttcacgtgatgagaggttatctattagtaatcgacctaagcagaaacttgcggaatgtacaagtcaaaaaatcataaaactatgagcataccttgattgataagttcttgaagggaatatgcagctcacatggtgtccgttgcgtgatctcatcaacggggcaggtggtttcatcctgggtttgcatggcgtccatgctctatgatcctacctgccccgttaaggcacagctgttacgattgcctgatgggctaaccattgcaggaggaatgtacggctggggatcctgggaccgatgtgcggccatgcgttcatccaccttccttgccacctcctcttgcatgctgagctcggctcgataccctgtactcaagatctgcaatctttgcctcatccgactcctgtacgtgtggatgtcctccttgaatccaatcttccagggaatcacgcctttccctggtgttcgtcctggatgctcgggagtctgtagggcgagtgacagctcgtccttctctctgtcgggtcagaatgtgccctgagaagaggctttcactgcgtccgttagtcgactggcagcctcgcgtatctgatcgctgaagacaagggagccatcaactgggttaagcgttccaccgtgagcatagtaccagaacttcgatcgatccggccatttagcggtggccggttcgatacccctctcaatcaatcttgcctccatctcctcccacttcggcattgcgacgctatatccgcctgaccctaagtggtgatggtacttctttttggcggcattttctttgtttctggccatcatcgcttgcccttgttgccctgtcttgtaagcaacgaacttgtcccaatgatctcttagctttgggaatacgtcgaagttcggtgttagtcccttcaggatgtatttcttgtagagatctcccttgaagctctggaactgttctgccattttctgtagagtccactgtttcactatgttctccgtacccgcgggtagcgtgagcatctcgagcattgtggtccacaacatctctttctctgattccgggacaaagctgtcattatccccgtgtgcccttgttctgcgccagtacaccgtgctgacaggcacgttgtccctcacaacccaaccgctgtggcgtacaaaattcttggctgcttctgccggggcactaggtcggccgtcttcgtccacctcagttatgatgtgccgaccctctatcttcttcacagaacctcgttgtccacgtgccctcttctgtccagcggagggatgacttccactagcctcctcctcctcgttcccctccgcatccctctccatgttcccctcctcgttcaagtactggtttggatcctcgtttccctcttcttcgttccagtactggctacttccctctgcgattgtatcgtacagtatctgttcctcatcgcgatcagccatctgtgcatacaaaaaatatttgttaggtctataggtcatatttgctaagcgtaatattaaaactctaataatcttatattaaaattgtaataatcatatatgctaagtctaacaattttatattaaatcgctactaatcttatattaaaattgtaataatcatatatatatatatatatatatatatatatatatctatatattaaatctctaataatataataatcttatattaaaactctaataatctaataatcttatattaaaactgtaataatcttatattaaatctctaacaaacacttctttacatcacttgcctgcgcgaattcctttgatggctagctaccacttcggcttgagggacgacgacgacgtcttctctgcaacattaccaggaaaatgtattagtctaaacgggccaagttacatatattgtatttcacgttttaacatatatatatataatcatatatgtatgctaagtttaataatcgtttaattatctcgttcgtacacgttcgctcgcgttcgttctcacacttttagtacaagtgcatt

SEQ ID NO: 45582 - DNA, 9596 bp, Oryza sativa
atctttactcccggatgttctcaccaatcgggactaaagatcttttcccgctatttccaaattctttttaaacccggttagggttaagaaccgggactaaagataatagcactgaattttgaatttcattacatttgtgtttctaaaatagtaaataatgcattacaattatttaaagtcgaaaaattaatgacaaaaccttcgaaaaattattgttgtctgtagtaaactaagtggataatatataattagcgcatgaatgatttaaaattgttaaaatttttaataatcatatataattagcatatgcatgatattaaattgttaaaaattctaattaatatatgtaaataccacatgcatgatttaaaattaataaaaattctaataatcatatataattagcatatgatgatatgaaattgttgaaaattctaattaacatatgtaaataccacgtgcatgatttaaaattaataaaaattctaataatcatatataattagcacatcatgataataaattgttgaaaattctaattaacatatgtaaataccacgtgcatgatttaaaacttttaaaaattctaataatcatatataactagcatatggttgatttcaatttgataaaaattctaataatcatacataattaacatatgccatacaacaattgattttatggatattcaatacatcaaaaatagtttacatcgtgtacacaacaattacggtaatacatcagcggtgacggttgaccgcacgtactttctcctgactattgttccttccttgtgatcgctacgtgagtaaggggtgtcttcatttgttaggaggatactagggtcaatcgtcactgtgaaagggggttgcccatcaaactgatcgtaatcttcgtcagtcttgttctctactccgacgatttttctttttcctgggagaaccacgtggcgcttcggctcgtcaggccctttgccctttttttcctttgctaaacatgtccttgacgtaaaaaacttgcgttacatcattggcaaggacaaaaggttcgtccgagtatccaaccttgttaaggtcaaccgttgtcatcccactgtcatcaatcggtacgcctccaccagtcaacctagcccataggcaccggaacagagggaccttgagaggtccatagtcaagttcccatatgtcctcgatggcaccgtaatacgtgccagttgtaccatcgtgtcccatggcatcgatacgaacaacactgttctggttcgtgctcttcatgtcttgggctctcgtgtagaatgtgtacccattgatttcatatccctggaatgtcgcgatcgagccagatggtcacctcgccaggaaggccagttgttggttaatcgtctcgttacccatgagatgttgtcgcagccacgcggagaaagtatcaatgtgatgccgtgtaatccatgcatcggacttaccgatgtttctggcacgaactagagccaagtgctcctcgatgtaaggagccaccaatgaagattgttgcagaactgtgaaatgggctttacgaaataaattgttgtctaccgtcattattgctttccttccgagagtcccctttccccgtagtctcccttcatggtgtgattcaagtaccccgattggcgaaggtcttcaataaattctacgcgaaattcaatgacctcctctgttccataccccttggcgatgcttacctctggacgagcacggttacgaatatatttcttcagaacgcccatgtaccactcgaaaggaaacatgttgtgtaggtacacagggtcgagaataccgatctctttgacaaggtgacaaagcagatgcgtcattatattgaaaaatgaaggtggaaatatcaactcaaagctgacaagacattgcaccacattattctgaagggcttctaatctatccggatcgatgaccttctgcgaaattgcgttcatgaaagcacatagctttgttattgttgcccggacattgtctgggaggataccccttattacaactggtagcagctgtgtcatcaacacgtgatagtcatgagactttatgtttgtgaacttcttctccttcgtgcttattattcgctttatattcgtggagtatcctgacgataccttgatgctctccaagcattcaaacatactgtccttctctgccttgctaagagtgtagctggctggactcaagtaatggcttcctttctcctttggttccgggtgaaggttgctgcgttgttccatatgtttcagatcattacgtgcttccagtgtatctttcgactttccatatacacctaggaagccaagaaggtttacgcaaaggttcttagtgaggtgcatcacgtcgattgcatggcggacgtccaagaattcccaatagggtaactcccaaaatatggagtttttttttcacatcgccgcgtgaccatcttcgctctctataggctggctgctaggcccctttccaagcactactttaagatctttcaccatagcaaacactgttttaccgctgcgatgttttggcttcgtacggtggtccaccgtatgttcaaagtgcttgcctttcttccgtactgggtggtttgctgcaaggaatcgacgatgacccatgtacacaaccttccgacagtgcttaagatacgtactttctgtttcatccatacagtgagtgcaaaccttgtaccccttgttggactgcccggataggttgctaagtgcaggccaatcgttgatggttacgaacagcagtgctcatacgttaaactcctcctgtttgtcctcgtcccacacggggacaccttccttcttccacaacagtttaagatcttcgaccagtggtcttaggtacacatcgatgtcgttaccaggttgcttggggccttgaataataatcggcatcattatgtacttcctcttcatgcatagccaaggggggaggttgtagatacacatcgtaatgggtcaagtgctatgaccgctgctcatctctccaaaaggattcatgccatccgtacttaaaccaaaccgtatgtttcgtgcgtcctttcaaaagtctttaaattttctgacgacgtttcgccactgcgaaccatcggcggggtgtctcaacatcccgtcctgttgacgctctttagcgtgccatcgcatcattctagcattccccttgttcctgaacaaacgccttagacgtggtattatagggaaataccacatcaccttagcaggaattctcttcttcgttagctgctcatcaacttctcctggatcatctcttctaatcttgtatcgtagtgctttgcaaatggggcatgcttctaggttctcgtactcctcaccgcgatataggatacaatcattcgaacatgcgtgaatcttctgaatttccagtcctagaggacagactatcttcttagcctcgtacgttgtctcggacaattggtttccctccggaagaatgttcttgacgagtttcaataaatcgccaaatgccttatcactaacaccattttttgccttccattgcaagaactccagagtggtatccaactttttgtgcccctgctcgcaacctgggtacaacgacgttctgtggtcctctaacatcctgtccaatttatgggcccccttttcactttcgcagtcctccttggcgtcctgcaacatctgaccaagatcatccgcaacgtcgtaaccatcagcatccatttcctcctcgcccgtttgatttccttcaaatccagagtactgagcaaagtccgaaatattgtcgtcttccacttcatcttcttccatttcaaccccttgctctccatgggatgtccaacagttatagcttgggatgaaccccgactcaaacaagtggaaatgaatagtcctggatgcagaatactccttctgattcttacacttattgcatggacaacaaataaaacccttatgcctgttagcttcggccactctcaaaaaataatgcacgccgtcaataaactctttggactgccggtcagcgtacatccattgccgatccatctacatgaaatgaaaaaaaatcgtacacaaataattattcgtacaataatggcagtcatacaataatgataaaataattacaaactctttcaacactcgtacaataatgacatatcattattcatacaaaaattataaaatattacaccaaataattcttatttactatttctaaagttttaaactaatattaatgtgttttacttcttttagttttcattttagtttgttttctattatttaagattaactttcactatattttccttctcaactattttataaaaccttatttagcaaataaactaaatttctatatattctttcttccccacacaaattctctctcatcaacttacaacaaaattttggagacaaaaaagtgtgcaaaacatagctccaaatgtaatatgacagtaaaaaacattggaggatgaagttgctaaccttttaggcacctccgatttgtatataatcaccaaaataaattcactagcaattttggcaagacctcccctcttttttgaagaaattttgaagcttgctcgggctagaggaggaagaagacatatatacaggggtaggactttagtcctggttggtgttaggaaccggggctaaagatcgccgggaccaaccgggactaaagttacgaactttagtcccggttggtgttaccaaccgggactaaagatcccggggggcctgacaagccctgacagcatttgaaccgggagtgttaccaaccgggactaaagatcaaatatgtccgttaccctttttaaccgggactaaagatcatctttagtcccggtttttattacaaccgggactattgtggaattcggccgaccgacgaaagatggtttctccaccagtgcttgctcgctggttctcgaaccagtacgtagcaatctcccgcaccacaaacctccattggtgttcgagagatgattctactcgctcactggttctcgaaccagtacgtagcaatctcccgcagtgcaacctccattggtgttcgagagatgattctactcactcgctggttctcgaaccagtacgtagcaatctctcgcaccgcaaaactccattggtgttcgatagatgattctactcgctcgctggttgtcgaaccagtatgtagcaatcacccgcaccgcaacgtccattggtgttcgagagatgattctactcgctcgctgtttctcgaaccagtacgtagcaatctcctgcaccgcaaccttcattggtgttggagagatgattctactcgctcgctggttctcgaaccaatacgtagcaatctcccgcaccgcaacctccattggtgttcgagagatgattgtactcgctcgctggttctcgaaccagtacgtagcaatctcccacaccgcaacttccattggtgttcgagagatgattctactcgctcgctggttctcgaaccagtacatagcaatctctcgcaccgcaacctccattggtgttcgagagatgattctacacgttcgctggtcctcgaaccagtacgtagcaatctctcgcaccgcaaccttagatggtcgaggtacgactacagtaataacgcagcagtcctcgcacgacaacttcaaatgatcgagagacacctactcactggttctcaaccagtcaatcgtagcgatctctcgtatatttatttctagtggttgagttacgactactacctggttcttgaccagaggtgtagcgattctcccattacctctacttcaacaaagttgatatcaggtacacaatatctccaagtgttttacccagagatcccttaccacaaaagacacctagcgttgaaacctatcctaatgtccctttacaccgtcttgacaaagcctctgaggaacctaagggaacttcggctggggaagtctagagcggataaggtcttgtcggatcctttagagacgaaagaccatgtaagatctggtcgtgtaagagttcttgccgtgcgtattaaccaagccgtgtaatcggaaatggattttccaacctcacggctgggggctaggatcagtgcttgttcaaccgaggtaggtcaaaggtccaagagccttatcctccgagaacgattctacgacgacaagggtgggggctagggagagtgtataactaaacaaattgactgatcgaagtcggtaaaagagtagatgctcatatacaaaacattggtttgtaaacctaattcattttcagtttttcatacattctataacatgttaccctttgagcactcgctcgggggctatttctatctaatattcttttttgagtattggttttagaaaattctattcggcattatcaaagactccatgtctctatggttctacaccaagatcgactaaggcgagtacgacaaatgttgacaaggctccgtcgcagactctgcgccttctcgatcactcaagaacggttggtggatatcgacaaggaatacggaatgaagaaatggtgtacccgccgagataaaatttccttgacttcaatccaaattctcgattacagcaagacgggagacttagtcgcatgtcctatactttcttggttgacatcggagattgactcagacgaaccctttaggtgcccgcacgaggctgataaaggaagtctaacattatctctgaactcaccgagaacggtcacgagagctcgataacagttcctacaaggtctgcggttgggaatatgaactcgctcatttgcattgaagttgggggatactgttagggttatggataccacatacctaatagtaattgactaaatctcggtaagacccaccacataccatgtctaatacggaaacaacctgcggatataggaggagttccggataaggaaagacaaccagagttctacatggaaatgacaaggactactcgggttgtatccatattggtttccctagttctacttggacaaggggacacctatgggtataaatacaaggccccctaggaggagaggggacacaatcaacgcccaccatagacggaacaacagaagccacaacatacaagccaacatacgctaagacaagacgccggatatcgacttcagggataggcacggctagtcccctacggtgtctccggatactgtcaggagagacgaaagcgctatctttgatctcgccgggcacgaactcgaggaggaagactaccctgttatcgactacgagtcagaccttcagaccgccatgtcgacaacagttagataggctaccccacgtattgtacttgtgtgatctagatgaataaagaacaacaacggcttcggccaacaggatgtagggttattacctgacaattcaggggcccgaacctgtaaaaaatccccgtctccatctcttttacctcagtctcgcgtataccctactaccaatgatccccataccatgcaaataccggaattgcgacatcaaacgtcgacagcgagtatattattatatgtgcagagtatattatatagttatttggtcgtatatagttatttggtcgtatatttggtctatatagttatttggtcgtatattattatatgtgcagagtattaattaggaatattttttttgacagctattaattaggaatattacccatactagctacttgcagcttgggacacatgctcttccctggagcaggcagctagagcaaatcatttcggcctagcccaagaaataatggcccgcttggcccgcatgtgttccggcccaacttgcatcggcttcagttgctccttcatttttcttgctgatctcagttattgggagcactaaaacactgattatagtagtattttttttgaatgattggcacatatgaaggttgaggatgatctaattgattatagaggtgaattaaatattatatatattataaacaaaataataacttaagaacaagttgtctaagcaacgaacacgaaggaaattttatgagagaacatatatatacttttaaaagcgtggatcaaataaagttttttttttaagaaaacaaactttgaaaactgtggagcaagtaatctgaccagcgacaataatccggtggataatctgaaaagaatgaggtcaattagggcttgttaagttcgcaaaaagaaaatttttgggtgtcacatcagacgtttgaccagatgttgaaaggggtttttgatacgaatgaaaaaactaatttcataactcgcctgaaaaccgcgagacaaatttattaagcctaattaatctgtcattagcgcatataggttactgtagcacttatgactaatcatggactaattagactcaaaaaaaattcgtctcgcgatttccatgcaaactgcgcaattagtttttcattttatctatatttaatattttatgtctgtgtccaaagattcgatgtgacgtttttgggaaaaaaatggaaactaaacaagcccttagtctgctaacatctcattcttcctgcagtaaaaccctttctactgcggttccaaaaaaatgagtctaccctacgtacgtggcttgccctatttttctaactgacatgcatggaacattcttttggagaatttatggatgtattttgaaacatcagaattcttttgtttgaggtaattattaattaaacattccataccaacatttccagacatccaaattaaaggtctagacagtgatgttcaccagtttatttctttttttcctcctttcaaaagtctggcaaatatgttcctacatcttccatcaaattccacgtagtttttacttaccatccaagcttcatttttcttgaaccatgcatggtccatggacaaacacacgacgatgacacttttagtcgtttactgttcttcagctggaaatgcagcaatcctcaaatcagctccaaacttgggagatctagcctgccggaaaagcactgggttgttcacacaagtgaagcagactgaaaggcacatctcgtcgtgaagactccggcaccaagaactaggtggatctagggtggtcccgggaccacccaaaatattctagccaatgcatatatacacatatgtgaaaagaaacttttgaaaaaaaaaagaaaaagaacttgtttctaatatatattatgatgcacatttgatctatttatatatttaaagtatttaaaaaattatataagttggatcacccatataaaaatcctagatatgcccactgaccaagaccttgctggctgcaggtcttgccgtcgctacctttatctgaagccaaaaaaaaatacgtacttaatgtagaggctgaattgaattttagtatatgtatgtatctctactactttataagcgaagtcatcctccttttagttatctcctcatctcaacacgccagcacgttcttttgtcacttttcaattatgggtttagcccatgcattaatgtatgggctctcagtctatttcagttatatagatctgacccgttataacttatgggcatgtaactagtatgaaaaaaggagcat

SEQ ID NO: 45583 - DNA, 17705 bp, Oryza sativa
tttaatacaagataatccaacaaatgtaattgatatgtgtgagttcgatatcgtacaaacgattttgtcccaaaaatattattgccgttagggttttgtccattccgtgtcgttaaatatactattcatcctatagcatttaatggcacgagatggacggaagtctaacggcgatggtatttttaggacaaaatagttcgtacgatggtatttattggaactcacacttgtcgatggtatctcttggatttggacgcttgtcaatggtatttcttggattatctcttaatagaatcaaccttgttttagaaaaaaatagcatatgtttattgattgagcacacaaatctactacgagaatatgtgtcaaacatactaatcctactaaaagtttgaacttagagttggaatatgtgtagcatagagttaaatcggactctatcatagattcactcttaaatagagagagtgacaccacaatgtaatcatgacaactacaatttagtgtaaacgcgtagggagaggatagcgcggcgagcccatggactcgtagcggttatgtgctatgttgattggggaggagcacctataatcagaggcctaaagatgtaggttttcactaaacttcgttaacaactattgtgtgttgatgtatcgtcctttagtgtatcttaatggatgatcactgtaccgactaacgtttataaaccgaactaacgaacacccttttccccaccaaaagaaacaacaaaaaaggcgtaacagacacgtcccgcgaatcgtagagggacatgtggctagacgtacgaggtgctggctactgctccactcgcttagagcaagtttaatagatcctagttagcaggcggtaacatgttccacatcatcaaaatcccaggtggaggagtgagaagagacgaaaaagggcggagcgggcggtccatttatcgcccggctgaagcgtgccgtacgagaaaaaaaagccttcttgcagcccgatgcgagcgtatctgccggcgcttcgttcctcctcctgatcccgtgcgtttctctgccccttcgccgttcctcctccccgatgccagattccttcatccgcgtgccaaattggcctcgcctcccgccaaatcgatgtataaatcctcaatccactccaaagcaaccgagtttgcccccaaattgtctcctcctaaaccctagatgctaaattcgtcaccaacctgcagcaagatggggcggcagtctcaaagggcatgtgtgccgacgcctatggaggtcccgtcgccggggaatcagccgatcgcgccgccgctgccacctcagttcatcgtcccgccttcgtttgcttccacctacagacccggtgcattgttccctgcagtaataacgcagtccatggcgccctcgtccgcaccatgttggttcaccacgttgcagcaaccaggcatgactggttcgtcgactcaaggaccttggttgttctctactggaattagtccatctacggagaatgctgagcgccctgatatccatgcgttgtatgatactgtccctctcttctcaatttttttggttgtttaattttttttattctgtatggatgatttttctgcataatcgattgacatggtagtagtattcagccagcagccggcaaaagtattagcatcgctcttacgtcgcccgcgtgggccgtagtgcatgtgcctcatgcccacacgtgaaacggcgccgctcatctagatatttctcactttagtaccataccgcgtgccaagcagcccctgggcccagttatatagcttcctcctcccaaaattaataactcgtcccaatacctatatataaaggcctgatcagtgatcaccaccaccactcgcttcctgctccctcaccccacttccacttcatcgccatgagctcgtccttcctcgggccattcaccgattttgactactcatccgtgctcgccgccggcgacttttttgccggtcaccatcctgaccagccgccgtcgccggcggaggtggtggtggccgtaggcggaggtgatgccagtgggaagcggagtttccaggccgacgacgacgatgccatgggcgtcgtgtcccgcttgtccaagaggacgaggaaggcgccgtcgagttcgagctcgccgtctcacagcgatggcggcggcggcggcggcggcgaggggaacgagccggcggcggagaggggaggtggccggcgggtgtgggtgcgggagcggagcacggagtggtgggaccgcatgagggacccggcggcgtgcccggaggcggaattccggcgagccttccgcatgccgcgcgcggtgttcgacaagctctgcgacgacctggccgccgccgtcgccaaggaggacaccacgctccgcgccgccatccccgtgccccagcgcgtcgccgtctgcctctggcgcctcgccaccggcgacccgctccgcgaggtgtcccgccgcttcggcctcggcatctccacctgccacagcatcatcctccaggtctgcgccgccatcaccgccgtcctcaccagggtcgtccggtggccggactcccacgccgcggccgcgtccaggttccaggccttgtccgggatccccggcgtcgtcggcgccgtgcacaccgagcacatccccatcgtcgcgcccagggagaacgccggcgagtactacgaccgccgcctcaccgaccggaacaacaaggccacctactccgtcgccatgcaggccgtcgtggacgccgacggcgccttcaccgacgtctgcatcggccaccccggctcgctctccgacgccgccgtcctcacgaagtcggcgctgtacgcccggtgcgaggccgggctgctgctcggcgacgacccgcagtggctcgtcggcggcgcgagctacccgctgacgagctggatgctggtgccgtacgcgcagccgaacctgacgtgggcgcaggagaggctcaacgcgcgggtggccgacgcgcgcgcggcggcggtgggcgcgttccggcggctcagggcgcggtggcggtgcctgcggcggcgcgccgaggtgaagctgccggagctccccaacatgctgggcgcctgctgcgtgctgcacaacctctgcgagcgcagcggcggggagctcgacgccgacctcctacacgacgagctcgtcgacgacggagtggtcgccggcggcggcaatacagtgcgctccgccgccgccgaacaggttagagacaggatcgctcacggtctcctccatgccggcaacactgcttcgagtagctaccaagattaccattacgggcggttataggtgttggaatataaagtgaattgtccatcttttcttatctgtttaatcttttgggttgaactgatccgtgtatgcaactcaataatagataaccgccgctagtaggttcacagccgataaccggttaaagcctaattggagggaggttaatttctagctatcctgattccataagaacatatgaaattatatatttatttatagtttaaggtaaaatttagaattatttctgcatgttaccggttacaaatttaattattggatttgcatttttatcggaataaattcagtaaccggtggtaattaatcaacttgttattggatcgggatatcctccgagtctagtaattattctagataaaccagtgtttcggaactctggtagatactttgcttatactataagaatttgatcaatttttatggtgtacaaaggttttataggacaaatgcaagattgattcgatggatctcagtataatgtatgtctcatgtgtttatgattgtaattgaaatttgaataattatcagaacacaaatttcatctaaatcttatattatgtttgtatacggttcgatcttatactagacatatatatccttgaactcaaatttcaaaaagggctacgttcactacgccagatccttgcacctgtgacggcatatctgtgacgggcataagtgctggtcagtgatgagggtcacctttgacgggtcctacaggatgccgtcatcggtgagccatcaggaggtgacccgtcacaggtaactagtcacctgtgacggttcaaaaatgaaacccgtcaaaggtgaggtaaaattacatgtgacgggccaaaaatatttagcccgtcacaggtaactagtcacctgtgacggtccaaaaacaaaactcgtcaaaggtgagataaagtcacctgtgacgggtcaaattttatgagcccgtcaaagatgataaaaaaaaaaatctttctcataaccctcccctctcatcccggctcatccttatcctctactaccggctcatccttatccatctcaaccactccccccatctctctctccctctcaaccctctctcttcatcgacctgtgtcggaggcggagacggcaccggcgccggcgggtgcgggggccgcgtcgtggtgaccgacgtccgcctcttcgccctctccggctcttggggctcgtctcggggagcagcggcgcggcgccgtccatcgtccatcggcggggaccagaggcggaggcggcggcctccttcgcccacctccgaaggtcgccgcctccttcgccctcagcctcatggtcgccgccgccgtctctccgccgccccgtcgtcagctccttcgcccaccgcctccgggtcgccgcctccttcccgcctgcaccacgccagatccgggtagcctcctccttcctgcctccaccacgccagatccaggtcgccgcctccttcgcccccctccccgaccgccgggcgccacggccgccgtcccccgactgctaggtgtcggatctagcctccacgaggttgggggacacggatccgcccgcccgccgccgccggttgttcttgcagcggcagcggcgaggagggctcaacggcgcgcggcggtgcagcggctcgacgcagcggtgaggagggctcgacgacgtgcggcggcgaggaggaggtgagtggcagcggcgccgcatccatccccatcctcctcccccttctctaatttctagattcggtgattcttggagcggcagtggcacggattttgtgaatgtgtgatggatttgtgaatgtgtgtgatggatttgtgcatgtgtgtgatggatttgtcccttactgttatgggtgatggatatattgttgatgagaaatttaggttatattttggctaatttgtgatggatatattttgtgatgcttctgtttactgctgctgaaatataatttctaaatattggctagcgatttgctagccaatatttagaaattttttttgtctggatgtacctcatcactgacggttcatattgaaaaagccgtcacaggtaaccataccagtgacgggttacaaaatggcatgggttagcgcagacacttacctctgacgggcggaagagttctagcccgtcagaggtgactgtcatcagtgacggtccttcacccgtcaaaggtgattggactcaccagtgaccactgatcactgaccaagcccaaagccgtcaaaggtgagggtttgggcccgtcacaggtgaccttgtccagtgtagtggtttcttttctcaaatgagaactatccggtacgttcaacaaattaagaaaagttttgcttgctagcacgcactactggaatgtataacagtatcatgctattgctctaattaaaatttctgaaatgattgaagatatatatcattttggagcccgccgggcaccatgatgccccaattaaatttagtattaattttctaacaagattaattaatactcgattggctttttttatgaccatttaaatatatttttgcgaagaaaccctaataaatccttaacatgagattggtttggcaatgcatgtcaaatcatcatttcaacgtgttccctcgcttatcctatcttactataaagttatcccccactaactccttaagattaacatgcaaagatgccacatcattatccactaataagatgccacatcatcatccactaattaacaagatgccacatcatcatccactaacaatcatcacatttaaacatcatgcaaatatactatatctttatagtttttataatttaagagcttttcaaattcaaacatgttaaattatcatccaacataattcacataatgtttcaaatacaaacatgttaaattatcatccaacataattcacataatgtttcagtgtatatctttattatgttttatgatatcctatatacttatatagttcatcctcacttagttagtgcttaaatgattaatctatggtccaaattatctctcctttttttctctaattaagtcatatcacatcaattgtttttagccattagatgattaatgtacggttcaaactatctccctactttttttcttccataaagtcataccaccttactttttaagtttgaatcaccattctacatactatttaaatttaaattatcataaaccacattaatttacttaatctgatgttatctagctatcttacacgctattttttttattgttatcatactaaatttccgcagtaatgcgcggggtttcacctagttccatatatatggatgctctcatgtaatcttaaggcatccaataataacatcttaagaaaaatcatccataaattgaagctttctctgatcgttatgattttatcaccggaaattacgccctttttccactcgggggtgatgcattaattaacggggtgatataacaaaagggttcatttttttatttcattttcatgtgcatatgacttggccgcgtgcaaatctctgcatgttagccgtgcaccgcagtaacagttggtgtataatctttatcgtcaaattaattactttatgataatatactacatatagaatacattccggcatgtcgagctgcaaatttaatatatccctaatttaatatgactggctgatttattttctaagaaacatagtataaacgtagatgctcgtaacacgtgcacacacaccctgtaagcacacatgcatatcttatccgtattagcacctctagaagactaagccggcttatcttgaaattggcgaagtcaccacaggtgcctcgttatcaatgggtatgtagcttaccaattaaaaaataattagccgtaattgcgagcacccgtgccatgtctaggatttaaaatcggatttaaaatatatatggaagtctaaccagtggctaaattttggatagattagggacgcgccggaacgtgcatgaagattttgattattcggattatgaataaattagccaaagaagaatgtacatgtgtacataaaacacaaggtaaaagcttttgcctttgcttaagaaaatagttgttggtaattagctttgctttagattcgcaaatatttgtatgtaatctaaaaagagtctaattagatggttcagctgccaataacggtagatcttgaatataccgaatttaaacatttccagtgtattggtacacagccataaattaatgcagattaataatagcattataaagctaaggcacaatttaagccacttggcaggtgaagtggtcactattgtagaaaccatctttatccggtcaggcaaaaaccacaataatcccggttccaataaaaaccgggactaaagatgggttttagttccggtttataagcaaaacgggactatgtgctctttagtctagtcctggttcatatgctgtcaggggctgccagcccccccccctcggatctttagtcccggttgataacacaaaccggaactaaaattcgatgtatcgtatataatccctaggacttatcctcccaaactcctcatctcctattcttactctctcttatcattttctttgcactatcctctccttccttctagctacagatggagcttatccttttcttgccttatcctctccttgcagatcgagcgaggagcgaagagcgaggacggcggagggccgcggcggccggcacgcggagggcggcgcccggcggcggccggcagggccattgcacgaggatggaagcggccggtgcggagggccgccgtggtggtcggccgtgcgaatttgttttttcttttatcccttgtgaatgtttgtttattgaggataatttgttcattcgatctatgattttagaatgattgttgttgtggatgatttgagattgtttgttgaggataatttgttcattcgatatgtgatttgagaatgactgttgttgtggataatttgagatgattatgttgttgtggattatttgggattatgttcttgtggatgatttgggatgttggaaaatgatgaaaaaaaacttagtcccggttggtaacaccaaccggtatctttagtcccggttatttcaaccgggactaaagatattttgtcccggattcttagtcccggtttgcaacccgggactaaagggggttgtaaaccaggagtaaagatggtttctccaccagtgggtaatgttagccaaaaagacacgagtctaattaaatggaaattgttatgcatccgattcaactatccaactcacacacgactgaatttgatcaacggttgcaaacgactacagtgcatatgcacatgatctcctttaattgatttatggtttcatgtttttagttgtacaactggatagtatgtatagcattactcaattaaaataatttcaaagtgaggcgtgagtctcgtgtgcacaaatatgtttcaaagaaggtacaatctcataaaaatgggaacatgtggatgctaaaattatgtggatgtcagtggaagatgctactgtcagaagaaatcggctggcaaagacttttaatacagtcttataataaatcactgtagttaattaggacctgtttgacagctggagatgttgacatggaacccaatggttaattcaaacaaaggatatgataagaaggtttccaagacatataaattcttcaacattgttcttccttcaagaaccaaatatacgactttagaaacaataattgtcctgcaaccaattactgcattttgtcaagaacaagtgaaaaggacattttgtcaactgtagccaccacattttgtcacgtagaaaaaacttgaaattactatctctgtcatttttcacacattccacacatatcaatataaaataataggattaggataccctccactttatcaaatcccaataaagttatcctcacttccaatgcatttgtatcctactttcataactccaatacaacttgattgcttaaaaagaaacttattgtgagaccaagaaaaagaggcaaaaatcaatttattttggaatggatggagtatgtaattttatcagctttgtcaaatagtatttccattttgagtatactatatatagcacacctttgaccgcgaaggtatatatgctcacatgttctgggagtcctgctaacaaagatcaaaatttgacaatcaactccgtcaaatggatcacctctgaaccaatccagagccaagcatctctatgcaagcgcttatcagtattattcggcctacctatcagcatcttattgtatacaggaattgtatcagatttgtagaatttcttcagcatttgcaaggcatcttgcaagttcttgaattcgcctgctgcaacaatctggcccttaaccctcctggcctatatatctttgttcagcatgaacccatgtgtattcaatttcagtgaatagatcttcagttaattattggcagccggtttttaggcaactctaagaatggaattaatgttctcgatcgcatatcacatatattcccactgacatagctgtgaacacaacatatacatcacaaccagcactgttaatttactcacttcttaaacctgtgttatagtgaaaataattacaattctgtcttattatgggaagaaaaggttgaagtaaaaactgcagttgcccaactctgaatttccttgacatccattatatttacgactagtacttaaaaaatagctatccacacttccacaaattagttgtggagctaggatattcatttttttttaaaaaaaattgatccatatatgaatgaaattaagacaataaaatgaccgtgacaataaaattgttccgtacacgaactattcataattgtgaagcacaataaagtgacaatgacaagttttaaagtaccaatattagcaaaaatatgccattcaagatatgtcctaacgagccagctcatctctacataaatatcattgataaaagtgtgtaattaagctgaaatgataaatgtgtcaacttagggctgctaacagatggaatttttgtccatttaaggtgtattattattgtttcaattcaattttctatgcacatgcataatatatcaaatgattttttttgtttgccataacttaatggatattaaacttaaatactctctctgccccactcaataaggcgcacacacattttaagactcattaaatatttgacctataaatagtttattataattaaatttattatgattttgttgctagaaacattataatacatgagtaatttaaataaagatttatattgaaaactctgcaagtttgactgtgactaaatgactaggatggagagagtacccatgaatcacattggatcctcccttgtcagaaaccattcaaacccactaggccactatatggtccactagctagcgagtgggcgaatgccactgacccatattttctacatatatatgtagacaaacatttggctgtacgtaggagttttgacggaaattaagttcacgtcatcaggtgggaatttaatcatatatacgaactttcgaccctttttttttttgataaattgatccttctcaaaacttattttgaaactagtccttgcaaaaaatttcaactaaaaatatgccgtcaactcagcgtcaaggacattggcgctaaactctaatcgaggtgacatggatttgccgagtcatcataactcatcgccaagatatttggcgctaaagtcctgacgatttaaattaatgtaaaggcgttcatttccaatgaaccacctataggacaatggtagcaagcttcagctatagccccatacaccaaggttcggttcccatctctccttttttttgttcttttcagttttcccatttctcttttctctctcttcatttatttatatgttttttctttttggttctctcattttttttctctctctttatctatatttttccttttctgtttgtctcgtaatattatcttcaaacgatatactttatttgcaacttttttcttgaatttgaaaaaaaatattaaagtggtatattatatggcaaatgggaacttaaaccgaaatttcaaatcaaatttaaaataaaacaaattatagaaatttaaaggagcatatacttctttcatattggcactcaaaatcaaactcaaaataaaaaaaatttacaaatgaaacaatcattttgtaaagaataaaagtgagtagtcaagagaaaagaaacttattttgtcttactctcataatattatatagattttaatagatagtaatctaaatactatataatttaacttttcaaatatgcgatgtaaattgaaaattaaaataaatttataagtagaacattttaatttgaaaagaatggtaggaaggtatgctaggaggaagtttgtcttactctcctaatattatatagattttaatagatagtaatataaatattatataatttaagttttcaaatctgcgatgtaaattgaaaattaaaataaatttataagtagaacattttaatttgaaaagaatggtaggaaaattatgctaggaggaagagaaaaggaaaaaaaggaaggatagtagaattcaaacccagcaccttagggctcacagttgaagacttcaaccaccaagctatcacagttttgttgcaatataatgcttgcgcatctatttaatctcatttggacctcagcaccaaatcacttggcgctgagctatgatgactcaacaaatttatgccacctcggattagagctcagggccaatgctattggcgttgggaagttatatctcagcgccaaggtccgtggtgctaaatccacggcctatttttggttaaagttttttttaagggctagtttcaaaataagttttttgaaaaggaccaatttatcaaaaaaaaaaaacggcaactttcgtgtggagtgcaaacattgagaaactttcggtcagctcgcacgacaggatcaatttcaatagcaaattaaagtcaacacaagtagtgtttacaacttgcctataaacttcgtaaccttgtacttccctatcacacatatattccctcagtctcaaaatgatataagcagttcgatttaaaacttttcacgaagagtaatgtcgacgtttgatgttgcgattccggtatttgcgtggtatggggatcgttggtaccaggatatacgcgagactgaggtaaaagagacagagacgaggatttttatacaggttcgggcccttgaattgtcaagtaatagccctacatgctgttgtcgacaacatgctcttattcattataatcacaccagtacaatatttggggtagtctatctaactgttgtcgacatggcggtatgaaggtttgactcatagttgacaacagggtaattttcctcctcgagtctgtgcctggcgagatcagagataacgctttcgtctctcctgacattatccggagacaccgtaggggactagccgtccttatccctgaagtcgatatccggtgtcttgtcttggcgtatgttggcttgtattggcttctgttgttctgtctatgttgagtgtgtcccctctcctcttagggggccttgtatttatacccatagatgtcccctgtccaagtagaactagggaaaccagtatggatacaatccgagtagttcttgtcgtttccatgtagaactctggttgtcttttcttatccggaacaactcctatatccgcaggttgtttccgtataggacatggtatgtggtgtgtcctgccgagatttagtcgactactattaggtatgtggtattcataaccctgacaagtaagtagagaggcgtaaaattaaattaaatatgattgtaattaattaagatgtaaaattaggtgaaaaaaaattaaataagcagaaacgattatgattggataagatgaagtcgagaagtgatggtatcttatgagttttacgagtaactttaatgttataaatagctactatattctagaaaagatgacgtaacaatatcgtacacgtacactgtaggtgaagatgattaatttatatagaaacctgacctgtaacgggacactactacaaaatatgaaataaaaaaaaaatgacatctttaaacaattatagataccgattttttttaaaaataaacctttaatattaaaaacccgcacctcctaattgagccgagctgacgggcccaccacgaacgacgagataaggccccggtatcatgaggagataaggcattcacagactcttgcaaatctctctccctcatctctcgactctctctcgctgctcgtggccggtggaggtggcggtggccgcgccgtcccttccgccagatccggggaggggcggcctagcggcgggaggcggcatgtggcggcggaagggaggggggatgcagcggcgggacaagaggaggtggcggcctggcggcggcgccctccctccatcggatctgaatgttcttcaatgttagtgaatgatttctgtgatgttctttaatgttaatgaatgatttctgtgaaagatttctgtgatgttcttcaacgtttcttattctgtgatattgtttgattggagattggggattgcgattgatttggagttctgtgatgtggggtggatgagctcgatgcatcggctcaatgcattgagctttttattagctcacgaggggtctcaaaggtgccggtttttaaaataggattggtgttagagcactcatcagtaccgcctccgtgatgccggttaggaaaaccgacatcttaaggtgtttcccaaccgacaccttttacgtgttctgtgttagtgggagaagcccgtatagtgtagtatagtcgatcgtctccaatcgatagaaatctcgtaatgtatcgtacatgtacactctaggtgaagaggattaattaattgggaattaaacctgacttgtaacgggaaaagacaggctagtgtagttcaatcggtagaaatctcataatgtatctcatgtgctgatgtacgtacatatagtgatacacacagtactatgtactccctcctaaatatagaaatttatactaccattctgaaaaagaaaaactctatctctactaaattcgtactccctccgtccccaaaaaaaaaaaaaaaaagacaaatcttgagtttccgtgtctaactttgactgtccgtcttatatgatttttttttataattcgtattttcattgttgttagataataaaacatgattaatattttatgcgtgacttgtctttttaattttttttataattttttcaaataagacggacggtcaaacgttaggcatgaaaaccagggtttatcttttttttgacgagggagtactgagtagtacctattctaattaaggttttatatattttcggtaagacacggagagtacgtcttgtctctctaggagaacaaaacaacaaagcacgcaatatttggatggaattgacagacgtacgttcaaatgagagaagtggcggcggccgccgggcggggtcggtggcggccgggctgggaggcaggaggaagaatcttttggtaggatttgtgttgaatttgttgtttagaatttgtgatgtatttgattgtgatgtgaataagtgatgttttgtttttaaatttgtgatgtaaccatctttgagattttgtgatgtatgatctgtgatttggagatgatttggggatttcacgatttgggatgattgatgtgtgatttatttggggatttgacgatttacggataatttgggaattgagtgaaatcaatatgcaaggagttaaaaataataaaaaactaaaaaaacatatcaatcgggacctggcctcttccatcgttaccaaccgggactaaagatttcatctttggtcacggttgttaacaccaaccggtactagagatatttcacccgagactatcttttgtcccggattcgtagtcagtgttagaattcacgttgtcaacaatcgaacaagtacacacgaacacacggacacgaaagtggagggcaatcaactttattgatgtttctctctctgtaacaagtattactttgccctcaacctcactattgtatttatacccacaataggatatcctatatggatacatacatatatatttggtataagcccacttcattaataaggaaacagaagaatagaaggaggaggtaccgtgatcctcatgatcacggtcctacaaatccgactccttcgggagatcggtttcataacactcccctttggatgaataccgcgctatacatatgcctcatcaaaactccttccaaaaatccagtgggagaaaaggaataggagaaggagtacatagtacacgctacttatattgcactgttgtctcattaaaaacctaaatgtgagaaacttcaaagaaaactcactaaagggaaaaagagtacaaccataagctaatctactggataactctttcattcttcaagaatgatatactgatctgcatgatcaatatcaacggaacacagttagggaagtgctccccttgatttgtgcacatctctcatcctcctcataccgatgccatgcacaagcttctcaaaaacactagttggcaaagacttagtaaataaatctgcgagattttcactagtcttggtgagagtcaccttgatttttatttcttttgcaattcatgcatatagaagatttaggcgatatatgttttgtgagactcgtcttcacataacccatttgtatttgtgcaacacaagctgaattatcttcataaataatggctggagttggtgtgatatttagtccacatgtattctgtacatgttgtatcaccctcctcaaccacatgcattccttgctcacttcaaataatcctataatctccgagtgatttgttgatgtcgcgaccatcgtctgcttcgtcgacttccatgagatggttgtaccaccacagagaaacacatacccagtctgtgacaatgctttgtgggggtctgacagatatccagaatcagcatatcccgccatggttaaatcttgattttttctaaagaataaaccgagatcttgtgtgccacgtaaataacggaggatttgcttaatgtcattccaatgccgtttggtaggagctgaactgaaccttgcaagtaggttaacaacaaatgcaatatcaggcctggtaccattcgcgagatacattaaagctccaattgcgcttaaatatggacattcatgtcccaataattcctcgttattttcctgtggtctaaatgggtcactctctactgctagagatcttactaccatgggggttctcgtcggatatgaatccttcatattaaatttctccaatatcttctggatatatgcagactggtgtaacaataccccttcaggagtgtgctcaagctgcagacctaagcaatatttagccttacctaattctttcatctcgaactccgtctttaggtaagaactagcttccttaatcacctgtgtggtctcgatgatattcagatcgtccacatatacagaaataatacaaaatccatgttctgattttttgataaacacacagggacagtcatcattcttgatgaatccttttctaggaattcactgagccggttgtaccacatcctaccggattgttttaacccatacaatgatcgttgcaatttaacactgtatatgttgcgttttgtttcttcaggaacttgaatcccgtcggaaactttcatatagatttcagaatccaatgacccatataaatatgcagtcactacatccatcaactgcacttctaagttcaaattgactgccatagatattaaaaaccggaatgtaattccatccattacaggtgaataggtttcatcgaaatcgatgccaggtctatgcgtaaacccttgtgctactaatctcgctttataccgaaccacctggttgttctcatcctgttttcggacgaacacccatttatatcctacaggggatatccctacgggggtacgatcaacaggaccgaatacttttcttttattgagcgagattaactctgcctttattgcttctttccatttgacccagtcttaacgctttttgcattctgccatggactttggttctgggtccagatcaatgatcttagcgatcttttcggcaaagtatatgtcgacaatagtagtctctttattgtatgtttcacctgtatccacataattggtggatatttcctctattctttcacattcctgatcttcattgtttcctgcaatgtttaagtcaggaatttccggtctcccagtgctagtagtaattgcg

SEQ ID NO: 45584 - DNA, 8086 bp, Oryza sativa
cccctaatgctgggaaatgatcttcattaaatatacaatcagcgtatcgacccgtatgtacgtctcctgtcaatggttctaaaaatttaatgatagacggagattcaaatcctacatagattactaattttctatgaggacccattgacgtacgcttaggtggcggtatagggacgtatacaacacatccaaaattgtgcagatgggaaatatttggtgcatatccacgtgtaagctgcataggggatacaacattgtatgcagtgggtctgatttgaagtaacgccgctgcatgcaaaacagcgtgtccccaacatgtagttggtaggttgctatgcagtagcaatggcctagcgataagcttaatcctcttaattaatgattcggcgagaccattgtgagtgtggacgtgtggtacagaatgttccactttaattcccaaagccatgcaatatgcattaaataccttagaggtaaactccccggcattgtccattctaatggattgtatccggttatccaggaaattggctctcaactagattatttgggaaataagccgcgcaaaagcgtgctttctagtagaaagtaagcaaacagtgctccagcaagttgatgcatcaattaataccataaaataccggaatgatccggacattggattaattggtccacatatgtcgccctgtattcgttgcaagaatactggtgattctgcgtccacctttaaattagagggtctaacgattaatttccctgttgcacaattagtgcaaacaaaatcttcttggtttgggaaatcgttagttcgtaaattatggccatttgaagtgttgcacaatcagtgcaaacaaaatcttcttggtttgggaaatcgttagttagtaaattatggccatttgaagttaagatgattcttctcatcatccctagaccgtattctgtatgactcaggatttttaaatattgttttcagtgcaacattttcgggttttatatgagtgtagtacagtccagatttcaaggaagggagtttttcaacaacagtcttatgatttccgtctaatttcgttatgagaagaaattcgagtttattctcatctttggtttctacgtgataaccataagcacggatatctttaaagattagtagagtacgactggactttagatataatagagcatcatttataatgatcttggtaccatgtgggagaactactgttgctcgtcccactccgacgatgggtgcattgcttccggcaatagtagcgatttgaccagtctttttctttaaagtctggaaatacgtggtatctcaaaagatagtattggtggtacaacagtctaccagacacatctcctcttccattgccatagtacgtaacactgttctatcataaagaatttaaatatagtcaattcatgaccatatagcaaaaataacactttaagatagaaaaataaaaatctggagaatatattaaactaaaagagttcactcaattattaagataaccacgctctgaaggagcttacagaaactatagttctgctaggaacacaaactaaatgcacacttgaaaaatcacctaactttagtctattacatagtctaaaatttaaagtaacttataatgcaggaagctaagatacaaattggaagacttaaatgtccccatataactgatcagagtccatgagatcatctgagagcttcagctctgcgtctgctgcattcttttccatcttatcatcgatgtgcattgcaaccactgccttctcgtcgacctgcttgtcgatatgcatggcagccatcttctcttctgagtgctggatctcaacagtgaagtgtgactcatgctctgacttcttcttcctgtgcttctcttgataaagctcaatgagatgcttaggggtgcggcaaatgcgagaccagtgtcccctagtgccacacttgaagcatacctgatcttgctttccatattcaccactagtagagcccttcttagacttactgttctgatttcctttcttcttgaaagacgtcttgttaactttgccaccatttttccagaaattcttccctttgttctggttattctggtttttccccttcttaaaggagctagcatttgcttcaggtgctgctgaacttccagtggggcgagacgtatgattttcaacaagtgtctcatcttctccttgtgcttcgatgagcatggagaccagttcagaatacttctcgtatttagcctggcggtattgcctctgaatattcacatgattggcatggaaggtggacaaagttttgtctatcatgtcagcatcagtgattttctctccacatagcttaagacaagtgacattgcggtgaagaactgagttatattgctccacagatttgtaatcttggaaacgtaagtgaagccactcacgttttgtttttaggagcaaggcctttacttgatggccatagcgatccttcagtgagtcccaaaggaccttcggatcttcctcagtcatatactcattcttgagagtagtattcaaatggtgcctcaggaaatgcagtgcctgatttttctcagctgaagttggtaaattattaactcctccagctgatgttgcaatagttgggtcctgaatgcagttcaggagtttcttagcaccaagcatgattttggcatccagtgcccatgtcaggtaattcttgccgctgactgctagttcagcaaaatctctcttagcaatatcagtcattttcctacattagtcatgcaaaattcaataagtactgcaagtaggagcatgacaagtgtgcaaatagtaaattctggttatctaaatttagtactgtgtcaatatattcccataattctcccaataattttcagaattgtttcactaattatttaggtaccaaagtaattactgaattactaacccattaaatagtattctgaaaacagctaggaaaaataaaccataaacacgatgctcaggttcaaatgatgagagctcattgcctaaaaaccatgtctctaggattttatggttgattcaaaaattaactaataaatagttaatatacagaaaattgaaaatacggaataacaaaaataatctgacattctcagtaatttctataatcccgagggactattccgctaaaattccaaatccgcgtgtatcctgaaaattctaggacatatttagaagtttgccattttcgggccaaatttcgatttgagcccgactccttttataggcctaatttatactcggcccacctctatgtaccggctactcaaattttaaccggcccgtcgggaccgtcggcctgctaatggccttggcccataagcggcccaacaagagcgctgcaccttatccaatcgggtggctagggttgaaaccctagcccccaattccaccgattcgatggtggcggcgagtatcccggcggctcatgcgagtgaggcggcgaggttgacggggctcgtcgtcatggcggggtcgacagagctcgtcggcgcggcggggtcgatgacagaggcggagcggcggtgaggctacaagcagcactgacgctggcgtggttggctacgggccgtatccagcgtccggcaagcgcagctccttgctgtgcgccggcggaatttggctcggcatgtgggccggcaaggcggacggctatcagcggcgggaggccgcggcggcttcggcccccgacccagtcgtgtgcggtagcgctggaggcgtgctgtgcgtgccgtcggcgggggggatgcgggcgcggtctcctcagcgtctctgcgggcggcggtcgtcgacggcgagtgcggatggtcgattgaagacccgtcggctggcttttcaagggcgaaccgacgacggaaagccgatggcacgattctgcggccatcggtgaagggggtggctggcgacgcgtgctggcggcagcaagggcacgacggcgcatgctggcgtcatcgactcggtttcgtcatcgtcaacatcaggaggacggcggcgctggcatgaggatttgggccaattcgttcgtaatcggcaattacgttagccaggtacgcgattcttctcatgtgcatcgcgattacaccctgaacgtagcgtcgcccttcgaggcatcactagttctaaaccgtcgttcttgctgtggcttgtctgatccgttcgcgcgtctagggcgtacggtatccgtgtctttgtttgcaagaaaagaaacccagcgcaaaggctgggaacagatctaatcggactatagcgataaccgcttctcgttcgatagatcggttgtacaagggataaccccatacgcctgtcgcgcatagggtggagagctgcaaactctcctgctacgtgcgccataagggacaaatccacgtagtacaacccatcaatcgaacgattagcggagaaataaaaataacagaaaacgatctagcaagtttatcgttatccctatagaacgagattagaacagatcgatgttgacaatataccttggctgaagagcacctcgtgctgataacgtgttagaattcatgttgtcaacaatcgaacaagcacacaataacacacggacatgaaagtggaaggcaatcaactttattgatgtttctctctctgttacaagtattactttgccctcaacctcactattgtatttatacccacaataggatgtcctatatggatacatacatatatatttggtataagcccacttccttaataaggaaacagaagaatagaaggaggaggtaccgtgatcctcacgatcacggtcctacaaatccgactcctttgggagatcggtttcataacagtcagggggttacaaaccagagttaaaaaccctttctccagcagctacctattgttgagaaggccgcactcaattaatttctttaatctcacatgattatttagattcaggacttttggtttgtacagattctgatccttgcacggattgagggttggtcttctttgatgaaccatgcagagaacacgggatgttgggatataggatatccgatcttcttttaatcttctagctagtacatgttgtatcttgtagttttagtctagtaatttataatttaatttttaccaattatctcaccattgcttaaatgactggatgtttgaattgataggctgtgttcttggttaatctctttttttacacttatcacatatataattaattaattatataagtcataccacatgttgagagacaatggtgacacaatcgacttgaaatcctggctccggccattatggcacgtggaggctaagaaataagcaactcaatttacgggttccgcatggtagttgggtggtcactgccatcactactataggttctaatatcgaataattgtttgttaaaattttaaccaaacaaaagaaaatatatatacactttaaaatatactccctccatattttaatgtatgatgccgttgactttttgaccaatgtttgactatttttttattcttttttttgtaaatatgaaaatatttatgtcatgcttaaagaacatttgatgatgaatcaaattacaataaaataaataataattacataatttttttaaataagacgaatggttaaacgtttgataaaaagttaacggcattctactttaaaatacaagctagctagtccaagtccagagatagatcgatgcatgacctaattaattaactctccggtgtgtgcgtgtgttggggctggggcctgcaggcgttgccttcatgcagaagaaataattgtagtggtggtccgtccgccggccattggatatgtcgtcatcgatcgtcttcggcgtcgtcgtcgtcctttctccagctctcgctgacaggattctgtgtggagagcggccggcggagttggtagcgaatttgcaaatgcacgcggtcgcgccgaattctgtgtggatgacggcagcccgcccggtcaccctagcatacgcacccggtcttgaaaacttgagaccagtatgaaacattgaaaacccctctgcacgcatatatatatatatatatatatatatatatatatgagttgcataatatgaaccaaggtgcatatgcacctatatgcatagtttgacacatgtatctacctgattggttcccttcatggtggctgtaagggatggtacatgttatgatttttgtggtccaaaatgtcccttaagtagtactataatagttcgaatgaattgtttttgtggttttcctttttttttcaaagtaatgtcctatgtttatttaatatgttgataaaaaatatgacattatatttctgaaaaacatataatgtagattcactacaacatattgtgagataattttgtaatttttttataactttagatatgtaattgatattttattcaagaataatgtatttctatttcccccctcaacggttgtattatctttttatgggtggattttgtgttctctttggtttgcatttgcaagaattttttttctcatggttttttagtcaatgcaagttataggtttagatataaattattttgtaaatgctatttagagatgtgtcatttgcaagtttcatttttagagaaatgtcattagtatgaacattaggagaccatttgcacattttatttagagatataaaatcattttctaaatgctatttagagaaatgtcaataacagatcatctgcaaattttatatttcatacaaacgaagatatatgatatatcagtatgaacatgttcaataaatcttaatatatattactctactacaaagttaagagaaataaaaaatactaatatttatatgtacgagtacaagatagaaatttgctttgaatcaatgaaccaatgaacgtctcgtattgtaacatactagtataaaagggcaatttgggacaaactcaaagtgggcagtggcattgtgtaccttccctcatctctcccctatatagtaatagcacaaatcttagcagccatcaatggtgtaaattgttggtgcatatgaacctaggttcacatttgcttttccatatatatatatatatatatatatatatatacttaaaaaaaaatttgtgcgttacaacgagtgaaggttattttaatcttattattattatacggtttagttaaggtgaaatttactgtgggaattctcttagatatttttttttacaaaatcaggagctgcaattaaaagtccgatcgtcttaagttagtatataagtttttctttaaaagaaatttcttatatgacttttatggtatttctaaaagcgaaataacttaaaaactgactcaaacacggatctgtatttctaaaaacgaacgaacttaaaaaccgacttaaatacgaatgaggtactaaaataccgataaaaacatcttcaatgtttataatagtaaagagagatagaaataaagatacttagcacaattatttgcttaatatttgattttcttttcctaaaaaaattatactttcggtcgttctatatctgttccaagatgttttgatttctgcaataatgtcgttctatatcggaagtatgtatttgttttgatttccttttatttttttttctcgttcacttagttttcattctcttcttccgtcttccgatgcgtggacgctgcatattggcaagacctccggtgaaaactcttcattcttaattgcatctgacggttcttgttattccgatgatgtggtttaatctgctaacgagaagaaacaaccaactcaacatgaaaaaaaaaattaaacccttacttgatctatacctaataaaaaaatacgtaaggcttccggtggtttttttcgtccgtcatcccacgttgctaaaatccgttttactccgcttaatagtcggatcggacttttctaatctactccaaaacctcggttgatatacaatatttaccgctcatgtagacaccaaccacaactagcagcttgcctacttggtcagtggagaaaatcttcaacccgccgaccacggttcgattcccaccagctctcc

SEQ ID NO: 45585 - DNA, 5278 bp, Oryza sativa
  unsure (1)..(5278): unsure at all n locations
nnnnnnnnnnnnnnnnnnnnnnnnnnnnnnnnnnnnnnnnnnnnnnnnnnnnnnnnnnnagacaccaaccacaactagcagcttgcctacttggtcagtggagaaaatcttcaacccgccgaccacggttcgattcccaccagctctcccttttagacctattactttgcctctatctctccgttttagacctattattactttgcctctatctctccattttagacctattattactttgcctctatcaggctagattgctcagaaatctcaaatcctattgctactttgcctcagaataagtctactttgcctcccacatctcaaatcctattattactttgcctctcctaggctaaattgctccgcaattttttttatccgccctactttgcctcccacatctcaaatcctattattactttggctctggctagattgttgtgcaatttttttctctctgccactagcacgttagtaattctgaaatcttataatgaaccagtttttaatttgaaaattaagcataattatttttttccttttgtcatctgcaaaatacgacatattagagtccgcaccatctatcgtccacgcatgagccgtgaaaacgattcgtctccacgcaagtccatgttcgattttagaaattatatcaggctcttaccatgcatccgatggctgaaaaatcaaaagttttgcccctctttcttcaatagatatttagtgattctgaaatcttataatgaaccagtttttaatttgaaaaataaacataattattttttttcctttcttcatttgcaaataacactatattacagtccgcaccatctatcgtccacgcatgagccatgaaaacgagtcatctccacgcaagcccatgttcgattttagaaattatatcatgctcttgccatgcaagagttgagagagagcgtgttacgataatatgagtatatcaatatgcaatagcgtttcttatcaatcctaattatcattaatccagtgaacaatttatctatcttagaacattattatatacatgtcaactgtgtatttatatcatttaatctgtcaatatacccgtagcgaagcacgggcattttgctataataataacaaagggattttggctggaaaaacaggaacccggaggctatgggccaaagtactgctaggaacttatgggccactttctctggtggaacctgagcccgtgctagtgttgcaccaaaaatgtctctcttctacagatgtggacaataagcacttggatcatctatgcaaccatttggatcccaagatagaaaatacaaaaagaaatttaaataattcaccgagtcttctcgctgctttgcatttgttgtggccttgtggggggttcttcatgcacacctaagtactctgaaactaattatctgcactcatctcaataaacatgttccttaaccgttctatcattaatcaccaaaactcatttagggggctagatgcactttcactattctcaacttgctttgcttgtatatcaagtgtgattgagtctcttgtctagtttttatcttgcttaattgctcgagtcttttgctatatgttgactagattgtcctagagcagtcggacaatatgagcccctttacaactttccgtttttcactctgaccggacaatccaccacattgccaaactctccgactgctcctatagttagactgtccaacctaatgtcagactatccggttaagctttattccactgcaaatttttgaatttccaggaatgcctattcactcttcctctagctctaggcgatgtatcccatcctcaaggccatttcaaggacaacatcgatggcagagatatcgatggcggtgaggtcggaggtggctagatctggtggcctctaacctccgaatggctggatccgatgaggaggagcgggtgttgcccggatgtgatatgcatcctggtccaattaggatgaggcatgtgtggcccatgaaagttgtgtgtgcatgtttggtaccacatttgctagtttagtaagggtgaaaccaagttataagggcatatttagtaccataagagtttttgtgaggcttttgtgacccataagagttgtgtgtgcatatttagtaccatattgctaatttagcaagggtagaacaaacttatattttcttttgtaccagtagtgatgagtcagtccattattgttgggtttttaaataaaccagcactgatattctaggtttttttaggacacgcgtgagttgggggtgggctcgaaacccttatcggtgcttggtttagtctaatcgacacaaataggggtggttatgatggctattctgtagtacactagtacataaatgcccttatgtgcctgttggaaactggttgtaggtgccgctgaatgatcgattaatcctatatatacatgcgatggtgaaaattgcagtgtagccaaatgattaatcctatatgtacatgcaggatgaagaaacacgtggatgaatacaaaactcataatttcaacattgggcagaagaacaattgtgagttgatgaagttaaaatatcgatcatgtaataaataattttagtctaaaaaatcatgacacattgatcaaatccatcaattgggctagggttgaaaagtatggaaggaatgggcttttggcccaaaaccaaggaatagttataattaactttttcaattatagtgtatagcaattttaatgttttaatttgttgctaaactcctaatagttgtaccattgaagaaatgcttttacccgttgcaacactcgtgtattttttctaagttaactttaaatgagtactatcacaaactctgaagttgttaccaggttcaaaattccggaataatactttcaaaaagtcatgaatttaggcccgccctatatgaaactatttcgccgaaattttcaggaatgttttttttttgtgaatttagccaaagtagtttttcaaatttaacaaaacttgttcaaaattcaaattattctgaaatttccacaattagtgaaatttcggttcaagcagagtctccagatatagaaagctccaaacagaaaaatctgaacctagcttggtcgttatcagcttataaccgccagtaatggtagctagtagtagcagctactcaaagaagcattgccgacgtgatgaagaccgtacgtgcgcgatccggtgatctctcacctcttcggcggcggcggagcgcactgtattgccgccgccggcgaccactccgtcgtctacgacttcgagctcgtcgtgtaggaggttggcgtcgagctcctcgccaatgcgctcgcagaggttgtgcagcacgcagcagacggccagcatgttggctagctccggcagcttcacctcggcacgccgcaggcactgccaccgcgccctgagccgccggaacgcgcccaccgccgccgcgcgcgcgtcggccacgtgcgcattgagcctgtcctgcgcccacgtctggttgggctgcgtgtacggcaccagcatccagctcgtcagcgggtagctcgcgccgccgacgagccacagcggctgttgccacccgagcttgtcgtggccgagcagaagcccagcctcgcaccgggcgtacagcgccgacttcgcgaggacggcggcgtcggagagcgagccggggtggccgatgcagacgtcggtgaaggcgccctcgtcgtccacgacggcctgcatggcgacggagtaggtggccttgttgttccggtcggtaaggcggtggtcgtagtactcgccggcgtgctccctcggcacgacgatgcggacactggtggagaaaccatctttcgtcggtcggactaattccacaatagtctcggttgcaacaaacaccgggactaaagatccccggttaaaaagggtaacgggcatcaccaaccgggactaaagatctttagtcctggtttaaatgctgtcagggcctgtcaggccctcccgggatatttagtcccggttggtatcgtaacattagtcggactaaagatcccagcgatctttagccccggttcataacaccaaccgggactaaaatcccacccctatatatatatatatgtcttcgtcctcctccagcccgagtaagcttcaaaatttcttcaaaaaagaggggaggtcatgccaaaatttctattgaatttattttggtgattatatataaatcggaggtgcctaaaaggttagcaacttcatcctccaatgttttatttttttcatattacatttggatcatgttttgcacacttttttgtcttcaaaattttattgttagttgatgagagagaaaatttgtgtggagaagaaagaatatatagaaatttagtttatttgttaaagaaggttttataaaatagttgagaaggaaaatatagtgaaagttaatcttgaataatagaaaacaaagtaaaatgaaaaattaaaataagtacaacacattaatattagtttaaaactttataaatagtaaatatataattattcggtgtaatatttcataattttgtatgaataatgatatgtcattattgtgttactgttgaaagagtttgtaattattttataattattgtatgactgtcattattgtacgaataattatgtgtgtacgattttttttcatgtcatgtagatggatcggcaatggatatacgctgactggcggtccaaagagtttattgacggcgtgcattattttttgagagtggccgaagctaacaggcaaaagggttttatttgttgtccatgcaataagtgtaagaatcggaaggagtattctgcatccaggactatttatttccacttgtttgagtcggggttcatgccaagctataattgttggacatcctacggagagcaaggtgttgaaatggaagaagatgaagtggaagacaacaatattccgaactttgctcagtacgctggatttgaaggaaatcaaacgggcaaggaggaaagggatgctgatggtaacaacgttgcggatgatcttggtcagatgttgcaggacagcaaggaggattgcgaaagtgaaaagggggcccataaattggacaagatgttagaggaccacagaacgtcgttgtacccaggttgcgagcaggggcacaaaaagttggataccactctggagttcttgcaatggaaggcaaaaaatggtgttagtgataaggcatttggcgatttattgaaacttgtcaagaacattcttccggagg

SEQ ID NO: 45586 - DNA, 10014 bp, Oryza sativa
tggaaaaaaaactctatattttgggagttaccctattgggaattcttggacgtccgccacgcaatcgacgtgatgcacctcactaagaatctttgcgtaaaccttcttctcttcctaggtatatatggaaagtcgaaagatacactggaagcacgtaatgatctgaagcatatggaacaacgcggtgaccttcacccggaaccaaaggagaaatgaagccattacttgagtccagccagctacactcttagcaaggcagagaaggaaagtatgtttgaatgcttggagagtatcaaggtaccgtctggatactccacgaatataaagcgaataataagcacgaaggagaagaagttcacaaatctaaagtctcatgactgtcacgtgctgatgacacagctgctaccagttgtaataaggggtatcctcccagacaatgtctgggcaacaataacaaagctatgtgctttcatgaacgcaatttcgcagaaggtcatcgatcctgatagattagaagccctgcagaatgatgcggtgcaatgtcttgtcagttttgagttgatatttccaccttcatttttcaatataatgatgcatctgctttgtcaccttgtcaaagagatcggtattctcggtcctgtgtacctacacaacatgtttcctttcaagaggtatatgggcgttctgaaaaagtatgttcgtaaccgtgctcgtccagaggcaagcatcgccaaggggtatggaacagaggaggttattgaattctacgtagaatttatcgaagaccttcgcccaatcagggtacctgaatcacgccatgaagggagactacggggaaaggggactcaagggagactacggggaaaggggactctcggaaggaaagcaataatgacggtagacaacaatttattccgtaaagcccatttcacggttctgcaacaatcttcattggtggctccctacatcgaggaacacttggctctaattcgcgccagaaacatcagtaagtccgatgcatggattacaaggcatcacattgatactttctccacgtggctgcgacaacatctcatgggtaacaagacgattaaccaacaactggccttcctggcgagggaaccatctggcttgatcacgacattccagggatatgaaatcaatgggtacacattctacacgagggcccaagacatgaagagcacgaaccagaacagtgctgttcgtatcgatgccatgggacacgatggtacaactggcacgtattactgtgccatcgaggacatatgggaacttgactatggacctctcaaggtccctctgttccggtgccaatgggttaggttgactggtggaggcgtaacgaatgatgacagtgggatgacaacggttgaccttaacaaggttggatactcggacgaaccttttgtccttgccaatgatgtaacccaagttttttacgtcaaggacatgtctagcaaggaaaaaaggctaaagggcttgacgagccgaagcgccacgtggttctcccaggaaaaagaaaaatcgtcggagtagaggacaagactgacgagaattacaatcagtttgatgggcaaccccctttcacggtgacgattgaccctagcatcctcctatcaaatgaagacaccccttactcacgtagccatcacaaggaaggaacaatagtgaggagaaagtacgtgcggtcaactgtcaccgctgatgtattgccgtaattgttctgtacacgatgtaaactatgttggatgtactgaatatccatacaaatcaattgttgtatggcatatgttaaatttgtatgattattagaatttttatcaaattgaaatcatccatatgctagttatatatgattattagattttttattaattatgtataattattagaattttaatcaaattgaaatcatccatatgctagttatatatgattattagaatttttaaaggttttaaatcatgcacgtggtatttacatatgttaattataattttcaacagtttaatatcatgatatgctagttatatatgattattagattttgtattaattttaaatcatgcatgtgctatttacatatgttaattagaatttttaaccatttaatatcatgcatatgctaattataaatgattattagaatttttaacaattttaaatcattcatgtgcttattatatattatccacgtattctagtacatacaataataatttttcgaaggttttatcattaattgttcgactttaaataattgtaatgcattatttactattttagaaacacatatgcaatgaaattcaagacacagctgctattatctttagtcccagttcctaaccctaaccgggtttaaaaagaatttgaaaatagcgggaaaagatctttagtcccaattggtgagaacaaccgggagtaaagatcttttatttagtctcggttgttgttacgaaccgggagtaaagatatttttactcccggttggtctcaccaactgggactaaagatccgggggtatatatattgccggtgcgccctcgtcttctccaccaacacttagacgtttttcaatcttggctcgatctccttcgccgccaccgtgcctagggcaaccctgcgccgacaccgccgtcgtctctcgccgtcgcttggcggtcctcgccgcctctgccgcagacgccgccaccgcatctcttgggtgagagccgccgctgcctctctctctctcgatctcgatctcgatatctctctctctccacggccgacgaccggcttcgacgcggcggccgtcgccgccgacgccgtcgccactgccattccgccgcccccgcctcgagctcgccacgccgctgcgccacgccacgggactgctacgccacgccgccgcgacgccacgccgtcgccactgtcgccgcgatgccacggcgcggccaccgcgccgccacgccactgctgcgcgcgcccaacagtgccgaacgttaacgaacgtgattgaaacgtgaccgaacgcgaacaaacgtaacgaaacgttaacgaatgcgaatgcaaacgttaacgaacgcgaacgaacgtgaacgaaacgttaacgaacgcgaacgagcgtaacaaaacgcgaacgaacgtaacgaaacgttaatgaacgcgaacgaacgtgcacgaaacgttaacgaacgcgaacgaacgtgaacaaaacgattacggaacgcgaacgaacgtgcacgaaacacttacgaatgtgaatgcacttgtactaaaagtgtgagaacgaacgcgtttatactaatacgatttactggtaatacatatatgattatatatgtaacttggcccgtttagactaatacattttcctggtaatgttgcagagaagacgtcgttatcgtaccttaagccaaagtggtagctagccatcgaaggaattcgcgcaggcaagtgatgtaaagaagtgattgttagatatttaatataagacggttagacttagcatacatgattattacaattttaatataagattgttatcgatttaatataatattgttagacttagcatatatgagtgttagagatttaatataatattgttagacttagcatatatatatatatgactattacaattttaatataagattagtagcgatttaatatgagattagtagagatttaatataagattgttatacttagcatatatatatgattattacaattttaatatgagattagtagccatttaatataagattgttagacttagcatatatatatatatgattattacaattttaatataagattagccgcgatttaatatgagattaatagagatttaatataagattagtagcgatttaatataatattgttatacttagcatatatatatgattattacaattttaatatgagattagtatccatttaatataagattgttagacttagcatatatatatatatatgattattacaattttaatataagattagccgcgatttattatgagattagtagagatttaatataagattagtagcgatttaatataagattgttatacttagcatacatatatgattattacaattttaatatgagattagtagtgatttaatataagattgttagacttagcatacatgattattacaattttaatataagattattagagattaaatataagattgttagagatttaatataagattgttagacttagcatatatatatgattattacaattttaatatgagattagtagccatttaatataagattattagagatttaatataagattagcagagttttaatattacggtacgcaaatacatcctatatacctaacaaatattttttgtttgcacagatggctgatcgcgatgaggaacagatactatacgacacaatcgcagagggaagcagccaatactggaacgaaggagaggggaacgaggatccaaaccagtacttgaacgaggagaggaacgtggagagggatgcggaggggaacgaggaggggaacgatgaggaggaggctagtggaagtcttccctccgctggacagaagagggcacgcggacaacgaggtgccgcgaagaagatagagggtcagcacatcataactgaggtggaccaagaattttgtacgccacagcggttgggttgtgagggacaacgtgcctgtcagcatggtgtactggcacaaaacaagggcacacggggataatgacagctttgtcccggactcggagaaagagatgctgtggaccacaatgctcgagacgttcacactacccgcgggtacggagaacatagtgaaacagtggactctgtagaaaatagcataacagtttcagagcttcaagggagatctctacaagaaatacatcctgaagggactaacaccgaacttcgacgtattcccaaagctaagggatcattgggacgagttcgttgcttacaagacagggcaacaagggcaagcgatgatggccagaaacaaagacaatgccgccaagaagaagtaccatcaccacttggggtcaggcggatatagcgtcgcaatgccgaactgggaggagatggaggcaagtttgattgagaggggtatcaaaccggccaccgctaaatggccggatcgatcgaagttttggtactatgctcacggtggaacgcttaacccagttgatggctcccttgtcttcagcgatcagatacgcgaggctgccagtcgactaacggacgcagtggtagactcttctcagggcacattccgacccgacagaaagaaggatgagctgtcactcgccctatagactcccgagcatccagggcgaacatgagggaaaggcgtgattccctggaagattggatttaaggaggacatccacacgtacaggagtcggatgaggagcaagagagataccgaggcgaagattgcaaatcttgagtacagggtatcgagctacgagctcagcatgcaagaggaggtggcaaggaaggtggatgaacgtatggccgcacatcggtcccaggatccccagccgtacattcatcctgcaatggtcagcccatcaggcaatcgtagcagctgcgcctcaacggggcaggtcggatcacagagcatggacgccatgcaaacccaggacgaaaccacctgccccgttgatgagatcacgcagcggacaccatgtgagctgtatattcccttgaagaacttatcaatcaaggtatgctcgtattttaatgatttttgacttgtacattccgcaagttgctgcttaagttgattactaatagataacctctcatcacgtgaaagtggcgtcgggaatggccatcccaacggacccttccgggacttaccactgcaggccgattccagcaggatactcgagggtcgaagttgagctggtggaagccgcgtacgaggatctcgagttggactacccaggaggagacggtgagacgcatctacgagacacaagccacgccatcatactatggcgcaagcggtacatcatccttcctgggctacaagcggcgtctcgtgcaccatctcctccggctccgccatcttctcctgcaccatctcctccggttcctccgccacgtcctcctgcaccatctcctccggctcctccgccacctcctactgcaccatctcctctggctcctccgcctccaccgtgtccgcctgcacctcccaagacaaggtctcgccaagctccaccgcctgcctgcacaagggcaacgaagaaggcgaaagttgacgccaccaaaaacaaggagccatcgtacgattgcagtcaagaggagcttgatgcttatgtggcaggagaggtgaagaggcaactcaagcctcggagtcctgaaaagaatatacctattgacccgagcgtgaagaacttcttcaagggaatgtccacaacaaacgaggcgttacagatatcggactatgaccaaacacttcagagagcctatcacaagaagtccaaaccagtccctcagcttggagaacaaccaaaccaagaggttgggccattggtgaccggcgaagattttggcataacggaattcatttcagacaccggtctaactgtggatcagttggttggaggcgcaccaatcccgaaggcggaagtggcatacaagtttgaactcggtaaaccgcttgtcaaacctgaacagctgcagtccctaccgacacagatgtacaaattccatgaacggtacatggaaatgagcgccaagggtagagagatgttcggagcgaggatcagaaaccccgacttcttgcaatgggaagatctctggatccatttcaaggatctcttcgatctgtaccagttggacgccctcgacatctctcttctgagggcatggattttgtgagtatttttgagttcgatttgtttcgttcaataattagctcctggcatatatgtaagcaataatactttcctttcatcgttgtagaatggagattcaaagggcccgacggcggagggtctacgatactgggttcatcgacccttggaaaatcaacaccgaaatgatcgacaagtacgagaaagacacagaggacaatctcatccatctcctaacgcagtagcatttcaagacgtacatactactgccgtacaacacagagtgagtttttattgtcgttcgaacaaattttgttcccatacatatagcatgtacattttcgatcatatatatctcatctcacgcatattccaaattccattgggtcctgttattcttcgacttggacgcatgcagagctatgtacgactcaatgaataaagaggagaagatttttgacaaggtcttcaaactgatagacatgtaatataatgccatctattccaaagtcacggggaatctattgctattatgttgatctcaggtaataattaattaatcatagcttgcaactgcatatgtagggcttgggatcggttccgtcaattggtccgcgggacttggaaagaaaaacttggacggaggtttcattttccagtgagtacatgcatgatccaaaattatattgaattgaatatctaattacagttaatataaatagtatattaaatctctcatcgtttctcatgtagtgtgcaaagcaggaccagggaactaacttatgcggctactacgtatgcgagtatgcccactgcctattaaaccaaatatgcacaacacgagagctcgatgtacgtatacataaaccattcaaaatttcattgctcgatttgttacgttgtttattaatttcatatattgatacgtcattatttttcgaacgatagcgtattcacatgagggataatctcccacacaaggattttatcacggctgttcaagaacaactgatgggattcatcaacgaagaagtccttaatcccgacggtgaattctactatgacggatcgacaattcataacgtcggtccttcctcttctgacataacgccggcgtcgaagtcgtagttatagctaccaagcaaatgaattgtactatatatgcatgtatatatatatttatatatgtacacatttacttttgtgttaatatatattttggtaacatatatatatgcacataaaatgttaagtgctttaaattatacatatgtgtgtgtaatatatgatttatacacacacacacacatatatatatatatatatataaaatcaaccatgcagcaaacagggccatgcaaataaaaaaaaatggtgcaccaatctttagtcccagttggtaacacaaaccgggactaaagatggtttggccggccacgtggctaatcgatctttagtcccggttggtaacacaaaccgggactaaagatcgatctttagtcccggttatttcacccgggactaaagataactatctttagtcccggattcgtagtctcggttggacaaccgggactaaaggggggttaccaaccgggactacaaacggtttctccaccagtgggaagtgcttggtgtacacggtgccgacgactccggggatcccggacaaggcctcgaacatggacgcggaggcggcgtgggagtccggccaccggacaaccctggtgaggaggacggtggtgatggcggcgcagacctggacgatgatgttgtggcaggtagagatgccgagccgaagcggcgggacacctcgcggagtgggtcgccggtggcgaggcgccagatgcagacggtgacgcgctggggcacagggatggcggtgcgcagcgtggtgtcctccttggtgacagcggcagccaggtcgtcgcagagcttgtcgaacaccgcgcgcggcatgcggaaggctcgccggaagtccgcctccgggcacgccaccgggtccctcatgcggtcccaccattccgtgctccgctcccgcacccacacccgccggccacctggcctttccgccgtcggctcactcccctcgccgccgctgccatcgcagttggacagtgagctcgaattccttggcgccttcttcctcctcttagatgaccgggacacgacacccatggcctcgccgtcgtcggcatggaaactccgcttcccactggcatctcctccgcctgccaccacctccaccgacaccggcggctggtcagcaagaaagtcaccgtccatgaggaggaagtcgtcagcggcgagcatggatgtgtactcaaaatcagcatcatcggggatctcaaagagaggagtggagaagggctcgagctcgaggaaggcgttcatggcgatgggagaatactcaacattcaacaacgagtgattgtgtgggcaaatggccagctgatgatcaggcctttatatatacgtattgggttgtgtaaactgaggcagaatctgagacggagggaatagttgggttattgtatgtcatctaactgcttatgaaattttttttttaaaaaaaataacaagatagattaatatatgataggccactccacaaatatgcaagttaaaatttaactcttacaagttaaaaagaattaaattatgactagttaacatatattcacagtcaaatttgttattttgttgcaacttgtcgaagttaaaattagctttgtatgtttgtgaattgatttatcacatattaatctatcttgttaaatattcttaattttttatcatcattagctagatgacatgtaaataacgagtagatataagtttagtatagcttaagcccaatggctgcttggcgcgcggtatagtactatactgagaaaatagctaagatgagcagggctgtttcacatgtgggcactgcacacgcaacgcggcccacctcgtacgtctagccacgtgtctctcggtgattcgttcacagagttggttacgccttttcttgttacttttggtggggaaagggttgtttgatcgttagggcattcacagtgcaaggacgtacgtggcgctcagcccaatggtaagaaaccg

SEQ ID NO: 45587 - DNA, 14663 bp, Oryza sativa
  unsure (1)..(14663): unsure at all n locations
aactgctacaaaacccctcatagatatcggttcataggtaaattcgacacctatgaacctcttcccacctccgtgtaatgagaaaaaaaatataaaaccaacacctatgtaccttttttttaaaaaaaaccgtcacctataacatattataggtaccggttaattaaaactgatacctataatatattatagatgccgattttttaaagaaccaacacccatacaaaactgagccgaccactcagtataaattcgagatcaagcctcctcattcctatcctagtgtccttgtccaatccccccttctctcgtcctcaccccctctccatcctcttatccactatgtcgccttcctctcaagcttgcggggccagctagctttaaggggcgggggggggggggggggctcgatcaatatgacggctattttagagtgcagcaccgccatcgctgaagccaccgaatcgggagctcctctcctctctccttctctaagtcctcctctccatccgccacccctccttctcctcttgaccctcccctcccccctcctcctttccatccggtgacagtggcagtggtggacaaggccggcgtgaaatggtgagctgtatggaaaaatttttctgtataagagtttcttaattaataaatcaaataagatttattttttaagttaatacttagtcatattctaatattctaatagatctcctcgttttccatgccaacattatatcagctcattctatcctctcgggcacgtacagccttcatctctagccctctcccataggaactgaaccaagagcgcgctacaagacggggaacctggaggcagcagtgatgctttagaaaattattcaccaaaaaatatgttgacatcgtaccaaccatagagtaaatttagaaactagcctgcacctatgctataaacagtcacagagccaatggcatgattgtatatatatcccataaaaactaacctagaactggatgtgagatattctaatactacaaatctagctagatatacatctgtttaaatttattgtactagaatacatcataagattcgtttgtttaggcggagggagtatgtctggacgagtaagagtatttcgcggtggccgaacactttttacaagcatcaatctcattcgacaatgagacgcgccagcagctcatacagctgcccgatcgaccagcccagaaactaagctctactaatcttgtggatcacctttcgtaactctctgttggaaatatataatgcaaaatgtcacgagcacaaatataacgcatatgcccgtactagaaaatccatttttccagacgattgtacttttttccaggcgagtagtcctcttggagctaaatgaccgcccgcgaaaataacaaccgtgggggaaatcgttatccacctgcgaaaataccacttaagcggtcgacctgcgaaaatacctttatttttgcaggcggacttcttaactggtccacctgcgaaaattggcgtggcatataaatagacgtgggagagacaagattttttctaagtcttggctctcctctcctcagccgtggaggggaagggaagtggcggcgctccactgccgtgggcagttcggcggcgagggcggcgggatgtggcgacggtgacgcgcgggatcggcggatcggcgacgacaaggcgcgggggcagcaggatcccgcgacggtgacgtgcaggggcggcgggatccggtgacggcgacgcgcgggggcagcggcatccacccccggcgcggctcccctcccctccctctagatccgaccgaagacggtggtggcggcggcggttcggtacccaccccgagcggcagcagcgcacctgcagcggccacccttaccttcccttcctctccctctccctctccctcccaaaactctaaccttagatcagccggaggtgggtaggggcgcgggtgggggtggaggcgattttttttttgttcctcgagagcatcttcccaggtgggtgactggaaagtatacgaaaatcgatttttgcaggcctttgcatacaggtggacctttcctccacctgaaaaaatgatttttgatcgcctgaaaaaacgatttttctacaagtgtgtgagcatcaacagaattttacagatcagaagtttaataaacatgccgccagatctgcaaaagttggcggagagacatgcattatcatttaaacctttttgcatacaaatttattacgagctctggtatcttgtttcacagagggttctttataaagtccaagctttgaaaatttattggaaattcatattaggtttgattgaggtaaatcaaagtttcctgagatccttataatagtttctttaatatgacttagtaaatgaataggtcaatttttttagtatttttatcactagtgtcaacttacataaaaatcgttttttcgatgtttctcttaagaatactgtcctaacataaaaaaaacataatatttcatataaagtacgataatgataaaatttatatgaaaattgtagttctcaatgagctagctttgtagtcgaattggttttattttagatcgtttagggtcccaaatgttcgttacaagctgcgagatctattttagaaaattcttgagtttgagtttttcaaacgagctggattgagatatcctttggacgaaagaagatttaagtagatgactttttcatttgttgtcattaagagctcaaattatgtgttacaagtgttttagagagttcaagttaaaaaaaaatagcatctattacataattataaattgattcataggtgggataataaagatgttacgcgaggagtgggaggtacggtcctggttcaaatcctatataccgcacgaacacatttttcagtttaatgtttgcaactaagaaaaataaaaaattcaaaaaatgtattttcgcgggcatctccggtcctcttccataggaactgaagcaagagcgtgccacaaagatcttgaaggagcactgcaagcagcagtggccgtgagaacccacgctatatatgacactatttcagtacattattgatcaagatatttcgccatcatgtccagacataggcaatcagcattgacgtactagtgatgaaaaatggaagaaggtaatcgttcgcaaggaccaacttgtattcgtaccttcgttaaacaatagttgtactctcgtaaattgtaatcaactttcttttccataaaaggtaatagtaaattttataccatatatatttagagacaaatgtcacagggtcgcatcaatttttaatattctttttcacttaattaaccctacggttacaattattgtccgtaaccatgatgttaaaataatgaagaaaatacttattgttaccccatcgcatattagttgttgttataccttatatagcatagattatgttatgagaaaaaagtccatactatccttattaaatgatgtatgtgtggtcgtgggagaatagttgagggtataaaaaaagagaaatttgaattaaaagtgattgattggataagtaaattgtgataactattttgggacaaagtttaaatcataaagagataactaatttgggatgaaaatagtacattagtttctaccaggggcggagacagccaaattaaaaagacgccagggtcaatgtaaactagtatttgcaataccgattaaaaaaaccatgaaaaccgcttggttttttcaatccgctagttttgaatccttttcttatatagagttgacgaaaaaaatcttcgaaagtttattagttttaaatatttgttctaagctacacgaaaatcattgatttttactagccaacaaaccttatgaatcagagaggggaaaaactttatcaaaaaatgataacataaatacgtcttaagacttgcatgtaatctctccatcccaaaatataaaggattttagttagatgaatcatattctactagtatgaacttagacagagaaggagggagtagcatctaataatgtatatataaaatattgagaagaatgtactgatccattacaagtttgcttcctgccaatttagtaaaaacaaaaagttaaaagatacggagtactagtgaagaagatattcatatgggctgtgaacaacagatatcggttcctaatttcgttacttgaagttgtgctgaaaggaacattgaacctaagctgcatatactttgccatgtgatttcaaagggacctgtcggcttgtgggccttgtctagttcacgtgggcaatcaggctaatgggcttgcaaaccagccggctaatcacaaagatttaacggaactgctagccgactgtcaaattttttagccattgattccgctttaagatttatgctgagatattttacgatcggatctaaatcctcttttcacaaactagtcatatcatcacatgtttatggcagatttgttcaagttatatctaagttgcattctagttacatgctagttacattctagttacactataattacattgtaactatatacagtgtaactacactataactacattgttatctctatataaattagatataaagttacatatattattttaatacatatatacaagttattattattatagtatagttctagtgaaattatatactatatttagatttgaaagttttcctctcaagaaaacactcgacagttttttagctagtcccaagatttaattagtagttgtgctcatacaagatgatcagatgggctgggtttaaatcaacaattttgccggggtcacattcaactacaccataggtatcaagtggaatttagctccggccatcggtgtcctaggaccccggtgcaacaacggtagctccgtccctggtttctacatatgttgtattctgaaatttactccgaaaaaaatttgtgaaatcacatctatctacaacatgtgtttcttttagactaacatgtgccacatgaaagcaacaattccactattcagctacatgaaaatagtccgaattaccttccgaactattagacagtatgaattaccctcgaaccacaaaaccagacattttaaacctcaaactattgatactggatgaattatcccccccactctatccagagagattttggtcctacgtagcatacacatggtgtcaacgtgtcaatccaatcagaaaaggaataaaaaaccataaccccccacttgtcatatacctcacctgtctcttttttctctctatcggctcttggcgcttgggaatgaggcgggcatgggggtggcaggcaccaatgaaatagcgttgcaggcacgacagcagccgagagggcactacgggcatgggtgggaaggacggcatgggcggtctgcacatgcgagtagggcagtggagatggcgggcagcggcacagtagggagaacattatgggcgacgaacataggtgaggaggacgctagagactgtgggatgtgaagaggcgggcagcagcaagcatggctgaaggcggcgggaaggcactcctcgaggaggaccttgtaggacgctcctcgaggagtgtggctcaagcttgctcaggggacatccgtggaggcggtgactcgtccaacattatggtctggtacatcgaagcttggggcggcagctcgtcgaagctttggggtgatgaagcacggatttacccgatgggtaacgggtggcagggaggcagcaccgatcactggtcttcagtgtcgaggtcgcactgctctaatggttgttgcaccacccaaaagccaagttcccgccgtgtcttgccccctcccaatccaagctcatccagccaatatctcttaggcatccccatcgccgcgagtagatgcatggccaccaacgaagaagcaaggaggagatggtggagaggccgccagccggccggcgctaataggagcagaataaggaggtgtgttagacgtggagagaggggagaagaagaggaaagattgacaggtggggctggaccattttattttttaggccttttaaaaacttacttttacaaatagactttaaaaaaacttatttcagtaatggaccattttcccgatcctagggtcattagcaccgaggttcaatgtttcaaggccaaattgatgtgaaaagggttcacgccaaagagactaatgctcatgatatatttcaaaaataaattatatggaaatggttaaaatataaatatttttttaccataaaagggctctcggagctagccttttggcacgtagggtctattttgtaagaaaaaaaaattatattttgacatattctatataatttttttacagataggtctctttgtcaccaacccatctacttctnccctggtccaggggcgaggagtcagtgttagtgtcatcaatgctcagacctgggacatggtgaaaggtcactggcaactaggaaaatatcattcctaaaataagattgtataggggtttatttataaaataagtttttaaaaagaaccaaaatattaaaaaattatagcttaacggggggataaggatcgattacagtcgaatgaactctactggttacaactttatcttgttcgattttcttcggaaaatggaaggagctctactggtcactgtcgaagtcgctgtatgcctcttctccgcatacagagtatctctttttctcgcaacattgtcccaattccttgcaccacacgtcacttgaatagaatttggcaagtgtatgtaaattaattaaaccggcttgtagggctttaaaaattaacttgtggaagatataaagaagtgtgaaaaaaataaataaaagaactatatagactccctccatccctagaaagtataacggaattgctagaaaacttctgtaagttttttgctcctaaaacattcagatttatggccatcggtttgtctcaagatttgtgcaagaagaaaaatattgctagaaagaaatttttacacatgtcatgcgtaagatcattccttaaaaaaatagccagccaaaccatagttaaatataatttttatataagttatatcattccttaaaaaaataaattatatcgtaattatagtatagttatgatgcagttacagtgtaataacattcagttatactgtagttactaataacatatgcgtgcggcagttttttaagatactcccaaaatatagtcctagctaggctgtagctacatagaacagaacagtgttttataatgacatggaccgttgctttttgatccatcatgagtgcatcaccatcagccaaccggccgcgactgctggctagctggtgcatggatctcaatcctaggttgcagcttggctccagttggacttcatttctccaaagtattgatacaaaatcccgcagtaacgcgtggggttttaactagtttaaattatttataagtcatggtcaggttgatcgtacatagtttcttattcaccttttcttttttttctcctgaggctaatcaatctattcgaacagggatatggatacttggcttgcattgtgacaaattaacaacaatcttatcgcccacatgcataccaattaactaattaattaatcaattaagtgtgtccatcattagtctgtgagattgttggaacttcttgttttgcatcactcatatttgtaactggatataaaataaggagatgcatggatatttaaagatcgatacatgccagagaaaaacagtgaagtatataaaagaaggaatgtttagttgtttacgtgtacaaaggagtatacatcaggattagatgaatggatggaccttttacagtgaaagcatcagaaattgcttgaatgcagtaaagcatattcagctacatgaaagatggaccacgtcgtatgtacatgcaattgcctaatgcagatgccattgcttcatcgcttgctgcagcattgtatgttatagaggacttctatggcatgatacagatctgcaaacggtgcagcacgcgctgttgttggctaccggcaacacatggtcgctgagtgaaatttcgatgattatagctcattgatgatatcgcgtcgacggctagggatttaatttagggactaactaatttggattgagttaagcgtattgaaaactaactctaactgtttctacttgtgattaaaactaatccactttttcggataaaaataaatctagtccgttattttgttttcatcgaatgctggttgaagtccattaatctgcatgtactccggtgcgtaaaaaaaaatacaaggacttgacattagatgggctttgttccacctgattaaaagcatgttagatcgacgatcatgattatatcatctgtctaattaatggttagatttctctggttaatgtaagagctcgtagaaagtgcccaattagtataggtatagattagagctgcggttttgaagcttagttctaaacttctaatgtgttcttggctttagtttttcattaattgggtataaacaaggcaagcaattagcatataattaaattggttttaatatatcttctattatatactaactttctataaacacttctaaactgacatcatacacaatcgtttttcttattatagtctcttatataacgaatagagcgagatactacttcttttaatattcttttttaaacaataaataagatgccgtgtatttgcgtgaatttcctttctcgttgttataaacatgaaacatatatgtttattagattttataaacaaagttcaatatatataaaaagttttttttgcaaaaaaaactaacatttaatagtgtgggaggtgttctcacaataaacgacaaaacgaacgaacgcataagagctgcggtttacagcttttatattgtcccaatatgcactctgtttcgcttatgcgtaagaacatgacacctactgtaggtggtgtcatgtacaaaacgatggctctctcgttgttccggatgtgtccccctacctataaatgacctaatacactgtatgttctcgtttgatttcttctattgaaaactagcacaagaaaatgtacacatggaagagatatttctcgtataagttcgtggcatgcattagcttggtcgtcgatcatgtgttggtgttaataaggaaattgttaacaaaaacagttctggctagttggctctacagtttttcactaatagagaaacgatttcctactaccagactaccagacccataaatcttgagaacttttacgatacattctactgctagtatatatttggtatttgttaaaaatctgaaaagggttgtttagccatttataaaatagatattgttttagtttttttatcacaaatagagattaactttcccgtggtttttttttccctggatatcgtcatcctcgtcttcctggcgaccccagcgacgtcgctcccaccccggcgcatctctgttgttgtacctctgttgtgctaaagccatgacagtgctttcttccatcggcagcttcggtatagggcttgttcacgccgtggcatagctatggccagagccatagcattcaacaagagggtctgctctgcgacagccatgccctgctgctgctgcggcatgctgccctcttgctgctgcgccatgctgctctgccgctgccacctaccgccggccggcttcccttgtcgctgcggcaggcaaggtccctagcaagcgtcgccctcccgtagacccagcagcccgcgccgattttggctcccagtggcagcggtgattgtggctgtcggcggcgggggcggcgccgacagaagccagtggcggcggtcgcccatgcgagcggagcagattcggtttagactctgtatggtcaaacggatctgactaagtgagatagcatgaatttaccaaaataccccccaacgcaaaaagatagaaagacaaatataccctattcaatttatactgcagcataattggaaggaaaatcagataaatttacaccgtcagatcaaatatactgctagtatatactagcagtagaatgtaccgtaaaagtcctctaaatctttgcaggtgggtcttatttttggctgcggttgcttgcatgcgtagatgtgggagaggagaccgatggccagccgcatgccgagatcaatttttgtagtgcggatggcttaagggggcccatctgcgataatatctcttctcttcacagtcgagcctctttagacctgcttgtgaaaatcgatttttataatcgcgatggcaggagcaccgattgtgttaatagtgagggtgttaaaatagaatatgctgatcaagccagccaagaggaaaccaaggaaacacctcaagtccctgatatcatccctccttgctccctgaaaattttggtttttaaatacggaattaaaaattcggaataaccaaaaaatattttgaacttccttgcatactggaatttattgtattttatttcccgttttcttgttatgcatggactaaaggagtgtattttgatttcaaatattatttacttaaagaaccatgattatgaaatatattaatactagttattttctgtcacgtcctgataaattcatcccgaattaaaaatcattctctaaaaggaataatagaattaattaaaattcgaaaagaaattggcaaacactaaaatatgtacaagaaaaattcaaatgtgacccggagaatttttgttaaattctccttggtctaaaaggagccctcaaattttagtggaattttcagagcacaaataataattattaagaaataaacaaagttgaaaaggttttataaaaagaaaaccctaaaagaagtcttcttttccccccttcccttcttgggccggctaggcccacttctctccctctctctcctctcccccgcggcccatcggcctcccccgcgcgcgcgccgctgacaggcgggcccgcccgccgccctcgctgacgggtggggcccacctgtcatcgccttcctcccgccgctcccgccgctcgcccgtgccctagcgccgccgccgccgccgaatccgccgcatcccgccgtccccgcgcgccataatgaggggggaatcattccccgcgattccctctcccgattcccccgcttttccctctctctctccctcggattcgttcggagttaatcccgcaagtttcgccggcgtcttcaagggcggccgagatctccgcggccgattcctccccctccggccgtcctctctctctcccggcgctatataagcgttccccgtgctctcctcctccgtttccgccactcgccgcctctcctccccgtcggaatcgagcccgcaccgtcgcaccttctctccgccgtcgccgccgagctccggttcgccgccgtcgtcgctccggacctcctccccactcggcgtcacctccttcggcttcgccgcgtcgtcgtcgaccccgtccgctcctccgatttgctcgccgaccgccggagcaccgtcgccctcgccgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccgatccaccgtggaccgagaggctgacgcgtgggccccactcccgtggacccggtccgcgcgccctctccctcggctgacgcaataaatgagatttttaattaaaatttaaatgaagaaattcgtaaatatccatttaaagagcatataaacttcaaatggccatatttggccatttgaactcggaattggaccgttcaagtctctaatttttccttaagaagtcaagaacccatttttgtgctttgtttctgctgttatttggagtttattagagtaaaagccttttcttttccgttggtcgtgtagacgctgcagcttcggaagatccgctcttcgtggaagttgaagccggcgtttgggaaagcgagcaaggcaagtcacatcatccttgatcatattgaatcccagtttgtaaaattatgttgatttaaattattgcattaccgctttatttaaattcccgcgttatcactgttttatctagccatacctatttacctttgttatgaccttattattattgttattgttattattactttgttcaccctaggttaaacaaaaccccaactagtgagtactctattcatggttccactagtataaatttaggtagatgcttcgctgattaattaggcaacattaggtggttttataactttagactttgggaattctcatatcatttggacactatggaatggttggcttatgttggaattggacacacacctccccctcttttcaaaacccccaaaatggtttaggctgggctcgaggtgcgtggttgggttttgttagtcgtacctcgggtactataaggattaagcttgggcctctgttgcaaagcactaccgtacttccacatgtctagtgggtaaggcttagtttgtggctcagcctggttataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgtttcaaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaaggctgttactgcaaaacttaacccctatattattacccccttgtactcctttgcattaattgtgcatctccggtgtggcttgctgagtactgtggttgtactcattcttgctctatctttctcccctcttcagtaagagaagctttggagaagatgtcttaggtggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgtcctttatatcatgtttgtgtggtgtaccccggcttttcctgggacggggattaatacactggcgttcgggaaaaaggcaattttcccggtcgcgacattttcctaaaaaccgttctctatataatagaacccctctgacatatttgctctgtaaaaaaaattgtatactactattatgaatgaacactacgggataattcattagaacgaaaactattttacaaagggaatgtgattccgattattttctaaagaataacagctattaaaaactattttacgggataattcctgaaggctattttaaaaagaaacggcattctcagataaagtctggttttcctatggaaaggcctagcctgatttgcataataggaggatttgttatttatttgtgtgtgcttaggtactgtgccaaaagatttctattaaattcttttccctaaatgggctgtcttctgttcgacatccttccgtttccttatcatctctgacagttgattaagcgcttcggtgcgaaattaatcaccactactacaaaaatcgtttttctgtacgagggggtcggtaggttccatgcgggccgcttgtggcggcgcctgcaaaaaccgcccccccggggcgggttgattagccgcatgcgaagatccattatcgcatgcggctggttaagacagccgcatgcgataataggtctattttcgcatgcggctggcttaagggaccgcatgcgatgatcggccatatatgctcctccaggcccgagcttgaccatttgaaaacgaagctttctctctcctaaagcaagcaccaattagggggggaggttttcaactcgaaatttttacttgaactctatacgaaaggtgaagaactctctatcttgcttcatttggctccatttttgttatatttcgttggtggaaagtggagtttttttaatattttgacaaggtttgttccaactatttt

SEQ ID NO: 45588 - DNA, 22313 bp, Oryza sativa
gcgctagagttggtttattacatgtgtatctcatgtggccagcatgactcacacacccaacttgtagcatatccagatgtccgtttgcaatcatgtcgtgtgattaagccgacaacgttcacgaggaattatccgttaacaaccttttctcaaatagtctagccacggccggtgctattagataggtcgtcggtcttcgttggtagattgggggaaacaactctgcatttgtcgagatcattctcgataatgcggtgtacttgaccacaacctactcgagtgctcaattgttcctgaaaaatattttctagaagacaagatatatagcagataatatcgaatatgtactcaaaaaaactgcatggatcttctagcattatcaggatataacgagcagattaaatatcagggcattatgtaaactgtaaacaagcatgatttatacagaagaagatagagcgagccccagcgttagatcgtagtcgatttaacatcggggacacccgcgcaacagatattgtataaaaaaatatgctctaggtaaacataataaattatagatctgataatatcgtatagatcggaaaagtaggtatggtaaattgtgtataaaatattgcgtacctttgcagatatatgccggatgtatctacggaattagtagaccaatttaaaaattaatcttactaattaccttgggagacatggagtatgtgtcatcaaaatacatataggagctctgttcggccaatatacatgcacgtgcgcacatgggtgttggctcggtaaagggacatgcagggtgacgtcaggctgtcgaccagtagatcgtggctagaaatcgtgtcctagttagaacacggtagtactaatccagcggtagatttttggctcctcgacgtgcttggttggttggtagggatcggtgtcgggttcgacttggactcagccggccgataccttgcaccagttgatgtcgcacacgtcgagaatttaatgttggatcatgccgacaccatgccgacaccatggcaacacgtcgaagcttggttgatctcgagagatcaaataattggtgactatggttccgctcttgtcgaaagacatattccggtcaggttagatctccccatagccaaagtcgtcgagtagcttattgttggagaatctatctcttaaacccatctcattgaaatcctgaagcaccaaaatcctcctacctggtacgccactgtcgacatttgatgtcgcgattctggtatttacatggtatggggatcgttggtactagggtatacgcgagactgaggtaaaagagatggagacggagatttttatacatgcctttttatacaggttcgggcccctgaattatcaggtaataaccctacatcatgttggccgaagccgttgttgctctttattcatctagatcacacaagtacaatatgtggggtagcctatctaactgttgtcgacatggcggtctgaaggtctgactcgtagtcgataacagggtagtcttcctcctcgagttcgtgcccggcgagatcagagatagcgctttcgtctctcctgacagtatctggagacaccgtaggggactagccgtgcctatccctgaagtcgatatccggcgtcttgtcctgtcgtatgttggcttgtatgttgtggcttctgttgttccgtctatggtgggcgttggttgtgtcccctctcctcctagggagccttgtatttatacacataggtgtccccttgtccaagtagaactaaggaaaccaatatggatacaatccgagtagttcttgtcatttctatgtagaactctggttgtctttccttatccagaactcctcctatatccgcaggttgtttccgtataggacatggtatgtggtgggtcctgccgagatttagtcaactactattaggtacgtggtatccataaccttgacaaagatcaggtacggcctatattatatactatttaatctgtaaaacaaattcatctgacaaaataaaagatactcttaatttgattatctaattatatatgtgttacttagtttgtattaaaaaaaattgatgagctttagatcatctccaacatagagaaaaaacgagttccaatagactctccatccgaatggctaaacgtagccagcctcttccattggccaaaggtgggtcccaccatctctcccatcccttcttccggctccccgcccccccccctctctcttgctctctctctctctcgccatgtactggcccccacccgcaagcagtgatgacaccgacggtggcggatcaattggtggtgacggcactgatggtggagcaaggagttgtagcagtggtggcggagcaagcaacgacgatgatagggcagggatggatcggagggcctgctgacctttagcggcggtgtcgacgaggtcagaccggtcactggtgatgaatacgttctggctgcgctttcggcttcatcacagtctctctcatgactcatcatttggagtctcgccatccaccacaactgcactgttgttgctcgtcgcggtctccaccgtctctgtccttgcacggcctccaacgcctctttccccacacggattcgactggcggccggcaaagaagaagagagaggaagagaagagatagaggagagggtgaaggagagaaagaagaaggggaaagaagtagggaggctgacatgtgagacccactatcagattagagaattgtaatagagaggctattgaaatgaaaggtaaatttgactatctttttattttttggcaaatcggtcaaatgaacatttggaaagtgagatttggaaaggatgttatcggagatgctctttctaggaagtgtacaaatgaagtgatgaatcgtggtacggtctcgtggatgcatccactaatgtttaaattttgatgtcacaaatattacacatacactatattagtgattcgtcgttgatatcggtctcttcgatcagcttgtgttggttaagagggtgtatgatcagttcacgcatgtatgtatgcatctagcttgtatcaataacaagctttataataagtattgcaatttactcttttggaagacgtacacgcactactacaaaaatcgtttttctgtacgagggggtcggtaggttccatgcgggccgcttgtggtggcgcctgcaaaaaccgcccccccggggcgggttgattagccgcatgcgatgatcggccatatatgctcctccaggcccgagcttgaccatttgaaaacgaagctttctctctcctaaagcaagcaccaattagggggggaggttttcaactcgaaatttttacttgaactctatacgaaaggtgaagaactctctatcttgcttcatttggctccatttttgttatatttcgttggtggaaagtggagtttttttaatattttgacaaggtttgttccaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatgtcgcgtgaaagaatgattgtcgatgtttccaccgatagtgatgatttcgatggtggttttgatttagaggatatgctacgccatgttgaaccagaggtgctagcgggcaggtcacgaggattggagaattggcaagcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcaatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgacaacggtactgcgtcgcctttcaagaagcactcaattttctttaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtactgctgccaaatgggaagaccgagattcctcctgcttgttactcgttgacacttgatgagaaaaaagccttctgtaaatgtttacaaggggttagagtgcctactggtttcgcatcgaacatcaggaagctagtatcaataaaggatttgtccatttcgggatacaatgcgcatgactgtcataggttgctaacagtgttcctaccaattgctataagggcagtcaaaccagtccatacaaaggtggttataacaaagttgtgctactttttcaatcgaatttcgcaaaaagtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagattggcatgtgggccttcaagtattgtcaattcatggcaaggttacgacatcaatggatttaccttgagtacgactacgaaggacatgaaaagcacctcacaaaacagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtgtggctcaggtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtattccaaatgtacgtgcatgaatttaggtcccccttatgttgtaatcattagcaaatgtacgtgcatgaatttaggtcccccttatgttgtaatcattagcatgtaacatttgattacgagttttgagtaattttcatgagttttcttagtgccaaaaacatttggaatgtataattgtggcgaaatattgggaaaaaaatatatatggacagtttacttatagaggaaaaaaaatatgagtttttttggtaaaaagatctttctatgcggctggcttaacagcccgcatggaaagatctttttcgcatgcggccggcttatgtcgaccgcatggaaagatctttttcgcatgcggccggcttatgtcgcccgcatggaaagaactttttcgcatgcggccggcttatgtcgaccgcatggaaagatctttttcgcatgcggccggcttaacagcccgcatggaaagatctttttcgcatgcggccggcttatgtcgaccgcatggaaagatatttttccatgcggtcccttaagccgcccgcatgcgatgatctgcgcctatatatagggagcgcggggagccaaaattttctaagtcccagctcccgcgaaaccctagccgccaggctgccaaaatttcccaagtcgccgtcgccgtcgtccccgccaccgccggctcctccccaaagtcgccccgccccacgccgtcgccgccgccgccgtcaggacctctcccccctcgcctttgccgtcgccgccgccaggacctctcccccctcgccgtcgccgtcgccgccggcaggtcgccgtcgccaccgcacggaactctcccccctcgccgttgccatcgccgccgccaggtcgtccccgccgccaagtcgtccccgctaccgccggctcctccccgaagtcgccccgcccctcgccgtcgccgacgccactgccaggaccgctcccccctcgccgtcgccgtcgccgccgccaggtcgccgtcgccgccgcacggacctctcccccctcgccgttgccatcgccgccgccaggtcgtcgccgccgccaggtcgtccccgccgtcgctcggtaacatttactttttagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgtttaaattgggacttatgttaaattgggatttatgtataattgggacttttgttaaattggcacctatgttaaattgtgatttatgtataattgtgatttttgttaaactgagatttatgtataattgggacttatgttaaattggcacctatgtcaattggagatttctgtttaattgtgacttatgctaaattgggacctatgttaaattgggacttatgtgaaattgggacttatgttaaattgggagttatgtgaaattaagttattgggacttatgtgaaaataagttaaattgtgacctgtgttaatttgagatttatgtataattgtgacttatgttaaattgagatttatgtataattgggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctcctcaaaattccggtagcaataagcagccaggcgcttctagtgaagaaacgtggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaaggaaacttacaacgtgattgctctcgatcaggatgggaagcccatcgagccaccgatagtgcggtccaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaacagcggaagcattggctttgaggaaaaaaatgtccgagctcgcgaagaagaacaaatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgactactaatttgcagcagatagtcgagaaagaaagatcaggacagttcgtcccacggagggagagagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcatttccaaggttattccctgatagccagcaacccacacaatccgcacagcaaacaactaatgtacccagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcttgcagcaggatcttcaaccccatcctcatcgcaggcaatgactgctgccgctcctgcaccaccgtcgcctcctgaaccaccgtcacctcgacatccgccgtcaccaccaccgcttaggtcaccgcctcgccaacctacaccaccaccctccccttctcaacaaccgcctctcccgaccccgcaaccagttcaagcctctcccacctccccaactaaacagcatgctcccccggctccgccctcagttcaaacctctccacctacaccccaatctgctctggtagaagaagtgcacataccagatggtactacatccgaaccaaagtctaatactttggaacctcgtcgtataattccaaagttgatatcgacatacgacccaaaggagattgacaaggataaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagacctttacgccctctacaagctagataaaatggacgttaatctcgttgcggctttctgtctgtaagtctaaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaatagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccgttttattttcctttctgtgtgcagatccccgaaatcccatattttgcacaacgattcaaccacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgatgaaaaaactgtgccacttgtattatatatttgtatgtaaattacgattgaattaatggttatgtattacatgtttgttactgcggcacttgtcttatcttatatgcttactactccgaaatacgataataaatctctcaataatttcatattaattacgaatcaccaaaatgctagaataaatattattttagctattcggaaattgaatttcgcatgcggtctacttaagacgcccgcatgcgaaaatagatcttcgcatgcggtcttcttaggtcgaccgcatgggaaaatatatcttcgcatgcggcttcttatatggaccgcatgcgaagatctattttcgcatgcggccgtcttaagtgaccgcatgcgaagatcaatcttcgcatgcggctgcgacggccgcatgcgcaaatggtgatctttgcagaccatttcgcgcatgcgggccggccaaccgcatgtgaagatcgattccgcccgtatgcaaaaacgctttctgtagtagtgacgtatgcagtcataagtttttttttttttaacgaatcaccggaggggagagatttcccacctgaataatttttcattgctcaaattgtttgcaaggtatacagaggagtacagtagagtatagagttacagcgaggacgaaaaacataatccctccggtttcattttaattaacgttttggacaataacacggtctacaagatacatctttgaccttgtttttctattataagatatataataaataaatgcatgtttacttttattatagtactttaaaagacaaatctatatatgttgttctagttcctttaaactaaatatttttaaagtcattgatagtctaaattataaaagtttgacctcaaccttgtcaatgaaatgctacatgcctatcctcttccttcagcaactctgatgatcttgtcaatcgatgactgacgattattccaaagagcccaaaaccagagcaggtagacttggatgctgtttgtcgtttgagcgcgtgaatgctttgagcatctgagattgctgggctgatatcaatcctctcccagaagctttgggcgatgtgacagttttaggcaaaagtgggtggccgatcctaaattaaatataacatatactagctaataattaaataaataattaaataattactatgtagtattggacaccaggtaatttttattattcgtcacatggcgctcttggcacagcaaccaggtgaactaattagccgttcgattaatccattggaagcttttttgtttgtaacattccatcgatggaaagctaacacggtcgaagagattgtgtgaccagctcctgtgtgtttggccatctcgaccagcccattagaaaaaatgataaagaaaaaaaagcatattgactcagtcgtttcagctcgccgccactcccctgtttgctccagtattttggaccaactattaactgggcctaatacatgcaacccgggccaatgtaagtgtttttctttttttaattctttattcttttttttctaatgtaagttacagtaaatacacactacatcatttttttcgaaaatttatatcccaataggttctattaatatcatagtatttataagattttatttgatttttttatcaatttaaatttgaatttggatgaaactccctgaaatcttagacggtttatacttccgagcctcgtcggaacatcgaaattttacgaaatccgtccgtcgaaatcgtaaatcctgatgtcatgtttatatgtattattttttagacacaataaaaacaaattatatgatgaaaatcctaatggaaccaacacttgtgttggcgagataattaaggtcgtggcgacatgattgacggctaacacttgggaatcctcggaatgtggatttgacgtggcttgcattggtgtatggagatcgtgataccctcgtctcatgggaagccttgtctttatgtccctgtgttctcccttgttagggtagaactcgagagataagttgagatacaatctaagcaatcccaatctgtaggcagtcgtttttcttccgggatcactctcctcatttgctcaagagttatcaggaatgtaaaattttgacgtgtcacatcggatattatataggatatcacatggagtgttcgggtactaatgaaaaactaattataaaatccgttagtaaaccgtgagacaaatttattaagcctaattaatccatcattaattagtaaatgtttactgtagcaccacattatcaaatcatggagcaattaggctcaaaagattcgtctcgtaaattagtcgcaatctttacaattagttattttttagcttatatttaatacttcatgcaggtgttcaaacgttcgatgtgaaagggtgtaaaatttttatgtgggatctaaacaggccttagatgtgatattcctgttcagatatgtccgtgtacgtggagtatcctatattttgtacactaaagattaagtatggtccttggtggagaatgttctctcattattttttttcatatatgcatgtcatatataatatgtaatacacagatgttcttacatgcaaaatatttccatcatgcatgggaatcaagcagaaaggattaaatgcatcctcacgtcatatcagacatctgtgagacctatctctagtgtattcccttagagcaaaaattctcgttcttcatctttagagagagaccttgggtggtgtttgaatctcccgaatataaaaataaagattaagattaagtgtttcacacagaaagaaagaggtggtaatagtgtataattaattgagttttaattattacaaacttaaaaattagattaatctgatattttaaaacaacttttatatagaaagttttcacacgaaacacactgtttagcagtttaaaaagcatgtcacttttatccaaaattttattctctactcgtagaacaaacgaacagggcctaacttatacctagctaacttagcttttctatttatagctagctagctatctttaactttccctgcataaacaaagcaatggaatagtcaaaagcaatgggcacatgttacaatgcgacatagctgggatgtctctcgtgtaaatttgcttctcaaatacaatactgatatttttttaggttaatcggatctatgccattacaaatttacatttttaaaaaaaaaactattactattcacttatttggacccaagacattacaattttacagttatctgagatatgtcattgcttaacccttcgatgcatttattaaaaattttagacttgttcctcctccttcccctatctcctctatctcatttccaattagcctggccaccatggccatccccctccacctccactccgccaccagccatctctccctttcccctcaacatggccatggctagtgcacccgttggagatagaagcatatccgatggtggagaggtcggagacgaagatgtatgaggtcaacgacggtggcaaagtcgccgactttgctctatctaaagtgagaggagatgaggagcaataaataaagcagaggagaggaagagagaggaaccatcggccctgacctcgccatgcgctgccgtcggtttgagtagctgggggagaggaagagaggggaaccgtgggccccaacctcccagtgcaccatcgacggagtgagttgcagatggaggagctgccagagtgagtagcactagtcaccagtgggaagagaggagagagaaggaaggaaaaaaaggaaaagaaagaagaaagggtaaattggtctaaaaattttaatgaatgcatcgaaggggtaagtagtggcatatctcaaatttctgtaaagttgtaatggcatgatttgaaatgggtgaatagtaatggtattttttaaaaatatgcaaatttggaatggcatgtatccaattaacctttttgagataatgataatactgatagttatggatgaacctaaaaacttttgataatgtataatatattgacatctaccaaactatcacgcacaaaaaatctcatgtcaaaactcgacctacaaaccaagaaaaagaaaaggagaaatatagtggtgaataatgtaattaagtattgttcacagtttagattcgtctttttttctcaatacgagagatgattaatttagactttgaatttccttgattatcatatgttacatagtaacaatgtcatctttttataagttttttttattaattttcgaaagtattttgagaaaacaaggggtcatccccttaagatgtggaaaacacttttgatccccatgacagcatgtacactcataattattaattcttttcaagagaacatagctaaatcgattaattccttagaaagtaaagtttattgggggactcaaaatggttttagtacttataaacaccctgcatcaattataaataccaaaattatttactagtaaatactctcaattaagtgagaatctttccagaatttacatattcaaaactcttcaagtgtttaggtaccaaaaccattcgaattttgcaccaccataaaaaactgaatgatttcaatagttttggattgaaaaccaaacttgcgtgacaatccaaagttgtaaaatggaccttgttttttttctcaagttgctagtagcatataaatttttgaggatatatcgtttccctcaagaatgtgttgacaaccaactactaaggaaaaatgaattcggtgtgaagtgtgttgtgaaccatgggtgttaaaaagcagtaataatgaacaataaaatttatcatatagaggagaaactgttgacgttacaaccttcaacttttaccaaagtcctaaactgctacatattgtttcacagttgccaaatttatttaggttatagatagtccaaaagatagtgataatattttaagaatatttgaagtaatttaaaaaattcaagaaatgttttagcgctggcttacatcaattcaaatactcgatgtgctgtacttctccctacattgccacttggtcgtcatttcactgaaaacactctttatctagacaatggtttagaagttcactgttgttttgcacacatttatataaaagtttagtgttgtatagaatggacattttcctaacacatacataatagttgacaacttcaataatgtcataataactattccaaaatttaccattattcgctaattcattaggaggagtagctaatggttgttaaagctctctgttttcccacgacacaatagagtggggactagtatatatgtgtttatcacacaagatgcaactgatgacgatggcataactaatttagacaaatagtttcctctaggaaaaagtccgaatccccacccctcctaaaaaaaacactatagttgtcaatcgaattacccaacccacaaaaaaattcaaaaaacagacaatttaaaccctcaactctttaatccggacaaattacacccgagcactattttgggctaggctggctgaaatgacatttctaaagtggctaaaaaaatatttaaaaaatacatggccaacttgtcagtgctccagcactcctctccccttctcttctgcctcctccccccccctcaatctctctctctctctctaccttgaaccgagcacagaggaggtggaggcagcggcggtggtgtgacaacgacagagactagacccccggggcgctagtggtggagcgtgatcagccggagaagcccagggaagcggcggtgcacggtcggccaaagaatcccaggatgacagcggcggcggcctcaaatccagaggaaaggcgagagcgacggggccaaggaggcgtcaatggtggaggcagtcgaagaagtccatggcagcggcagatactggtcccccacggcgccgacaacggagcgtggtaggacagagaagcccagggccacatctgcttatccctgctcgtgctacggatggaggaactggaacggcgttggcggtgtcctggggaggtggtggtggagatgttgtgcaggttagcaccggggccgcgtgcccacgtccgctattgtaagatgcggctggtgggccacaagtgcccacgttgtgcatggcatgcagccggtgaccagcctgtcggcctgctacctcgctgtagcgtctccccaccgatgccgcagcttggtctccacaccaatcccttcttcgcgtggcgtggttctctcctccacaagcatgtcaatcggcaagtagaagtcgtcgaccagaggaggtcgagtcacaagtgcgtcttggttcaccggtcactgccttgtagtcgttcatcatcgctgctgcagcctcctcaccgttgcctccgctcgagcttcatctccgcgtgagctatgcagagccggagtatgcgaggtggatgctttcccgctctccaagctccgtcgtccatcgtccaccaggggcagccacagctggcgagcacctcgcctccgcgggcatagctctctcctccaagatgttagccatgccttgcctcgctggggaaaagaggaagagggacggtggctgacgcttggttcgccctcatgtcgtcgacgaagctcatgattgaggccagaggggaaagagataaggtcgagcttgcctatgacaagtgggccccaccgaattgtttaataaaaaagtgctaattggattgccacatgtataccacgtatgaacaacggcaaaatttgctacaaggcatccgaaaaacgtgtaattagctgatggacaccgcaagacgtatctgctgtaggccgtaaaaaactgataattaactgttggacactcatgatattattttattattttcgggaaaattggagagagaaactaatgtgtgagagcacgattctaaccctgctcttcatgacacgatcccttgtgtccccagtggacggtgccggtgagtcagtgacacgatcgcggcaccggctgatcacccgacaaattaaaggagagtggccgagcacgtaaatgacacatgccgcgtcgtcggtgtcgtcgtcgctgcgcacatgtgctcgcgcacgccgcggcccaagcagccagaggcatcgtcgccgcgcatgccagtgccaccattaacgacaatacccgtctcatcccacacgacgtacggtctctcaccatatacgacgcgagcagcatggtaattggcatgccacggcgtgtgcgcgccacgcacggacgcgaatagggctgtgcctggcgcacgggataaagcgagcaggagattccacatgcagaggagaaaatctctcgcgcgcccgtcttctccacctgcgccattactgccctttggctgcttcttcctcctcgatcctgcactgccactgcgacgatacatgcacctgctgttataatccactctgatgctagttggtctatggcactaggaaatatttgtcaccaaaagacaacttgattagttgattaaccgacggtgcagagaacgtgtaccctccatttggcaactgagttccgccgcgccacgcacttgccgccagtactcgtcgggtttgcgacaggcatcgatttactgcgaaaagcctcgtggctggtttgaacaggaaccagtcggattgaaataagttcggtcaggggcaaacttgtctttaattactatttctctctccaattctatcagaaataataaataatatcgtaagtgtccagcagctaattatcagttttttatagtgtcctacaatatatatgcgttcttgcggtgtccaccagctaattacgctttttttatgccctatagcaaattttgccatgaacaaaaccactccggattgaatgagagggttatttgtccagtttgaataattgagggtgtaaaatatctagtatttttagaggctaactcaaacgaccgtgatagtttaatggggtaattcggaccttttcatttcctttataacaagaagcagtactcctaacccatatataagagttgacaaaaattaatgggggtcaatagttaaaatgcataatcatgttctcgtgtgtgagattgtagttaagaccaaccagaacattttgaaagatgggatatcttccatgcatgtagaccaacgagctagcaacaaaatctatcttctctctcaaaaaaaaaaagggagctcgaacaccttgtaaacgaactaacttcacttttgaactataaatggctcgagatactctttacaggagttttaaattcgaccgatgcaattaggacagattagctgacctcaggcctcgttgttttcagattattcactggattatttaaaattaattatttgagttatgctttgaaaaatatgttttctcaaaacaaaaattcttctacactgcattgtttcgaccagttattctaagctatctgttaagtttatttcctaaaatatttaatttatttctatattatgtagagtaatccgaatactctccacagtaatcttaatcaaacaaggccctataattctgttacctctatgcttgttgctcagccatgcatgcatggatatataggataagatgatcaaactagcaagaacctagaggtatactccctccatacccataaaggaagtcgtttagaataatatttaagtcaaaccttggaaatataaatcatgaataactcttaagttgttgagtttgaaaatataaaaattatatgtatagatttatattgaaaaatattttcataaaagtatacatatatcacttttcaataaatatttttatagaaacaagatgtcaaagttgtattttggagaccatgtcgctgtcctaaacgacttcctttacgagtatggagggagtacaagaaaacacaagttcacctctttgtggcatcagcaaattaattaatggatgaggcatttattctgttcaaactaggaaattgaagggagtaggttgtgtacatgcatcccctcgcaatctcctcctataaataccatgccatccccttcagaacccataagccacacattccaataaaacagtagtctatgaaactaaagtcacaagttaaggtcttggaaagcaatcaagagaatgagaggccacaccttttgttttgggcatgtgttttttttcctttttgctaatcaataactttcaagcatgatgacatgtcttgctgatttgtatacagggaaggaacaaaagagctagggagccgacagaagagagtgagcatatatagttctttccttgcatatgtggtcatatgtgtgttgactgaagagatacatatatatagagagagagagttcatgtgcttgaagctatatgtgctcacttctctttctgtcagcaaattatctccctccctctctccctaatatatacgcatgggtgcatacaacgcaaatatatatatatatatatatatatatgtgtgtgtgtgtttatagacatttctttcattagttagacattacgctactgttgcttttcttgctattcagattaaattagaacttggaatatataattatgccgtaacaattcttttttctttctagcacaagttagctagctagctagccagctagctggtgtctgaatgttgaatctggtatctttgacacacacacatgtgtgtgcgcacgcgcgtgcgtctttttttagaacttatagatatgtgtgcttggatcaatatatgctgcaatacatttttcatcgagaaatatataaatatggacatatatgtttttccactaacttgtttcttcatctcacattttgaccatttggtaggtttcgggat

SEQ ID NO: 45589 - DNA, 25138 bp, Oryza sativa
agccaagtaagtctgaacctccattgtgaagatacgggctccaccactggtccacgtgtaagtgatatagttcaacagcataaatgatactcctatatcatcaaaaaatcaaatgagggcatgtcaagttagtttggcaaagaaaacaaaaaaaaaaattactcccatgcatcagtttgtccatggatttttttttcttgtttttaaattattaaaccattttgaaaattaaattactagaagtgcttccaaaattgattaccaaaaaattggttcctaattttatggtgtacaaaatgcaaaaaggtagtttgtgcaaaacaccattttaatctgtcccatattatttcatctgtttagtaaatttagtgaaaaaaatgtgtttttttcctttgatttaattgtttaaagaaacttatgtgtgcatgctccttctatttcatcatattacacatgttgttttctcaaattagttgtaatatgatttaatttggtccagtcagtttatggctcctgtattttatatttaacgtctatcaaatattatctattatatgttttcaccaagtagggataacatgtgttttctcttcttcttttatcgtaccatcattaatagtaggaatgaaaacagctagctcgaatacggacggaaaccagctagttctatcatattcggtttcatatatttttctaagaatgaaaactaatatagtcaccctagatatgaaaataaaaataaatactacacatacagagcaaatatgaaccagaaagaatacaatcacgaatatttatcggaacatgaaatcccttagactgtgctttcaatataaacaaagagatataactcattatttcacccgaaagaatatattaaattcctgttaaatataatatgtcatactttgttttttactcctctgtacattagtttttgtttttttaaaatttaataatttaaaatacttgaaatgataaatatgaagttgtatccatgttagactctcaatttagaaattagttaatttaattctaatattaataattaataagatgtaattgatctatactcttatttaaaaagaatcagttcttacattcaaaaaaataatactacctccgtttcatattataagtcggtttgacttttttcttagtcaaacttttttaaattttatagaaaaaattaacaacatctacaacatcaaattagttctattaaagctaacatttaatatattttgataatatgtttcttttgtgttagaaatgtttgctatattttttctataaatttaatcaaacttaaaaaagttaactagaaaaaaaagtcaaaaataacttatgatataaaaggagatagtgttatttaaaatacattattaaatttttaatatttacaatatcaataatactacccatacaacgtatatatggtttgaagctagtaaatataagaatagctactccacatactatgtttctaagataaaaatattggataatgagttgggctagagatatgagcctaaagttaaaagtaatatgggctacaggtctaagtctttgtttctgagaactatctgaacacctatccggatagtttccgattgttttcattcccggtggatattaaaacttctgtatttatttccatacgtgaagaaaaaagaatctgaattttattccgaatccaacactagctatccgagctgatacattttgtttccggaaattctgaatcggtcagaaactagccaatccattttcacccctaattaaaatatcaaatcacaattaagaaagcatgcatgttaaaattgaccagaagatatatatacatgcaaattaactgatctctctcaagaaattaaaactgtagattggtcaacaggcgtgttctttgttgaaatccctataatgagtagcatttgttgctgcagccgcggtaattaattaagacagaggatgcaatcgttatctgggttcttgatgaaaaaaatctgacaaaaatacgtgtgttcaaattttgatatgattccaattacaaagccagacattgtcatgtacatacatgcatgagtgcatatatgtgtatttggctctatcaacggctcatgcaacctgcatcctgcatcccccagaaaattaaaagagagtgcagccgacagaacatatattctcctcccacaatgtataactaaatgacctaaaaatattttaagcaagcaaaaagtagctgatatgcacaatacaaaaggagaacataccaaagcgaaccatatcgatgtaaagcatgtttcgtttcaactctcaagcattagctgcatgcatttgatgcatattcttcctgttcttggtctagagtgatgaagaattatgctaatatcctttggcaatcttttgatcatgtcattatcatcttttatatccctttcccggaagcaatgtatgtagctatagctatagagatcaacattattgcaaaagctagctacatatccaagctgcagtatggaatgtttctagagataaaatggatgcatgaataatgtaattaattaatagtattagttagggccgagcatctatgcatccgatccattgaatcgagagaataacggctaacgtgaatacgtgatccgacagctgaacgaaccgacagagcaacactgccggttcttgtcgttttgggcatgaaactatatggtgaaccagcagtgatactccatcttaaaaaaaggagatttggaagaagagatgttcctccaaatatattttttaaaaaaaaattatgagccccaacataggatcttggagttaattaaaaccatacacctcttaccactgcactattaagtgcatctcaataatactctcatagccagttcgcgctgaattgacagtggtgaccattttagtgatagtgcttgtaaatgtcagctcaaattccttaattatcacagataatattgcggccatcaaagaaaatactcgctagctagtcacattactacggaaattgatcattgtaaacggggcaaacccactttcacaagtggcacaaaagttattatcgtaggcggggtcaagttatgctgttcgcctgcgaaaaaatcaccaaattaaaacaaacaaaaatgagcttagctcatatactcataaactgccctttcattaccatccccagtttgcgcagaaggtttatattcagtgttgttattgtccaggatctcctccttttttttttttgaacataggatattaggatctccttcttgtaagcttttccctctcactgcaaacttccgacgtggttactaatttgcgatgctacaggagctttacgagttgcttactgtttgctttgctggttgcctgatgctgctctcatgggccggctaaggccctgcattctacgctagcttgcttgctttgcttgggccacaacaaataaaccagcccacttacacttttttttcatctcaattatttgtggggcattaaaaaaataatttctaccgtcactcaggtccccattggttggcttatttcctaataagccaaaacggcttattaggaaataaaaatgaatttgtgggtaaaacttttagaaatgtgttatttgtgacttaaaagctaatgttgaaaaagaaactatgttgaaaatatgtcaaaattaattttaaaattaaacttgaaaatttaaaattaggctttttctttgacttattaggccatccgatgaggctgttatattatatactagattatgtcccgtgctttaccgtggaatatatggataaatttatgttgaatgttgtagaaaagatggatggacttgggttaaaatattgtgaaaatgatattgataaatattatgatttaccgtgctcgtttgttgagttttagcatgtaataaattatagatgtacttactatgcttttgttgttgagttttaaatgcttagtgcgttgatgtgtcgtatttgcatattaagttttggaagtattaataatttctatatttgaatggttaagttttactactccgtctaaaaaaagatcaatctgtgtccagattcgttgttaggattgggtttttttagacggaggggtaggtgtttagtggcttgtacagatattcgtacttttcactacttataaattttcaggaatattttggtaatgaatcaataagcatcgtgcttataccccgttcattccaccattgatgttactctctctttttaatctactccaaacaatttctgcacaagagtggttgtcagctgtatttgacccaagggatgtaagcaatagaagattgttacactgtactagtaagtaaaaagtaagcttatgcactacaagaccacgctggggtatgaaatgtaatccgaaaaataatgattgtccatgggagtttaatgggctcaaagttcaaaatgtgaccactaaaccagcccaaaaagagagcatcgatctgttactcatcagataaagtctaattcgagttcctcaaatttatgttggatctgcttcgcgttcctcgacagaaaactagctataacgagttctcctaccgttcggaccgatgcaaaatgactcttcaatggtttgtaagacgattttgactaatgtgactcttattggcaccttgatattacaaccagtgaaaatcaaataaaatatgcattgggccccactggtaagagacattcatgctctttgtggggctgccatggagcacaaagcgtccgttgagcgtcaaactcccgtcgctgcacgatggcagtgaaggaagaagagattggtaaggaccagcacagataatgagtgagtttgagccattaccaagtaacacaaccttatctttcttcgccttgagactacgaatagataaatagtgatgatatttatctgaataggcatatttgcaatggcaaagatcaaattaacttttttttcaaagattagaataatttgtggaagcaaagaggtgcccgggttttttaaaaaaggatgatacctacaaacgattcaacttacaagtaacttagtgatatgtgaaaacgagaaatagacaaatagatacttcctccatttcataatataagtcattctagcatttctcatattcatattgatattaatgaatctaaatgtatttcctacatttatattgatgttaatgaatctaatataaatgtgagaaatgctagaatgacttacattatgaaacggagggagtactttgatactttagtgaaagagaaacaaacatttcaaataactgtaagatctttccaaaagtaccagcaaactgacctcttgctaatctgctactataagctgtcgtcacttggcacattgcactttaaaagatcatacaaagctattcactattagctgcaatcaagtgatagagagagatggatggtataccctcctctatgaatcaaccaaaagcgccactgcccatccggccccaccaaaccccagcatagtagtcagtccccaccaacccctccccgaatctcaaggcaaatcggacggcctatctcccaccgcaccaccgccccgcttcgattcccattagcgacggaagcggaaaccgagcaaccaccaccaaaccccaaccccccctcgccgtctccggcgatctccgccgccgccgccgccaatccgaaacctcgtcgagtaccccccacctaccctccgggcgctgggtcctctgatgcttcccaccccatggccacccacattcccctcgcccgcctccgcctccgcctccgcctcccccacctcgccctcgccctcctcgccgtcgcatcggggaaccctagcctcgggggtttcgatcggggggacgcggaggcggaggcgtactcgatcctgaccttccacgactacaccccgccgccgcccccctcgctgccgccgccgccgcccgccccgtcggcgacctgcgccggggacctccgcggcgtgggcgacctcgacacccgctgcgtggtccctgcctccgtgaggctccgtggccccggcgtctacatcagcgggaatgggacgctggtgctcgtcgacggcgtcgccctcacctgcgagaggcctgggtgcgtcgtctccgccaatttgtccggcggcatcttcttcggccgtgaggcccgtgtcgtggccgggtgggtttctctttcagctaccaacatcacgctctccagtgatgctgtaatcgacaccaccgcgctcgctggcgacccgcctgataagaccagcggcgtgcctactgggtcgtatggtgatggcggtggccatggcggccgtggtgctagctgctacgtcaaggaggggcaggcgcaggaggattcgtggggcggcgatatgtacgcttgggctgaactcaagacccccaatagctacgggagcaaaggcggttctaccagcgtcgagaaggactatggtggtggtggtgggggtgtagtgtggttgttcgccaaggatattatgatgaatggaacaattcttgctaatggaggagatggtggcaccaaaggtgggggtggctctgggggaagcatctatctcaaggctaaaaccatgtgagtatttgtaatttatattgaaaatatgatattaactttgttggctaattcgaaatcgtataagcaattcatatggttatgactgttaaagttcaaaattcaggcctcttggctctttttcacactttcacacaaaggcaacacgaatttattttttgaagtttggataaatcattgctctgcctgttgcccacaattcatatatacttatatttttgttatttttaattttaccatatttaaaaagttatatatccaatatcatattctgtaatagatcatgattcctgtataggatgcactcaacatgcactagcttgtccaatagatgtattagaaattttacactggaatggatgtaaagccaataaaatttcttctgtgttgagaatggtacaaatttcacattccagtgcattggattgaaacagtacttcccaattgaaataaatcaggaggaactatatctggtactggtattttaggacctaataaggatttgagagagattgtgtatcctttttttatttatatatgcctaaaactgacagttgcagtgatggggaccagataagttttaatttacaattatgttaagtgctaaatcatatgataggatttgtagccctcgaagattgtatgttgatatctacgtatttgggttacaaacacattcttcagaaagacatattgccaggcaactaataaacaaaggattttggactaaatgctacttaaacttactccagatcagttgctctagtctaaaattccacaattatgtcatagtgactagtatgagcatgactagcgaagatcaaacaatacattccaagtctccaacgtagaaggaaccatggaagcaaagaattaccaagaagcatcagttatgtacatgttagattataatgcaggttggcctgaccagccatatttggagttttggacttttaagtgagctggtctatgaaaaccatactcattgatattttaaaatattaaatgaatatatatatataacttttttgtttaaatttcgaatttatgttatttcgaacagttgcctcctctctgatattttgttgtaacaggcaaggaggtggcacaataagtgcttgcggaggggatggtttggctgggggaggtggtgggcgtgtttctgttgatgttttcagtaggcatgatgactcccaattttttgttcatggtaattcacttgatttcatttgtatcatggactacttttgctctgataggcttccaattttgtatcttcacattgattttctagttgctgaggttatatgaggttgttctcgtttataacctgccatcttcatggtatccgtatttttttccctgccagctttgaatttttcttttctgactttcaacattgatttggtcaactgtcaaaagagcttgttttagcataatatactttttcttcaaacttctgatcagggaaaccactggcatatagttcagtttgttgtaaattgtaagatatgaactattctttaaaccttctacattattattttagagaccataactttagtgaccaagttagtgaccataacttttctgaccaagttattagtttagagttaaacatcaagaacttgttaaatatacagaaccaaccagtttcttccagtaacagtttaaaagggacactaatgtccctgcagggtgttagttttcattttctgatttggcttcttgaatcctgctcgaaaattaaaagatgatctacatattctccatttgtttcatgctggcggagtgtaaagtgaactttggcgttatctgatctaggttagatagatatttattggactagcccagaatttcttatttggttttcgtttgacgaggacaagttatgagtattagtattacctgtgtagttggtacttggtttatgcaaagtacatagtttgtacaagcttatcaacaattcaacatactacttatttgtgtttgaactatgttgccttaacaggtgggaggagctcaggttgtctggacaatgcaggtgcagctgggactctttatgaagaagtgcctaagagtattactgttagcaacaataacttgagcacacaaactgatacagtttttctagaacccccatatgatccactctggacaaatgtttttatcaagaatcatgccaaagtttctcttcccttgcgttggagtcgtattcaggtgtgaggcacttagttttaaagtctattctgattgcttgtccataaacacttcatttgtttcgtttttgtggagatgaaattgcaaagacataaattattttctttaaaaaggatctgagcctctttttctttcttaaattgggaggaggaatgctattattctggtgacttccattatgggaaaaaatgttcttttttactgcatgtcaccttggtaaataacatgagttgctgttccctgctgttgagctatttttctgtccttattgggactggcaggtataggtcaacagggatacatttgctgcagcttgcagctgatattggactagtattttctttaactaaatgtttctttcattctagtcactatagatatttcagttacccttttttcaatgttttctgattttcaggctcaaggacaaattagccttctatctcgcgctacattaacttttggcttgacacactatccatattcagagtttgaattgttggctgaggaacttcttatgagtgattctacaattaaggtatttatctgctgttacttcatgcagatgttgtattccttttgctcaattttaacccattatgtggtgtatctgcacctcacgattcttaaatcacattcaggtgtttggtgctttacgaatgtctgtaaagatgcttcttatgtggaactctagaatgttgattgatggtggcagagagtcaggagttgcgacttctttactagagggtagcaatttgatagtgttgaaggtatgttatttgttcaaaattgcaagatatggcccttctcctcctctgccttctcttctgtatgatttattttgttcccatgcttgtcaggaatcatcagttatacattctattggcaatcttggaattcatggtcaaggcatcctgaatttatctggagatggagatacgattcaggcgcaacgtcttattttatcacttttctacaacatagtggtaaaataagttcattttggtttgtttattcacaatcagttatgagtctgaattgctttatttctttctgcataccttttgtggcttaggcacatttttatggattcggattgttttcagagttggaatgatgaatatgcctttgatattgccttaaatttgacatgttatgaggccatcgtgtgacatcagtagtttgcgtgatctatctgtagtgttctccattctgttatttacttattcatatctcatctaactcgatacactaaatttaatgttctaaacttatctttgagatgaattatgctgctgttcatgatatacaagatcaatattttctcgaagcccttaagatatagagtgttgttcattatatacaagatcagtattttgtccaactgttaggtatagagtgcagcccttgatgcatttcctttctcttttaccttgcatatcgtacgctggtataaccctgttgcaaccttgttgtttttgattttttacagttcaatcatttcattgtttctattagatgcttctgatccttcgtgatcattcagactactctaattgataagtaattccattttaggttggacctggagctgttctacaaggcccacttgtaaatggaagtagtgatgatgtgtaaatactaccaccttcagtttttgtgttgcttttatttttgctattccaccatgaagtttaaaacggtttctgagcttttgtctctacactagggccccaaagctgaactgtgaagatgagagttgtcctatggaaatctttcatcctcctgaggattgcaacctgaacacttcattgtcttttaccctacaggtgcacactttaatttcccaaggctttccgtgcagtgtgtatctatatatattctttatcttagattttgccttttcatttaacatgtaacaaatggttagcttttgacacgcagatatgccgtgttgaagacattgttgtttctggccttgtgcaaggaactgttattaatttcaacagagcaagaaatgtcactgtgagatcatctgggaccattagtgcaacaggattaggtaactttttcttctttgccataaatgctattaagattctgttcagcattgtggtggttttcgagaagcactttattgtttctactctggataaaacagtttattggaagcataatttcttaagctgtgagatagaacttcttacaggagttgttaaagatacccgtatccagattgtggcattgcacagtgcagccctgctttcgatctgcaatcacaaactattgattaactaaatattcgaaaggaaaccttatttagtttaatgatagcttcctatggctatgataactattctctagtccttgctgcaatgttgcaataatcacttcaaaaatttgtcatatggtaagcctacctaggcttaaatcggtatgcttatgtcactgatggccattatccatttgccctgttatactcgagatttcaaatgacatgacacgctataatgtttatagcagtgaataaatcttgtgcacagctccaactgagtagactagaaaaatatggcatttttttagtcttacatctaccagtcttattttatagctgtctgatctgagataagctgtcttaattctctgtttgttcgtgaattggtgaatcatcagcattgaaaattatttttgtttgaatagttactgcttcagtatacctatttttcataatggagatttcattaagcttcagtatttctatgtacacatttaatagtaacatatagcttcttttgatatctttcttttgaatgcagccttctgtaaactattgtagaatttagatttgatttctccctgctgcaggctgccgaggtggaattggacgaggaagaatgttaagcagtggccttagtggtgggggtgggcatggtggtaaaggaggggatgctttctacagtggcagtcatgcagggggtggaactgcatatggtagtgctgatttaccatgtgaacttggcagtggtagtggtaatgtaagtacatcatcttcaacagctggtggtggtataataggtaacagagatcgagcatatggatctttgtcaattatcatcctctattcagtcactgttactcttagtagtactggtttttactgcctttcatctgcacatttccagtaatgggttctttggagcaatctcttccactactctcccttgctggttcaatagaggcgaatggtggcagttttgctggtgcggtgactcatgctgcaaatgaaggacctggtggtggttccgggggcacaattcttctatttgtgagggcattgtccttggaggagggctctgtactttctagcgctggtggggttggaagtaatggtagtggcggaggtggaggtggccggattcacttccactggtctgacattcccactggagatgattatattccctttgcaacagttaatggatcaatacttgcaaggtgcatcttaattctgatgttttctctgtttgttctatttttttccttctgttttactagctagatctgttcatgatgctaaagtgctgctacatctgcattcttatatttaaagttctaagtttatgatgctttttgctggtggatgtccttacatttccttaatcgtagttctggaatatttcaaggagtaatagttagtagagcaggttaagcaaactaggagcaacccccattcctcaccttcccattttccagagccttgattctgtgtggtgtgggcagccatgtacagtaagattggtaaacagtatgctgactcttcctttttgaccaaaaaaatactgcctattatttgttgtgcagaggaggaaccgttgatggccaaggttttccgggtgaaaatggaacagtgacaggaaaagattgcccaaaaggtctttatggcacattttgcaaggtaacttgtagcaaaagtgtgtttgctattttcgaattattgatatatttgtagcttattgtttctttgtttaaatcagataacatgtcttcttatcaacatagccgcatgtcatagttgcacttcaattttttcagtccaacctgccatactacttattttctcactttgctgcaacggtttttatggcacgatgcaggcctgtcctttaggaacatataagaacattactgggtctttgaagtccttgtgttctccatgccctacaaatgagctccctcatcgtgctgtctacataagcatccgaggtcatttctattgtttctttttgtatgcgtctcaagtgcagatcaaataaatttagtgacagaattatggcgtctaatctgcaaatacatatgtcgttgggtctatggttttaaattttctaaagaattataggctgtcaatggtcctatatctaatgggattatttgcaataaatctgtggacacgaggtatgcataccacaaagttccatgcggcctagctgctagaagtgccttgcttttaactgattgtcttgtgtaaactaatggctagacggaattgttgctgtatataattattgttgtttactattttaatgagagtatgaagttctgttctctcatgttttagcattttcaaactcttcaacttttgttagctttacatgtgatatatgaaatgtttcggccagtttaccttaatgttctaaccttagatattgtttttgacaggaggtgttactgaaaccccgtgcccatacaaatgtgtgtccgatagataccgcatgcctcactgttttactgctcttgaagagttaatatacacttttggtggaccttggttgtttggtctgtttctctcaggccttctttttttattagcccttgttttgagtatcgctcggatgaagtttgttggcactgatgagttgcctggaccagcaccaactcaacatagctcccaaattgatcactcttttcccttcctcgaatcactcaatgaggtagcagaacattctgcattcctaatttgtttctttaagctgtggtgtgattgttctggtttttcgttgaaatctctcctcatgtggtaggtactggaaaccaatagggccgaagaatctcactgtcatgtgcacaggatgtatttcatgggtcccaacaccttcagtgaaccttggcatctaccacacaccccacctgagcagatttctgagattgtgtacgtagatctgtccacaagtaaatcaagattatttttgaacaacatgcattcagcctttgggctcttttgtcattcttttttccttatctttactggttttgctttttttgccacaaattttacctgtctcatttaagattatgtttatcggatttttgttaggtatgaggatgcatttacaagtttgtcgatgagataaatgctctcgcagcatatcagtggtgggaaggatcaatttatagtatcctgtgcatactttcataccccttggcatggtcttggcaacagtggcgcagaagaagaaaattacaaagattacctgaattttgttcgatctgaatatgatcattcatgtttacggtcttgccgttcacgtgctctttataaagggctgaaggtatgttcttttcagtgccaaatccctggtatgagctttagtggttttttatgagctcgacaatcaatttcatcaattatcttggaatttcttgaaattatgttgtttagccttactttctcagtcatctagtgtatgttaagtgttcttcatttgattcaagctttttagttaatcttcaattgctataagagtatgtaccttgtacagcatcattagacgtccaaaataaccagatagatcttgtcactgtactgttaagaaaaagtctgttcaaaggttctaaaaagtggtaagtggtattattgaacccaccttgtagcgatcatacagcctacccatctgcttacgtggtacgaggttgggcacccatcccttgttgccttatggagttttttgttttttttctgggaacactgaatgtaattgagttacaaatattgctgtgttgattctgtgtgcattatctgcaactgtaccagtacaagaaccagaactgcacttgtattatgaatttttatacaattatcagtctcatcacatcatggattgaggtatgctttctggttttccatttgataggttgctgctacaccagatttaatgctgggttatttagatttctttcttggtggggatgaaaaaaggcctgacctcccccctcgtcttcatcaaaggttgccaatgtcattaatctttggaggcgatggaagttacatggctccattttcacttcacagtgacagtgtggtcacaagtcttattagtcaggtttattctgaaacatttcaagctgtactggatcactaagtgaacaattcattttattagcatataacatgaacatatttttacagggtgtaccttcatcaatatggcaccgccttgttgctggattgaacgcccagttgcgtttggctcgtcgtggaaatctaaaagccacatttcttcctgtactcaaatggcttgaaactcatgcaaatcctgctttgaacacataccgcgtgcgtgttgaccttgcatggttccaagctacagcactaggttactatcaatttggtctagttattcattctgtgggaccattcagtagtggccttcaaggtggctctagaatgaaatttgattatcatgcgcagtgagtcatttgctttagctctgcacattttgcacttatcatattaaaatttatcccactgatccgtaccatgctgtgcagatttcagaacacagatgttgattctcaactagaccactcaaggaacaatgatgctgttatgcttaaaagaataactggcagagttctcgacattgacaacttaaggacactcaaggacaagagagatttattttaccctctttctcttatattgcacaataccaaaccagttgggcatcaggtgacttccattttgcacagctatcctgacatcattgcaacccctagtttggttatgatggatctacacaatcttgaacttaccaaggttctttttctttcctgcaggatcttgttggtttggtgatctctatattgcttcttgcagatttcagcttagtattgcttacttttctccagctatattcatattctatgatcgatgtgttgttagtgctgtttgttcttcctcttgggatactggcaccctttcctgctgggataaatgctctatttagtcatggaccacggcggtcagcaggtcttgctcgtgtgtatgcgctgtggaatattacatcattggttaatgttgtgagtactcatctttgactgtacttatattttgatattaccagttcatttcaaatgctttaggttccaaaaaaggggaaattatataatttggttggctattatcattgctcatacatccacaatcacaagaacagtaacacacagtttcggtttatttggtacagtttgctatagtgtattcagttaggcagtattttcccacttcttgatgtgtcaagaaagcctgggctcatcaaggtatccagggttctcgagcacagtggagctgatcttgagctcaaacccttgactcattctcaagtcccatcaagcttggttcttttaatatatacttttgagcatacatttatgaagtccatgtgtcttattgagtcgaagtttgagcctgtaatgtaccaaaatacatgcattttagatatcttttttctgagctcaaatcctgatgtttggaagaactagttgcatggaattatgttgatgttcttactcattgcagtagtagctatatttcaatttcttaaggacattacaacagctgcaatgcatctttctttctgctaatggtaatagcaagtttaatcctttccattatggatcttcttaatctattcacacttggttcatcccttgcagatcgtggcctttgcgtgtggacttgtgcattacaagtcttcagccaaaaggcatccaagcatgcaaccttggaatttgggcgggtaagtaaccttagctgaaaaccaaatgacatttcgctactgctctaccataactgttgctacctcaaaaactctgcctctgttcttttcacacaagcattggtacttttggcagggatgatactagctggtggctgttcccaacaggacttgtgttatgtaaatgcatccaagcaagacttgtcgattggcatgtctctatcttagagatccaggatcgtgcagtttatagcaatgacccaaccatattttggcagtgatggcatttgtatcactgaattgatcatcagaggttttggcaactcgagtttttgggagttgataaaaaggaaggctaggggatgagttgattctttttcggcccgtcagaggaagcgaagtacacaaagtacattgcttcttacagatgcatgcttatagtccatttgttaaccttgtgcagtctcagatttggtttccttgtacataaaaaggttttattgatccattctttgtaggatctggacaccatagaattataaacttacctgagctaatcatagagatgagatggtggggaaagaatgtctcttgttcagaacttctccgagtctcctgccttcatgttgacgtggaaaagagcgagttatcagatttctactccctccatttcatattacaagtcatttgacttttttttctagtcaaacttctttaagtttgaccaatttatagaaaaatatagtagtatttttaacacaaaacaaatatattatcaaaatatattcaatgttagatttaatgaaactaatttaatattttagatgttgctaaatttttttatatacttagttaaaggagggagtagaattgagctaatgtctctttcagcatctagcaggctgactttgctttctatcatgcttgactagcatatcgaatagcatagtgcttcctgtttttagttcaaccacgaatgaccccaacaacataattactaaactcgcacataattttaaaagccaacaaccaatcaggaggttgaatgattggcgctaagatgagattcttttaacaaattgaaagattttaaccactcatcattaaattcaaagggagcatatctagctagcagataagttaggggtttagcaatttgagaaaaaaactttaatgcatcgatagaaccttgtgtgacctaggaagctgtggattccctttacattgttgagagatgaaagttgcttcattacttctatttttgctctctccacctctatccctctttcagaaattcgctgtcctaggactatcccctcttgaccatgaaatgacattttttttctccaattaagcatcaagttcttttctttacaccattgcaaggccttgtctaagttctcgagttaatgatcgaagatttttccatagactgagaagtcgtccatgatttcattcgtcatttcggagaagataaacatcatgcacctttggaatgatatgggtgtattgcacaacccgaacaacattcgacgataagcaaatgtggtcttgctttgatcatcgagatgaataggactttggtgatagccagaatagtcatcaaggagacagaagaaattatttgtaagccgctctagcatctcgtcgatggaaggcgacggggagtgatccttcctagttgccttgctaagttttctgtaatctaggcacatcctccatcccatgacgattcgttgtgggatcaatttgtttttggcattttcaacgaccgtcataactccttaggcacaatctggattaggcacattatagaagtttttctatgggatagtcgatcagaagatcgaagtcagggactttgaacacgtggaagtctagggtggcttcgacattctcgttcctcataggcactccacgtagaatcccataaacttctatgataggacttgaggaactccgaaaggttttgtcggttcgtactaatggctcgtgatggcaacacgagctgacttcgttgatctgaactctgcaatcgtagcaccacatctcctctagtatcaaccatgtcgaaacccgatagaccttgctaacaagactaatccctgcgtgcgtattgaagaacaccgaactctgcaatcgcagcaccacttctcctctagtatcaaccatgtcgaaacccgatagatcttgccaagaagactaatccctacgtgcgtattgaagaacacaagcaagaacacgaaagatagcaactcaattgtagataaatgattaatcaagaacttgaatttggggcttgtcacctaagcaagttaatacaaaggttgtggacatgatgttagcaccggcagtgggattatcgagaacattcactgtaacctccatcacgagacattggatagttagggacgatagggagctagtccgaattacttcggaagaaacctctacatctcttaaccattcatcgctcatgatgatagttaattccctcacaatttccttgagaaaattatcttctagaggttcatagggagtacccggagcaggagatgtttcgttgtggacgaacaagatgttccatggacaagatccaagagtttccttccatttgttgtggttttgtgtgcaaacgaacctccgggatatgaggcagagtccttgtttagacccaaaccgaaatattgtaacatggtcgagtatagacaaatctgggtcaaattgagttaacaatgaaatcctagcctaagctacttcaatagattccttcttgcactattgaaaaccgagaacttccatccgtagggagacaacataggttaacaagacaaaagcaagatagaacctacttttgagttcctcccattcaccgtttgttttcctaatggtatgagagtatcattgttccgccctctccatgagagagaacggaaacaacttccacttcaaagtttcttgcgtcatgcctgagattgtcaggcatgaacacaattgctaactctcgtagatgatggtaggggttttcactgtcgcaccccgagaaggattttgcccctgaaccatggttataaagccagtcaaatgtgagaatgagttttgaatagatagctactccatggcaggaaagaaaagaaaagaagaaataaaaagaaaagataccagggagaactaggttcaaagataatataacaactattcccaagcaacgacaccagaaatgcttattggtatttgttacgatcacaaataaatccgcaagcgcacggataacgctgtaacacttcacctcagagtattccaagggtatcgaatcacaaggaacatgtgtataacatcaagaaatcaagttcatccaacaacaacaaaatggtaggcggagagtagggagggtttctatgggttaaaattcttcaattaagttaaggtaaaactctatcacttgcttcaggcaccgactttcccctggtctgccaagcgaatccagcctacagcccaatgacgtaccggaatgtggaggactacaaaagacgatcaaggctgttaccatttgtcgcctacctctatagcccatgaaacacacaacaaataaatgtaacctataacctaaacactacgtttgcattatcaattactactctagccttggccaagaacttcattttttatccaaagtattagtactagagtacttaacataaatattaagcgatgaacctgcaatgataagcatatattttacttatacaagaagagtaaataccaaaagaaagcatgaacacttacttttataaaaagaaacatccatcgaggtacaagagtggaaagagtgtcagcaactccaacactcctctagagcttccccttattctctctcacaagagcgaggtgatgaactctgctctacactgagagggacacctcgctagctgggctttggagatgaggccttttggcgaagtcaatttaaagccatcaaacccttcagctaaggaaaatgtcgtatagagtaaagggatacccacaacttcgtggatgatggccaccttcccgcaggcggtgctgatacgcggtcatccatgtgccgcgcatgacgcacgagctacacgacaaccctcctccctctagtctttcctctctctcctctctttatacgtatatatacatacatataaaaatatatattttaatgtgtatacgttttttttatgtataaaaatttatacataaagtgtgtatacatacgtatacaaactttatatacgtacgtattaaaaaaatatggaaaaacctagaaataatatcacgtatacaaactttgtatacatgtatacaaactttgtatcctatatgtataaaaaaaagaaaaaccaaaaaaaaagaaggaaaaaaccaaagaaaaaaagatatcagaaaccagcgggacacatgtccactcccacgcgcgcgtccccccgcccctcccctccgcgcgtgccaacgtgccacgcaggggagcgggcacgcggatgaccgtttattagcattttcgccttcccgctcctaactccttgaaactcatctatctcaacatagctcaaggataagattaaaaatatagtatgatgttccattttaaatcaaatttgggaaatgcttatgcttaaagtgctaagggtgtcttgctatgagcacacacatacatgtgagtcctctggcaccaatcctttattttcctcatatttagctttttcgtatcaaatgacttcccaagctactttaccaacttgatgaactaatcatcacaagcaaagaaaagaaaataatgcatcttttccctactccctaagagaattgtctttttagttttaagatttgtctcacagagattgtttttatatagtgatatccaccagaactcctagtaccacaaaatatatcattctggttcaagattgccacgaccattttcgagatcctacgtgacgctgatgtgacattatcatacagatgcaaacgtggcatcatcactagcctacagaaactgacgaagtataaaggcataggtacatgcaaacaaatttagaaacctgccgtgctccttaatctactacattaaacttgctaagttgtcaccagcccacgacctgaatccacactcagccttatatatatatatatagcctaatcaacaaacggtattaggaaattacatgcccaccaagactttcacgagataacaccaatggttatttgcaccacatcattttagctgatagcaatgttcttcttgcatcatctgcatgagaaatggaaatgcaaggagttatacctgtgcaataaaataaatttgacagcactaagatctaatctgaaatttcagaagtacactatacaagatgaaaacaaattactatagcagacctgcgatagttgcagcagaaaacttatcaggtatattagcttcagattccactgatgattttgctatagcaatcccaaccgcaacagattgcatcatacccaaacctccacatagagctgaaatgactccaccaacaaaacaatcaccagcacctgtgaggctaaccactgaggcagatactgcaggaaaatgaaaaacacatgttctggaagagccttctctaggcaaatctacaagcatgttagatggaaaacatcgctccaatttttgaagtagtggagttgagaaagacatcatttcagactttcgctggtccatcaaacttgtgctctctttgcaacaaacaaaaacaccatttgagccaagcgtcaccagaagaaactttatgcccttttcgaggaggaaaaacattgctgggctgagcatttcaaacaaatactctacagctttggctttgttcttggactgctccattttgacaaaagtatatttctcaggaggagataatgaatttgccattgccacaagctcaatctcatttggggaagtgtaagtaatctgaatcaccaggaaattattaagtgacaagaccttaacatgatacatagtaataagtaccaattcaatcctttgcactcacatattttgcaattggtgcaatccttgaacccttcgcaagtgagacaggctcaaaaaacacaggcactcctgattcatgtgctactggggaaaaaaaagaagaaaatagcatgcatgtcatcaactttttgatgcaatgtagagattaggacaaaaacataatggtgtaataattgacaggactgtctttctcatttttgtcaaggaagctcctcaaaacgatggtcaggagggacatgagtagtgcaccagtatactcagagtcagagataatgcagttcaataataatacaattctataaaattagggagtgtttacaattagaattgcatacattagtaccccgtccagttaaatttatgtggtactgggaaccgcaaatatttttgagttttgactagaggaagtataatagggtagatgttaagaatattgacacctaatcagataagaaactcaaaactgctgtattccaagcttgttgcgaggcactcattcgtaccctgctgatcagccacactgatgtcgagcgctgcggggcagttgttccattgacaggttcaacataaaggcacctatttttcaaatctctttaggaacaccaatagtgcatgacaagaacattcttctcactcatttccccttttgatagaattacagatttctgctattattaggttcgaaagttataaaattaaattagttaaggtgaaagtttgaaagtttatttccaggtaaaagtttcagagttaaggtgaaagtttgaaatttttaggtttcacgtttccacagtgttgcagagattgtcctgattttcttacttcaaattttcattctagccttcaaagatgcttagaattcctgatattgagttaaaacctccaaattactcaaattgagttgaaagtttccaaatggatatagaaagctgctggtttctcgagttgaaagtttttcaaggtgaagtcgaaagctcatgttttcttgagctaaaaggttttggaatcaagctgaaagctcatgattttcttgagatgaaaaatttcaaatcgtaaggtggtgatttcttgttttttttgtaagattatatcatagagctaaaaataaaaagcctgcaaacagcatatctctaaaaatgtttcttgtatacattattactttttcatttcttctggcagaagactttctcatcggttggcacaagacaacaaaagatccttgtttgcaggcaagggaaggttaggtgcagccacacagatgctattatattgaaaaagtggtgtcggctgcaacccttgttggaaaggaaacacaaagatccagcaccgcatgcatgcaaattaggtaacccctttatttattctacctggttcaaatgcatactagtatcagctatatcagcctatcacataagcttaggagctcactgcctaagtaaagaaataaggtggaataacctacttttgcaggcggcttcaagtgaatcaggagataaatttgcatcaagcattagtagaggtgcagtggagatatgaagacggaactgacatatccagctaggagagagaaatttttcctgcccaaaaagaaatggagataagtacagtgattacttgtcaacattagcgttgatacagatcgaacactacacaatgtgctgcaaaattcttacaactgccccaacacttgcaacgccagcaattaattcaccgctcccatcaaacacatttgatactattggggttgttacgtcatcaatctgcagtattcctatgtaattattagcaacagtgttagctaacagaaggaaaactatgtactccctccggtcataatatttgatatttaggaaaagatttggccaaacttctaaaattttgaccatcaatcttatattaaaatattataaattctaaaaagtttttgacattatgatagtaattttcaaggacaagctgtgcttaccattttccatttttgccatttgagaaattattgatggtcaaagtttcaaaagtttgactgaatcttaacctaaacataaaaatttatgaccaaagtgagtatatatttataagaaataagttcattttatctgaaccccttgaataccaaacagaactacaaaagcaatagtggggcggcagattcactgccaccaccactagaggcttttaaaggagtacatattttgtagagaacaaaaaaataccct

SEQ ID NO: 45590 - DNA, 3172 bp, Oryza sativa
  unsure (1)..(3172): unsure at all n locations
tgaaaaactacagcctttcctaacaaacataacaaggattagactgtaatttcaaggatgtatacaacaatatgaatatcttcacacttaccatctgtacatagtccagccgacctccagtatttcaaaaggaaatcccctgcagtagaaaaaatggaaagtattgaagcaaataactacccagagagcagaaaaggacagagtaattcaaaatgagtaaaccaatttagaaaaaaactatatcttcacaaatagataaaagaaatacctgccatatcatttccaacaacactaatcatgaatggtcgagtctcaagcttacaaatgcactcggcaatatttcttgctactcccccactgacgtacttaacctaggaaattcaaatgcattattacttgattttttaatttttttaactttttgaatttttaattttaaaagtagaccctcccaaaacttttttccatctgaagcttttggccacgccagcccgcctggcatgacaaaacaacactaacacaccacccgtagcaggcgtgacagtattgttttgccacgccagcctggttggcatggccaaaaggttcagatcttgaaaataagttttggaagggtttatttttacaattaaaaattaaaaaggtttaaaaaaaacatcctacttcaacttctcataaatgattgaaatggaagaagttaaagctcacaagatttatggcctaaacctctgtatgaataagatgcatacagtaccaagcttatggatatcacaacccaaacatcatcctgcagaaccttctttctcatataatgaattcaacactagtttacattgaatagtattattggtcatgctgatccattcaatcacacacatatgccatccttcttgcataccagcaaataagcagtttgctcaagctaagaagttaataaagagctggatgggtggtttaccatcccaggcacagtcgttccaggatgcggctgcatggatggcttggcatggatgtccagcaccatccccccaataatcactggagatgactccagcctgatggcacctaacggattctgtgcagaaaacaacataaaaattagaacacaagaaaactgaagcccaagaaacactagttagaaaggtactcgatgggactgcaggctatagagaggataagttgcagtagttcctcttaaggtagccgtacctggtaaaggataggcggtgatgctgggaggaggtggcggcagacagactccatcctccgcaggggagaggaggtggtggtggccccagccatggagaaggacaggttcagggggccaaagattgcaaagccacctatcaagatctgccagtttgggcagtggcacacgagtgaggcctacgagaaagaggatttcatttagtttatgccacagatgcagcatccatacccagaacatcagcaattgaaagatggaaataagctaaaaatctaagtgtttgtttcttctcaaccattgctagccttgccaattttttgctatagcaagatttggtaagccaaaaattttggtagagttggttgtttggattgctaccaaacttaaccaatccaaaataattggcattgccaaatttgtggctacaaaccaaataagggacataatttttggcaacgcaccaaacagcccctaaatgcttaacatcatcctgacatattcctgatacgagattaacaccacctccttatcacgcgtaatagttaatttcatgccactaaaacatgataccaactttcgcattcttcagttgcaataactgaataccaatgatagaaaaccatgtgatagtattattctagttttagctttgtcacatggagtatttttttctctatttctagtgaggcagtatagtacttagcagtagcagtagcaacattaccaatggattagcacaagagggcaggcaatgccctttttgctaagttcttgctattggtttgttctcagaatttagaggcagagcagctcatcgcagcgcaattgcctctctcaatgaagttaataatatttacaggcttgaacctatcgtcaatttacatgttatcagtgaagttattaagatgaaattggaagtctcataatgctcatacttgagacttattgagaaaagcatggcaagaataaagctggttgggctcaaagctgacatacaaacaagcaactacatatttactttgctaaagacagacagaatgcctatgttccccttcatatttgattgattcaagttaatctaaatcataaaaccaggccatctttgaactcattgatttcatatttcacatttcaatcaaataccaatcatccaggaaaagaaaaaacagagatcagagaaagaaaaatattgtaaaaagatgaaaaactacctgttcagttactagctgacttgcactagacttttgtttctggtcctggttggcgttgatccaatgcccatatgtgcctgagtgctgagtgctaactcactttcaatttatgatacttcaaaatggtgttcctagtatatcaacatttccaccaacagagtcatggtaggcattgcataatgccaaagacctaggaacgatgcacaaggcatggtggccagtggcagcggctgagtggcataatgctgaggagctgggacactcgctctttctagttattatgttgctctttgcatgatgcaaaagttcaataaccaggttgacatgttatagttaaaacccatatgacttgaacaatatgtcaagaacttttattgtgtgttgagcaggcgctcacgagtgcagattttacatcatcttctactaaagtgagcaacacaaaccaaacaaattgctctgcaagctcagttttgaagatgctgtctgactaaatcatgagacattataaatgttttaacaacaaaggacccaaaccatgggacttctatttagagtaatggagtgcactgagagttactagccagtgctaccatcagtgatgtaccctttttttttataacgggatttaccccaggttctattggaaacggaataaaggtttgatgaagtacagaaggctgggaattccagcttaacaagggnnnnnnnnnnnnnnnnnnnnnnnnnnnnnnnnnnnnnnnnnnnnnnnnnnnnn

SEQ ID NO: 45591 - DNA, 2172 bp, Oryza sativa
gttatagttaaaacccatatgacttgaacaatatgtcaagaacttttattgtgtgttgagcaggcgctcacgagtgcagattttacatcatcttctactaaagtgagcaacacaaaccaaacaaattgctctgcaagctcagttttgaagatgctgtctgactaaatcatgagacattataaatgttttaacaacaaaggacccaaaccatgggacttctatttagagtaatggagtgcactgagagttactagccagtgctaccatcagtgatgtaccctttttttttataacgggatttaccccaggttctattggaaacggaataaaggtttgatgaagtacagaaggctgggaattccagcttaacaagggagccagctactaccgagaacagcaaaacaacatatagccttcctatcttgtcaaagcatctacagacccaaaagaacataaatcacatattgtcccactcctgacgatgcttccagtctttaatcaacgatgggaggcacttggttcagttgttgtctgaggtaaagcgaggggagcacagccatagcttcaccatcgacagctaggaggtcatcactgtcactcgtgaagcacttggttccgaatttgacactgtcagaaagaagatgattcactccaaacaatctagtcttgatgactaggaaatgaaaagatgaattgagcatacatgtgttttgtggaggccctgatgtgcagcgcctgaacctgcacaagaaccttgtcgccgacatacaccggtgccgcaaacttgagcgactgcctcgcatacacggctccaggctgcattagcatcagcatcagatactagaagggccaggccagcacgtcatgccgatgcagtgctcgacgaaatgccggtgcaccatctggcaggcatgagagcgagcgagagagagagagacaagaggggcggcgtacgaagtgggcggcgatgagggcggggaagagtgaggcgacaagcatgccgtgcacgacgcggccgcggccgaaccctcccacctggcgggcgaaggcgtcgtcgaggtgcaccgggttgcggtcgccgctcaccgcggcgtacgcttccacctccccatccgtgaagcgccgccgctcgcgcagcgtgtcgccgaccttgaggacgagggaggacggcgccgccgcggtcgtcgccgtcgcattgcagcgcgcgagagggatgatggccgccagatttcgcgcgaacgctcgcatcgatccacccaccgattcctttcccttccttcccccactaaaaaatgttgtgctagccaagcccaggggcggatctaaaatggggggaatccgcaaacttttactatattttttaacaaacaaactgttgtttgcggcaaatttctagaacagaagctagggtttacgcaaattcgagaagaataagaagtaaagtgcgtggttctagagatgagaaagaggatgggctgggcgctcaccaggatgcctgcgcccttgcttgctcgcgggatggatggggatcggcggcggcggcggcggcggtggcggcggccgaactcgcgagtcgacgacgagcggacgccgcacgacgatttcctttttcgtcttcttttatttatttttttttcttctttcttgagaggatccactttcttctgggactgtagtacctacgtactccctccgaaaaaaaaaaaagacaaactctggtctaatgtttgaccgtccattttatttaaaaaaataaaaagaaaagtcacacataaaatgttaatcatgttttatcatctaacaacaatgaaaatataaattataaaaaaattttatataagacggacagtcaaagttgtacacggaaacccatggtttgtttttctttgggacggaaggagtaggcggcggcgtgagtgatgatgctccaagatgcaaaccaatttcacaatccacaacggctttttttagcccctttgaaattgaggattagcaaatgaattttagagaatttattttctataaagccctttgattcataagaagaggatagaaaatttttcataggattgcatttctaccgtcaatttcataggaaaataagcagcggttagacctcttgtgaaacttttctttgttgagtgtctcttgtggtgtaatcaaagagttttt

SEQ ID NO: 45592 - DNA, 8634 bp, Oryza sativa
agtatcatgtaaagaatgggtgggaattgaattttaagtcatgatataggactaagatttatctcaaaaggtaagcgtttgctcttaaacccctcttcccaatctatcctagaacttccatgccctccaaccaaacaatagatttaataactctcgttccccataacaattcccccaaccaaacgcgttgcaagtgctctagaccctgtttgattccgcttaagattattaggagtaagctgaaacaaataatagcttattatgatatattattacaatctacaagccagatttctataatctagtaatccactttaaaggtgctttttagattattgggtggctaacaactaacaaacatctaataatactgagaaacaagcagcttatagcttattctatgccggcttattataatccagtttatagtaatctaactcaatattttattttagattacaataatcttaagctgagctgaaacaaacagggcctaagttagtgggttgatgtgaagcaaactacaaagaacttccaacagttcttatgtaaagcgcgattttggtcggttaaagaatatgagaacattatatgtaagtccaatcgctttgactacaactgataagtcgtaatgccaactcaaaataatttgttatttatgagtaaaaattttatacgtgtgctatagagcttaaaaactggtgttgaaaaactatttatgacgaaataacaatcaaaattaactctaaaataagttttaaaatttaagctttggtcgtggctaaaaagcaaaggatggagctgccacaaaatcaagggaaaattgcagaaaacaaaaggacaacaaaaaaaacacacatcagaagtcacttgaaatttaacatttcaccgcataaatcattttgttgcaaatatcaacctccctatcagttttgttgtaaaaaaacactttaatgcactcatgcttaattgaatcgatcccttatagctgaatagcgaatctcaacgcgataacatttaagctctcatcaccatttctatttgtggaatctccgaaaaagtatccagattatactttaaaagtatttaatttggtaaacaccacattgatggcttataatttatgaaaacatgttgattcagttaaacacatacgcactaaggtggattttacaacggaactgagtagaggtgggcaattacaacaaaataacttatgggatggaatatcaactttaagtgacttatggatggtttttaaaaaattttcctccaaatcaatattgctaagccatccgcaacatacaataatataatatagtaaaggcaaactgattctacagcatcgtaattttgcgattttagttttgtaccacaaacaaaatccagtttactttactggcaccagaagttcccatcactcgatcggtgatctgtaccacctaacagtcaaacttagatgatctctcaaggtcagtgttcacaattccagtttcacgaaatccgtgtttggaaacgataggaaaataaacgataaaaaataatagatcaatcacagaagacactggattttggaaaactctcctaaaacagaagaaaaaactacggcgccagccagcaaaatatcttcactatatcgaggtgaggttagaacgtctaacggcgtcttacaagagatatatatgaaggtgaaaccctaaaaggataatgatccggcccaagcctccgcttcatttggcataagctagcctttattatgtgcaaatgaatttaaatcacaactcaactatccggactttctagatcagtcaaaaatgtaaaatcaaaggtatttttaattgttattctgtgatgaacaattggcattggagattattggttttgttatttggaatttatttgcgaagtggttttggagatgattggatttcacatgtgagtactgctgtttgttggaccggtcagaccgggcatgtgctgccggtcagaccggtgcagcccgcggtctgaccggccgactctatgtcggtttcggtttcgggttatttgtttggatatccgtgattgtttcatgattatggcttctagatggatactatgcgtatgtaatactgtcgttagctactaatgagtcaagttggggatagtttggtctcggaatatggtttctttgtttgttctatgtgtaggtgactcgggatgccgggagagtatttgcggtgatggaccgggagtcagcttggggataagacgacgtccgtggtggtcagagatcatgcgggatactaagactagagttcaatacacgtggttggtgaagattccatatggtatacgatggaggtattgtgtgcgtatgggatgcggagtcgaatttggaaggagtccaaatttggtatgattggttatgtaaagtttatttcttctactagagggtttcctagggtgattaggatttctagtatgattttggttcgtggctttaggttgcttgcctcgggtataaatagagggggagcgtaaggcttcccagtatcgcttttgaaagcaattgagttgatagttgaataagggtttcgtgtttagtcgagatttttgtaaggagtgctgttggtgcactttgtaaacacagagagaatcaataaagtcgtcatccactttaagagttcttcgatctgtgtttcatcgggtttcggcggcataccggcggttagaccggcggcaagcaccggtcagacctgcgggcgcaaggcggtcagaccggcgacgtcgacaggcatggcaggcgatctcagggtggtcggaccgatcgatctacaccggtcagaccgacggcacaggcgcggtcagaccagcaggacaacttcggtcagactgatctccgtcgaatttgagggtaacttttatttccgttaaaagtttcggtttttgagcataccaaccattcacccctctctggttggcttagttcttgtagttcgatccaaaaaaacacaattcacttggtttttcggtcaaacaaaaagtattcaaactgaattttaaattttgacacaatttattcggattacatcagtttttcagcttttcgatggatttcacagtatcatcaattttcgatggatttcacagtatctgatgatactgctcatgagcggatttcgattcagggtcgcgattgtgaaccctgctggagggagtcttttacccctatgccattaagaaagttggaggttacgcgtgtgccacaaaaaagttttgagtctactgtatgccatgacacaaactttcgtttacccgtgtgccattccatctaccttctgttagcgaatgagctctgacatgtggaacccacgtatgaaaatgactaaattgcccctgaagcattttcatctctactaatcctctcccgtgcaatttctccagtgtgcctcggaccctagcctagccgccgccgcctcgcctcgcctatccggcgacgcgcctcgtctatccgccgccacctctctagccgccgccgccgccgcctcgcctcgtctatccgccgccgccgggcgtcgccgccgccgccgccgatttctcttctaaatgttccatccaaagtggctgaaatagagcaagggcaaaatagatctttcaaacctccgttagtctccgttagtgctgattccatccaaagtgacgcacgggtaaacgaaagtttatgtcatggcatacaggagactcaaaacttttttatggcatacacgtaaccttcaactttcttaatggcataggggtaaaagactctgctggaggcacgacttacacgcaaaatgcgcaattattctctgaaagaggatgaaccacgtgattaacacaaccagccactaataacaaaacacgccttcatcaattcgtaggccgtagccagctcgagcatgctggcaaattctcgcacggtctgacgaaatcacatgaaagatacgtcaaacgcccacagcaacaatccacgtctcatccacccatcaattccaccctcctcccaacggcagcaattcctcaaaaaactgagctgaaatggacatggccaagtaaacaacaacactggtcagagttaataacctataatcaattgtcgaagcagcaagaaagggatggaagagagagagagagagagagagagagaggagtcatgtccaacactccaattgtccatccagttaagaaaagcagcagcacaagctgcacgagtagagagcactatcttggctagagaacaaagccagattccttggagttgtcctgccttctgaacaagaacaggccaagacagaaaggaaacaagctcaaacagaaataggagagagagattgagagagattggagggttcttgctagctttggggtgctttctttcttgcttttttgcttttcttggcgttttcgatggccgtgagctgaatccggagccttgcctgacacccccaattttagctgctgcttaggcagcctaatttggggattttgtctcaggcagtacaaatcccaaaaccaaattcagagactttgttggctaggctgggttaatctcctccccggtctggtcgattcgaagccatggagatatagcctgcaagcttcatggggctggagcgagctcgtatttcttgatgcaagtttcagcccctccaagaacaggttcaggttcttggccataatcttcttgcagtcaaaaagaaagtctcaatttcttgctcaaatgtttggattttttttattatcttttttttttggtgatcaaggtaggagagattatttgtgttccttccattgctggttggttgctgcagtctgcatgtggtggattcttgggaagaaggtggtggtgaggtgaggtgaagagggagatgcccaaggtggccggagatggcggcggcggtggccggaggagcgaggacttgcgcgttgttttcctcagggtcggcgccgccgtcgcgctctccgtcgccgggctgctcctctcgcggcggcggccacggcagcaactccggttacctcctcctcctcctcgctcaggtatcaacagcagaggcgtcttgttcaacgtttttttttcatttcgggaagaaattccagattttcagatggaaaacaaaatgaaatttcaacgaaaaattggaatatgaacaatattttggctcaatttcaaataaatttgattcgttttgggccggaggaacattcggacccaccggtcaatctgaatttttgggaatttcgttccggaattgtgaacccgttgtttgttgctgattgctactcctagttagaaaattttggtgatgaatcgtttcttgatgtttttttgcagattcggatggaatgaagggtggtggagggctcaaggatgagctgaggatcctcaagaatgtaagaatcttgtttgcacataattattataaattgtatatattaatgtacttttcatacttccatttatatttagaatggttcagttttggatgtatggtcttgaactgttcataatccagctatattttcctcattatattataaattctctaagtctgtccatatcacatgcatttggggtgtggactttgcttttgttttttaatttcaaccttttttcttctctatttttttagtctcatactgcttgtttctattccagcagtttgacaaaatacaacttgtcctcaaatgttaccattgtattccatttttcttctccttatgttgaccctcttttgttttgattgtgaaggaggataccaaggccaaaatcatcaatggaaactctgtccacactaccactaccactacaacgatgaccaccaccgcgttagtaccactgcccccaaaatgtagaactcttgatgatgatgaagaattcctcctcccagaattcaacgaaatagttctcaaagaattcggccgagacatgggcaacattgcaacctcacctgcaccaagggtaagcgaagaagatgcaacgaagaccccggaaatttttgagcttagagaaatggtcagatcacttcaagaaagggagaagaccctggagctacagcttctagagagctatggtttgcaggagcaagatgtcgcggtgcgggagctcgagaatcagctgaagatcaacaccgtcgaatcgaagctatacacgctgaagatcgaatccttgcagtctgaaaatgagaggctgcaggctcagttaactgaaagctcaaagctggcttcagagcttgaggcagctagaatgaaatgcaagctgttgaagaagaagctgagacaggatgcagaacaagcaaaggagagaattgcctcacttcaggaaatggccgattcttggcagtgtaaggagattattactgaggggaaattcagtgctgaggttgaggaaaaattgagtaagctagaggagttggaaaatgaggcaagagagcttagggttgtcaattcaaggctgcagcaggagaatgcacatcttgccaggcgattggagctcacacgcctgccccctgtacccaagcccatcaataacatggaggtgaatatttactgttcttgaactgtattgtagctggcacttactaatcaatcttaatcttcagatagaggttgttactcgtcagaaggaaacgctgttcttgatatttggtttgaaagagcaatcaattgtttctcataagcgctactgatttttcaaactcatttttcagtgtttacttcagcttgtgttgctctgtcaggaactgaacaagtaaaattggttgcaggtaaaagcattgcaggaagctgatcatttgaggcaagaaaatgacaagctggcaaaagaggttgaacagctcaagactgacaggttttcagatgttgaggaattggtatatctgaaatggatcaacgcttgcctgcgttacgagctcaggaaccaggatgctccatcagggaaaaatgttgcaagggatcttagcaagacactaagcccccaatctgaagagaaggccaagcaactgataatggagtacgcaaatgctggtccggatgagaaaaactttgatcatatagagttctgttcagagtactcttcctcaagagcatcatcattaggcgaacccgacgacgcgtcgatcgatgtctcactgatgaacaagcacaagaaccctaagaagaaaaagttcttttcgaagcttcggaaatggtactgggaaaagaaaaggagaacaaaaccattcctactctggagaggaggatatcgatttcgagctgttcatttgacgagttcaatggaagagagtcaattgatagctattcttcattcatgacagaacctggtaattctggcaatcaacagcatgataatcacggctcccgttggcattctatggacagccaaagtgctcgacatctcagcaaggaaatcgcagatgcaagaaacctccatcttggggtcaagagtgtgtcttttggggaggggagagtgagtaattttgggcatagttctcaccttggcaatggtgaagccacggttcctgaagatgccaagaagattcacaaatttgcagaggcactgaagacatctagaccaggttctaggtcatcaaggaaggaccactgataaacaaatagcataggaacaatctgctgcagagtgcagtaggcccatcttcctggatgtatatatttctccagttcttgatgggagattacttatagaagatgctactggaataaagcacacatgctttattctgtgtaaaatgtacaatacagtatatagtagtgtagtgtactaacctttaatcccagccctcaaactattcatttggggttggcttgtacttattcagtgtattgttcatgtattgctctatgcatacttcactccagctacaaacatacagctctttgacaagttatttatgtgtgcaaagttatgtattttacaatctttatagcctagattagttaagaccatttgtatatttgagtatccaccttactagtatgtcctgctcttcccctgtacagtgatagctttccagggggagggagaggagctagcgatggaggccctcgtggtttgcctaaaatttggattttaaaagttaattttgaaaaaaaaatcatctaagtttattttcaacatctattatatactaaaagtccattaaacatcctacaaacgctttcaagccgtcacaaaaaaattcctacaaacactcctaagctgccatatggcactctaataaattagatttttttttctttaaatatggtggacctattattttttaccataaaaaataaaaaaattgaaaggcccacgttcctctccttccgacctgtacgtgtagtacgcacgccatgctaccgtacgtacgtacgtagatgtattggcccctccttcctttctgttcctctctctctcttatttttgatgacccttctgttcctatctctcctattttgatgatgtggtagagtgaaaacatattatatgactatacgatctaaaatcatatatttttatgcactgcacgtacgtttgttgcataattcaagacccaaattaactatatttaacaagtcaaagaaatatgttagggtaccgagctcgaattcgcc

SEQ ID NO: 45593 - DNA, 5509 bp, Oryza sativa
tctccataaaatacaaattgaaccaatctatctattatatactaaaagcccattaaacatactacaaacattctcaagccaccacgtgacattctacaaacgctctaaactcgccatgtgtcatgtcctaaaaatcagaaataatcttataaattctgaacaaaatgaaagctatcatcatcagttttaaggtccattatttataaaagttagaaaaataaatcgcatgcacctcctctcctactcatatgcacataccactacctgtcccctccctatttttagctattaaacaataaatatataatcaataatttatataatagaaaaaccataatatttaagatgcacgtctgattttttctctatttataattaaaccaagaatttaagatccatatgcttatattttcttatatacaaagtatgccattcgcccatattcaacccacatgccttgtacatcatacaaataaaattgaaataccttaaacaaattggttgcatatattacgtcattatacaccagtctgcaaacaagctaaattaaatcaatagtataactataaaactatttttttagggtgaacacccctgcccttttacatgtcattggaattgccgtaaaagaattatgaaataatccaacaccacatgttgcatcatcatatgttgtttttgcaaacttgcatagctaaattagatagacactatataagtaaatagaactaactaaaatatgaatagtccaagctaccaatgcatagcaaatccaatgcccatagttagagaaaacaaactccaattatttcgtgaattttttaaatgtgctgaaataatgcgagcaagctaaatgatctttcgtgtatttgctctaaactatgttaccatcaaattaacattagatggttcttaatgcaaatttagtatatcatagatatatatacatatatatatatatatacatatatatacatatatatatatatacatatatacatatatatatatatacatatatacatatatatatatatacatatacatatacatatatacatatatatatacatatacatatatacatatatacatatatatatacatatacatatatacatatatacatatacacatatacatatacatatatacatatatacatatacatatatacatatatacatatatacatatacatatatacatatatacatatacacatatatacatatatatatatatacatatatatatatacacatatatacatatatatatatacatatatatacatatatatatatatatatatacatatatgtatacatatatgtatatatgtatatgtacatgtatgtatgcatatatgtatgtacatatgtacatgtatgtatgcatatatgtatgtacatatgtacatgtatgtatgcatatatgtatgtatatgtacatgtatgtatgcatatatgtatatatatgtatgtatgtatgtatgtatatgtatatgtatgtatgtatgtatgtatgtatgtatatgtatatgtatgtatgtatgtatgtatgtatgtatatgtatatgtatgtatgtatgtatgtatgtatatgtatgtatgtatgtatgtatatgtatatatatgtatgtatgtatgtatgtatgtatatgtatgtatatgtatgtatgtatgtatgtatatgtatatatatatatatatgtatatgtatatatatatatatatatatatgtatatgtatatatatatatatatatatattcaagcgtgtggttgtggctttctacaccttcccggtaactctatttattttctttgtgcatagaccagtcaaaaggtgaatcaactatatgagcattaatcgtctatgaatatacacttgaagcattaactttggagtccatttagattttaggctataccaaaaacatggaaagtggactaactaagcttgacaaaaatgagatcaccactacgatgaatcacgatgaatcacaaggaaaccttcataggtgcaacgaccacatctcagttgtaggacacaatgactaggagctgtgagaaaaccgtatggtaggggaaaaggaacaatgagtttagctaggtcttacattttcaccaaccccccaaaactaatgaaaataaaaaccaccttgattttaatatgcacttaatttgttaaacatgttctaaacaaactaagtctactattttttatataatgataaagattatagatatttggttatactgatgaattaaatattatatagtatataacttagagaaattatcaaagtgatgttgatgaagaatatttgtcgaggaaacgtacttccgaaagatggcagaggctatctgattaatatgatccgttctcaacgcagcccacgatacatgcccacgcgaatccgcgggctacctttctagttggctttaaaatcgctacccacaaattatcattgttttgctaatacaccatacggcttattagtccttgattcaaccgtgcagggtcggcaccacttaagtctagggcagctgccatctgataactgttgttgaccaccttccttagctcaattagatgatctgaaagatagttcaaaccgaaattgaccacatcaaggtttaatagtttctccctccttaacaataataactcatatgtctgctcaagttgattccaccaaagcataagctcagatttacatggcaattgatgaagttctatctaaatcccatccatcaactcatatgtctgctcaagttgattccaccaaagcataagctcagatttacatggcaattgatgaagttctatctaaatcccatccatcaatgattgaattcctaaaaaaacctgagcatcttttgtccatgagaaaacaccattgactaaccttatcatccatcagtcctaatatcatgcatgtattgcacccattatatattgagatctcaagtattgccgtgggccaaaaatccccaatttgtaactgaaaaatatagcattaataaatcctcctcggtatcatgctcatcaattaaaattattccactaactctagcaaatagatagcaatgtgaaaaccaaatcacactgaattccttttctccactacacgatgccttgctgcacttgcgataacccatggtttcatgattttgttggaatgagcacaacaaagagcagttaagtgaatctatactgttggatgctccagcaacttagcaaaaggcagtgtagcagagcacctttttacaccaaaatgtacgctgtacgcaatctgaacaattcagcaactgaccataatacaatttcttggttgggttttataacttatgctttgagcggaactcatagtaggaattgcaactcggaaccccaagcttttggagctttgggctcatgaggtggtctaaatatgagatttttagggctcaacttttgtgtagtgcagatgtgcatctggcttatccaaaaaacttcatgttctttttccttaagttctctgagtattgatttgaggagacattttttggtggctagattgatgaaattttaactgctgtctcaaaaaagataccgcattgccaaaatgtatatggaggatcagaattattcagaaccacctctgcattgcgaaaatagctgagacatgttttccattaatatgcaatgtttgcttaaggtacatataagtagtactagaaacttgcacggcaacatcgagtatgtattgttactatttttcctttttcaagaatatatgttttgtgcattgtttgtctcatcttgtcaagttaccactatggatgttgtcctgttgattgaaaaaaatgagaatgaaccctagtatttcttaatataaaaatctagtgcattggttgcaaactctgtaatccaaatgatggtttcattaacagaatcagggtaaaaccttattcttcaaatcaaaatgcatcaaaatgaaaagcaaaatgtcttgtttcatgaggttcagttgttgtaataggttgcagccttgcagcaggttggcatcacactggaccctggtttcagtccagtggaagacaagtgatgttgcctctaggttcggagagataacagtaacagaagttgagtaaaagtgacaactgacaactgctctatttatccccctctattttttatatgctgtagaggtgtgaacttatcaaatgttaggactgtgggaaaatgtttggtttgttacttcaccaaatttttgaacagatggcgggtttgtttcgtacgttaccaaattttggtaaggtagggatactcgaacatatttggttcgttatcttaccaaaatttgtgatggcttgaaatggtagcaaacaaaacatgcttcagggtttagggttcttaaagccattgcgtagcagggtttacacttccagtttgggccaaaattgtagtatatttcgggcgagatagttgcttacccttgtgggcggggggagcagctcacaacaaacttgcagacgaaacaacaaaaaatgacagaattttaacatacaattaccaccaagctgaccagttgaactggtttgttgtccagctttaaaggaatatgttttgcagatcatcaaaacaatttcttgtgtcaaaactcaagcgcataacagagtcaacagacaaaacaacaaaaaaggggcagatttctgacccgatctgatggactggtttattagttgattcttaagaactgcttcccagatcatcacaacaaattcgaagcatgtcaaaaggtgcttgaattcagggacacagctagaaaagaaaaaaaaaagagatactgcatcttccctggtttctagcaagaacatgaaagtttggtgattgtatctgtacttatgttctgcttcagctggtaatgcataaaaaatgactctaagcagcaccattcatatatattacaaggaaagaaatcataggcatctacattatgtagaatgagaccatgtaatgtactgtaattaatttcaagaaacagtgtttggtacagactagacaaaaggtaagctcaaggtaaaccataattcaaggggggaaattcagacaacctattccaggatgtcatcgtcgatgtcgatcggggtgacctcgccgtcgtcgaactggtccttcctcggaggcgcaggcggcgcgaacagccgtgcagggccagttcccttcttcttgttgcgcggcctcgcctgagatgagcaaacagcagtcagcagatggcaagtctgaagaattgcagcaaacagcagcacaggaagcaataagcatatgatttttttattaattttatttttgtgctagagactcacatttccgtacgagtggttgaacctttttcccctcttggtcttcttgtcccctctcccgcagtaaactggtcacaccaaatggagtaatttgagttggaatcgtaattggttcaaactgcgaggtttttgtttcaatctatgttttggtg

SEQ ID NO: 45594 - DNA, 5105 bp, Oryza sativa
ccttcaagaactggagtgagcggggccgagagggtggcggcggcggcggcggcgacgcgagagcgggagcgggagaatgcggcggcggcggggagcgcgcagtaggaggagacggcggcgtggtggtgggaggaggggaaggtggccggggacgcggccatggcgtggacggcgaggagcgccatggaagcgagagaggagtgagagcttgaggaatggatggaatcggataagctgtgcgtgcatcggagtagataaaacggagggaaagggaagcccaggcccatggattgggctttgtctcttgggcctatggaccaagcccatgattggcttggccctctgcaattctgatgtttctctttcttttttttttgtcctctcatttctttttctatagataatcatttttttatgattaaattattactactagtataaaacttatgaagaatatagcaaagttatgatatttttaggacttctgaagacaaatctagccataacgtttttaagattttagaaatcgaaacgttcaaaatgatattgatggttaaagctcaaacactgttatgaatattagtggaagagatgaaaaaccagtgtttttaagtgtctttggttctgggaatgtgactatagcgtttgttgagtatacaaagtacaaacaaatagttttccatgatggcacctgggcaattaattaacccaaaaaactagtttacatattactagtttcaaacattaaaagctcatattagtaccatgacactttctgctacaattactgactaataacacaagttcatggcactttgtagacaggcaaggagagtgtgcataagcagggctttacataacttcatacagtatatatggattatggagctacagatgcaatccaaacacaacaaaaaggcaccattaagcattatgagtatctgattggcacaaaaacttttcagcgacagaattttcaagagactgatagctgctatgtatatgttctttattttccttggaactcatactgttcttcttacttccttgagctcactgcataatcacggggaccaacttgcctcagtaactgcatcagcagaaggaacaggagataaccaagttgtttagccatgtagcaatgctgaaaataaggtaaacagaaagagagagagacaaggatgtagtacaacatacctgaaaatatgattccagcttctgcttcagagtggcatgctccctcttcatcttctgaagagacctgcggcatctgaaagagaacatggcctcatcacatcatgtgaggaaattgcatgatgattggatagtatgtgaagaacaagttggacgagtcaatgaaatgcatacccttccagattcctgtcattgcagtttactttgaacacagagcactcattcttcatcctcagtgcaccaatgctgcgccaaacacaggccaactttagcgaattttgaacacataaagcaggcaaagatgacaagctttcggtgagaacattcatattaacaaataatatttgttcatttcacatcaataagcattcttaagtttgaatgtttttatattggttatttaagacctaagacatgattttacactgatgagacctgtaaaagaatattgttcactctgtgttctgggcatatgccccagttttatacctggatccgctgcctttgagttgttgcacaagagaatctaatctgtagaaatcctgagggtatttatcactgcatcaaaagaaatggaagtaaatgtaattgtcatgtctttcaaatcatgggtaatcattgtacaaaaaatcaattatctattcatatcgtggatgcagacatattacttacattgcttgttctatatttgtcaacagtcttgatgaatctttgaagaacagagccgcaacttcctcaacaaaattggggcttgattcatcctgcagttcttccagctgattaaactgttcatcaaggtaaccctgcaggaaaaccacgaggtagattataggcaaaagaaagaagcatgaaatacacaaccaaaaaaaaaacttttgtgcagtccatataatacaaataagtgtactaatttacaagggtaaatctatataattagtcaaagattaaaaaaaaagtcaggttccagcaagtgacttactcccttcgtcccataaaaaacgaatctagaaccggatgtgatattttctagtactatgaatctggacgtatatatgtctagattcgtagtactaggatgtgtcgcatccggtactaggttggttttttatgggatggagggagtaggcttcaccctagttaagtataaaggaaatctagtatttgcctaggagatactaatgtatcatcaaattgatgctactctatgattactctctaaaggttgaaagacctgactttttgtatattctcaatggaatagtacaaaggaaattaagaaagtggtttgctattgtctatggcatattacatccttgacgatctgcttaaactcattatcataatgcatgcatatgtgatgtaaaagaaagttgtataacttttagataagataagatgggtgccaactgctaagtgagcattattgcatcatcccagactagtagactacactacaaaactgagttatgctgttgcaaatgaaattcacaattgaaacagagtgcatgaatgatataagctccacatgaccacatatctgaccattgattgataatgcttttctccaggggttcagtgtgccctcaggggatgtcaagggtgcaatcaaactttgttatatacttacatgtaagacaaaaactgaagaaactaactctctctcctagttaactatctcatctaatattgcagctcaggaactgagaagcaataaaacatcaactagtgtctagtgcaatacactaattaattacgatctcatttctcaaaggaacaaaagtgaaggcatgaaacctgatcgaaaagatttttcttcataaagatgatttggcgacgcaaatttgaatactccatatatggctaagctttagagatcagttcaagcaggtggagagagctgagacacaatgagccatgcacaagagggggggtgtatatatagaggaaaaaaggatttttcttataacatgcaaaacctttattctacattgataatgccctcctgtgaataaagcataacaaaaggacagagtacttttctttcatgaaactgttgaacaataactcgagtaccaatgctacaagttgctgagctctgtatttcatttggtttctgtggtttatatcctagacagcaagagatatttaagaatatttgtgacactgcacagcagaggtttgtagaacagtagcacctagaacaaggtttgttcccgaagaagcaactgtatagatgtaataaataaatattttaacagtattatattgctaatatatattttatgaaattacattatttatagacaaagaagttatttctacaattcaaatactccagagtgtgtgcaagtaactgtaacagagttgggaaacagcctatctgaatgtcacacaacgcaagccgacaaagttcgttagtgactgatgaccacttaatgttttaaggaggacagattcactaaatctagcaaatttaaactttacaagatatcttatactaaacatgagtttcgggagagattttcatgcctccctagaatgacatcaaccgttgaaattctgcattgagtatttaacagaaagtaattatcctatttcctgaattatatagataatcagagtacaaaccattggcaaccttccaccaaactctgcctccgtacaactcagttgatttcattgaacaaaattgaggttgcatgctatgcagatgacaaaattggcatatttcaattaggatttatacaatcaaccatgaaaaaaaatcaaagatgataggactaacatcctgtaaaataaataatgaaaattaccatggacatgaaatatgaacaagcacccaaaaattgttcgcccaacaatgatatttgtttttcataggataacactgcgccaggacagagtaatcccaaatacaaatgaaccttttttttcttccttacaatgggtaccccggaattccatttctcaggggaacaaaaaattatacaatcagccagtacttgtccactcagggtcaccaactatcacaactaacatagttgaacttccttgcagtataataattttccattttcaacgagtttacagctatgtcattccggtgttatgcttggacttgcactggttgaacagaaacggatacttgacaaaacaaaaacaagggtgtagcagcccttggccacaaccttgtgcacaaaacacataacagaatcagataacgactggagaatcatttattttctatgtatttgagaatgaaagtgagttggctagtgatttcgtaagtcactttcattctcctttttttttgaatgtatgaattagcactctgctggttcgttcaaagaaaagagagaggtaatgaaagtgacttacaaagtcactagccaataagccaactgttaaaaagccacttcacaaaaatataggaacaacaggaagttacgaactcagaacaatggtaagtaaattaaataaaagtacatctaccaacaacaatgtatgtattttcaataatcaaattcatatgtgtaatatctattattagcaacaccactgttcaatcagttagagctgtgcccttcctctagctaaatcagaccaataaatttctcaaagacaatcagatggataaaaacatctaggggtatctaacatgcaagaccacaaggcctggaccgctcaggcagatctatcatctgatgaaccaaaggagctctactatctgctccttttcgccacatctcacatatcctgaaagattgtcagaaaaaaagctaacagcaaagattggaaataagacataaccatcaaatggccgaaggaggcatcctactaaaaagaaagaagagaaacagtggcatccctatgctttcacactgaaaccaaatgaaaactggatgataaaa

SEQ ID NO: 45595 - DNA, 737 bp, Oryza sativa
ttttaacccattatgtggtgtatctgcacctcacgattcttaaatcacattcaggtgtttggtgctttacgaatgtctgtaaagatgcttcttatgtggaactctagaatgttgattgatggtggcagagagtcaggagttgcgacttctttactagagggtagcaatttgatagtgttgaaggtatgttatttgttcaaaattgcaagatatggcccttctcctcctctgccttctcttctgtatgatttattttgttcccatgcttgtcaggaatcatcagttatacattctattggcaatcttggaattcatggtcaaggcatcctgaatttatctggagatggagatacgattcaggcgcaacgtcttattttatcacttttctacaacatagtggtaaaataagttcattttggtttgtttattcacaatcagttatgagtctgaattgctttatttctttctgcataccttttgtggcttaggcacatttttatggattcggattgttttcagagttggaatgatgaatatgcctttgatattgccttaaatttgacatgttatgaggccatcgtgtgacatcagtagtttgcgtgatctatctgtagtgttctccattctgttatttacttattcatatctcatctaactcgatacactaaatttaatgttctaaacttatctttgagatgaattatgctgctgttcatgatatacaagatcaatatttt

SEQ ID NO: 45596 - DNA, 867 bp, Oryza sativa
tttgaataaaattttaagtaattattaacttttttatcatttgattcattgttaaatatacttttatatgtaaatatagttttacatattttacataaatttttgaataaaacgatagtcaaacatgcttaaaaagtcaacggcatcaaatatttaggttggagggagtaaaacgcaaactaaagttgaaaactaacctctatagaccttggtcaaacacttggcgtgcgagcacgaaccgcgagccgaccatcgacgcccgtcgaccacgcacggtgtgccgctacccggctgccgcaagatgcgcattccatccttcctcttcccttcccttattttcttcccttctctctgttcttgattttgctgtcatggcgcgatgccgccgtcgtgcgcaccgtcgtctcctccttgcgcggccggcgtctagccgacccgcgcactgctcttcctctggctccccctactccgtcgccccggccggcactgagccgagaacgcgcccgcgtcgcgcgtcgtctctgcctcggccgcgccgagccgtgcacccgcgtcggccctccattccactccaccgccgagtcctcctctcccccatccaccgttgccttcgttccttcctcgacccgacaccgcggcgcccggttaagccggctcgatgcgggcgccgacccgcggagctcgccgcccccttccatcccgcaccaatctctccacctcggcatcctcctccacaccgctgccatcctcctctccccaactgcggcagtctcctccgtcccccaccgcttctctcccggcgccgcgccaagccaccgccccgcgacacgcccggccgccgccgcccgtgccgatgcgcccggccac

SEQ ID NO: 45597 - DNA, 1566 bp, Oryza sativa
gaatgtgccagttcatgcattgatcagcatgcaccggatgttagcatgatacatcctatatgtatgtgtaatatcttgtttcatccagcatcttcttgtgccattgcacggcctgctgagccatggtccatgggcctaattgctccatcgatacatttgcgaagaagcttctggaataaactccatccggtggccggtgcacgcacgcatgcaagagcatttctagatcgctacacgcgcacgcgcaagatcgtttcgtcaagcctcttccgtgaaaccggtgtttccacgtggcaccattctccttgcgatcttttgcatcgaattcgtattataagatacaaaagtctatgaaacctccgttgtcttcctcggccgaacccgagtgattgattcctctataaaagtctatatagtgcccttcatctaaccttcgggaagagcccaccatcggcccccttgtccactaaagtctatgtaatgtccctctacaacccaaaccctctctaaaagactataacacctccccacccgaggagtttttcctcctcggtttataaatccttccaaacttcgaaaatccatatatctcaaaccgtacctctgattaactccgttcaactttcataatctctataaaatcgagatctatttactggcaccattagattgtattgaatattactttattttatttttacgattgtgtggggttattctttggccgtttattggacgttttggatattctggatatttatcaaacacgggtattctggttatttttagcgatgcagatttctcgaagatatcagcacctaaagcaaggcaagtcactacactcccttccttcaacatattgaacctatatttatatatgtgttgtgtgcaaataaaattgcatgctaattataaaactgcgtacctacacttgaatgaaaacccctccttgatcttgttgtcattatgtttacacaatcatccattgtgcctgagtctatttatttatacgtcgtcaattattgacatcgcttagcattgctattatagacaattgcacactccatagttcatcaaacgagtgcaattaaattattttatggtggttacgtaagcagttaagtatatttagcccagctgaacccaaaagcggtaagtaggttcagatgatgaagtggaaaaaggagctcacatgttgcaaggattagtcttctcgacgaggtcaactgggcaatgcacggttgataattagataagacgtggtgctgcgattgcagggttcacatcgtgttaatcgaaagctggatcgtgtgtatcaagtttccaccaaaccaagagttatcaatatgtatctaaagatcgggacctacttcatcatcacacgctccttgcagcgcacggcggcctgccctccctttggcagcatggcggcggcgacctcccctcgagaacatatggttgctgcgatgccccccaagctcaacgatgggatgaccagatccagccacaacgaccttggggcagtggcatccaccccctccgatgagcagtggcgtatacgttggc

SEQ ID NO: 45598 - DNA, 1132 bp, Oryza sativa
gggcaactcctcgagccatgaatccccgtgcttcttcaggacgttgtacgtcttggtcttgagtcctttaaggatttcggcgttggctcgctcgacttggctgttgctcttggggtgggcgggtgaggcaaagcacaatttgatacccatgtcgtcacagtaatcgccaaacagctcactggggaactgggtgccgttgtctgtaatgatacggttgggcactccgaatcgagacgtgatgcccctgatgaacttaagagcagaatgcttgtcgattttgacaactgggtaggcctcgggccacttggtgaatttgtcgatggcgacgtacaagtgctgatacccgcctcgagccgccttgaatggcccaaggatgtccagcccccaaactgcgaaaggccaagatagtgggatgatctgtaaggcttgggccggctggtgggtccacttggcgtggaaccggcatgccttgcaccgctggacccattcttgggcatcttgtaatgcagtcggccaataaaaaccttgccggaaggcttttccgaccaaagttcgtaaggtcgaatgggctcggaactcaccctgatgggcgtcggctatgagctcgatgccctgctctcgagaaatacacttcaagagtatctcgttggcggtacgccggtatagggtcccttctacaaggacgtaccgtttggagatgcgcgcgagcttttcagcttctgcgcgatcctcaggatgagtattgccttcgagatatgcccggatgtcggtcatccacacgacctgacgaggggggtcagggttgaccccctcgggccccgaggggcacaggtcgcccggagtcgggtcggagggcgtgtcattggggtccctcaaagggctcggtcgtgccgatggttgcgcgagcctttcctcgaaggtccctgggggagtggggctcgtgccgacgcaacatgcgacaactcgtcagcaattgtgttgtcgcgtcggggcacgtgctggagcttaagtccgtcgaagtggcgttccatgcgccgtacctcgcggacgtacgcttccatttgcgggtcgttgcactgatactctttggatacttgatttacgatcagctgggagtcaccaagaccaggag

SEQ ID NO: 45599 - DNA, 1674 bp, Oryza sativa
caaacagtttgtggctttgtgcatactatggtgggtgactcagtttgtaggctttgccagaatcagaatgcatgtttctgtgaataaaagcatgcctttgtgtaacaccttacataatttatttcaggttagtggcaccacggagaggccaagactcagtgttttccgctcaaacaaacatttatatgctcaagtgattgacgatacaaagtcatgcactctggtttcagcttccacaatgcacaagtctctttcaaaggacttggaatactcggcagggccaacagttgtaagttgattttgacttacccatgtctaatttctttgcttctttttctctctgaaaataataaattgagcagtgcagtaccacaataataccgtaggtgatgctattaacattttgtaggtgcacttatgtgaaaagatgattgtgcatccatatttgtctgatcagacaatcatgctcaattcaatctcacttgttcaaatccttaacctagtgtcgtctcttggagacattgattgcgaaatcaataggttctagaaaaacttaccattgaaatatctgacgatcctttgctgatgtagctctgaagaaaacccagaggaatgcacaaaaaatgaaagctgtttgaagttgtcgcggttgttttttatggttttatgcatgtggcatttccattttagtacatggttctgagctctacttacaaattaaatgttccacaggtcagatagtataggattaacagtgttgaacacgtatcttaaagtttagctgtgaaaacacaatatatcgaatatatttctgcagttgtttcttgccgaaagtcacagctctgtttctgatgaaagttctctgttgttctggttggttctccaggaagtggcacaaaagattggctaagcgattgccaagtcttgcttggagaaaggaattaccaaagttgtttttgaccggggtggtttcctctaccatggtcgcattaaagctctggctgatgctgctagagaagcatgggcttgatttctgggaccgccgaatgtttgttcagatctccaggatcacttgttactttctttgtcgcccacctgtcgaacagagtttttctttgtagtgatttgatttgctctgcaggcttggctactctttaattgtatatcaccccactatcagctcaccagttattgagtttgtctgcttcatgaagtttcttttaacgggcatattttcagtttaatagatcaatctgttgccatcctatcctacatgtgttgttttgaactctgttcgtgcaaaatggagcactcctacaacctgctactagagttctggcctgcaaaagcccaggcctgaaatggctaatgtgggcttcctggccaacattttgtgccaggcctcgtactcttgtcgaagctgtcaggtgctctggagtctggagcgcgttattcagattacaaaaataaaaaacgtgctaattgcactgatgcatactactgtccttttccttttcatttattttccatcatctctgatcgaattatctatcagtaggtaacatttattttctaaacatctcttccatgagtctttcagagtaatggctgattagtgattactgaagcgaaaatgaacgccatttactaagcttacatttctctcactttcga

SEQ ID NO: 45600 - DNA, 848 bp, Oryza sativa
ggtgagcacgaagatgaccgagctcgagtacatgcagtagccggcggcgagcaggttgctccccggctggcacacgctcacgatgcacctctgctccacctggtcaagctgcaggcacacgcgcgcggacagaggcgtttcgttctgttagcaccgtgtcagtgtgtgcatgagcgattgctaggcgatcgataacgcgttacattttggtcgtcggcgatgtcggctaggcactcgtcgttggggctgtagatgccgaagatggagccggtggagacggcggcgtcgatgttggaggagccgtcgagcgggtcgaacaccacgatgtagttgcccgagtagctctcctccacggccaccggcacgtcctcctcctccgacgcgatcacgccggtgcgcccgctcgatttgaggcagttggagaacacctgcggtgcgcatagcgctcagcttatggtcggtcgcgcttgttgcggtggttcgcgcactaaccacgacgagctactgataatttagtcgtttacctcgttggagacgacgtcgagttttttctggtcctcgccctgcacgttgacggcgccctggacgccggtgaggttggagatgggcgcgcgctgcaccagcgaggcgatctgcttgcacgccgtggagatgctggccagcacgatggtcatctcgccgtcgatggtcccggcctgctcctgcttcagcagccacgtcgtcagcgtggtgatctcgtagctgctcttcttggctagcctccgtcgcggcgggcgccgaggccgtgtcgacgggcgccatgcaccgcacgctcggggccgacgacccaccggcgagcctgccgggct

SEQ ID NO: 45601 - DNA, 1071 bp, Oryza sativa
  unsure (1)..(1071): unsure at all n locations
nnnnnnnnnnnnnnnnnnnnnnnnnnnnnnnnnnnnnnnnnnnnnnnnnnnnnnnnnnnnnnnnnnnnnttacttattcaccatctggaaatcaagtcaccgaacagcaaacttagctattgatgtaggaacctcgctgctgcttcataacaatagatttccagatggcatcatttgcttaaagagcatcggtttgcgttttgtttcagatacgtgaagaaccaccatcatattcaacatcagttctacagaaacgtgagtcattcgaaaacccccttgctgggcgtggtggtcggagttttggatcccatgaggacgaagacaggagttcagggaaccctcaatctgggaaagcactgtatgacttcacagcaggtggcgatgatgaggtatggaggctgaaattgtcttggttggctataacgtaacatcctgagcttcaatgcttccttgatcagagcttgataggcattagctgttgtgaaacatagttatttcagtgaagcgaacctcgtgcttttcatttgttacaagaacttaatatcttaattaattgagatagctttttaaatttatgatttgataagcgagttctgtagtaaaagagaagaccaaatgaaagcacaagtaaattatttgaagtgattaagctggctcttatttcttgtcttggaatgcacacaaaagaaagtttatccatgtaaatttctttcagttgagtttaactgctggagaagatgtggaaatcgaatatgaggtcgatggttggtactatgtaagttctcttctcactttctagtttttcttgttctttagtcatgcgcaaaaacattttaatattggttattattgctgtatcttcaggtaaagaagaagagacccggaagggatggaaagacagcaggtctggtccctgttctgtatgtgaattcgtgatagctatgagtcctgtgacataatgctctcgaaagctgattcggagtaaacgggcatacatatggcgtctggggaggatccttctgtgatcttagtagtgcacataaccttttttgagctccctagcatttgaca

SEQ ID NO: 45602 - DNA, 11393 bp, Oryza sativa
gaattgattgttgtgaaattcctggatcacagtttcaaaatgagggctaacatcccgtaattttgttttatagtacttgacaacttgtacagttgtactaaagtcggtactcggtagcgacacaagcaatgcatcgatactccctatgtctcgtaatataggattttgctccttccaattatcccacaatataaaagattttggtgtaatacttgtcacatcaatcaactcaaattcaaatttctatctattttaaccttcaactatccactcatccataaacaagggaaagtgatttcatccctcgaggggatatcctctcgtttcgtgcatatcacctaaatagctataaaaaatataaaaaaattggcaatatagattaatatgaaatatatcactccacaaacattgcaagtttaaattgaacttctacaagttacaacaaaaataacaaatatagttgcgaatgtgcgataactattctcagcttaatttgttatttttattgcaacttgtagaagttgaatttggtctttcatatttgtggactggtatatttcatattaatctatgttgttgttgacgtaaaacacgaggcctgggagatctgcttaactccagtgcaggtccaaagctcgccttcgggtgtgttagcgtgccagttgatttgattctacaatcaacaagaaatagaaacaaagagatcgcggttaaatctataaatgatagctgatcggctaagtgccgatgacatatcatttatctttgagccgatgtcatatgtaaatcgatcggcgactataaatagataataaagaactaaacctactcgatcggctgtagatattaccaatatatagttcttatatcgatatatatttaaatcaagtgattgagatagatcggtcgccatgccaagacagtataaatcacttggatcaaactatatattaataacaggactatatatgtttatagcatagccgatcatataaatttagcatgtatcggttaatactccgatactactctatatcaggatattaaaacaagtataatatatcaaacaaaagcttgatatacttaaatgcaataagatcttgacataaagggcggatttaacatgtcactgaagcatatagagcgaatatggttaaatcagataagatcggctgaaactccgatactaccctaatcggcaaccagaaggcgggctagagattgatattctaagcacgacttaatagatcaaactcaactgatgcagcattaagtatgaaaagaagaacaatatctagacaatcaagccgctggaagtttcatagagtggtagatatcttatataatctaaatcaacatcaaaatctaacctaatcggctgcgctctactaacagatgttagccgattgtaggttagatagcgatattgcaagagattatgtacgatatatgataactcgatgaattacgtaaacaatattagagtatcataaagatggaagcactaatcccgagaatacaagccgtcataacaagttttacctcttgttgaagatcaaaaccgatgcagctcaacccgaaagtaagaactcgtcgaaataaaactaaagcaaaaaggtggcgatgcgccgaaattgtattgaacgtgtgtgtgttttttattacatagggctcggggtctatttatacccgagaattataagatatgtccataccggacacgactattatctctaacaaactctaagataccataagtctttgcggcagacttttgccctaaacatatctctaaggaaattacataaaacatcctaattaatagatataattaccttttcaggactctatccacgtgcggcaatcatcttgaagcatatcaactcaaacccaatgttggatacgagtcatattgccggaatcggctgtatcacctaacccagtctgattcagatttagccgattctagtcgtagccgatctggactccagccgattcttactctgttcccgcaacaacccttatctttggttccgcttcgatcccatgttcacccccgatgctgatattaccaaatttggtcgttaacagttgtcaatgtcttttaaaaaattttaataaacaacgagaagaagtcccctcgagaaataaaagtttacgtcccacaaacaaatcttatttaataagggcattctattcttgcttaatcttattcaaaagagaataatccttgggagtacggagtactgcactgctcctaccttctgcaaatccaatcaatcgcgggttaatatcccagcacaggtcctcgtggacatcgtcgtgttgtcgggcgcgtgttcttgtgagccagcaatctccttcgatctgcgcgccatcctccccgatcgtgacctgcgccatcctccccgattgagactcgcgccagcagaattaacaatcaaggattgccttttcttccacagaaaaaaatcgccttctcgcgggtgggtggcagggtgggtatacgtacacgtctccgaagccgcaaccaaaaccaggcaaccagcacgcgatggggaggggcgagcaggaggcggcggcgagccatgggttcggtagcatggaggagttctgggggttctacctgacccagcactccaagcccggcacccggcggtggcacttcctcggcacgctcgccgcgctcgcctgcgcgctcctcgcggccgtctccggccgcgccgcgccactcctcgccgcgcccgtcctgggttacggtatggcgtggtacagccacttcttcgtggagggcaaccggccagccacgttcggccaccccgtctggtctttcctctgcgacctccgcatgttcgccctcatcctcaccggccgcatcgacgccgagctcgctcgcctccgcctccagccgcctcacgacgccgcggctgcctctgcacaccgggactgatccgccgaagtgctcgcgatagcaacatctggaagtgttgatgtgtactccaccctgtaatttgctaatccaatttggtactttttttttgttgcttttatcattttcctcgccgatctgttttggttgcggggaaagggtttggataagcagtgtatccaaaattagtgtggctaggcagtggctgcttaacaaaataatgaccagctactagaccataacataataatgctgtttttatttcctgtaatacttgctgcccccaaacacaaatctgtgatcgaagcacaagttcttgggagtacaacacggttaacaccacaagaaactccttgcagaacagtaaagatgcatgtgtcctatgtgaataaccaagtgtggcttctttatatgctggtggaatgcatacatctggctgtacgtgtagtcatgtagagcgcgcgttgctcagctgtcacttctgttgggcttgtctgacgccggatacacctgaaaccaacaactggttgcttgcttactgatgcttcttgaacagaatttcaaccaaactctgttgataattgctgaagaacaggcatgtatacagcattggacaacttaaacaagtacagttaccgtgtcagctgatgggatccactcgtttgtagcaggatttcccttgcaggaggcatggcgctccgatgcatctgggtcatcagacagatgaaacgaggcgtccgccgagggcttgtccatcttgatgaaccctgttccagtctgcaggatattgacagtgcacacacaaattaagatcataagtgcactgtgatcagttcgaattaatggatggaagcatgagggaactaggcagcgacgttacgtaccgtgtggtgctgcttgccgacgcagccgagatccttgtagtactccgtctccacgaactcatcccctgccttgccaccctcgcacaccaatttctgcagcagcaaaccaccacgtaataacaccgtaagatcaactctaagctttcgtgggacacatatatgaaagtgcagttgagagttgggactgggagacctcggtgtgggcttcgagctgctggaacctgtcgagctcggggtgggagtcgtcggggacgagcgcgtcggtgtagacggcggagggctcgctgcgggagggcttggagtggcgcttgggcgccgcctcgtcgtagtactcccgcacctcggcctccatcgccgcctccccctccggggacaggtgcgcgtcgctcctggccggcctcgacatttcttccgatctttcgcgcgaagcgcgctgtgccttcgttagctagcgctcgtgtaagcttcaagcagtccaaggacgacgaggggactgtggtgcgggtgctcgggctatattggcgtgatggctgcgtggtccgcgccgcgggtggatatggacgagatatttttgtgacttctgaggataaatatctgcagggaggtgtagaggttggtgggtgggtcgattggcttagcgagaggtggacgtgcgcgtgagatgccaggaggacggaatttgaccgcgcgcgcggtgcatctcgcggcggcgcgcgtactcgggtgttcgtttgcaggcccggaacgtcgcgtatgcggccgaaggcccaacaacaaagtccccgttgataactgggcccccgtccgtttcctctcctcggccgcatatctgcacaagacggcaaacaccgcccactcttgcagaattcttcctctccgcttctctgctcatctgctggtggtggctgcagattgcgctccgatggcgcaagcggtgcggccgtgcaatggtcggcgcgtcggtcgctcgcctttctctactcgatggtatggcttatcctagttcgcgcgcatggctttgattttgtgctggatgttgcagccacccttctcgcgcggctccgtgacggcgaggcgaggttcgagctcctcgaggactccgcggccgcggccgcggcctcgcccgctcctgctccagtttggcccggcctcagctgcttttctagggttgctacctccctgtacgtacggctggtttccctttctcctcctctgctgatctttgtgtcgcggtagggttgtgtgtgattcgtccgggggattgcaggaggggcgggtggtcgggggcgctgaacaaggtggagcactacggggtccagagggtcacgggtgatggccggtgcatgtttcgggcgttggtacgtcttgtcctgttcaattgcgcattgggaatttctctggattctcaaggaaaccctggtgtgtctcctcgtaggtgaaaggaatggcaaagaacaaggggattccattgacctcaagggaggaggtacaagatgcaggtaacctgcaattatgctttgttcatggataaatattcacagttgtttgagacagcctgtgcagctgagctatctctagagctttgaatttacatttacgaaagtaactgcaatagctctgaggaaagtatatttaggctgtgttcgtttgtgtgagatagggtgagaaaacaccttgttttccgcgcgcacgcttcccaaactactaaatgatgcgttttttgcaaaaattttctataggaaagttgctttaaaaaatcatattaatccatttttgaaatttaaaatagtttatactcaattaatcatgcgctaatggctcatctcgttttgcgtatcttcccaatcttctcaatcccctatctctcaaactcacccttagatgctaccgtaatcttttgatacataaatcattttttaaaattttattttgttcagcgcactcctacaacttaaataatgcttattcagaaaacagaacatccactacaaaaaggagggaaaacttgtcaacacaaggcatataaagagagagctcctattattcttgtgagattcgagtagcccacttgtccatcaattgcataaattagactgcattgcagttcttatctttggcttcaaaacaactttgttaaagcatgcattaatttaggatttccatattgttcgttccatggcagaagttttaacttctgaccgtaacttatgtaggaaattaacctagctactgtttgaaacatcaagttagttaggcataatttgctgccaccactgttcagacatttcttgttggcacctcaagaggtcattgttttggtcgaagaatgtctagaacagaattcttgcatttaagaatgcatgtttcctaccagtttcgtctcagtaaaactgtcattgctgaaactgtctcagtaaaatgttccctaccagtttccatgttcccttaccagtaataccacccccctatgtgccactttcgcatatgtgacttgtgacgtgacaaaaagataaatctggagtggcaaaaaattaaatgttccgttatccagggggcatttaaattttttccactctgcaccaaacgagtttaatccctctcacaacatcccctcttacaaagtggcaaattcccagtatatcctctctacccagcagccttgtcaagtatgacttttcatgagcaacttcactctccaaataaacttatgacactacccatctttcacctaatgagctgaagattttgcgcacagatttccattgaagttcgaagtttgaagatgatatattattttaatatacttttgtgttgatatcctttttcaatttcctagatgatttacggatggcagtaaaagaagttatctgcgatgatgagactgaacgacaaaaatataagaggcagttatagcaattactgtggatgaatcattgaggcggttagattcttatgtcctcaattcatttttatggcatgacctgtgataaagaggctgactatcctggttttgcagctactgccatagaataaggcgatctgatttctggggtggagagtcagaactcttggtatagttttcataattctaaagttagcatgcactattaatataaacagcaaccatacatcatttagacatatagaacacctgtttctagtatatgtatcatactctaaaaaaagtatgtgcaccatgtttatgcatcgctccttaagtgtgccaaaaaatataatattgtttgatcgtttcgctctgaagattctaccaaaagtaggtttacctgtttctagggatgaaactggttcggatagtttccgtccatccgaaccatttttcggattcggatagtttcggtcggaattattcagaaattttcggattcggaaacgaattcggatattttttctcggaaacgaaaacgaatacagtaagggtactatccgtcggaatcggaaaacgctcggaaactatccggatttttttttcggatatccgcagacattgagcaaattttagaaaaaacacgtatatatttataactttttcatacggaatcagatgaagacaaactttatatcaacattgtagagctcgatgagatctacaactttattattgactattttattatttgaggtcatttaaaggtctaaatattcattataatataccatattaatttttcaaaatctcggatctacaattcaaacgacatctgatggagatgtgttccatatcaaaattgtagagctcaacggatctaccactttgtagtttataacatttgtatttgaaagcatttaaagtataatacaaacattacaagtttcgaagatgtgaagtaaaataaataacatctccaatttatacactggtaagtaagttatacatctagtaaaaggtcttgggaatagaaaatgataatcatatttgcatatggatctcttaaaggaacagccatgaaaatcgattttcacatacagttgtgggaccgtatacaaaattgatgatataatgttggagatgttgaactaaaataataagcgatatctcttcctttatcaagaacctcaatttgaggggttttttatataccggtaaatatttgctaccgtattcgttccgtctcgtattcgctccgtatctgtattcgataatatccgatttcatttccgtatccgagtttttgattccgattccgaaaaaaaaatatgaaaacgaatatgataaagctagtttccgtccgtttccgatccgttttcatccctacctgtttcatagtagagtgtaagggcatctcttgctttgtatcagtacatatggtcgtttcatacaaatctattctacatctgacatattgatgtttcaggttttgtctaaattgtgtcggcagccaatcattatttatattccagagcgtgaggtaagcctctatatacatggataacacatatacatgaatgtgtgacccaaaaatgtaaacatgttgtgaattgtgccttaaagaagagagtatttctaattaaatctatctctagatggttgcaaaataaatgttgttttggacattaatatgagaccataaccagcatttcaaagagacagttggcatatcgttgaaggcaaaatgggtgtcaaaccatgaattcgtactgtttctaatagactttattgcaagagaaaaaatagacaccagatattggtagaccaattaattttaggaccttccgtcaccatgcaaattagatctgggaatgttaaagtaccgagaagacagctagaataggcaatgtgccaaggtttacttgtgcttcatgatgaatggttgagagtgagatgatctgctaaagtgattccaaacatctggatttcattctatatttctgttatcttgttgtaatgctctgaatcctaagaggttcagaatttagatattttttaggttcagaggaaaaaaaattacagaacataggaatgcatttgcaactgatggatggaacttaatgaaaatatagtgaacgtctgaatgcttctctttgcatttttcttgcttataactgacccatcctccagtttggagttgctagttggatgtactcattgcactattgtctgtttccttgcaaacaatcttatgttgcttttctttcatagctagcctttacaatcccccatttcagctgctcgacttacatctttcctgtttgtgtaacagtaccatgggcgtggaaatggttttattcctatagcagagtatggactggaattctccaaggactcaaaacagtggaagaaaaaggtgccagtaagactgttatacagtgggaggaatcattatgatttgctagtataacatggttgcaccgaacgttatcagtaccctgaaggtctgaactatttatgacaactgattttgattccatcattccattgttattctttgatcccacgtagttttttgcttgcgtctctgcagacagcttcgatgctactccatccattccaaattgatctaatatagttttttttgaagttattcttaaatgatctacatatttgtgttcatttattgagtattcgttatttgtacattggagtaaatggacattgatgcatgcatctatgcacacaagtatttataacccacatgcaatatcttgatttgctattggctaagaaatattagggatggtgtatacatcgagtttgttgctagagtaaatatagtatgagagagttattagcttttcttggtcttggtgtacctataaaatatgtagatcaatttggaatggagggagtatatagctaactgttctacctaggaaaaccacatatatatagtagaaaactgaaaactaccgttggatcaaaaaataaatgtctgagatttgtccacgtcattatgagtaaatctgcaagtaaaatttttactcgcgatgacttggacaaatctaatatgtctattttttaccaatggtactacatatgtggtttccaccgtatattttcccgttctaccgtatgaaatccattggttccatcttatctgaaaaacttccatgactaaaatgacactaaacctaataatgtcgcatgagctaattacttcctctgtctaagaatataatagcaacctagcaaataattagacacaacctagtacaattaatctggaccggagagggttagtacattattctcctaagttactatatatattttaagacaaaggagtaggttgttatattttaggacggataaagcaggacaccaggtgataggctagtgaggtcatttggcatctaggctaaggttgttccccatcctagtgatgccattcggcatttaggctaatgctgttcgcagttcgcctgtgattcggttggcgtcacgccgtcaagctgttgaccgtatttccggttggtgccgggcatcgtaataatggcgtgttcgtcggactcggtggttgccaggggcaaagacgatgagaggacatgcttcaaatcctattcttgtgtcgttgcaagcctggttgaccggaatcatgttcttgttggatgagctgtgcgatgcatctactcctatatcttgccatatgttttgttgaacagcaacagcgaatgttttttcccctttgaagcttggttcgtttaatcctaagagaaaaggattgagagaaaataatttcacactacaatacatatgaaataaattatttccaaatccccttcaattctcttgaggaagggattaattgaacaaggcttgaatggggtaattcttttgttgaatcctacattcctattatatctattattctctttgctaaagtattggggaaaaaggttacatttttaaattggttgcaacatattaaaaaaaacgtcacgctatgcttgccaagttatgatccagtggacgaatggtgatgcccaccagcagatcgtacgttcctgacccaaatcacgcttaaaagcaagagttgctaaaacgagccgtaggtgtaacacaggtgtcattggagtaaatgatgcattgataccttgtccgtttgctaagctaagctagagctggccacaggccactgccgtgccaatgctactcgcctgctgtgatgggcccacaattcagcgtctcaccatcgacgtagaggaccgaactcggcggtgcacgtatcaatacaagaaatcgtcctttctctctgcaatgttttttttttcgataaaatggagagagagtacccttccatcctataaaataccgacataatatttggatacacatctatctagatttattatactagaatgcatcacatctagttgatttattgtttatgagacggaaggaaaactacggtgtactgcaatgcgctatgcagggcataatgtgctgctctaattccaagcaacaaatgccaatggaggagaaggtacaaggggatagtccgacgaggcagccggagaaggctggccgacgtcgtgggccgcaccactacgcgatgaaagtatctgtcatcacgccatcatccactgagagcctggcacgcgggccccatccccgtcccccaccc

SEQ ID NO: 45603 - DNA, 61636 bp, Oryza sativa
  unsure (1)..(61636): unsure at all n locations
ctgcacttctctctctctcctcgtcctacaggctacagctgctgcctattgatgacacacctctactgcaatggcggagccgtagaaggctcgatgccatgtggaccccctcgtctcgggaccccacttgcagcgagacgagtggccgctttgtaagcaagccgctgcgtgcgcgtaggctaagccgcacggggacaccactaatggcagtaataattgcgtatttttgttaatgagcgctgcacctcgcggggcccatcggtctcactgacccgctctctcctttttcctttccgtcgcggcaaaagtgaggcggcgtcgacgcgagttgagacttgagacgcccaaaaaatcctcaaaatcccattgctcacccgcgttatataaccgcggccggccattgggagggacgccgcgaggggtgctcgtttcagcgcgggaggagatcagatcgggctcagatcttccagctcgccgcgccgcctccgccgccgcagcaggaagagagagggtgaggagaggaggaggctacgatgtttagcgggacgcagcagaagtgcaaggtgtgcaccaagacggtgtacccgatggaccagctctccaccgacggcgtcgtcttccaccgctcctgcttcaagtgccaacactgcaagtccaccctctccgtatgtcccctcctcctccctgatcgcgcgcatatatgctttttcttttttctttcgcttcctacctgttcttttgttctggaggtgaaaaaaaaaagcagaagagggaaaaagacgtttttatggccgggggaaaagtaaagatggatctgtaggatagtgcaatctgtaatgtcgcaagcagtagtagtagatctgtggattgatgtcgtgaatggatctggtgcttgggttttcctgctcgaatttcgtgtttgagagatcatggttttgtccgtttcacatctgctgacttggtaaaagaggatcatgagaaaagtcggcttttgattaatcagttaggagtagtcgtgcttgttcaggcaaagatttgcgtcagtctgacaatcgttctggttatctcgctttgcgattttacagcttggcaactactcctcgattgaaggagtgccatactgcaagccccatttcgagcaactgttcaaggagaccgggagctacaacaagagcttccaatcacgtaggctactattgaattccaaaattgcgaacattgacaacctgtttattttgttgataaaatgtgttatgaattctgatgctctggccctgcttatttgttcaattttatgcagccgcgaaacccgcatcggagaagttgactcctgagctggtgagtgccattggctgcatgcattgcttgtctgttttcattccaaagtacttctatgtttctatgtgatgctacctcgcttttcaactaattttgtctgaaacattcatttcagacaagatcacctagcaaagccgcacgcatgttttcagggacacaggagaagtgtgccacttgcagtaaaacagcgtatcctctagagaaggtaatgccccataatttctgctcttttcatcttagtttcatactgtagtgttgttaggtcatttcttccaaaattgcattgttagatgttgaaatagggatgaatgatcagagggatcttttaggtacattattccgcctaattgtattgttctactgtaacaagttgtaaggttctgccttgattgtacttatttaccaagaatttatttcaattatgctcctcaagtctttggaacatgcagtggttgtgatgataagcttttatttgcaggtgacagttgaaggacaggcctaccacaagtcctgcttcaaatgttctcacggtggctgtgccatttcgccatccaattatgcagctttggaaggtatcctatactgcaagcaccatttctcccaacttttcaaggagaaagggagctacaaccatctgatcaaatgcgcatcagtcaagcgcgccgaagcacagccggcaccaccaccggccgctgcagattcctcctgaatgtaccatatctccagtgaggcttgagggcgaaaattcggaagccctctgttttacaacctgcttgtatgccatgttccagttctgaggataccgggacctatcaatttcgtgtcctctgctgtgctagactcgatcacattggtgaaccatgaatatcatgtccctttcaaagaaatcgttgtgcaagtactgatataccgtactctattttgttgattgctttttgagcgtgtgtttatctgttcagtcgtcttgctctcttttttttttttttggggggggggggggtgggggtggatttttcataaaattggtatgcggcactaacgatcatgatagcgtcgaaagaacacgattcggtttattagccccgaaaattatctccatttttctttttaacattttggcggctgtcatgcaaaattgcgcaggaaattagactagttagtttaatatcaaaattggccacatttgagtattactttttgttccccgactgcatggtaaaaagaaagatataaatatacagaaatacttctgaaaatctactgacatgattttcattttttttccatacgttaacacacgaagtttaagaacctctcttaactgctagcgttccaaagcaagaaaaggacaaaccgcattttaaaacaaactccatgttattttcaaggaccaattaatttgcatatgtgagtgcattcgatgatcatgtttacgctacctccaattttgttgaaatgtgtgatagtagcttaaggaggtagcaggacccaaagtgggtgtgcgtatccacaagtgcgtgtaattgtgttcaccttgtactaggggaaaaaaaaagaagagcaagacggtatggggtaaactgagaagaaaaaacggagaaaacctctatttcttaaaatccctttctcaactcattttactcacgtccatgctcaccacaaagaaatgaattcgcagtcaaacatcactaaaataggtaatgctccgcaagttcatccactacacctacggaaaaaaaaaatgtggtgcccaaatgcccaataatacaaactgttcccctcccgtttctttggctgtcctgttccatgctctttgccgagccagaacaaaacacaattgagcaagccaaccatggaaagctcagcacattaaggcaggtcaagatggaacctgcacctcatgtacctacgctgtaagtcagcttgtgcttgcggtggttctccaattttcccctgcataaacaccgtcacttccaagttcttcctctattctaagcagctgcagagaagatgagcacgataatcagaaaccatcccatcgacaacaaaaggctattgtactatgacttatcaatttctatagcagatgccggtgtgcaaatatgtgaatggtaatggtatatttcaaaaccataaaagttgctctggcatgaatctaactaacccaaaaaacaaacctgattgtatttactgagacattctccacggcaaggagcacccgctttgatctgtccagcagcagcaccaacagccaagtcagcaatgaaagaatcatcagtgtccccggacctatgtgacaccattacgccccaatgagcatcctttgcctgtctcacaacctctatggcttccgtgacagtgcctacttgattagcctgcatatcatacacaagcacaattcaggtatatactaaatgacctttgaggttgagagagaaatcagtgatcaaggaagattccagaaaataaatacttcatacttcatttgcatgcaaatatcgtttgcacctctatgtctacaacatgctaaaagttaaaaagtaaattcctccagtggatagttaatcttgaattattatcatattaatttatgtaaatgcctattcaagtactaaatgccaaacgtgtgaattgactatttgtatgctagcctattaacgattggttttcattgcattgtttgtaaatgccttagaaatcaactcatatgacacaaaacttgaactataatcaacactggaatggcagtgtcacttaaataagattcaaagggagcactgagcgtcccggcacaaagatgacaacaactattaatatagtaatattaattccaaatctttctttcagatggtattaatcttggatagttccaataatacgagtaagatgttgcacaaagtagctctaatcagtttcggtgcattaaaaatagaagtataacttatacttcaccttgagaacaagagcattgcaggtatactcatttactgcccgcttaatgcgttcgggatctgacataataagtcatcacctacaacctgaacaaatgttatgtcatgagatactgaacaagaagaataaaagctcaaagacatattagccacctggcacagctctagggtggtaaacttcttcgaatgctcccagtcatctttatcaaagggctgttcgattgagacaagtgggtactctagcgtataataaagaaaaggggaaatataagcctcatgaatgaaatcaaaagatgtaacaaaaagattttaatccagacatgtgatacctgaacaaagctggctataaatctcaatcaaatcatctgcagttttgaagccctgcctgatttctctgcaaacttgaactccatgtcatacttatttcctgcacaaaatgcatgaatatagccagaaatttaggtcatcgatatatcaaaacaaactaaccatagcatacaacacattctaattgctgttcaagttctctgcttctatggttcaaagttgtacggttaatataagccattaggttgacggctgaccagcaatactgaatggcataattccactgatgacacaaagaagaatgaatactaggtggccatgaaaaatagtactccctcggtcccaaaatataacaatttttaccacttaggatttgttccaaaatataacaacttctccaccaacattcccttcccaaccaatcacaaccccttcctattcaattttacctactttcttaataaccgtgcccaactctaaaactctctatattctgggatagagggagtaaaatcaagagatgacacaagaagagtgaacagaaatgccataggtacataagctgaaaaacatggaaataatgaaaaatgagttatcaacagagtcatggattttctcaaataataaggaactctttctttaatgcatgagagatcagcagagagcttgtattcgatcaatcagatatcattcacatgattctttatttgatcaagggaactgcatattaaacaatcacacaaccaatacccaagaaatcactctttctatccttacccatgcaaaaatcggtagcggcgacatcaattgctagcttgatccttccattatatccagctctatttattgcctcaatgacaagatccaagccttcggttatgctgaacattgacccaacggatacggcacattgatatcaatatgcaggtgaccaaaagggaaacaataatagaaccacaaaaaggtacagacgattccttacttgcctggaaatatttggagcaaatccaccatcatcacctatgttgcagctgtttgaaccatatttctccaagatgatatcctatcaaatcaattggtaagaagctattcacgaagatagtaagcttctcttcgcactataaaaacaaaattttggaacatctgaaagaataaatttatctaaggaggaatccacccaaacaaattaacactaatcagagtggacagaaagctgaaaagggcatcaaaagcagaatacaatgccagttaagttttgtggacagaatcttaaactatttgaataacaggttggtcaacatatcagagtggagcagatgcatgccatgggaaggtaggcccagcatgcaagttatagtagtctagtgatagtaccttcagatgatgatatgtctcagaacccatctgcattgcttcttcaaagtttttggcaccaacaggaaggatcataatttcctataaagaagcaactttacttgcaggtctcaaaaaaaatatatgacaacatagcaagatgttgatctacctggactatcttaacatgttcccagagaaaaagaaaacttcaaacaatgaaagaaacatgggaataacaaatttaaactttgcagatttcttaatggaatctgcagaaaagagtgatccagtaatttgcagagaaatgttggctaagaaaggtaattctacaggtttagtgagaatacttgaatagggagactgtttccagcatgtgttcctccattaatgactgtaattgcagggatgggaagtgtcgtagcgcttttcccaacaagttctgctatatgcttgtacaatggaacctgcacagaaataagcaaccaactataagaatgcattgccatatccaacaccttcttttaacccagaaccgtggtgattttatacagaactattacctctttttcagcagcacctgctttacaagctgcaattgatacagccaacatagaattcactccaatctcagcctacatgatgcagtgtcaatagttattaaagcaggacaattacaagcgatagaagctgtactgagctggctgctacaaagttaggcttgacagtaaagtgagatggtagtaaagagagtagacattaaaaaaaaattatagaaaacaacacatcaattattttcatcattaaatctacatggaacaaaccaatgttaagaactgtcatgtggctgattatacagatcgatcgactgtttgtggtaaagcacaaccctgaataatctctcattataactctcatcaaatagagctcagcaatgtaggatcaggtaattccatagagtgagaagagatatcgattggggttttagggatttaccttgtgatgcgccttgtccaagtccatgatggcctggtcgatctgcgactgctgctgcggatccattcccacaagcgcctccgacaccttgtcgttgatcacccgcaccgcatcggcgaccgccctggcgagcagcttccgcttctcggcgtccctgacggcgtcggcggcggcgccctcgggggcgtccgcggcggccgcggaggcgcggtgcacggccttgttggtgtggaggctgacctccacggcgggctccccgcggccgtcgaggatctggcgcgcccgcacgctcgtgatcacggccggcgccgcccggcgcatgtggttggagatgaagagcaccgggtcgggggccttggcgcggaccgccgcgttcacggcctcctcgatcttgcgcgacagcaggtgcttctccaggtactcctgcaccgacatggctgaggctgcggcggtggcggcggcgtcccgcgctgctcctcctctcgccacgcttcccccctctctctggctctctcctcccgcgccctctgcctctgctcgtcggctcgtcgcctccagctgccgggatcgctaggccgtggacattggccgaactcgaggaaggggaggctcgagacgagaagtcgagagtcctcggaccagtgcgtgcgtttgggtaggcgtgggccagtttcacgatgggccggagcccatttgtgtaagcttgtaccatgggctgagtacacactgtgtctatgggccactgactaggagaagcccagcccggtggtcatttccttcccattgtcttcaaggaaaaaaatcggatcaagcactccaattttggactggaagttgctggatatctcgagtttggaagcagagaattaactgcacttgagtcagtcactgatatgtgggccccattttactatggcccacatatcagtgactcaactacacagcagttaagtcagagcatcctttccctcgagtttgttctggacgattcgggtcgtgctggtaacctgaactgttccgttcgtaatctaccgagcccagaaccaagtccagcattttcgagtctatccaggaatagaagagaactatcgagaagctgctttcctctccatccttatcattcccccgccgcatataagaacgccatcccctcctcgacagatatccaagcaaagcgagaaaagaagccagcaatcgaaagcccaagcttccaaaaatccgcttccaattcgcgaaactacactagtcgtaagcgccaaatccaaccgacgatgtcgctgatccgccgcagcaacgtgttcgaccccttctccctcgacctctgggaccccttcgacggcttccccttcggctccggcggcagcagcagcggcagcatcttcccgtccttcccgcgcggcgcctcctccgagaccgcggccttcgccggcgcgcggatcgactggaaggagacgcccgaggcgcacgtgttcaaggcggacgtgccggggctgaagaaggaggaggtcaaggtggaggtggacgacggcaacatcctgcagatcagcggcgagcgcaacaaggagcaggaggagaagacggaccagtggcaccgcgtggagcgcagcagcggcaagttcctccgcaggttccgcctccccgacaacgccaagccggagcagatcaaggcgtccatggagaacggcgtgctcaccgtcacggttcccaaggaggaggccaagaagcccgacgtcaagtccatccagatctccggctaggcatcgccggcgtgccgcgtgcgcgacggagaggagcacggcggggttttcgctttggcctggtttgtctgtcgtgaaggagcaaataaaatcgggtccggttgagtccagtgtgtgtccgtgtctgtcttgaacagtcgtgtgtcgcgtcgtgtcactgggtcagtgtgttgttccagtgcgccgttcatcagccgatcagcgtctgtaccggtcttttgcaactagttaagtgatgaatactataatctgttaatacgtgatctgtctgatgcattctgtgctttaatttgattgagtttgggtattactacctgacaagattagaaaccatacaagcacctttcgaatttcgtaactctcactggcggatttaacccctctagccgccaatgctcgttgccgaaaacctaaagtttttttatatgttttcaatgattgaagagtttttctttagcaatatatagaattctgttttttttcaatgatttaaaaatagtttttctttagtaaatgctctatatagctagaggctaggtttgggttggactttttctgtatctatctaagattatggtagcttgcagtgactttagaatattactctctctgttccttaatatagggcgtggctgttgtagttgcaaagaccaataaaaccgtttaaatatcagttacgctgattaattctctctgttcgaagagcgacgtttaggtagttgcgcggtagatacgctagcattaaccatcatgcagcgtgcgctcgacctgtactttccgcgcgaatagccagcatgcatgcagatgcatttttgctagcgtgctttgctcgcctggcataacgccatgtatggattgttttgattcaaaaatttggaaagccccatgcatgcatgcttgatcgaaaatttggatggcgccatcagcgataaaaaatgaatagaaaattttcacttggcgccactatttgccagcaaaattttctcctataaatatgggcaatgcaccacacatttttttccatctctcttctttcctcccatggttcaacgtacgtaatggctggttttgatctaaatctacccatcatcaattgggacgaagttgaggatttcgatggagatatatctgatttgaactatgactttgtttgggattatgacaatgaaggtgttcataggagcttcttctcttgctttgtcttcttttttttcttgtgcatgtgtgactataattttgtttcaacgcacagatggtgaagatggcaatggccgcggcagtggcaacgacggtggctgcgacggcagcgacgacgatggcggcggcagcggcggcggcggcgatgacgacggtggtggcgacgacggcggcggtggcggcgatcaaaccaccgatggagcagtcgatgcaggtaatacacgttcattttctttttgttgctgtgtctttttgctgcacgagttgaaggcctttgcatgtacacatgcacagtgccatgcttaagcaaactagccgatgcatgccaaccatagtatagcctgcacgttctcagccatcatccaccatgcatgtgtaggtatcaatatcaagaggaggagacactaccctcctgatatgaaacgagccatatatgcattgtgtttggagagatcggatcctggtatgatgaaggagggagtgacaaagtcagttgctactgatatgggggttccatggagagttgttcagcatgtatggcgacatggacaaattggaggtggaattgaagctttcgaatcgaagaagaagaataactgtggccgcaagaaactttcttttaaccctgatgccatcaaagatgtaccgcttaggcaacgccgaacactccgtgacctagctaacgctttgcatatgtcaaaaaccacattgtttaggcgtttgaaggaaggaaggtttaggcgccatacaaatgccataaagttcaccttgaccgaagataacatgaaggcctgtgtgcaattttgcatacaaatgcttgatagccaaagcataccggacgagccaactttcaaatctttgtacaacattgtgtatatagatgagaaatggttttataggacaaagccggacgaaaattattacttgtcacttgatgaaccgaaccctcgaagaaatgtgaagagcaaaaatttcattgataaggttatgtttctagcagcgaaagcccgtccaaggtttgatgagtatggcgaatgtacatttgatggaaaaattgggatttttcccttcacttactgggaggcagccaagaggagtagtcgcagtagggagaggggtaagttgtttaattatgcttagttactccacatatgacaactctactaattttgtttaattgcatgatttaatacaggaaccatggagctcaaggccatgacatctgtcacgagggacattatccggaactatctcattgaaaaggttttgccggccatcaaacataaatggcctaatgaggaacgaggacttccaatattcatccaacaagacaatgcaaagacccatattgcagttgatgatcctgcatttttaagtgttgcacaagaagatgggtgggatatacgacttacatgtcaaccaccaaactctccagatcttaatgttttggatttaggtttttttgcagcattgcagtcattgtttcagaagtcatctccatcaaacatcgaagaaattgagacaaatgtgatcaaagcatatgaagaatatccggcgaatagatcgaatcatgtgtttcttactctacaagggtgcatgagagagattatgcttgcaaaagaagggcagcactatgcaatcccgcatatgaagaagagatcattagagagaaatggtcaacttccaataaggttgcaatgtgataagcaaatttatctagatgcggtagatttcatcaatacatagttaggatatttctcttgtaactttgcatcgttcaacaattagcaagaaaaagaggagtattcatgtttgtttttctctgatcttcacgaaaaagacattgcattaaattgaatagaacaatcaagtgcatacacattagctaaaccatctagcaatgacaacaagcagcaacattggcactgattatacctctagtgaatcagttgtttttttcctcggcgttagtctcctctagtgaatctgcaacaaatgtgttgttggccagtgagtcaacaacgtacccaatgttgtcagagtcagtgaaacgatcggcgccggccagtgagtcgaccacgctgccctctcggattccggcatcccctgccttctctccgttgtcacccttgccgtcgtcggtgttgcaacagcgaacgagctctgcttgcgctcgcagccgcatgcgaagggcatgcacacggagcgtacgagcatgagcgatatccatctgcgcctcctgccgcatgcggacggcggcgtcgcggagcactcggacacggccaagctccacttgagcacgacgtcgcatgagcacggcgtggagacgaagtgatcgcgcgcggccgaactccacctgcgcctgctgccgcatgagtcgtgtagatgcaatcttctcctctgtcgtcgccatcgtcggcatatgaagtgtgagcagtgtcacagaggggcggtgtgtgcagtgagagagagagaggaagcagtgagagcgagagagagagaggggccaggagctgagctttttaaaagccaaaccgagtcatcagttaattctctgcatgcatctgcatgcatcagtacaggagccgaggagtactcatcaattcctgcatgcaccgaggagttgccaccctatattatggaatccaattgaaaagaagttacgccctatattaaggaacggagggagtacgactgtagtataaatggatgcttaacaaggttagaattgcctaaatatagtctctgatgatcattttctatgtttttaagataaacggttaaaatagaagcagaaactaggagtgtttatgctagagctccagtttacacgttggttaaaaaatgtaaataaatagtacgagtgcaaaatgtaaacaaagtctctacttttggttaaaaaaagtatgagttcttatgcagggacttcagtttacaggtttttatatatataaaaaaaaccaacgagacaatgaccacacctcaattagggatagtacagtcaaaaagataaacatgaagtgtagtaaattcaacacctaaatacactaagctatcaggcggtcaggcctaaagcaaagataacaaaagtactagagagtactgtagggatgtcagcccactcttcatgatttcagccatcagggcctttaggagctgttgttaagtatgatgcagaaggttcctccgttgtagaagaaatcacgagaggtgttcataattttgttcctaaaaatcatatcattcctaacattggaaaggtcccaacaagccttcgcaagtaaacctaatatttgctttttcaataatttaacatccccaatgtttggcttagttgtgaaataagtcaaacatcatattgcaaaccagaagtaatttgttaataaaacttttatatacgtgttcttagcgacttaaaagcgaaggccgaaaaatatagtccgatattaaaaaaaaaacctaaaatcagcttcaaatttaaaattaaaaaaagaatcaaattttgactgataagtataagtatagatgaaaagatgagacgttttcctttaataactacttaatatagttagaattgtctgggctattttttttatctaccaactctgtgtttattacttgtgcatttaaaacccacacagaaaagccctcacaatgtggcactagttttagttaacttgtttcactgatgaattagcaaagcttagttaacaaaaactaagcccctaagcaagtacgctcatcgactcattatctagtaaccctacgcacatgagtgtttagttgagtgataaactttgtcatgcttggaccattcctttgactagtattcggctacaactgtagtgtgtcacactttcttttaaaagaaaggtcttgttcgatagccctaaactatagcgttttttgctgtgcaggactgtgctgcacagcccagccgaacggctacattcggcaatctgctgtatcatgtgaagctcaaccgaattgctacagccggccatctgttgtatcatgtgaagcgtgtcccaccgcaattggccaacagttataactgttatttgcagtgctgcagctgctaggcctaccgaacatgttgaaattaggcccacttgttattggtggttactaacaattattttaaggattatatttgaaacaataggaagtaatgtatacaaatattatatttatggtgtgccatatttttaaaagaaattaggcccactctctcctaggtggttgctaataattatttcaaggatattatttgaaaacataggaattaatgtatataaatattttatttgtcaaacaggtacactcatttagccaatatcataaaaggaatgttatacatgcgtcattatttacaacaaattccaaaatgatacctagtgggaatatgtgctaagggccaacatattataaaaagggccccattgccctcttcccctcatccaactccatcgccctggcgtgcaaccaagttgcatattccccttgctctccttgtcatccctctcaataaggcaacgccggatgtagatctagaagcggaggacctcaattgagcgcaagctattctagatctgaacaacgtaagtactctatttggtttttatcttctccttctccctctgtgttgtagtggatctagatctagggttcgttctatttggtgacattatccttcctcatggtgacgcaccctaatctaagggagcatcacaagtgaaatggtgtgtgctaaacaacacgatggtcgtcggttggtgatagtgaaatcgatgatgacaaaggtggggaagactaagagaggttttgtaggtgggttaaattgcatgttttgtctatttgatttatgcaatgcaagtagacaaccatttgaatgttaatttcacccccaagtgcttttgggtagttccggttgttagtcctcttcggaccatcctggtcattttgcacaacagtataagtgagccttttctattatacgtgtattcgttaatcttcaagtgcgctatttgattcaaaattgttacacccccaaatcgtttaggttcgatttcaaacatccttttgaaatagcacaaaaaaattgctactaatgcacatatgcctaagtaattacacattaccttttgctttaaaaaaactttacatttgagtcatttgagtcagactttaaccttttccattcagccttgagtgctgatggttatggcggactagtagccatagaccatagctgaccaatacatgcaagatatttctagctatacggaggatagacatccgaattatccattcactcgatatttcaagtataatatatagtttatatttaaacttatgttagggaacaaaccaaaatgctcaagtgcccgattcacgaaaatattattcgtagtggttgtgtgtggatcatgagttcatcacctatttgccattctttgtgatctctgaaagcttgagccaccatggccttatgcggctgtgatctcatccctcgtgtgaccccttatgctcttgcagtctagcccagtgcgtcgcttgccaatcctcaagcttcattgaatgcaaaagagggctttgtgaactccaaagttgtgcttcctccacgcctttaattctccaaacacaacttccatatggttggtggcaccacagagtgattggttttgtgcatcgcacatatggctgtggcatagtgttgacaaaaaaaaatcgaacacactggcctgggagatctgcttagctcctgtacaggtctaaaaattgatgagatgtgggcgtgccagtcagtttgatcctgcaactgacaagatatgcaaatagtagatcaaaacagccgatcaactgacaagccgatggagtagttccagccgatagccgataacagccgatgccgataccagccgatagagatagggtttaagcaatcggctatatgtccaatgtagataatgatataaaggcaatcggctgatgatgctataataaaataacaatatagtcatgtataaaccaatcggttagcaatgatatgataaataagcatcgatccgagggttaaagcacacatcggctggaggtccgatatcatgaaatccataagattagattaaacagtgaaacctttgttgtcatcggctaaatccaacttatatgtatatgcaatccttatgagccgatgcaacatccagataactcaccagctgaaaccccgatgaaacccttattggcaatcaagaggcaggctagagattatggttctaagcacgacttagtagatcaaacttaactgatacaacactaagtatgaaaagaaacacaatatctagacaatcaagccgatgactgattttcagggtggtagatgtctaagctaaactaatctagcaatgcgatttagccaataccggcagaaaccctaaaacgagaagcagccgatagagctaaattgatatgctaagactatattaacagagacatatgataaataggtaggcaaatatatcattcaaaccagatcaatccaagaggtcgaatgtactgatgcagccttgaatgacgccgacgtagacgatacaattgcctggaccgacggaacattggacttatcccttcgccagagatcgaagacgatgcagcctcgcgtcgggtgccaagtttcgccggaacgtaaaaacaaaagtagaaataaaaagggtggcgatgcgccgaattgtattgatcgtggagatagattacatagaccccgggtgtacatatttatacccataggttgatacaattccttgtcggacaagaaagaaactaacctaaagataaaaggaaaatataaagtccttatcggacactaaacacactttcctaaagataaaaggaaactaacaaactattcctaattaatagataaactgccatgccgcatcctctttaaactcggtcacttagggataagcttcctttagtagattgatttccttaaccgaatatagcaggaattcgactattggcgacttgataactcccatcagctgattccgagatgctgcaaccgataatgattctaagccgatgacgtctttgccgattaccaaattttactgttaacacatagggctccttgtgtcgtgtgtgcatgtctctcatcagctctgagctatgcggtgataatgttgccttgctactgcgcggccacttaacaaccataggccggtctcatcccacaacatgcttgatggattgggtggccaggtgtacaccggggtactggcccctacaacttatatctgaaaatctagtaagtgggtccggggtctagtttctggtcactttcacttatagttgaaaatctagtaaaaaaaatgttgtcacctctatagcttattctaaatgattccatgagcatccttgagaaaatgttaactttggagctccgatcagataacgactttcactgcactatgttgttgcattttctactggtttccttactcctccgacccttaagtgtttactaaatgtttatgcagttgaagcaactatggtggagaatcatgtgtcaaaagaggattcaaagaattataaattgaggatgggctttgtggtaaaaaaaatccatcttcttaaatatccttgttgtggtacttgtcgttagtttccggacaaataaaaaggcatatgttagaagaaaaataatattttgtttgagccttgatcagatatagatctggtgttttatgacgcgattagttgattcctacctttagttgcacgaaagagttagcttgccgattttgcatatagaatcttctccgtggcatatcagctctaaattgtaaatctattttcatccaatataacaaaacttacattctttatgcaggatggccatatttgtgcaatttgtgatgatggtggtaatttgatacggtatgcctattctttgtctagttatcctatttctttttcatatatttgtttagttgtactattttttcccctttgttattgttctcttatttaaggcactaaaccgatagtgtggattgtacttgatagggtgatggataaaattaatactagagttgttttactgtctaaggcattgtagtttaggctcactggacaatggattggaacatagttgataggatgatgggtattagatttgtgtttgagacgatgtcctcatatagattgaagacattcaaccttgagttttccagatcacactgagtaggttttggcaaattttcccttctatttactctcttgatcaacacacgtgttcctgtttttgttgtcatgttactgttatattttcaagagccttaccattcgctgagaaaacaatacttatagatgttattattgtaaatattgaaattctgaaattaaaatcataagaaagtatttttaaatataaatccattgatgccacttgtatggtgctgaacatagatattggaagcttaactttttttttgtcaaaaataacaaatgttgatatttctgaatacacgtgtgccctatatttccaacagcgggagtaatatcaaaaatcataaagttattgggttttataaagtatcataatgtaaaattactggtgaaagtttttaaagtttaaccgaatcttgttctgaacgccaaatatttatgaccggagcgagtactaggtagacaattttcccatatgccataattcttgtagattttggctgcaaaaggctcaaggtttttgctttttattgtactaaaactatcagggtaaagcgctttatgcgttcaatttattttaatattatgatacttgattattgtagctgtgagggtgcctgtcgaaggtatttccaccgaaccatttccaatgatgcagattttaactgtgaaactctcaacatgagtcaagaacaagtggtaagtgcatattcctttgcctcttcaacttattcttgtttaagtattccagtattgccatttaccattaatatttttcaacaatataggaatcatcaaagttcatatgcaagaactgtgtgtataagcaacaccaatgctttggttgtggagagttgggatcctctgacatgtcatcgggttcagctgaggtatgtataagaaaaagaaactttgtatgtccttgggatacttcctcttgtatttggtatttccttgatttatcattttgtttttcaattttcttatggaattgaattaaggcactgcttgaaagcaatttttagggatggctaggagtcaatgataactttgaggaatctgagagcgatactttggaattgtatacacattaaagttcaagaactttttttttgtatgtgctcgtcagcataaaccaatttcctttaaattccaacttttccttcactttttgttaggtatatcagtgcagtaagagcagatgcagacgcttttaccatcctaagtgtcttgctgaatttgactctagtaagaacccaccagtttttgaatgccccctgcatgaatgctttgcatgcaagaacaaaggggaaaaatataacgaggaaacatgcaagaacaaggggcaggagagtatcaagaaaaaacaaggggcggaaaacaacaagaaaatgcacctggcattatgcaggcgatgtccaatagcataccatcgcaagtgcttgcccaggtgtgatatgtatttggcactatttgctagtgatagtgcccttctaaaaggatattttgttgacacggtgttctcttttttaggaatatttcctctgttcccaaaggttgtcttccaaggaaatggaaaactaataagggccaagttttcttctattgcctgtaagctttttgcacttcatcctttttgttagcatatgttctccatctccactatattcgtggaacttattattcacatagaactttttcagaaagcatacgatggtagaacatctcagaagtgcaacaagggatcacctcaaatttccaaaagttatggaagagcacatgcagaagtatgttcccaaaagagaagttgaaaacaaaaaacttattgtttatgttaggaaacgacatagaggtgcatctaagaaacaaggagcttccatggtggaagaagttgatcatgggaccatggaaagtgatcatgttcagagaagtagagatattaatctgcgagcacatgaacaaaccgaagcacctcgaaactatatgtctgaccgtaacacaagcactggtttcgtgttgtcttttgcacctaagtccttgttcccactcccatatccaggcaattgtggttggcttgatgattgattcatgatagtatttcagaaagaaaactgaagatttttaagtttcatgtatggcagataactttgtctgtagcatgtaacaccgttgtgttgatgttcgtgatggtagttaattactggtgactgttgagtataaatgtctggatactgtggcagcgacattccttccattgtcaggaatgaggatatattaagtactattatcactgtatgaaatgtttttcgcgaacgcctgtatgaaatgttattaaaatgcttctgttcatacctaggtgaaacaatgcactaatgtgtaatgcaggtatgtaactctctgttgggcagctttgctctggcctctgagactgggagtgtggctgtttccctacaatggtgaatcggtgatgcaggtcacagccttgcatcttgccgatttgtccagctcatttgaggtgacggatatggtggattttgctgtgtgttcattgtttatgcagtactggttcctccaattattttcataattttcttttctgttacgggccggcggaagctgccgtgaccgtggatagcttgatttccagtggacaagggagtataggtggactgtcaattgcaagtttgccagtgggaaactccagtaactaatgcatgcctcagaaagcattcagttgagatggcatgatgaaattattattttttgcaaactagatgaggagatgacgtgatagcctatttaagcgaaagcgatcgggttgtagtccacattacgcagaagcagcagtaaaaaaacagtgtctacctccgtcagccggaataatggccagcaacagggaagttctacaggtggtaacatgctgtgacggtgtatctaattgggtttatattctaagtttgacactgatgtctgctaattttagaaaggaatacacgtgggcacgtcttggtggttacatggatgctcatactctagcgggtgtttgatacgtttgacggtattcatgtatgcgaacgacacacatacttaaaaaaatttccctcttagaaaaagaaaagaattgtctgaagaggattagataagtcataaaccgcggtgaagtggcagcttgacccactagcaatcgcgcacagccgcacggttgttatcatcaaagattcaaagctgaagccttcaaccagggcaatctccattttccactcccggccgggtcggagtcgcgcgacgacgccaccaaggcaccaactccacgtctccgccccttccggttaattcgctcctacgcgcacccacaccaccaccacgccatggcgtgggagtaacgcgcgcccgctccacaccaccgacccgtggcaacgtttctcatctggcatccggctgtcacgttttcccgttcgctacagcccgcaaactcggggtttccccgtcacgccagccgcccaagcacaactgcacagcagcggggactccgccggtgtgcgccgacgcgagccgcatcaaccagttaccgccacccgcgcggcaacggcagcggccgcggcagcgaatcggggccagggcaagggccaatccatcctcaccaaccgcaccaccaccaccaccaccaccaccgcaaccgaacaaaactcggggaggccgcagaataaaggcgaggaggcagtataccggcgcggctggcctagtgtagtgcgcgctgtactgttcccacgtcgcgtcgaggcatcggttcgagcgagcgcgcgcgcgacgcgggcgaggctccggctcgattccgtcgccaccctgtgacagcagcagccaccgcccaccgccgccgccgctttctggaggcttcccgttggctcgtggttgcggggggactcgcggagtcgcggttgcgagttggctgcctgctactctgctagtgtgctaagcctgccttttagttagtctgggagcacgctactgctactttccccaatccaatccaatccaatccaatcctcgccggcgttggttcgctcgatcggcgcggcgcggatggagacgctcaggaagcaggccagcaagctcagggagcacgtcgccaagcagcagcaggtacgggttcctttgcccaattccagtggctccgtctccccactatgccaccaccaccgatcagcgcgtggcccgatgcgcggctaaaaaaccggaatttgggagtgcggggagctgcgtggtcgggttactggagttcttgtttgctccccgcagttaattccgcatacctagtggtaggaatcagggtagggagtggcgagtgcttgggttgggatagcagcaggccagcagttggtggaaggagctgaacatgaactgctcatttgctgcgcatttctgtatatcagatgatttgttccgaagcttgagtttcacttgttccagtagatgtgcttgtttggtaactaataacagaattccttgtgattacaggctgttcggaagcagttcagtgcacgctataaccaggatccttctcttgtcgatgaggcggaacttgagtgccaccagaatcttcagaggctatacaacagtacaagagctgctaaagtatgtgctccaactgtttgttatatgtgatataagaaagttgtctagctcatgatgtaaaagttattgggcatatgtctcattgtatagcatttccaacgaagtattgtacgaggtgtcgagggtttcattgctgtcagcaccaaacagatggagattggtaactgttaccatggaatatctgttcaacatccttccaaattttataatttttgtgtgatcacgttgcgatgtttcttcctgtagtgaaaaagctagctgaggattgttgcagatatggaaacgacaatcaaaattttggttttattcttgcaagggcttcagttgagtttggtaattcccatagccaaatggagaaagagcgggagaatcttcttaaatttcttggagagcaggtgctgtcatattatcattttcctctctttcttaagttttcagaaccaagcaaaaacaaatacattgcaacatgcaacggatatttaaataaatatatcataaattgtatactcaaaaagctttatataaatcctagaggaaaacatatataatctgcaagcacacatcaatccctaaatagcatcattataagcaacatgcacttattttctaaaaaaacacatgcacagatgttatgcttatcctcaaaacatcccactaactcaagatgtggtgtgcgatggcacttactatcaccaacaccactaacttattttatattgcatagaaatttcaatgctgcctagaatcttgtttaatgttcttaacctgaatcttctaggtttccatatatttttctttttgtacccttgacccttgagttacctgaaattaaatggtgttctcctgaaagtaacaaaacagtgtaaaaaacaattggtggattctactccaagagtacatattatatatggaagtttgctacaaacagaaacttattcagctttgctgatgcttgatatttaagttgatggacgtagcatagtttgtttatgcagtgcatggagctggagggaatttttttttattgctgtgtaaaactgagtgccttaattgcttcatttcggctccaatcttgcaggtttttgagcctcttcgagaaatgataatgagtgctcctcttgaagatgcccgcctgttaacttaccgttatcaacggatcagacaagatatggaatctcaggtaattacccgaagtgagacttcctgttcaccagagatgacaaccagatactaaaaataaattttattagatagctgatgtgatgagaaagcaactgaagtccaaggagagtagcggtaatgcagataattctgtgaaactgcaacatgcagaatcaaaattatctgagctccgaactacattatcagcattaggaagagaggcaactgcagctatggaggctgtggaggttcagcaacaacaggttacctttgaccgtctccttgcaatggtatgataagcctcactgttctcataaaaatattgcttaacatcatcaaataatatgtttttgccaatggttaagacttcatgtacatggcaagttgagcctatccatcgtaacaacatggctatttctcttttgctttgagtatggtgtaaccaatacatgtacaccattaggggtagaaaactgtagacatcaaggtcacaataacctttgggttctgagcagaattggtgtttgtggccatgtttggatgttgctttttttttttccctgtcaaccccaatgtgcaggcccctttgttagttagagcatatctttgcaatatgttgacccataatcctagaagtttctgcatatctacgacaatgaaaaatcccactccattgtttaaggccttggttggttggggtggtttgtcccagtccttataaaatttaataccaggaatttgatcggttttcctaagggcctggtattgactcttaagcccacactctcatacagggttccttttctccctgctcaccttagattgtaacaatcttatcttttatatcatgtggttgcttaagttcccatataaatttctcatctggatttccatttagtagttccagtacttataccatttgtccataggatgttcctttcataaagagtcatgcatctccaatttaccttatgacccacttgcaggttgatgctgagagagcttatcatcagaatgctgctgatattctgaacaaacttcacgacgaggtacataactgttgcaaaagaaagaaatggagattcttacacctgttggcttagaggaaattcgaatgccataaacctggaaaaagtgtgtatgtttatgctgaatatcactctgtttttgttctgctaatttgcacagatggtccaagcaaaacaccatgatgagccggaaaaccattatgatgagacatcatcagatcctaaaacagctgcaacacatgagcattcacgtagcacatccgaagatcacatatttactaatactagtgaacctacaaggactgaaaccagtgaacctacaaggactgaaactagtgaacctacaaggaatggtcaggaagtgcattatgttggagaggtatgtgtgccctttgcactgctgctcataatgatcataccagaacttataatgtgtcaccaactcacaacatcactgtctttcatttaattgcagtgcagtataaaatgttagaccttagcttgtattactggcattgtatctgtgctatctgtttatgagatgttttagacatagatacaccctcttacaaatatggtacttcgactgaattttatgtccacatgatatatataaagcggtttgattctgcagccaccttagaagttaaaatttcgatagcatgagcaatacatatgtgattttttagagctactttttttttaactttttaggaatggaatttagagctactgttggtaaagatggtagtctgaaatcatgtgaatttaaattcaaaaggtgcaacttgaacataccggtgtttcttcaacataaccttttaccttaatctttacatttcactttattcctctttacacctggtaaatactatcaccgaatgtcggtatggaagtcacctggtaaaaagaagcaaacatatacaggcaaaggataatcagtatatgccaaaattactagttcaacaattttagcagttacacaatcagtaaaacagatcagcacattattatacaagctgagcagtttgtgaattactcattggtcaggtaatccatccattcgatgctcaggctgatggcgagctcagtatttccgtgggagattatgttgtggtccggcaggtatacatggtttttgcaggttttattcatgccatggggtaactaatgaccaaaattctgaagtaaagaaccatgtactgtataattcactgcggtagcatcctagtgtatacatctgtgaccgctgcaggactatgatcagatgcagtgcaagcatataattgtccccttgttatatttttaattctccaagggtgaccaggggggaccagaatgctaactaagcattccttgtctgtcttcacaggtggctcccaatgggtggtctgaaggggaatgcaaaggaaaagctggctggttcccatctgcctatgtggagcagagggacaaagccccggcaagtaaggtgatagagcctggattgctgactacttaatctctctcatactaatagttgctttcatcgccctgtttcccctgtacatggggtttttcttgagtgaatagcattttgtagaacttctacctttctgtgcatattcatgtgcttctaggcttgctgttacccaataattgtatgtaaaatttattgttttgcctttagcatctcgttttctctttctttcacaatgtatagagctattggtcctgggatgctgtaaccttccctttcttttgtggaaagcgtgcttcctgccaaaattgtgagatggatttcagaacagtctcactggccttgttccttcacttttggacccaaaagctcgtaatctacttccctccaaactctatttactcttcttttttctgttcttatcaaaacagcaaagcaaaggacggattgcagcattcggtatgtctgattgggtagaagaagaaggcatggttgctggattcctggatccaactttatctgaaaccctgaaccttaacgggaacaggagcacttgtttgattgctcccctcctctcatcatttcactgcccacaaagttaatttgccacttttacctacttttggctctgcggatgctgaatttatggggccaagccctgacgcctcttccgttgccggtccgcttcgcggaatcgcggtagcctggccatgagcgcgccaccaccgccgcctcgcttcttgccgcgacacgcacatggagctcggaaagctcgcgtttcccaagccccgcgcgatgagtgcaacgtagcccggattgattcgcgacgttagcccgtagcacgttgcgcgcaccagcggcggcaggactggatttttcacattttggtccttttgaaaaacttatttcgcaaatagacccctgaaaaaacttatcccagaaatggtcctttttgggacgccacagtgcctggcgccgtcatccaagggggcggcgccagcctctctggcgccgtcctcctgccaccgtggcgcacgcgaaccgacgtggcaggaggagggcgccagcatggctggcgccgccgcctctattcctgtttctctgtatggagttgcaacggtgtcatttttattttatttttttgatgttttttcacactcaggatcacgatacaaccaaccacaaaaaaaaattaaactcgaactaccacttagctaagtttgaaaatatttagcataccacttagtctactttgcaccttcactaaaattagaccataactcttttagtaaaactctttgatcagcatgttaaacataatgcactctaccactatatgaaattacttaatctaattcaaaatataaccacatgaaatgagatatataagttaaacagtacatagagatgtaatttttttatttttatttcattttttttgatatttttttcacacttaggagaacatagaaaccaaccgtataaaaaataaactcaaacggacaaaatatgtgacatgtagaattttccaaaactctaccgaaacggacaaaatatgtcatctattaaaataggcgtaactttctcatacggactcggaatcaggcaaataatatatgcacggacatctacagaaaaagttacatccgattctccccagctttgccgggttcggcgatattaaaacctccaaattccgcttgcaagattgtgttttcgaggagagaagtttttcggtggagctttggaaaattccacatgccacatatttcgtccgtttgagtttattttttacatggttggttcctgtgagttcctaagtgtgaagaaaatatcaaaaaaataaaataaaaataaaaaagttgcacatctctctcctctgcactagttcggagagaggagaggagaggaaaaattctacatgtcacatattacgtccatttgagttcaatttttctatgattggttcttgtgtgtccctaagcgtgaaaaaaaatatcaaacaaataaaacaaaaataaaaaatttcggggggggcgccagccactctggcgcactccccctagccacctcagcatcgccccgccacgtcggcagggggacggcgccaaagaggctggcgccgtcctgttgaacgacggcgccagccactctagcgccccaaaaaggaccatttttgggataagtttttctaggggtctaccttgcgaaataagnntttttaaaaggaccaaaatgtgaaaaatccaggcggcaggatgggtcttcggtgcgtcgtgcgcaaggggcggcgtgtatgggtggtggtgtccaccggattgattgcgtgcgcttcgcctcaccggtcttgggctgctgggtcctcgtgcagttatggcgcggctcgcctcatcgcccgtgttccgccgatcgctttggggggcaaggtagcagagatggaagagagagaaaatgatgcgtgccggagacttgccagtgtttaccgttcgtctgtctgcctgcctgcctgcctgggtgggtttaacccctagactagtatcttcttttggctaaattttcaggacatgtactaaactaccacgtgattttaacattagtgaagcagctagggactagggagagaaagcatcaaccaacaatcgacaacgaaagattgaggccatgtcttagttcacatcaaacttctgcctgactctcaacttttcatcacatcacatccaaaactttcctacacatataaattctcaattttttttcaaactatcaactttccttaaacttttttttcaatttcaaaaactaaacacagcgtgagaagcttcaacggtagcaggagtacagtaaaacgggagcagtggtgtggaagggtgaaaaaacaggcggtttggcctggccgatgggaggaagggtcacatcgagagcagaggacaccgggtatgagacagcacagctcagcaacctctgggtcgcctcgttggtcagagctccgggcccgccaccagcgacccgtcgtcctgcttcactaggctttgtataattgtacccgtaggtgctgcacaatcaatactttacctaatacctaaatactctaccaatacgatacgccgcttagctcaactgaacatcttcagtatcatggagaagtcgacaccgcgtgtagtttccagtgacagactgacatgctctatctagtttaaagctgatattctgtagaaattttgtcctaatcgcaggtccaaatagctcaaattgaaacaaaacaattggctcaattatctatcttgaggtctatgccgacctaacaaaatgtactgctcctaaccaacatatattgacaagctgcaataactcggcctaccttcgcctatttggaagttgagagcacagggagggccgataggaaagagagaaaaacactgtagtttatcatctgattgttcagaatttaattcgtcccaaaggctaagcacggtccggcatgggaatctatcgctgtcccgtcccaattggcacgtcattttcactcagcatgccacacaagtaccgctacgacgcaaaggcacgcacacctaataaccaataaatgtgaacgaaaaagagaaggaaaggaaaagaaaaaacgggcgaagaagaagaaaaacgtaaaagcagcttgcggtgcgaggcaaaagctagtagacgaggcgggggtgattagctgttcgtcccgtgtcccgttgctcgcccacgccacgccgcacgcggacaaaaccgcattctctctctctcactacactcctcccccacactctcctctcctctctccctctcgcagccacagcacagcgcagcactggccgcctaatctctccgcactctctcccctcgccgctccctccactgccgcttcgtctcggccgacgacctcgtcgtcgtcgtcgtcgtcgtcctcgtgttcgccggtcgccgcgccgacgcggatcgccgtgccgctgtccagtgcgagagcgcaggcaggcaggcaggcgcaggtaaaaaccttgcccccgctccccgtcctcgcgccggatctgccgccgattcgtgcggccgcggtgagcccgtgcgtcgcgtcagcttgtgtgttgctgagtggtgaactggtgatgccgcggcagcgggcgctcaaaactggtgtgctcggtttcgtgtcggtagcgtcgcgggggcttgtgggttgggttgtggctgtaccctactttttgcttagtggcgtcggcggcggcagttgcgacggctttaactctggatgactggatgcgtgcttgcgttttggcggttgcgagctggaattagtaactgctttgttgtttcttcggctaactaagttggtccttttttttttctttttaagaagtaactgaaagatgttgatttacagtaattggggtgactaaattgttttcgaaattaaccgctgtctaaattgtttttgttagaatttttggggaaatttcaaattgcaggttctaggtaattcaaataccattaaacaattttgtggaagcacataattttttttattaataaattgtcatgttttggttcttatggtcgtccattttgctaaagaggagccatgagtgtgtcacaatgtactgcatttgatctgcatatctgattgttgctctgtttatttgataactttgcatgattgctgatatgttcctgttttcacttacagtgccagcaatttgcctccctcaccaggggcacatctacatgtggagttcattcccataaaagaggatgcacatggtatacctcacccatgacctctgtaataagctgcggtgatctttatatgcttcaccaactggtgaaaaatgggctcttttctgagaaaacagcccagtttcctcttaattttgttaattctgcaccttggtgctcgtgaagcaagagcactaagttcagatggtatgtgacatttcatagttatggttggtatttgtgtgctacatttgacaatctgtgctcatttattatgattcttttgacggtttcctacaggtgaagcacttcttgccttcaagaaggcagttacaacttctgatgggatatttctcaactggcgtgaacaagatgtggatccttgcaattggaagggtgttggatgtgactctcacaccaagagagtagtttgtctgtaagaccaaaataaaccctacataaatattgtgaaatgcttagaatttcaacctggctattattttgcttcagtaatatggttttcgtttttaagatggcattttctaataggaagggaatgataacttcatagcttccattgttataaatatatctgaccaccaatatcttttgtttaggattcttgcatatcacaagttagttgggcccatacctccagaaattggaaggttaaatcagttgcaagctctgtaagtgtgtgttgatagcgttctttgcttaacctctttcttttcagcatctgaaattactattttatgtcattagatcactgcaagggaatagcttgtatggctcactccctccagaattgggaaattgtaccaagttacaacaactgtaagtttctaagtattactgtttttccagcatttgtaacaccatgtcttgcaaaaaactattcataacattcatactgttatgcaattttaattgatgcaactttttacgttttgtgttctgacttgtgagatgaccagcaggtatctacaaggaaattatttaagtgggcatatcccttcagagtttggtgatctggtggaacttggtacactgtaagttttgggtggagtttctggttgctttttttaatcatttattacctcaatcaaccaatgtctttcctggctgtccatttcacatcagactgatctcccctgtctgattagttcaatctatgcatcagaaacgtaccatttcactgaaacaatcaacacaaaagttctgatataaaaattaagtgcactggattgcaaatgaattcgtttgtcaatttagaggattactcatatttctggaatatgtttttccccttcagggacttatccagcaatacgttgagcggatcgattccaccctctcttgataagctggccaagcttacatcattgtgagtgttttttatcttgataaatccattgaatttttatgctaactttgtgcggcaaattaaataagaaatttcacctgtgcagcaatgtttccatgaatttcctgacaggagcaataccatctgatggttcacttgtgaattttaatgaaacttcgtgagttatcttctctatgttgtttattcttgtctaattcaatatgtatatttgagcaagtagagtgggggatgtcatgtgatagagtgcttttgtttacctcttcatgatgcgctacactacatcacacttgtaatatatcatatgattttgcatgttgcaatgcagcttcatcgggaaccgtggtttatgtgggaagcagattaactcggtgtgcaaagatgcacttcagtcaccatcaaatggccctctgccaccttccgcaggtaccagatgtttctaaaactgtctacatacctttttttcatgcttcaaacattttttgtaaatagttaaatggttagcaagatttcaatgtttgtatttaatatttatccatcaatatcaatcatcagtatcagttgcttttatatttgactaggaaatatacttctggcagtttggggttctgtaaagtgtaaattgatccctttcttttcagttcctttcatgaacctatgacttatgttcttctgattatcatatggcagacgacttcatcaatagaagaaacgggaagaattctaccagacttgttataagtgcagtagcaacagtaggagctcttctgttggtcgctttgatgtgtttctggggttgctttctgtacaaaaattttggaaagaaagatattcatggtttcagggtggagctatgtggaggtaaccatgtcattgaatatgctatgtgaatcatcttcaatttatgcggtccttataatcttgcttgttttcttttaggctcttccattgtgatgttccacggggacctcccttactccactaaagaaatcctcaagaaactagagaccatggatgatgagaatatcattggagtagggggcttcgggacggtttataaacttgcaatggatgacggtaatgtttttgcattgaaaaggataatgaaaacaaatgaagggcttggtcagttctttgatagagaacttgagatactgggaagtgttaagcatcgttatttggtcaatctccgtggctattgcaattctccctcatcaaagctattgatatatgactatcttccaggtggaaacctagatgaggtgctacatggtgagcatgttcagttttctacttcctatttattttatttgtattgcattcttccaattgttaacagttttagtttgtcttcctcagtaaggagttaagtatgtgttcaaagcccaacattaaattaaggtttgaggtgattcagttaatggatatgaaagaacctagtggtgatggtggagtctgccattccaccaccacctctagggttggtgttatcttctaagggtgcatagatacttttatatgtgtggcttggctatcagtgtggattgatgctctcttgcaaattacatattcttccatgaggagtatacatataatttgaattttagaacataggatagtatagtactatagttacattcaatctacctattggaaagaggtacaagtacaacaatatcttaaggggcatactagctaatgtcagctagacacagaatgcaatagccaagtgggagatgaagactttagtatgtgaaaattgtgccactgtgggggcaacaaagttgttcatttttaagttcttgatcgtcccatttggctattttgtggcatgttcagacctccatgtgaattagcagctacagattccacgatggatattatttctgcctcttgtaacaaaaatggaatgctacttagtagtcgatgggcatgggacttcagctattatgtagtacgagtagagggttgtatataacatactaggacacaaggacagaagatgctgtctactcatggtgattccaattttacattggcagcgagtctgagaattatactttattactttaaatacagacctctgttcattcttcaattacatctggatctaaacaatcgagataagagtgaaaaccttaaccatgatattaccatttatattccatatgcttgtggaatatatgcattgaattttataacaacgtataattaggtcttacattagcagacttcactattttattttttaacatcaagtcctaatatctcatctatcttcaatcttgacagaaaaatctgaacagttggactgggatgcacgtattaacataatacttggagctgcaaaaggcctggcttatttgcatcatgattgttcacctcgaataatacatcgtgatattaaatcgagcaacatcttactagacggcaattttgaggctcgtgtatcagactttggactcgcaaagctattagaggacgacaaatcccatattactacaatagttgcaggaacatttggctatcttgcaccaggtatgttaaaactgttctgtttcattcattgtgggaaaataacagcatataacaaatgcttaccaccttattgcatctctggattttatttatcaatatataatttcatatgctctgagctaatttgcaaaattcaaaatccagagtatatgcaaagtggcagagccaccgaaaagactgacgtctacagttttggagttttgctacttgaaatactaagcggaaaacgacctactgatgcatcatttattgaaaagggattgaacattgttggatgggtatgtatgacctttatgtccttccatttcatatccacagttttctgatatgaattacgtatgccttcaattgatttaatgtattcttgaaataatctacttgctctgtggcagttgaatttcctggtcggtgagaatcgggagagggaaattgtcgatccatattgtgagggagtgcagattgagaccttggatgctctactttctcttgctaaacaatgtgtaagttctttgccagaggagcggcctacaatgcacagggtggtacagatgttggagtcggatgtaattacaccatgccccagtgatttctacgattcagaataggcttcgacttacggctgctcttgaaaacgccacactgccgctggttttcctgtggaggcacattccatttattctttgcagattatgtaaattcattcctgcggtgttcggctccaatcggctagctcaatggggaggacatttttgtgtctatgtatctatgctacgtacaaattattactactacatgtcaagttaataagaaacttaccaggagattactgtacttgtattgaactgtcaatctcggaagaatggaaatggtagggattagggatgccaagtttcctgaatctccatgagctgctgctagatatattaatatatttgagtataaccagctgaatttctcacgcattgtgcgtctcgcgatcgagaaaatatgcacttggaggcttcacatgtgctaatttcttaagacataagaatataagattcatatttacactaatcaaggtgaagaaaattgactaagtagagtagtagtagaacataatatagttcactttcataatgagacaacaggttttaccgttttacatagcggagtagttcgagcggcaacaacacacttgaaaggaaccagagcacaccaaaaacaccagtaattacacctcacataagtgatcgatacacttgaagccacagataaatcgttttagattagcccaatgctctagccggtgatctggatggacttgacgtcgggcttcttgggctcctccttgggcacggtgacggtgagcacgccgttctccatggacgccttgatctgctccggcttggtgttctccggcagccggaacctgcggaggaacttgccgctgctgcgctccacgcggtgccacttgtccgtcttctcctcctgctccttgatgcgctcgccgctgatctggaggacgttgccgtcctcaacctccaccttgacctcctccttcttcagccccggcacgtccgccttgaacacgtgcgcctcgggcgtctccttccagtcgatccgcgcgccggcgaaggccgccgcgtcggagttggcgcgagggaagaggctgccgctgccggagccgaaggggaagccgtcgaaggggtcccagaggtcgagggagaaggggtcgaacacgttgctgcggcggatcatcgacatcgtcggaatagctgcgaatttggaggtggaacgatcggacttctctgagttcttactctgatgtttgcttggtttgctttgcgttttcttcgtggttctgccggtgaaggggagcgcggttttatagagggcagcgagagggcatcgtggagcttggaataagcttctagaaacttccagtttgcccccgcatgggctagaacctagtacgagatagcttgggctagaagtttacaccaccggtagcggggtgggctgtagcccatagcgtccaggactctccagaataatctaggccataagcaggcctagaacaatccagaagaccacttccaatttcggcccaaattaacgaacaaacgagaactatccggaagcaaaacttccagtagaacccatggaccatcacgaactgctatataaattgttgccaccacgcagcgacaggtgccaaggaaatcagctcatcgatcgaaagatcaacaagctctcttgagaattgagatcaccctctttccatctagaacacaaaccagacaaccaaaaaacagcaagacacaatacacaatgtcgctgatccgccgcagcaacgtgttcgaccccttctccctcgacctctgggaccccttcgacggcttccccttcggctccggcagcagaagcagcggcagcatcttcccgtccttcccccgcggcacctcctccgagaccgcggccttcgccggcgcgcgcatcgactggaaggagacgccggaggcgcacgtgttcaaggcggacgtgccggggctgaagaaggaggaggtcaaggtggaggtggaggacggcaacgtcctccagatcagcggcgagcgcagcaaggagcaggaggagaagacggacaagtggcaccgcgtggagcgcagcagcggcaagttcctccgcaggttccggctgccggagaacaccaagccggagcagatcaaggcgtccatggagaacggcgtgctcaccgtcaccgtgcccaaggaggagcccaagaagcccgacgtcaagtccatccaggttaccggctagtaagaaacttcgggtgtgacatgcacggtggagagcttcgattcgagccttcggtttgtgatcaattgcagtaaataaaagcgtcaaatctggtcctcagtgtttatgctgtgaaaaagttcaaagctatgttggaagtgagcaataaagacttttcttgttttgtgaacgaacctgagattatactagtcctacacttgtttgtttaatctaatctccggtatattctgccatttttatctcgatgtttcagtacttttagcctttggttcttgaatccttctgtcgagactggagagttcatttcggaaattgagagctcaatttccacataagtcccacaaatttcacttgtttcagcattttcacagcaatcgattcgattccaacagaagtcccaaaaatttcacttgtttcgaaagatgcctataggttttacgttttcagatcggactgagaaaaggcctataggatttccgttttcagatcagactaaaaaattattccaatgctaggccatgactgaactaaccaaatataacgaaattgctaatattgtgatttgcgattcgtacttcatgtgttttttcttcaactccaataacctcatttatttctacaacactgataacaacctaaactccggcaaataggtttgggtttaggttggggctgagagagaaggggaaggtggcttagagggatgattgtggaaggtgatggcccgacgatgtacagcgggatgagtgggtggcgaggcaacgacggcaccgccaaagccgtagggtcgataacatacggtgggtcagtgttaggggcaaagtagagcgacgggttaggagatggcgtggcaggggcacctcaccaccattggattgaggtgacaacagaggcagcgatgacgagagccattgagcgttgttcaaggacaaaggaacaaaagataaaagataaaaggattagggtttggatatctgcaccaatccgaaagcgatctaatggctcaaaaattataagaatttttaagtggtgttttctgtcaaatgtgtaatagaaagtctcaaatataaatatgaagctctgttatgattaaggagtttctacttctaataaatccataaaatagaacttttatttatgcgacggtggtagctcatgcagaacatgccatgatattcacaactattaaatctctgacgtataaaaagtggatactttgctatggacacaaacatcttagattttcagccaaaaaaacgcatggccgcatgtctaagggcaatcccactccgaaccttcaatcgaacaaataagggcatcatgtcacaacctgttatagatcaactaatatgagggtattgttctttagcacgagattgtttctagcgcactttctttttctcaaaactttgtttaaacttttttcatatgaaatgattttattgaaaaattcatctgaaaagttttacatgaaaactttcatgttacgaaagcacgtaggctaaatagcaaatccgactagggtaaatagatctaattgtcctaatcctgttccgggaccatgtgcagatggttcactctttgcccaagagaaggtggagcccaccatttggtccataaacggagattgagatcctctaccttcaaaggcaacatgccttatgtcactgacaaagacttcatccatcaccgccaccatccctcgcggcctcgccggcgatcaaatcgcctgcacggctggttccggtagccgttctccatcttggatgctcaagcgggcttggggtcctgaagaggcggcgccaattattttcttctcctccccttccgttctctctcgtggtcccacggcgttggcagaggccagggtgcctcaaccctcaagagtcaagaccctatgcgcctcgcgcagattgttggtgaaggggctcgtgtgcccctcttcctaatcccctgttgtattacttcttggtatttctgtgcagagattaatgatcattgcgctttcgttgggttgtggcaatggcattagtcttaacgctggataagtccatggtgatgcaggagaatgaatccgggaagtgtgccatgccatcagccaggtgcgtacattgttcttgccgcttcttcgtttgtccatacctttgtgattgcgttggtttatgttttgctaattcaccggcatagtattgtgacggtcgattcggattctgctattacgtctcttataagaagaaaatgggagagattcagcgtatattagttatgctggataataatcagaactgatccttctaaatcaaccgagctaccagaacaaccaatgttgtagaaccgaactggccactcccagtttccattccaaaaggctcaagaaaaactcaaacattggtacattaatcaagcttaaagtttatttcccgtacataaacgcataggagacaaacacatttgggacccttggaggagaccacacattcataaacacatgatcatatcacacacattttggactgtgtccctcacgacacaagcaaagtaccaaaggaggagatcaattgcagcattgaggagaagcagcagaataaacaaacggggctctagccggagatctggatggacttgacgtcgggcttcttgggctcttccttgggcacggtgacggtgagcacgccattctccatggacgccttgatctgctccggcttggtgttctcggggaggcggaacctgcggaggaacttgccgctgctgcgctccacgcggtgccacttgtccgacttctcctcctgctccctgctgcgctcgccgctgatctgcaggatgttgccgtcgtccacctccaccttgacctcctccttcttcagccccggcacgtccgccttgaacacgtgcacctcgggcgtctccttccagtcgatgcgcgcgccggcgaaggccgccgcgtcggagttggcccgagggaagaggctgccgctgctgctgctgctgccgccggagccgaaggggaagccgtcgacgggatcccagaggtcgagggagaaggggtcgaacgcgttgccgcggcggatcagcgacatggttgacggatttgggcgagaaggaaggctgtgtttgtgaacactaaaacagtgtgtgcttgggaagcttgggatgtgagcacaagggatcgcgatttgcgagttgctttcgatctttgtctgggccgcagagcgggaggggaggccggatttatacgggctgtgggcggcgttgagaggtgggatcctgataattctcgtcagttcaagaatgcactggaaaacacctgatttggagcctggccgcctgggccgaatcatcgagtgccttccagaacttttggccctgtggatccaaacggcatgggactctggttacagatttacaattgccgatttccttctgccatgttaatatagaaattgccatgtatctattgtgaactatagttagatttgttcctatttctatttttaaaaaaatatttaaaacgaagaccttttaaattttggtaatatcaaaatttaacaaggcagcatactaaacatactattaccaatgcaaccatattttagtaattcgggaactttctactctagctactacacaatttagtaatgtgttaaaccaaacatcgtccacatccttaccttattatcttactactaaacttcgattctggtaaaattactaaaatttgataagttttttccaagtgaaaaatgaacaagtcctacatctcctctggcctatagcatagaaacccatcactcccaatttctactttgagtacgcctaagcggtcaaaaaaggagaccgttcacacgttttacaatgtaagcataaacttatatggtcatttcataataatcactaaccttttgtcgataaaaaaacatccccaaatcttagggcctgtttactttaatgccattttcaactataccattttttaataaagttgtcaaaaaaaagtatctacgtttagtttgttgccaaatttagtcaatacataagaaatcatgccaaaattttagcaatattgccatcttgccaaaattttggcattgctaaaatttggtaaggtttattttagctacaatctaaataggcccttatagttttgggtcactagatgtgctttgcgattcgtgctgtagacccttatcttgtagctctggtgatctccctttcttctctggcaccggtgacactgcaaactctagtggagtagcaacggattagggccccgggggttgggtggcagtggaaggaggagggggaaaaggggatatccatgcgtttagatggatggaagtaggaggcggtggacacgagcaggcgacgaggcaacaatgacgacgctggagctgtggggatgaaagagagtggtatactggagcaaatttatggttaggaggcagtgaggagccactaaagacgaggaaaagggcagagcggggcacctcacggccggcagccaacgacttgagtaggagaagaggttggtaacggggaggctggctagggagggaggggggattgggctcgccagtgttattaacgccttccggccagccggcgaggccgggctgcagggcggtggcgacggaaagcatcgagcgagcgggtgattcaatcatgtctggtgacactagagtgagaagggaggagaggaggggcggggtaaggtttagggatgtatgcaccaatctatacctatacttattataaaaattgaagatgtttccgcggttcgtcatctgtgtttgtgtcggttataaaaattgaagatggcatcatccgtgtttgagtcggttttaattttatgttttggtttatactattataaaaattgaagatgtttccacggtccgtcatccgtgtttgagtcggttataaaaattgaagatgtttccgcggtccgtcatccgtgtttgagtcggttttaattttatgttttggttttaatctgtatatcttctctactattataaaaattgaagatgttttcgccggtatttttgtacgtcatccgtgtatgagtcagtttttaagttcgtttgctttcagtaatacagaaggaatcatataagaaatctgtttaaaaaaactcgcatgctaacttgagacgattagactgctaactgcagctcatgattttctaaaaatatatatatccaagggaattcccacagtaaatttcatcttaactaaaccatataacaataataagattaaaatagacttcacccgttgcaacgcacgagcatttttttttctagtcttaaagaaattcaactgttcaaaattcgacagttccctttatatattgtaacgtcttacatatgcgatttttatggttcagagtttctgacatgagtttcttatgtatgtctcacatgaattgtctgttctgatcgatacatgtaagttttcatcctaagggcacccgtaatggttatctataggctctctacaagatatctatgtcagcatattttcctacttgaaagagattaaatgaagagatagagcaaagctatctactaacctggagatagtctatagagaaaaacgaggcaatgaattagagagctatagatacccatgtagacatactattggggtagtttactattaatctagtctattgctgagatgtacatgttttatagagagcaccttactttactattgcgggtgctctaacagttccattttcaatttccaatattatctttgttttggcctctaccgtttccgtgaaaaataaatggctacagaaatgctttaggctgtttgtcgactgttttcaggactagtgagaaggagcctcgacctatcaacagtagggatgaaatccttcacaatgggtttaattaattcgccatcagaaaagaaaatttctacaaatatattataatttagttacaatacttttttttttagaaacacccccgtatatgaaacttgcagtcaagccaagaacttctcgaccttctccacttcctccacgctcccgatgtacagcggcactctctgatggatctgcacggcacattcacaaacgaatcaattatatagacacatttcgatttctaagtctactcgtagattaatccattaataacactgcgcatataatgtgtgcgcatattttacctccgtaggcatgatgtcaagtatcctctggtggccatcggagcccttgccgccggcctgctcgacgatgaagctcatcggcgcgcactcgtacagcagccgcagcttgccgttcttgctcttctggtccctggggtagccgtagatgccgccgtagagcagcgtgcggtggaagtcgccgacgaggctgccgatgtagcgcgcggagtatggcttcccggacggcccgggctccttgaggctgtccatgtagctcttgagcttgtcgtcccagagcgcgtagttgccctcgttgaaggcatagatcttgcctgccttggggatctgcaccttctcctgcgtcagcacgaactcgccgtacatcgggtccagcgtgaacacgtacacccctgtcccgatggtgagcacgaagatgaccgagctcgagtacatgcagtagccggcggcgagcaggttgctccccggctggcacacgctcacgatgcacctctgctccacctggtcaagctgcaggcacacgcgcgcggacagaggcgtttcgttctgttagcaccgtgtcagtgtgtgcatgagcgattgctaggcgatcgataacgcgttacattttggtcgtcggcgatgtcggctaggcactcgtcgttggggctgtagatgccgaagatggagccggtggagacggcggcgtcgatgttggaggagccgtcgagcgggtcgaacaccacgatgtagttgcccgagtagctctcctccacggccaccggcacgtcctcctcctccgacgcgatcacgccggtgcgcccgctcgatttgaggcagttggagaacacctgcggtgcgcatagcgctcagcttatggtcggtcgcgcttgttgcggtggttcgcgcactaaccacgacgagctactgataatttagtcgtttacctcgttggagacgcgtcgagttttttatggtcctcgccctgcacgttgnnnnnnnnnnnnnnnnnnnnnnnnnnnnnnngacggcgccctggacgccggtgaggttggagatgggcgcgcgctgcaccagcgaggcgatctgcttgcacgccgtggagatgctggccagcacgatggtcatctcgccgtcgatggtcccggcctgctcctgcttcagcagccacgtcgtcagcgtggtgatctcgtagctgctcttcttgctagcctccgtcgcggcgggcgccgaggccgtgtcgacggccgccatgcaccgcacgctcggggccgacgacccaccggcgagcctgccgggctgcctccggaaggagaggccgcattggagcgaggccgccgcctgctggcgggagagcaggagcaggtgggaggatgtcgtggctgcggcggccatcgctgctgctgcttggttgcttgctctgctcgcgctctcctctcgctgcggctacctggtcttggtgccgatggcttcttgttttgttccattggttttagccgcggtttgtgtggccggagagagggcgggaggtgagtgtgtggattgggggagaattgtgaggatggcgttgcctcagatactagcctaattgcaactccttgtccttcagccagcgtcacgtacagtcacatacaagtagcatcgccttgctcaggggcagtatatacttgtgcttttgattaggcagatctattattcgtacctatgaatatagatggtcatatgacccagcccaaggccaggtgatttgacccggcccaggcatggcaggtcgggccatgccggcccagcctaacagccatgtcgtgcttgggctgccacctcggcacgttgggtcggcatggcccggcacaaagttcagtgtcgattggaacgatgagcccagatccacatagttccggaggacaaaggagcaaaacggtggtcagctgtcgatgatgaggctgctggctcatatgggtttgccagtagaggctcaagcatcagtgacgtgcgtggcccaatgagagagatggtgtcagaccactcccctaccgggatcacggacggcaaggtaggcagcgactgtgaaggactgaagcaggcgaggatggggaagatgtctgaaggggaagatgaggaggggcggctttctctgccgtcatcatcgcgccattgcctactattgtccccactcgagctcgtgtggcggtgtggaaaaggagaggggggtgagaaagagaggggttgctcgcaacattggtagcgatggcgatgggaggggaggctcatgtcgtagtgttagagggtcctgccaacaggatgaggccacagagtcgtcacctccatccctagtgagttccacaacctcctcgagctgttgttacctatcggcctactgatacatactcactgacatgtgacccccacatccggttggaccaacttgccacgttggtgaaaaccatttttaaaatgggacaattgcatatatgcccccaatttcaaacccaattgttgttttaccctcactttttagggtttgcggttttagccccactttttgaatctgaaccggccgtctacccctacttgtaacaatcgtttggtgggtcccacgttttgtgttaaaggaatacaaaaggaaataaaaaaaggttttaggaaatatgaatttacgtttgtacccctgagagaatgggtagggactaaatcctctcaacctgtgcgtgcgtgaatcagggactcgagggcgggcggctgcgagggcgtacgcgcggcggcggcaaccgtggagagggcgggcgtgcggtagccaggcggccgtggggctttgacacggggattcgcagttctagttgccacacgagttcatgctctccccgatcgccgccctctcccttgccgcgaggtatgccgccatcgagaggtctgtacgaccgcttccccctaccgcaccctcctcgcactactacgcagccggcgacgaccccatcctgctcgacgtcgatggcaatggcaacgccgccttcatggcggtcctcggccccacccacccaagcatactctccccggtgccctccgcgctgccccccatggcatcgtcaccgtcgaggctcttctccccgctcgaccaggcctccgtctcctagctcagcgacctcagcccttcgtccactccgccggcgcaacccctcccccccaacccatgccgccgttcgcgccgagcacgcatagcctgctgctgtccacgcccaccgtcgccgatgaccttctccatcaaggaattcttcagtagcaacttcccggacctgtcgaaatgctgtctaaattttgttcaaagtttggtcagattatgtacttggctagtatttgtgatttttttattaaagtacaaaaacatcacaagagatgctcatatttgaattatttataacaatcacacaataggggcaaaatcacacaagctgaaaaaaataggagcaaaaatgcaataatcactaagggtataaatgtccttttgctgtacaactaacaccgttaaaccggatgttagaagtggaggtagtcggatggttcaaattcaaaaagtgggggtaaaactacaaaccctaaaaagtgaggataaaacaacaattaggtttgatagtgggggcatagatgcaattgtctcatttaaaatagtcaagataattaagttacatcaattttaatagttggggggttagaacatcctctttcacgaatgaggaatagaatcagaaggactttaaaggaaaggagtgccatccaacagaaggccctataactacttacgttcagcaaatcctgatatgtagcctgagccgagctgctctttcttgggcttcttacttgttatactctgtgggccgtggcccaatttgacaactccttaccgttttacttttgcttttctatttctctaggggtataaaacagctgtaccaaatcaatagaaaaccaatgctgcatttcttgtgtactagaaacaaaatgtccatgcgttgcaacatttttttctttctgtggtacgacggctaataggagctaagcaatatattgaaacattggaatcactatacattgccccattcctttattttcagccccagcccaatccacgcctcatatctccctccgctcggcctgcctctctccagcgcaccctacaaatggagttgcaagagcccagctagcacaatcggttgcctcctccaaacactacagtagcgtcttcaaacctctagatgacagtcatgtgcccgtatcatgccggagctaatcatccccatcaagtccggtggaatctttctcgatctctcaaaattggttgagggttttaatccactcgatctcgatcctctttccatttctcccaaaatcagagcgtcgcatccaaatcgtcgtagcccaattttgtaaaacttgggataaaaacacgcgcacggtagcgctacggacattgacgagcccaaaaaactacaaaagccttacgtatttttaattaagatatataaaaaaaggaatcttggtctcgattagactcttgatcgtgtcgcaggtgcagcgatgatgaaacgaagcggagggacgaacggaagccgaatctcaaagggatttaagggaatcattgatggatgaaaatttcaacagaagctttacgcattttttaaataggtatatatagatatatgaactacttgtacaatacttttgtatcatctaacattttatgcaagatggacatgacgcagacatcagaacatattcttaaaagaacatatcagaatactaacaaattaagcaataatcacctcctccagcttaatccttttttttgctctttccacgacaccaaccttttgaacaagaaatacaatatttttgtagaccaaataatataattctcttgcagagtccaatcctcgtattgtttaagctttgagtttagcaaactctactcttaatttgtaccattgcgtggcaggattccaatcaaatactagtagaaaacaactcctatgcttacaaaaaacaggacattccaaggcaacctacctattcaggcgcgcacgtcgatgtgctatgctttacattgacatgtccagcaatcttgtcctatcctgttccaagacggtggcaatttttgtcagctaccgattgggcaggggagcacagctacctcctgcctcatcggagacagaaacagagtcgtaacccatcaaaagcaaagacaaaatacacttgtcgagaactcttggtttgtttggtttctcttcacgggcaacggaatcttcaaggtgtcattggcagaatggcaggcatgctaatttgttcagaaggtctctaattcatttgacgagttagcgtgtatactagcaatcaccctcttgattatctcatgctgtgctcgtcgtcttaggaaatgccatgtctggtagggtcaaagccaaaccgagtcaggtcagtatgaaaccaaatgcatttcggttagtggcgggagaaaaatatcgatgtcacaattagtcaacgagcaagcctactctgttctatctagcacatggaagaaatgggacctaacagtagacttctgattgttcttctagctctttgtgttttataatacatatctgaacgctcaaactaacctgtagctatagtcgtcggttcaaaccagtgtttgattcgaccacactctatgaacccaactacttccaccactccatctcttgatcctgaaagtgttaacatttcataattaggagatcatgctgggagattctgccaaaccacatttgcataccaacggcctagattttctatagcttaccagctgccactccaagcttgacttctgaacccgaataggttcacaacaaaggctgtatttagatctaaagtttggatccaaacttcagtctttttccatcacatcaacctgtcatatacacacaacttttcagttacatcatctttaattttaactaaaatctaaactttacgctgaactaaacacagccaaagccagattcgccgcgcttgccctctccggcaggcggcagcttgaccctacgcaccaaattaaactgaacagataggataggataggatgacctcattggagcgccagcatgaataacacagtaacctttttttctcgacacgaaaggagccaatgacctatatgagcgcttgcttttgctgaaactgtactttcacacggcagattaacctaacgtagatatatcctactgaaaagcatctcacgaccgacctgtactgctgctgtcctttctctatagacgatcactccgcagcaataattctggtccagtcggagacatcgaccccccacacacaatagctagatcgctagctagcccaaggacacccaagaacagcgagatggggcagatggcgatatcgccacgttctcgtttcattcgtttcagcggccgtcactttcactgcaaatttttcgccgcagatcgtgcagctaattataaaagctgataacaatcgatctgaagccgcctctcttcgtcccgttcacagaaattcatcttacctaattaccagaggagacactagctccttttgactttgcgtgtcgctgcacctgatcactctctctcacacacgcacatccattagctgggcatggctgctacttgcagctgagtgcccagctcacgtagcacgtcgcatacagtaatacacttacaggtcatgggctcatggcagtgacaaaaacaaggccgtcttcccaggctcgcacactggcaccggcagcctcgcacactggctagctaggtgacggagacggcatcgctttacaactcaaaagggcctccgcacctcggcacgcctcgttttctattgctcggccgcctttgcgcaccaaccggccgggtcggacaaaacacgagggcgtctcgcggatgattgggaggcggtctcgcagatgattgggagggacggggttggttgcgcgcactcgcgcgcggggcagtggccggttgtggaggaaacggtgctcctctcctatcccgacgtccccgcggcagctgatgttgaacgggctccaatccgatcgatgcgatgcatgcatggcttgactgcatgcgacgttaggtaccaaggctggctcagatcaggaccgggacgtactgtctcctcgcagctgtaatgaaaacttgcaaagcaacctggtactactaaatttgtcccaagatacaaaaatttttagagataatacagttattaagaaaataagtaaaattaaacggaagaggttatgattggatgagaagtgacggtagattaagaaattaaatggtgaacagttataattggttggaaagagaacgttgatagataagctattatattttgagacaaattctgaatactaaaaattattatattttggtacggataaagtaatagtagtacagtaggttattaagctgctagtaacatgatggattggaatcgccgtcgccgaccgtgcatgatctaacatcgatgccttctttgttttcaaaaagagaaaaaaagggtagaagaggattcggtggttctgttaatttgcagcccctgtcgttttcaggttctgtggaagcatagaagttatttcctagatattgactttgttattcttttttctttgacctcttacagctttcaatactttggatccattccaccacagctagcctaactccaattccttcgttgtataaacctattgcgctcttgacttttttagcatgagaattaaacaaactggaagtcttagcttagctgctgaacagcagtgcatcaccacaatttttttccgttattgtggtcattgatagtagcatctttgatctaagggatgaattgtcggtaacgtacaaaggaggcccattttccatgcagatgtgaccaccggaaccaccatcgtcagtgggcacggcaagccaagcggtaataagattcgcaagaacgtggggggtttgcctcccgtacgtgaagacggtgcgagcgtcagcatctgacaagtccagtggtgtcgggccttggcgcgaaattagcaagcaatgcttcgatcagaaattcagttatactataaacatgaaagaatcaccctgctcaccgggttttattttgttttgaaagggaaatctgctcaccggatttcgatcgcagtgtcaggttgttggggataccacgtcgagcaaacaataatattcccgtctctgtggcaactgcttccaccagcaagcccaggctcaccaatcgtgaaagcggccggccggcggcgatcagtctcctgtaaaacaccggaggagcaacatatatggctcggcactcacccactcacccagctcagctgtgtaacctctaaaaatactagcaatacttttaatttggaccatatcttatctgccttcactgacacctcttatccagtacttatgcgtatctagatcgtgctaatcattgacgctccgtaataatgtctgtgatccggccatttgattggagagtatgcaaaatatgcatagtattacagacggatggatcggatcgaatcagtgtactgtaaatgatgagtaaccctggcctgattgatccgtggatctcccatgtcgagcggcagccgggcaatcacaatgatgagacccgatctcacagagtggtacgtggtgtccatggcctttcgatctccagcagcagcggcagcggcagaaacctggttggcacgtcggaggaaacggacaggatctccacccccacgaacgcgaatacaataatcccgcgcgacgcgacgcccgcacgcacggggcgggggcggagcggacgacgctagcgtccagccacagcgcagcgcagcgtggacggaaccccgacccgccgatcaagccgtccacccgcgccggcgccgcgaatggcgcggcccaaccaccgggagcgtgaggataaaccaagccgagacaccgggaatctggcgcgcggcgtgcacagcgaagcggcccgatatcaagcgacgatcatggcggcaacctaacacgggggcccgggtgcacggtgcgtgcgcgcgaacgtcaacagcctacgactacaactagtactgttcgcgatcccctcctcctaatcgtttgaagccagtgccgcgcacgtaggcgccctaccggttatggaaagggactcgcgggccgttcggaacggattagctagtcgtaactcgtacgtactcaggcgtcatgcctatggttcgtgacttgtacgtactgtgttacatctcactccacggatgcgcgatcaggatcgagagagaaaaaaaaaaggcaatcgatcaattgcttcccaacaactccaggttcccattatcaatctgaacgtgtcgatgcttccatcgaattgactactcgtgcagcaacactccgtacgtagtatcatcttcaacagcgaagaatcggttaaatgcaagtttaactgataaagtgagtgtgtgggaacactgcagaacggcacaaaggctgaaagttgaaaccaggaaagggcaacgcatgatcgtgcgtatatgtgtatattactgtttggacgatgagcacaaggatatctcttgagaaaagaaatgttaaacaagatcgcagagtgcgtgcggccacgaccaaattttgggggggcaaaaataatgtaagagcaaatcttggaccccacctgccagctgcccgcacgactcatcaaaaccggtacaaacccaccgagacagggtaggcgtcataacgcaacacaaaaggaaccgcgcggcggcaccaaagcgagcagaagcagcagccgaaggcgatcggagctcgcgcaacaggagagctgtctccatgaggaagctgtgcccgaacctggagcgcgatgacgcgctggacacggtgctcgaggtgcccatcccggaggagatgttctcacgcggcagcggcggtggcggctcccgcggctccaggttcggctgcaccaacgtcaagtcgtgggtgcggccgaacgcgtccgaccgctccggcggcgccggagagccgtgctccatgagccgcggcgagctgcagctcatgctcggcgtcatcggcgcgccgctgataccgctccccgtcgaccacgccaagcagtcgccctgctccgtcctctgcgaacagctcaaggccgatcccattgtacgatcgccatcatcggattcttctccgtttcgtttgtccatcgccgcgcgctgattggctcatccatttatggcgtgtcccctttcaggagtcgtccacggccaagtacataatacagcagtacatcgcggcgtcgggcggggagtgggcgctgaacaaggtcacgaacatgtacgcgatggggaaggtgaggatgaccgccgcggagctcaacagcagcgacgccgacggcggcggcggcggcggcggagggcaccgcggcgggaagaagagcagcaagaacggcggcgaggttggcgggttcgtgctgtggcagaagaagccggagctgtggtccctggagctcgtggtgtccggctgcaagatcagcgccggcagcgacggcaaggtcgcctggcgccagacgccgtggcatcagtcgcacgcctcccgcggtccgccgcgccctctccgccgatcgctccaggtataatataaaccgcgagttcttcgttagttccatataaacgcttaccgtattcgcacgacttgactgcaatactgcatggtcgcgtagcatcatagaaaacacgctcaactctcagttaaagtttccaacgactaggagaactgcgtactgaattggatcctgtttatgagacggacgactacgagaaccaaatttggtggcacatattttcttttctggttcgacgtcaaacgagtagtcctttgtgtttgggtcgatccaacgttgctgttggccgaacttacgtagcgagtccattgttgtcatcgttcctagtggtaggtactaataggcatcggtatcatgacatggaacgcatacgtccaaagtcgcaaagttctcatcttaatgggaacttactttctgtagttctttgtcccaagaagctctgtttttccccttcgtcctgctcaaaccggcctgatttgggtactaggtggccatcagtacgcgccgtaccgagcgtgcgtagtacgagtagagagtagagcatgcatggcaacttggccagtgtcacgtacctggatcttccctgcatactgtcggtaggacaggacagatcggtcgagtacccgcacggccgagcgacatgattacgcctttgccgcactcattgggccgttggcattagctgtggtcaaggtcagtccagggcggtgtcgggatagggctggccgatcgctcgctcgtctcatcatgaggcttgtacacttgtgccgttgcgcgagagatctggtccagggcacccggtacacacagatatgggggacgtactcatcatccatcgtcagtagcggtggctgcacgctgtcgctgtggagtgggggcgaatcatggcaaggggagggcgattagcgggaacaaagcgcggagcagcgggattaggggggacgggttttcaacaccgtcaccgcaacgtgccgccatgtgctgcagcaacgcggcgggacacatcacgtggacatgggcctaaaccgggacgcgacccacgccatcaatcggttggtggctcgcggtttgtcacccggccggttccacccgactcttgaactctccccgctaatcgcgctgcaccaaccagcccgatttaatttgaccgcggtgtcaactatcataccatgttcttttttcataacagctataaatagtactagtatatagtgtccacgtggattaaattaagtgactggagaaattaactaacttgtgcatgcatggtgtgtttggtacgcagggacttgacccgatgctgacggcgagcctgttcgcggacgcggtgtgcatcggcgagaggagcgtggacggcgaggactgcttcgtgctcaaggtggaggcggaggcgtcgagcctgcgggcgcgcaacagcagcagcgtggagatcatccggcacacggtgtgggggtacttcagccagcggacgggcctgctggtgcagctggaggactcgcacctgctgcagatcaagtcgagcggacacggcagcgtcttctgggagaccaccatggagtcgcacctccacgactaccgcgccgtcgacggcgtcaacatcgcgcacgccggccgcaccgccgtctcgctcgtccgcttcggggacagcagcgacggcaacacgcggacgcgaatggaggaggtgtggaacatcgaggaggtcgacttcaacatctggggactctccatggactgcttcctgccgcccagcgacctcaaggatagcaaggaggacaaggacgtctccgccgccgtcaagcccgcgcggccgccgccgataaggataccggcggtggccgtccgcgtcgggccatcgcaggtcgccgccgtcaacatggacgattccgactcgctcattgcgaggtcatgacatacatagcgggcagtgttacaccgtatgagtcgtgtgtgtttacgtgccttatcgccataagttacttatggtaagatctgtaaatatattgcaggttgagatatttttgttttcggggagtggattttacctcagatagatgctcaggggtgagtagtaaagcgagtaatccgggatagatgttctaattagcggtattgtaatttgcttatgacgccccttcactgtaaagttgaaagaatctccagttctgctagtcacacactgggcttcagcatgttttccacttctcctgaacatacttgtgctacaggtggctgcaatccaaaacgcacataacttgctgcaagtgttttcaagagtaaaaacttaagcctcagtcctcagattaacacaatgcagttccaggctttcagcccccagaacatgtacagagagtggcacaaacgtatcacaacatcggtgccatttctgcaaggggttgagtgacagaagctttgcgaggatctgctttgcttgcatataaaaagggtagctaagcactgagatgagccttgcagcaacacacctagtcattttacatgtacagttagctaccccgctaaagccgattccataagattcatcacatttcgatgtgagtcgcatatggatcatggcataagattccacgacgcaactcgagttacagaagaaaacgaaaagaaacaaagaaaaacatacatttttatcacaggaagctaggctcgccctacaggagatagcggcggccggtgtggcacatagcttgcctgagctctaccttgactagctgccatgatcttgttgagcttatggtcagcgagggatgcgtgctcttgcgatgcgtgcacacctgcttgcgtcctggtagggcgcctgccgtgaagcatcactatacacatagcaaaagcctgaagtaaagcaatggatgatctgaattcaactgtgtataacccttctctgaatgaaaccatactgaaagcatgcttgtcttctcgtgatcgaccctacaaatacagatttatataagcatcaactgattaggtcgtcatagattagatacataaggacataggcaagaacagagaagcacaaggacgcacctgaacaaacaagtcaaaccgttgacttccatccgtcgtctggtttgcttgagtggatttatcacctttgttttctcgggcgtcatcgctgaggacactgagcatgcagccttcatcccacccaccacagtcacacgctcctcctgatttccacctctcaatcagaggtagtggctgtcctgaggttgatgtaccatggaagccattaggaagtacggcaagaacactggatgatgcacaactatcatccctcgtattaggatggaaatttcccaatgggcaagaacagtcggttggtgttgacatgcttcggctggaatgctgtgaggatgagtgacgagaagtttctggttcttgctgagacaccgcactaataaaagccgcaaactctctgctaacatgtgaatcacctgattcttcagaagatggtagctgctctgagccaacagaacaaattctctatgcaaatggtttttttctgcctggtagcatcttgattttcgatgtgaaaccctcattttcgccaacaatattataaacaagctgatctttcttgttccttattacctgccttgatccaagccccacctcttttcttagggtcttcaacaccaaacagagtgtatgtgctctccagatcattgttatcggagatgcccttccttctcacggtagccaccaggatatcagaaccacaagaaagcatgaaaaaaggcaggccattcttccacgctagctgcagaagcgcatgccttgttgttgttgaatctatatcttgctggaggtacctttcactgttcaggacctgaggaggctggtttgtattagtttctgttcggcaatttgaatttaccactgaatcaactgacctacgttgaacattctgcaaagcagatcctcccaagctcagagattgcttatcaatatggccaggcagatgacactttggaacaaatgaaggttgaattggaccagaagtggatgactgacgtggctttaatattggatctaacatcctcctcaatgggctgcgtctactgcctttgttgcctgatgacttatctccatttatcttatccacagaggtgcttgcttcaggttgtcgaggacatggtccatccttcaggcttgaacagcggttcactcgattcagtccagaaacaagatgtctatgtggtgacgcatccatatcactgaactttgcactgatccgaggagttctctcagaggcacccctggaaatttgcttttggttgcgattttcacctatagttacagcagcaccaacagaatcaccttgagtcccagttctgctggtgccaagctcttcagatgaatccatgataggaagtggacatgagtatggaattcgaggaaattcatggtgttgcccaatatcttttgagaaaccaacaggtgacaaactggcatttctttccatttccatcaccgcactagacactagagtctcaaaaacctcaccagtcacgccactgctctgctgaaaatcaccacatgcagaatcattgttatgtgaggtgaagaaactttggccaatgttatcatcatctgtaaaaagcctgcgcgaacaatgatggacggcctcctctatattccttgtagtctcctcatcatcaaccatttcatgtcgcatggaactcccagtggcagtaagaagagggtccgagagtggagatatgtttctgagattcaagtcaccgtatttgccagtgttctctggaaagtgttttccatgaacaggcaacaagttcaacactgcagaatttgggctaggtgaatatctggccttcccatggtatttatcctcaagatcactttgctgaaactccatagaacaatgctgatggtcattgagtgtaggagattgattgctttcaagagatttgctgctgggacttgcagatgactgggatggagaagagaatatcagggacctactagtattagatggagaggcaccatggctgctagaaaactcatgcttttgttggtgagaccacctggctaggaggccccactcgagaactccaacattcaatgccttgtcctgaagatggcctgatgtctctttacgctgcaaatatgaaggaacatttgacatatgcttgacaagctcatcaaccgtagtggcctttcgaccaggccatggttttgagcctttcaaggatccacccgcatctgcactccgaggttcccgttgccttcgaaacttctcatttttcacaactctgattctatcttcaaattttccatcaatgttcccaccgactactgcaatcttctcttttggcacttgtacagattgatcttgtgaatttcccctttgacgtccatcacgacctaatgtggcctttacattcctttctctgctaaactgtcctttcgttggcatctttttttatggtttaacatacgccaacaagcagagcttttcacttgattcaaattgaatcgtcaagtttcaacaggatactacacttccttgaacctgcaacttcaatattagcagaaaaaaactcagatatgtagcttctgatatttccaccagagcactaatgaacagaaagaaaatagcaggcagcaccacagaaccaacataactacagtattgcagtatctcaattcagaactaagtatttgtcggtggacaatggcatcattttgtctcccgggaatcctggatttatgaaacattatgtttctacatgtacttagtggggttgggagttggccaccgacagttttgacacaataatgttctaattaggatatgtcaataaccatgcaaacaagactgaaaaaaaaagggctcccactaatgataaaaggtgcaaataattatagatatttgccctgatgctataccgtgtgtggcttgtatataaaaatagtttgcacattgttaagggcccagccatccataaatagttcagtcagtcctgataaatgtatatcaactatggctatggggcatctttccccgtttccctcaagaaaaagggcacctttctccacttgattttgttgggtggcttacaaaatgaaaatttagccgtgcaagcctagctactcacaaaaaaattaaaggtctaactacaagcaagaggggaaaaaactaaagttagttgcccggcaaaaataaaataaaatctggagttgcatagacaacaaatattttaccatatggattaggttgaaaccattttttccctttgcaaattagcctacaaaatgcatcatcatcaacgatggtcgttatagcggcagaacgggggaagttggagaaaacttgctgaactgaataagatggaacaccagctgcggcattaaacccaacagaaacccaccactcttcagcatctctctccaatcgagccaaccaaccacattacccaaacattgaaacagaagaagaaaagaaaaaagcacacatacgacgaagtcacgaagataacataccaagatgctcccaagaaccacttcaagaacagtccccccagctcatcgagatcccatatggaggtcacgcacccgcagatccgccacctcccctacaaccagaacacagatcagtgaacctcgaccaagcagagaaagaatgccaccccaagaaagatgcgccaccttgggggataaagcgagagcgagatggaacgagagcgcgcagcagagtgggagcgaaagaaagcttcggaggtggactggactggatagagacctggagcacggcgacgcgcactcggtgggtggtagtagtagtagtagtaggattgggagtgaggcgcggtggtagctaggagcctcctacttcttctactactcctgtcccctctccgagaccccccaactggttaggtgggtggattggctttagg

SEQ ID NO: 45604 - DNA, 4268 bp, Oryza sativa
gcggggggtggtgtgggtgcttgggtgggtgacgtcagcaggcacggcgcccggcgcaggaggacggcgacttcggtgagtaccacctatactactggctacgagcactagtagcagcagctctcgccctcgcggcgtcccatcgagccatcaaattattgcaatcgcttccctgttcctccccatctcgtccttgtgatccgtgcggtacgtggtgtcgcagcttttgtttaccggacgcggctgggctgaaggcctgaagtaggagtaggagtgtttttttttcccctgagaaaacccagtggggagttgacgggcggagggacggacggggggtggagccgtggaggtgatgtgaaatgtgatcgctgatgcgatgcttcggagacctggtggtggctggtgaatggtggtgatacgtgtaccatgcaggtgtaccgcgcggttggccgggaacgtgtttcggactttcaggtttgagccgttctcttttggaccacaggggttacgaacttcgggtgtttcagtggagagctaaagcctaaaaggcctgtctatctaatttttgagctaagtttgatcaccggtgttacctaaaagaggtactctattcgaccacttgtgtctagcggttagctcattatcatggttagtgcgctatctcatcttttctattctactggcccaacaatcatgcactcatctattactcctacctcatctagatgtagagatagagaaccaaacagaaaaaaaaatggttgacataacttcatagcttcaatgtaagagagtacccaccctccgttccaggcatagctgctcatgttgtttaaactaccatggtggcgcgtgcagattacgtggctaacataattatattttctctcgtataatagcatatatattctctcaattaattattaaaatatattagaaataacgatataattttaaattttatactaacattaccaacctaccgatgtgtaataatcatattacattgtatatacgtaatagttattaattatttttaatatctaattttagttatttctaaattatatttctatatgtactctaaactcgtcttccaatatccttattttttaaaatccggatatttgttatatgtaaattgtatttctatatagactctaggctattctttcaatattatttatttttaattttgattttttattatttataactgtatttatatgtggactctaaactcatctatcaatattctttatttttttatttcgaatttcagttacttctaaattgtattcctatatggactcgtcgtcccttttttaaattttgaattttagttatttgtaaattatatttctatacggactctaaactctacttttaatttattatttttatttcgaattttagttaattctaaattcctactcctatatggactttatactcttctaatattccttttttaattccgagtatttcttaattgtatttttgtatggactctatactcttctttcgatatgtttttttaattccgaatattagttacttctaaaatgtatttctatatggactctaacctaattttaattttctatttttaattctgaatttccattaattctaaattgtatatcggcatgggctctagtcacatcttccaatatttattactatgttttaattccgaatttcgactaattctaaattgtatttctatatggactctgtttttctttttcttcgattaatatgagaatttctagggcgtgagagtgaatatggaggcgcatttttctattactttattaagttaataggttttatccctaaatgtggaaactagtagcaaggatgctaactactccctccgtcctagaataaataaagttcattttcatccatcccgtaaaaaccaatgtagaacaaaaaaaaaagactataataccttcactttatgaaatccctatgcaattattttttatctactcccaatgtacctatacatactttcacaaactctgatgcaatgattgctaaaaaagaatttatttgagataaataggatgtgctaaaaatgaacccattataagatgaagagaatattttaactgtgaattttgaaaagcgaacaacttctttccaagtctaactgtgttagcaaaataattaatcccttcattctaaaatacaaggaattctagggttcagatttcgtattaatatgagcatgtatacaccagttttcatgatttccatcactcaataattctatagccaattagatgcttgataagtaaattcaaaattcaaaaaaatgacaactagagtgacttaaaaaagaaatctgttgaacttaccttagtacttactaaacaacctaaaaatcattatactccctcctttaacaaaagttacacatgttatttttgtcaccaagaccaaggataaattaacttatcttgcatgtaacaaagaacaagaaatgtatgcacgcatacaaccaatgagtatgaagatggcttctcgggttctgatcaaacatttaatttatctctccacttaagtctgcaatgcatagagattacaaacagaacaacttatttggaaactcaaatataaaatagatctaactcttgtggaaggagtgagtactatatgacatcactacgagagaagtttattaatgaacattgcatacgcctttagttcttttatatttatttttgcctctaccaatgagttaactgttttgtaaaactagataaacctcgtgcgttgctatgggagttctgtataataatagtgtaaataacatttaatatagctagacaatatcactttatatactttataaaattttcatttgtgatcggccatgaaaaaagttataaataattatgatgatgacgtggttataacagtttaaatcatatatataggatgatcaatcaaaagcaaaactacgatgatacatcttaataacataagagaaatgaaaagataatatagattaattatccaaagacaaatttaagtaatatatgattccgtaggtgaaggaaaagagggaaataatttagaccatagattaatcatctaatagctaaaaacaattaaggtggtatggcttaattagataatagagagataactttaactgtatttattgataatgaattttaggattcgtatatatgaaaatactatggaattctttcgttccaaatggacgactttaacttttatcggtgatacgtgactaaacgtgatgaaaaaacacaacacgtacaccggaaaacaaaacgtagtagattaacttgtgtcatcctgcttgcttagcatcgatcctttgcttcccttttctctttagattgagttgctttcctttgtttcttcttttactccaacataaaacagacgttagatatcgttcgatcctttacagagccggccgctttgtttggcacatgtggcaagcttctttattccggaaatggtcgtgaaataggtttttgggtgccattctttaatcatcaacacgtacttcgtatctttgtccgcctcttttctggctcacatgtgcaagcgagaacacaaacaatatggcttatacagttcaagcttttccgagacgaaataccactacacagtacacgtcttggacggcatacaatgcgtgtgctagacaccgatccaacaacatccagagctactgcaccacaaagtccacgacgaatcctctttcggcaccgatctcccatatgctgtgctccaaagttgcccagaacaagttctctcctgaagcagtggctttgggaagtactatacgcgccatgcagatctttttgttaccatgcgaaatctgcgagacatttgcaagatccacaacgccgctggggcccccggggttctacgcccttgtgtcgtgtgttctaactaatgcagcatactaagctgcttgcctgcagttttgctgttaaatttgacccgctcttttcttattcacttacctatgttatttcatatttttgttagcacatttttaaactgctaaatgatttatttcgtatgtaaaatttttatatcggagttattttaaaatatcagctagatatttttttaagtttataataattaaaactcaaataattatgtgctaataatttttatgctttccgtgtcctaactttatttggatcttcagtaaaacaaacatcatctttgatcgcatttttatgaacactctactactagca

SEQ ID NO: 45605 - DNA, 21370 bp, Oryza sativa
  unsure (1)..(21370): unsure at all n locations
acctgtcaggccgccaatttgcgcgtacgtccggacgccagtggccccgccgctactacgagtcgtgtgaactgtgaggctgtgactgttccggtgggcccagcttgacccatgtgctactgttacgatgcacccgtttcttggcccacgttactaatacagatattgcaattggcccacgtaatacagtcacttgggctcggtccagtctagtactcgtaggaggccctggctgcagcgctaggcctaggcgacgccggctagaacggtccgctgctttgcccatctccgtgtgccgcgagaaggcggcggcctacggaaacggtgaaccttcacgtgccgcgcggcccagccattgcccgtgccggccgtgcgcgtgacggcccgagacgacagtacgccacggtgtcggtcgggcggccgcgcgcgcggccacgtacacggcgcagcgtggcgcggcagaggcgcacctcttcccgcgatgccgtggatattccccggcaccgaccctataacttggaaggcgtattcctttaaaaaaaaaaaaaattggaaggcgtggcgggcgacgctaccacaggtgtggaaaaaatctcttctacctaccggcacgcgcgaaacgagcagtttctatcagcacgtgatgcatcaaactcgttctatggcggcaagcatacacacagcgataaattccagatgtacacgcgcgtataatatactagcgcttgttaatatattttattataacgtcgtttgattttaaacatacatgaatgcaaaatctacaatagcaaatacatatttttgtaaataagatgaatgataaatatatttctaaaagtcaatgactccagacatattaaaaactgaaatgagtaccactgccatcgtacattcgtagtacaagataagagtggtatgaagtaaaaaaataattgtggtcaaaatattgtactatgcaatttgaatactgcatcaccgtagttttacaagaaatgtatcactggcacttcttggagtgggtcgacaacgacagtatagaaaatacagtgtctcgacgggcatcgtgtcgttttattcgcgggcgccgacttcatacacaaaggagaaaactaaagaggggatcccaaataatattcccaaaccctaaagccctcctccccttcccgtggcgattcgccggtccgtcccccaagtctagggtttatgttcgctttctccccacgcattcctcccacccgcggcgctccctgatctggtcaagcccaccagaatccgctctccagagttggtgggggcggagggggaagggaggggcggcggatgcagacggaggcgagagtggggatggccgccgcaacgatggacagcggcgccgccgccgcggccgctcggaggtactcgacgcagcagcagcagcagcagccgccgccgccgcagctgcaccaccaccagccgcagctcgggacggtgccccacctccttgccggcggcgtcgcgggcgccgtcagcaagacttgtaccgcgcctctcgcccgcctcactattctattccaggttcgtcttagctgctgaccgggtagtttaacttcttctgagcatgtgtagacaactatgaatccatgcgatatttgggtttgtataactaagaaaaggtgagacatttgtttctactatttagctgagctgcgaggactaatcctgcttcagataggtggaataagggggaatatttttggcattttgttttcccgagcaactattaagtattttgcacaacttaactgtgaagagaaaactcaacgcacaagatcttttgttgagaaatcttgatctggtttgatgtgtgaaacgaggcacaaactcatttctttttctttataagcaatgaaagcacatttcttacaatattttacttaaaatactgtggctgttaatccaatttatgtattctatgtgcaggtgcaaggaatgcattcagatgtggctaccatgcggaagactagcatatggcgtgaggcatcccgcattgtctacgaagaaggcttccgagcattctggaaaggaaatcttgtaactattgcacaccggttaccttactcctcaattagcttttacacatatgagaggtacaagaacgtaagtacagatttcttcagatgaacttgcatgctcattctctatcacaattattatatggctaatttcttaattaaatttggactgtgcagctgctacaaatgatacctggtcttgacaggaatggtggatttggtgcagatgttggtgttagattgataggtggtggtttgtctggaataacagcagcttcgatgacatatcccttggacttagtacggactcgtcttgctgctcaggtaagcctattgtcaccagtctgcatatcactggcttcctgtgttgattctcatccacttgaaaagccactatttgaaaaagtttccctgcaattagaccaaacaacatctatttccatgtgaaggacatagataactcaaaatcccctgttgattcccttctttatcagtttcacgttcagggtagaaggcatattgcatttatgctctctgctttgggcattattgaactgtaggcctttttccattgaagctttgcatttttaatatgtaatcttcactaataatgaagccttttcatcaaatgtttgcagacgaacactgcttactacaggggcatatctcatgctctttacgccatctgcagagacgagggtgtcaaggggctctacaagggccttggtgccactttgctggtaagaatgttcgacactgccattctctcccatctttttgagcattctacctttcgttatccaattgatatttatctaaaatacagggagtaggtcccagcatagcaataagcttctgtgtctatgagacattgcgatctcattggcaaatagagaggtaagttgcacaagatacaagtgggctctttattcatatccatgccacttctcgcatttgttctaactgtatttattacctttgatctttaaaccaggccatatgattcccctgttctgatcagtttggcttgtggaagtctttcaggaattgcatcctcaactagtaagtaatctgtaaacgaatgctgattactacttcctccgtttcacaatgtaagtcattctagcattttccacattcatattgatgttaatgaatctagatagatatatatgtctagattcattaacatcaatatgaatgtgggaaatgtaagaatgacttacattgtgaaatggagggagtacaaagtattctgtattactgaggtgtgacgagcttttctcaagaatgaaacgtacaatgtggaacggttgtgtgaatacacaaattatgtgcaaaatagaaagaccccactttgctagaatttgtttcccccacttctaaagaagttaccatgtaatccacaaactatttttatagttgaataacataggaactatttttttgcactgttccactagtttatgctctgattctgtctagacttttgttattggagcaaattggtcaataacacctcaaagatcaattatctgttgtattttttgtcactaagtgaaccttgctctgatcattatcatttattatatttcagttacatttccgttggatctagtaagacgccgcatgcagttggaaggcgcagctggaagggcccgtgtctaccaaactggactttttggaacatttgggcatatcgttcgcacagaaagtttaagaggattgtatagaggaattttgcccgagtactgcaaagtggtcccaagtgttggcattgtttttatgacgtatgagacgctgaagtccatcctcacggaactggcatcagatgattagctgtccaacatttgtcacgcttgacaattttgatgtttgggccagaataacacttgaggctgattagagcgagaaaaatgactttgtagcatatgttaggatctagatggtactaggtttttaagtttataatatcatggaatggaaggatattcatatggttacagattttcttgtagtgcatggtaaaagaagagccgctgccataggtcttcaaatttctgtccaccagttttagtgtatgttaacagtttcagttttgtaatggtacatgaggccattgtcttcagctctacaatactattgaaagatggcctccaagatgatctgtttatccatgttgtcctagtgagcttattacaattcacaagtgagttcggctacattattgtgaatggccttgtcattcaaatttcctggtagtgagcaaggaacgttgtatccctctttattggacgatagtttgttaatgcggcctcttcttggatgcaagtacaagttaaaagttaattttagatccacattgtaattgttcaacttcttgctcgcacgatggacaaaactgtctatgggaaatattggacatgtctccactgcttatggactgagaaacgcgtggccttttccggcaaatgaaccaatctcaaatgcttagttaactcaggtgaagagaggtgctgctaaacttcgttgagaagacatataatgaagtgtagtgtcatatgcggcagagccattatgtcgtcatcaatggctcaatgctagtgcataatgtgagaacagagttcaaatgctcagtgacatcaatgctagcagtacataatgtgagaacggagtagctaatccacagctgatggcttcctcagaatgcatgtcatctggttccgctgcttctttgcacctttgcacgagtattggctgcgattcgcaaaggcgttgatctgtggtaggggattgttaacaggtcactgaagactgttcagcatacttcagattcgaggggccattgtttacttgaaaggtgtctccctcccttcttaaatacttatcactgtttcaacttcgacattagtaatttctaaatgactagactacgatgaacgaaagctaaatgcttatatttaggatgaacacaattaagtacttatacatttttgcaaaaagcgacaaatgattgaagtttaatcatgaatagtgtcccgtgacaagtatttgagaacgaacagattgcttaggaaaatatttctcctcttctcgctgaattttcatttgaaagatactcttgcttgtatgcagtcatgcatagggctgtaagtgggtcagctgcgaacccacttataggtcaaaataagcgggtttgtggtttattttagcctataagtgggtttcgcgggttagccacttacacccctagtcatgcagatcaacagtaaataattagtacattatacacatagacgtatataaatacttcactgcattatcatgggccatactgtgcattacattagtgtttcttagtcaccttattagattgcaacctcagctcctgttaattcgagcaaatgcagttccttaactgatttactctgataggacctctctgaaaactcaaggtcacccaaatccgaaatcttactccattaccataacccatatgatctccatatgtatgtgtgtatgatatctgtatacccgcatccagtatggacatagactgatagacagtgctttcttgtgttacacaggaaagcctccggttagccgtatatggttcagtgattggcgaaggccatacttgttcacagctgcataggcagctctgaaaccatcgccgtatgctgatgatgtgtcattggcgatctgatgcaggaagaattctccaagcttcttctcggtgtgagagatcccacccttcttggacggtggtggtcgacaggaggacgacgaagatgaagcgtaagatgttgaagcctgtccatatcttgaagtggatggaaggatctctgactccagccacaggtaagacatgacctggcatataccttcctcaatctccgcctttaggttccggtaacctgtaggtgccattgtcagacagatacaaagaaattaattaatgttcagataggatttcagaaaatgggagaaatggatgttcagatgattacctttgaggcgcaaccacccatgcatcaattcatgggcaagaatggagcccgttagcagcctgcaattgtatggaatgtttatgacttcacacaaatgatacacgaattgtagcatttgatttacatgaaaatggaaatacttgtgaagaatgcactgacctggggaggccaaacaatacaagaattgcagtgacttcgcatctcctagttagcttttgcggttgggttttcatatctagtaaccgatttgcaccaattctgggcctcctaagtatctgtagaaaatcagaacacaaaggaacaaagtcaatgatttcatttggccaacctgctactcagtggaactgtggatgtaagatctgaaagcaactactctgtctagtttattgcaactacatcattgaacagggaatctcattagatgatcagtatttatcagagaatctcatcgtttgatcagaacgatgttgatttcatattaccacttggtcttccttgatttgttagttattcattagagaaattgtaccatcctaaaaactgtttaggttgacatgcgttgtacttacactggtcacagtctgctcctctgacagacaaaggcctcgtgtttcaggcatatgatgcggtccctgcagaaatacaagatgcaatgatcaataacacatactccgtccagtcataggtatttgacgtttaggacaagatttgaacaaacttcaaagtttgattaaatcttatcctaaacatcaaatatttatgaccagacggagtaatgcattatgcattacagaacaaacagatgtaaagaacccactttgctttctccttccatagcttcattaagggcttgacgttcaaccaagagcatgggtatctgctggtctagtttcatgttcatcccttagtagtagtctctgatggaatggtatagcggttgacattcaccggtgtccatgattgcagaatccaggcattccatgcacaagctgcgtccatcccctaatgacatatactttgtgttccttggctgcagggattcacaaaatgtcttaagtacgaactcatattttaaactgacaaatcagtacaattgcaatttatagaaattttgccgagaaaatagagaaactaataatatttttaatgtgtatttgtaagcatgaaatacattcatcatatgcaagaaaggcagtacaaacctccattttctcacagctacagcaacgaggtgttctatcatgctcatgcaaaggacaatacttctgtccccagaatggatgggctctgtactctatcaaaccagtcctgttcgttgggatctgcaataaaaaccaaacacgtaaaaagggtttcctgcaaatgctgttccaacggcatgctaatccaaaaatcagttctagcacttctgcaaatagttcatccacaaaaaaaaaaatcttacaaattgaaggcagacgtcacactttgggtgatgaagctccttgtagcacagcttgtggtatggatctgtacctagcaaggtgaactgggaaacagaataaagtaaactgtcacttcctgagaacacctgaacacacacaccttcagacattctaaactgaattgcagaaaggttacctccatctcacggatagggtggcgacaggaagaacagcggaagcactgagggtgccagtacattcccaagcagctcaagtaatggccatgccctatctcatgcttgcaacccccacagaccctgaaagatatatattgcttctttacataccagctgtttctgtgaattgtagacaggttagtgaaagcagatttgctaacctgtatcctctcgacctggcctgggtctgagagggtgcacaaggattgtaaggctggtaaggattcatgttcagactgtcctgtattgctctagcgagttcttcatcgttttctcccttgtcatggtttctctctacccaaaaaaagttgcatcaatggtgcttagtgaagagataggttaaaaatatatgatcataatatcacagaattcacaaatatggcaccttttgtatttttggcatcgtctgcaagagcaagggcaagtgcatggtccatttcttcattgttatgtctaggtggttcttccttctagaaacataacaaagaaaggttcagaaactcttttccccatgatagtgctacatcattaccataatctaactgataaaggaaggggaatttggatagtggcactccatgaaccaaagaaaagaacagaaaaatgtcaggttgcggaggaattgagaaacattacctttggtctaactggttcttcccagagcgtggtctcttctcctgccgtcacccgagggcgccgtcggttggcctcgccgtccttcgtccccttcaggaaagcgcagagccacttcatgaagccggatctcctctctgcgttgcagaaatgttagaaccggacaggttcagggcttcaggcactatgcaaagaaggatctcagacatggctagaactgaaatgtggagagcaacatcccacctaacacttcctgcccgctgaaagcaggcaaagaaaaattgatgtatttaaacactttggttgtcttatatgctcggttggatgctaattgtaagtggattaggtgatgggttatcaacaacataatttcgctagccctttgctttgatcagatagtcacagttgcacagttaaaaaaaaatcagtcatcatgtcatgtacagctaaactaaatttttaagtttttgtttgtatgaggctgttaattggactgtcatagaaaaagaaaggcagatgcgtgtacctgcattgaacaagatcaagaaacacagggacaaaacgccacacgaaattgcttgcgttgctaacatggcccctctctacaccgtgctaatcacagcgttatcttcttttcctttttcaattctacctccgattgacggggcacgcaggcgcagtcagggtcagtcaaatcttggtggccctcaaatttatcctggattataagaatcagtttgagtctcccatttatgctatgtttggataataggaaataaaggatgggattgggattagaaaatgaatcaatggctaggatgaaataaggtggaggaaatgaatggctaggattcaaagttaccccttcataagtgggaaattatttccctttcctattatctaaacggtgccttaatttccctcctctgaatagcacagtggtatgatttatgcatgacagttagaaatgttcatctgatgtgattgcacggcgatcgatgttaggatcaaacagctaaaggtcgattcgaagctagaccaataatatggacctgtaccatcaccatttgcgccacgctcacgccatgaatgtttagatggggctaaaattttctagtccatgtcacattgaatgtttagatgctaatttaaagtattaaacatagactaataaaaaactaatttcataaatgagagctaatctgcgagacaaattttttaagcctaattaatccataattatgaaaagtttactgtagcatcacattgtcaaatcatagcgtaattagactcaaaagattcgtctcgcgaattagtccaagattatggaatgggttttgtaattagtgtatgtttaatactctaaattaatgtccaaacatccgatgtgacagaagtccctgtttcacaaacaagcccttagaataggacagcctaatggcaacaagaacgttctttcagagagagtggacatgatgtggcgagtctaacggataacagtctcatgtgtaaagaaacgcctaaaaaatcggctattttgccatggatgttgacgcatcgatcgattggtatgctaaattttttctctgaaagggatcaactgggatccatttttgtgttccccggagtatcatctttaggaaagctaaaagttcattttgctttacttgctgaaatcaacctcgttttagtctatctgacgttaattgcactgccgacagtagtttagcctgccttgtttgaagttcaatcaagacagcacatatatttcaagcaggcaacaaataaaaagttaaaatcttagtcaggcaagagacaacgaccagctactggtgccatgaaaacaatagctctctgctgctgaaaaagtacgtgaaatctaatctacccatagtgcacaagcaaaccaaccatgtgtccaacatgaacaagaacgtcaaaaagtacgaggaggacgacgatggcaacggctgaacattaggatcagagaaattaccgtgactgcactgatcacaagaccgtgaggagtaggccatgtacccaagaaccgctgccgcaacgtccccaatacagcatatatatatgcacacacggagacagaagcgggagagagatggcagcagaacacttcaatcagagcgagagcagagacagagctctgcaaggtcaagtatggcgatcgcgatttttacgatgagcagaggatcaggaggaagaagaaggaggcagtagctgcgatggacggaggaggaggagggggaggggaggggagggggttcttagagaataaagcggcgtggtggcgaggagttggccgcgacagaaaggaaaggattgagggtgaagcgaagcgcggggcggccgcccgcccacaacgcacggcatctcatctcatctcgcctctcctcgccttcgcctcctccgcgttccgtgcaaaaagcaaacgatctctcaccgggttaactcgatcgcaattagcgtcttctttagcgaagaaagaaagaaaaatcgaaattcggtagtcgccgtgccgccagttgatggcgcattagtggcggatgcacggggggaatattttcggttctgtgttaacggcgggaggggaaaagaaagagattcgttgtgtcaacgcgaatgtatgcccctccatttgcatgcttttttttttttgtttttggtttttttggattggttttctttttgtgctcgctgagagacggtgatgctacgcggaaacgggaggagagcagagcggcggcgggggtggcgctgcgctgggcctgcgactagcaatgcgggaggagtacgtttgctctgaaaatttttttcccttcctttctcggatagggaaaagaaaagggaaaaaaagggtgcgaccctgaaagctggccgctgccgctgtcgatcgccattcgccagcacgcacgcgagtcggcgagtgtacagcccattatttccgttgttcgggggagcccgccccggtgttttgccccatggaccgtggactcatggtgagctcgcgtgacgcggcggtgggtagcctagcaaagcaacaaaggccaaagtttaggccctttattcaaaggaaaaaccatagaaattctagaggattttatcctatgagaaataattctatagagtcctttgaaagaaaggattgtttcctatcaattcctttgaaattcctatggaatgaaccttactagagcaattttggagaaaaataagcatgaggtctcacctcatgttttcctcttcatgtgtctaaggttcctacgtttttcctgtgtgctaatcaaacgacagtttgaagactttcctgtgtttcaaaatcccataggaatccaataagtatggcattcaattcctaagtttttcctattcctctgttttctgaatcctgcgattcaaagggacccttacttgcaacttggtagcctaagggaatgtagcgctctcgtgcactgatattcacatatgttatttgtggacgctggtttcgtatcgcctttgcaggaagaaaataagttaggacctcggtccttccacctaatggaaaagactttgttttctaattgatatgtgtgtccacacgaatcttggagcactcatcgcttacctcagctcaagtcctcaacttcgcccctctcctctcctctccacttcccgcctcccttccttgtcagaggcccaattgttgggactttggagtattacgtttcacgcgcaagaggtatcgagctcgttcacccaacttttacctctctctcctctccacttgaaccacttccactacttcccttcctctctttttctttcaggtgggaagtctaatctttgattagagcttgatgcgcagcaatgatgtcggcggtggtagagagctcttccattcgtcggggcatgagttgtcaaccttaatagcttccctagcaaggagcgcatgtaccaacatgggtgccggttgggcgtcgtggcatgctgcttctacaccacgtgtcttcccacacagcaataagaaggagaaggcggcaagggagcttctggtcaaaagagaactgaggaatggaggtggggagatgaggggaaaagttaagcacttgagttggaggtagaaggtcaatgctccaagattcgtgtagacacgtggcaattaggaagcgtggtcttttcatcggagcggagcaccgaggtcctgcccattttttttccacctttgtaggagtaggaattactgtactagtaatagttttatcatgcaccagaaatgcaatatatcaatgggaccataagaattattctagactgtttagaggactgatattatttttctttcatgatataaccactttactgtagattttgtagaattccaatgtacatccagattttgtaaaactccaatgtacatcccgttatttgagaattttgtcttagttatcccacgacaattcgcatttctgcaccaaacctctacaatcctcttcacctatctccatcctacttcatttatgtatcttctccttcctcatatgagtcaagctcgctccctatctcatattcggtagtttaagggtgtgttcttaccctaggttttccaactcatctccatcgttttctgcgcgcacgcttttcaaactgctaaacggtgcgttttttttgcaaaaagtttctatacaaaagttgttttaaaaaatcatactgatccatttttttaaaaaaatagctaatacttaattaatcacgcgctaatggaccgttccattttccgtgcgcatgttccggttgggaacacgctggagcgaacacagcctaatattggtatataattaaggaaatttcggctcgtacaaattggtttgtgcgttagcacgctcttgatcagaaattgcctttaattggcatgattacaaaagtgcaagcatctgacctgaatatacgatgcttgaactgccgatgatgcgactgggaaattagggtggtacaagagcgtgcagagaaatagcgagccattttggatagggagtacccaaaaaaaaaaaggaaattgatggagacgcttccatgcatggctacaattcaggtttcaaccatgttggcatttacacttcagtcaatgctcccccccccccaaccatgcttctcacttacaaaatggtaacattgatgcatctatcgtctaaaagaaaaatagtccaaaatcgatcgacacaatgaaataaacaaattcgatctacacattgctctgttatctgtgatgttgaaatcctgtttttaactagtattctcagttagtttagttcgctgcagatacatttgtatttttgttagctgtgtgcaggaattgaaatggaacctcctccatctatgactgccttcctctgtttgagtgtattctatggcactaaaagaacttcaagaaaacagcatttccctgtctttgaaaagaaaagtccacgtcatggttaccctatgatggtcttaaccaatggactaacttacatggcaagtcacatgctgtatcatggaagcatccacctaactgaattcatagtgtatagaatgcacagagagttacgtagggaatgggcaaggggagccagcaaggggtgtttaagatggggttaaaactttttagcccatgtcacatcggatgtttggacgctaatttagagtattaaacatggactaataaaaaaactaatttcataatgagagctaatccgcgagacaagttttttaagcctaattaatccataattatcaaaagtttactgtagcatcacattgtcaaaatcatggcgtaattagactcaaaagattcgtctcgcgaattagtccaaacttatggaatgggttttgtaattagtgtatgtttaatactccaaattagtgtccaaacatccgatgtgacaaggacttagaataagtccctggaaaccaaacagcctctgaactactagaatataatagctggaccactagataggccgtttgttaactgttatacataggccgtgtttaatagttcatatgccaattttttttacgtatacagacacacatttaaagtattaaatgtagactaataataaaataaattacagattccgcctgtaaactgtgagacaaatttattaagcctaattaatccatcattagcaaatatttactgtagcatcacattatcaaatcatagcgtaattaggctcaaaagattcatctcgtaatttacatgcaatctgtgcaattaatttttttttcgtccacatttaatgctctatgtatgtgtccaaacatttgatgtgacataaattttggaagtttgaaggaaactaagtgtgtgttttagttcatgctaaaattggaagtttgattgaaattggaacgatgtgacggaaaagttagaagtttatgtgtgtaggaaagttttgatgtgatagaaaagttggaagtttgaaaaaaaactttggaacttgttaaagttagtcgatatagtggaacaacaactaaccttcccgatcgcttcagtcattgatcacctaagacatgtgttgatacgaaaaacacacactggcctgggagatctgcttagcttcagtgcaggttgctgagatgcgggcgtgccagttagtttgatcctgcaactgacaagatattcaaataatagatcaatgagccgatcggctgacaagccgatggagcaatctcagccgatgccgataccagccgatagcgatagggttttgatcaatcggctatatgtccaacgtagataatgatataaaggcaatcaactgatgataatataatatatcaatataatccagtagaaaccaatcagctaacaatatgatgtaaataatgatataaaggcgatcggctgatgatgataaataacaataatatagcaatataatccagtggaaaccaatcggctaataatgatatgatagataaacatcaatccaaaggttaaagcatacatcggctgtaggtccattgtcataaaatctacaagattagattaaatagtgaaacctttgttccgatcagctaaatccaacttatatgtatatgcaatccttacaagccgatgcaacgtacagataacttatcggctagcaccccgataaaatattagcatgaacctatcggcttaataagacttatattatcaacaacaatatagtaggtcgaacctaaccgatgcagcacgagattgtatatgataatctaatactcggtgagccgatagatctatctaatgtgatggatataacaaatctatttagaacagcactgtgatcgtagagatatatcggctaagacagaagatcgaacctaactaagacaatcccaactaaaccgatgtgtctctaaacataatacaattagagatagaattgagatatcaggtaggcggatatatcaaccaaaccagagcgatccaagagatcgaagcgatgcagccttgaacaacaccaatatagccgacagattcaccagggccgacgaaacgtaggacttaccccttcgccagagatcgaaaaccgatgcagccccgcgtcaggtgccaagttccgtcggatgataagtaaaaacctcgggaaagagggtggcaatgcgccaagagtagttgtattgatctgtgtgataaattacatagaccccaggtgtacatatttatacccatgggttgatacaagtccttgtcggacaagaaagaaactttcctaaagataaaaggaaaacataaagtccttatcggacactaaacacactttcctaaagataaaaggaaactaacaaactattcctaattaatagataaactgccatgctgcatctttcttgaactcggactcttctggataaattccccttagttgatccgactccatcgagaacacggttgttggagatttgacgactcccattggatgattccataactctgaagccaatactgactctaagctgatgatgactttgggcttaccaaatttcatcgttaacaacatgccagatgacgacataggaacacacgatatttgttaacgaggttcagccgaagcatacatccccggggctctgattatgggcgctcctccccaaccaatatagctcctagccgctacgagtctatggcctcgtcgccatcctctccctgcgtgtctacgatatattgtagttgccatagttacattgtggtgcccccctctctattttagagagatgacgggttacagagttcgactctaactccaccctctaacacctattacagctccaagtccaattgtaaccaaatagaactagtatattcgacacctattctaacagaactaaacacggcaaaaattttcctacacacataaattttcaacttttttcttcaaacttccaattttagtcaaacttgcaattttgacgtggaactaaacacaaccttggtacaaatcatcatgcaggggcatgaaaacttccatttttttcttgggagtgtcagtcacttttctcatcccttggatgacaatccaatggctcttatcattcccactattaattattcaaaagaaaatcctttattttcacaaataaaagattaaacaaaaaattgcactgacctaacatggaataaattatcaagttataaataaatacatgtaaaagtatccaacttggataaacataaatctacaacgacaaaatcagggctagaatgaacaaaacttgcagaatgcatagcactaaattaaatttagtgtaggcttagcaatatgtatgtcgagggatgatcctctctagcgggaggtcgtgagacccccctttcatgagttcggccgggggaagaagctcacctctagaaaccacgtgtccgtccctaaggctactagctagctcgcacacaatcaaattatacaggtttgggccgctgagaggcgtaataccctactcctgtgtttgggatttagattgagagttacaagggttcctaaactcaggagaacactcttctcctagagctcaagttctttgagggtcgtccccctctctcggtgggcaaggtcctccttttacacctcaaggggataccacatgcaccgcctctacctactcttctttcgggtggggacccaccctatcttgactggaactcgacccgtgccttcgcctggaagctaagccacagcttgtccttgagtggggcccaacgccgtccctcgcctgacacgggggacaaccctgtcattcccttattaataggtgaagacttgtggtggctgccgtccgaatgaccctccgatgggacgggtcatacgtacctccactccgccggaagcagacgcgacgtgggagcacggttgtcgatccagtcagacgtgaccggcgtcaggccggtcacagaccggtcattcttgactatggcgcgtcagcttagcacgccgcacgtctgcctcactgtattaaatgcgacagggggcagttggggcgttgcgctcattaaaggaggctcagcctgggccccctcctcgctcgctccccccgccaaatggcggctgggcgagggcctcggggcaaagcggtgcaagggcccgaggggcatgacgtggcaccccgaggcctcgaccccccggccgctcctgcggttcgcggactgcgggggcaggactaggctgtagggacacatagcaggatagaaaggtagattccccacacttcgcatacccccggacccatatatctgacaatgtagttttagccaactgaaaaactatgaccctgttcttttcttcgactaaagttgaataaaattatataaatttccatgcccctgaaatgcagcggaaacccttctttcttctacatatccacatgcattttcccttgtcagtgagaataacacctcaaatcagagctgggcaccttcaaagtgcgagaactctggttggctgctattgcaaaaaaaagagatctggatggccgataagctgcaaattagacaatggctcaacaatcacttctgtcaattctactattggaacttgaaaagtatgcaacaccgctgtaaagactgtaatgtcgtgcggcaaatgtgggaatgaactttacaaggagtaagacatgacatcgcaaacacgcatggcaaagatgatacattggtgaattggtggattaggcgaacatcacaaggagaaaagcataaaacgtagatcatgaaattaattcatatgctagtgatttgagggatatgatgtgagcggaacaaaagagtaccacgcctattgagcaagaccatcgacgaaatcagggtgtatagcatgtgtgtctataaagatgtcacaagaatatccattagataaaaactgctcgacgtgtatttttctctctttgttcctgtgttgttgggtccatccttctttcaacaacgctaatttctgaacggataaatgcatttttcgttgttttctacggtaaaaccacaggcgggtataggatttgtgcaaagaaaagatcagaggtggatcatgacataataaggaggtgctagtatacctgcatattacgtggtggccgttggcgcttccgccaaattggagaccgaggaccccacaccgcgccaccacctcaaaaagagaatttcttttcgagaagtaaaacgaaataataaaataaagaaaaggaaaggaaaatacacgtagtacaaacgagccagcggcgagggcgaggcgagtttatctagccagcggcggcccaccgcccaatctctctctctctctcctcctcggccgcgtaaaacacctcccaccgcctcctccaccccctcctcctccccccgcagagccgaaaccctaactccgccgatctctccaggtgcccaaggggagggaggggatggcggcggcaccgggggcgggagggcagggcggcggcgggatggacgccgtcctcctcgacgatatcatccgccgcctgctcgaggtgcggacggcgcgcccggggaagcaggtgcagctctccgagtcggagatccgccagctctgcactgtatcccgagaaatcttcctcagccagcccaatctcctcgagctcgaggcgcccatcaagatctgcggtacgtgctcgccccccccccnnnnnnnnnaaaccctnntccnccgnnnggnnaanctgctttggccgcccggccgnnagctggtgtattgtgggggagactgcttctctgtgtcgcggccttgaacaaggctagcatcaatctgtctgtcttggaaagtatggtcaagggcgttatctattttttttgcaacttttttctcgattgtagttctcgtgaggtagatttttattgaacaggttgtttcgtgaacattttcaaaacgagcacattcacaagggctgagtgagatttcctttaattctgactgtgttatttcaaattttattagttcgcttgatattttaattttcggtattgttcgtgtgcacagcagcttctattgtctagcgccatctgattctactagataattaaacctatctgtcctgacaactgttcgtccatagatgatttgtaacaacatctagttaggcacggcagagtgtagatagggtcatgttgaattgttttctcctgatgacactgattaatgatgaaacgtcaaccactttgtacatgccaatttgaaaatgacttcaagtttgttgacttgattttctgtggtcagtgagttaatagtaaatgtgggcagctgtaaccacttccaggtttgcagccgtattgaaattcccaaccatgaattcgtaattctgcagtagtttccttagcaatacgatctactgagcatttgctcattgagaacaccagttggtagactatttatttgctactttcatgtattgttagtatttttatcctctgctgttgaattgctggcattgcatcatattcggtgaaacattgtaatcatgaaaatgagattatctatattagcggtagcactaatcatcccgtaagctagtgcctccttttccgttcccagcaaccatcctgtttttttttctgttcctgtccctccacttcggcatcccctctcccgtgatcccgtcttttatctgaataaaaagttactatcctggtatcccctgccgccctcctgctttttaagtccgtccacttctgcatctctctctggtccgagtaaaataattacaactttgagatttattcttttttttataaaaaatactgtatgtcatctgagtaaaaaaatacttctataagttcaattaaaaaacccactccctattaaggtggatcagtggtaaaagaaattatacacattcgtcttgtctttgcgtttaggttcattagtgatgttgtgattagtaacatatttactccgatcttccggacaacaaaaaaaagacgagtaaatcttacaccgacggctaacctcaccatagtagtgtccttggctgcagatctcccaggaggggccagtttcctccctgctcctcccgctgacggagatggaggagcttggcgaggtcggtgaagtagggaagcacgagaggagcagatagcacggattgcgttgattgcgcagatctgtcgccgatggcctcgtccttgacccaacctccaccttgggctttgcttgcgttggaacctctgcctcgcttccaatctgtagcacactgccacagtcgccatcgatttgcagttgatctccgccgtggaggcaccgcttgccaaggggtggggatatggttatggtgcgctagtaaactcactatgtcccaaaatatagcaagttttagctatgaatctggacaaccacttgtccaaattcatagctaagagttgttatattttgggatggaggtagtagcggaatggaacggataagtgggagagcatggtgtggcatagtgtgtgacgagggtattggaggcacgctacatgagctaaatagggtgctaatgctctgtgcaataattctcctaaa

SEQ ID NO: 45606 - DNA, 3263 bp, Oryza sativa
gccccccttggtgtgtatgacaggtgcgactaaaacttgccaggcaaataaaattgcagttttctgataaaatcgtacgctattgttgcaattctctgaagtgtctagataaagttgcagtaaattgataattttgacaaaatagttgcagttatctgaaatttactcttttatattatctactacagcacctgtttgtgttgtattcatctaaaaaaagggttgtgtttattggagtccaaaataatgttgagctcatttctacttagcgccttcttggggagtttcaatctgtagtgagcctgtaaatttgtagctggtggctctaaggtgtgtatttaacttttttttcacttgtcatttggtatccaggtgacatccatggtcagtacagtgaccttctaaggctttttgagtatggtggttttcccccagaagccaattatctattcttaggtgattatgttgatcgaggcaaacaaagtttggaaacaatatgcctcctccttgcatacaaaatcaagtacccggagaatttttttcttctcagaggcaatcatgagtgtgcatcaataaacaggatatatggattttatgatgaatgcaaacgccgatttaatgtgcgtctatggaaggtcttcactgattgttttaactgtctccctgtggctgcgctaattgatgataaaatattatgcatgcatggtggcctctctcctgatctgacacatttagatgagataaagagcttgccccgtcctactgatgtaccggatacaggtctgctatgcgacctactttggtcagatccaggaaaagacgttcaaggttggggcatgaatgataggggggtctcatacacttttggtgctgacaaagtttcagaattcctggaaaaacatgaccttgatcttatttgccgggcacatcaggtacaattttaatgcaacatcttttcctttcagtattttttttggtcaactgaggtgatcatatttatatttcatgtgatgtcaggttgttgaggatggatatgagttctttgccgacagacaacttgtcaccatattctcagctccaaactattgtggtgaatttgataatgcaggtgcaatgatgagtgttgatgaaactttgatgtgttcttttcaaattcttaaacctgctgagagaaaaggcaaatttatggcatcaaacaaaatgtgaaatggtgaagcccatttcgctcatagcgactctgaggtcagttgcattaccttgttccataagtttgccatatagtttgtgtggcttgaaaatgtaacatgtttactgtgtgctgcatttaactattcacttgaaaagttttaaaatgtatggtgtatttgctctatgtttgatgtagtaatgtgtatcataacttacaactaaattttattttataagtatgttaagttgttcttagtttttcttatagtttgttgtatgtgttggccttgatatttctctccggagtaaaattggctctaccttataggccatacctgtatcagaattttatcccagtagcatatggtacacaaaaaaaaagctacctgtccatggagagtaaaagaattgattaggtgctttgttctccattgctgatgttatgcaggtaggaatacaaaatagatccctagtcgcctccgcgcaaatctattttgtatgtattacactagttgagtagtcattatcttttgagtagtcgttagtactcccttcagtcgcaaaaacatataatgtattattcatgattatactttgttttggaaaattgctagcagaaattacttgttctacactaagcaatataatagtattgctagtgtttttccaccaataacattttccagaataaaatccttcaattgtattgtgcacaatcttgtggagtactccctctgtcccataaaaaaccaacctagtaccggatgtgacacatcctattactacgaatctggacatatgtcgtactagaatatgtcacatccggtcctagattcattttttatgggatggagggagtaagcagaaagactatgctggtcgccttgttgacaatcgccataccaggtcaagttcatagtgcctactttgagttacaaattgtaaccttggaatttcattaggttattggtttggttcaccagcaggtgttatgcactcagtgaatatgaatagaataatttaggagcccttcagacgatacagttgttaatttatggttttttattaaaaaaacactattttttgtccttttgatataattattgattgaaataatcttatctgggcctgtaactgtgagttgtgacatcatagttggaaacataatttggcaatataatgtgtggagagaaacaactgcaaatcgggcccaccaccaattttgggagaatatttcacatatacaaccataactcatttgcaagagcctagctcatcatgtaagtaggctggtgcagtcgtacggcaaatgttctgcttgtgttaggcagataatcaaccatcacaaatgttctgctcgtgttagtcagatatgatactgcaaacatcattttatggtttcagctggttggcgcttaattatgatcatgtctactgtaggctgtcctgtggatgcatctagacatcaacgtgcaggcgttaggcttgaagcaacattgggctaattctaccggagaagccaaataatatcatatctaacagttggtctggaaggttactcttcatggcaagtgccaattttttttccattttctgttatgatgcgtgaaactatcttgtagatgtagatatattgattatggaaggatgaagttgccaattgacctgaggcggtttccttctgcagccaggaaaaatctgaatatggagtttctgtttggtagtttcactatttaaaagcacatgtatcacttgtatggaggtaacaactttacttatgcaagcccgtgttttctgttgcttgtaagcaaaattggatgagtttttatcttgttttctatagcgtgctaatattgccaatggcaacaatttgcgaactgcaattctagaatgtactggatgattgaacctttaagcatttgcgaactgcaattctagagtctagaagtcctctggaaaggctaatgaatggtttatcctgtaaactggaccagcttgacaggtgctgcgtgatctacattgtatacttattttgtcatggtgtttccttccatgtgtcccactcaatgtttagg

SEQ ID NO: 45607 - DNA, 7025 bp, Oryza sativa
  unsure (1)..(7025): unsure at all n locations
gggtggtgatttctttgccagactccagattcttatgccagctataccatgatgcacgtgtcttcacctgtcaaattctgcccgtatggagtgtcactttacctaaaatgagaataaataaaagccactagtacgttgtatactactccttctgtccaaaaagaaaaaaaagacaatccctccgtccaaaaagaaaaaaaagacaacttttaggtttatgtgtccagcgtgtttccgtgttcagcgtttgatcgtccgtcttatttaaaaaaaattaaaaagacaagtcacgtataaagtattaattatgttctatcatttaacaacaataaaacactaattataaaaaaatttcatataagacgaacagttaaacgttagacacagaaacccagggtttttcttttttttggacggagagagtactctccaacaacccagggtttttcttttttttagacggagagagtactctccaacggagattttagggagatagtacaatccaactaatcctttatatttttgggatggtgggagtaataaactgagttgtagctgctcaccatccatacctgcatagtatcatcttcgtacctaggattacctccatcccaaaataacaaaggacaatgagtttatgtacgtgaatgtggacataatgagtttatttatttcgaaacggaaggagtattaaatcatcgaaagtgctacacataggccttgtaacctatgatccgatacatatgaatatcaaatctggtaccaataggtatcagaattggaagatttggtaccctatgaatatctatctatgggcttgttcggctgccctataccacggctgtacagcagcggcagctgccaccatatatcttcgggcctgttcactttgatgctattttcaaacataaaattttttttggtaaaattgctaaaattttggctacttttagtttgttgtcaaatttggtaaatacataagaagtcctgccaaaattttggcaatattgtcatcttgtcaaaattttagtattgctaagatttattttggctacaacctaaacatgctcttcattgtattatactgtggctggctgtccactagcagtaccgaacagaccctgtatttctaacgtcggtagttctgccggcttgtgattggtggatgtggcaagcaatagtttgttgacacgtgttgcttctcctctctcccaatttgtgtgaattgtatgacaagccggttcaaaaaaaaagaaaaataaataaattctagagactattgagtgtcaacataacatccagatccttcatatcctttcaatctggtttgatccaacaaccaattcaatgaaaaatctagaagcgaactaaaggggcaaaatccaccaggaaccaaaaaaaaaaaagtatctaccacctctcagacagaaaagagtccacctgaaaccagagccctatggtaacctcgagctgccgacacgagcgatctggtttgaggtggcttgttttatcgttaaatgaattttaagtctgatttatattttagcatatttaccctatttttttataaattgaatggtcaaacatcatgttaaaagtcaatggtgtcccttcatccaaaaaaaaaaaaacttaggtaagtatggtaaacaatctaatgacaacgaatctgacagccacctatccggatttgttgtcttaggaatttaaaatgcattaaaagaggtcagtttaaatgttttttctttaaaaatacaatctactacatgttaaattcaaaactaaaaccccacaagaggttcttccaaatgtatggtctttgtagaaatttaatttgaattgaatcaattctcaaataaaatgttttagaatggactgcaaagatgacgacgccaacaagcacgtcagatttgttaccctatgaatatcatcaatttgttgtaggttttgtacttaacaggcgccaatacctatatgtaccaatctagtaccaacaggcataagacttaatacctaggagtactacttatatcataccatcgtaccgttccagaacagaaaaccgtggtataacagcccccttaatagttttaatttcaacacaagcaaatctgattccaaagtccggtggcgggtgtactcgttcatttgttactgcccccatttccaatataatacaacagtgaaccgaatgtacacgtacaacaatgttgactatagttgattgtaactctacaaatgatcgttacttgctgtaagctctgccttttgtgtgtaggcaggtaaggggggaaaataatcggtcatccaaaattactggatcgttgcatatgtttcttgtttcattttcattaagttgctctctatgcctcttaacacaggtctatatctgcataagtgatggcaacagttaaatttcaccaaacagaggggaaaataaaatgcagaatcggacaaacaataatagtatacttacaggcgtgcgaggttattctgcgcttgcaccgcttttctgagttcagctgaaagtttcattatttctgccgacaacccctcggatctgctctgttctttgatgagctgatcctgtagacaatgaaatatgcagttgtaaaccaatgacatgacaataaatagatttgactagtcatggtatagacaagaaaatattctcgacagctccagcaatcaacctttagggagagattctcagttacaaactctggcgggaatgaaatgctggtctcgttctgcccatctggctggatagtggtattacttgttttcaatagagtagcttgctcaagtcttaacttctctaagtgagagcgtagctcttcattttgcttgagacaatcttttacctggaaattgtgattaattgaacacgcaagatgctggtatcatccataaatgataaatgtttgtctctccatgcatgaaatgactgataacagcacacctggttttcccattgcattgtaacagctacagcttcttggtatgaagtagacaaggctgagttctcctcaaacagcttttctatttctgatgattgagaatcaatctgtcaaacacaatccaaaacttagccagctcattgggaacttattttgttcaaagaaaaggaaggcagcatcaaacacctccattaacaacttttggcggctgccctctagcctctcaaccatcaaagccatatcatgcaattggctttcaagtttttccctatcttcctgcataattaaaaaatggccagtacagtttaagattgattcgagcccagcaagaagattacggcgaacacttagcattacaagtttctaatcacccctgaaaattttgaattaagacaagggcattcaggcttacaggtgtccacctagcctgttgtaatgcaagatctcatctcagttttacttttgagtccttgataactatggactaacacatgaagtatttaccttggcaaaatcttaactcatggaaaaacaaaaaacttgaagtttgttcgatacattaccattgaaaatgccttgcgtgcagcaaattcagaagcttcatctgcatggtaggggaaacttatttcatgcagtttaccagtaaaatatggaatatctgaaggaacggaaagcagagcagcatgacaaatgtggaagtaaaagactatgctgaatggcacgtttactagagatagagtaccctatatgaagctacaaaatatgtttcatatgcacctgatgctttcttcgtcaaggcagcaattttttcttccaactctttcttttccgcaaccaaggaagcagcatgagactgttctccagttagcttttgttgctcttgttgccttaatagggactcttcagaaagtttctgttgctcctgctgccttagcaatgattcttgctgcattaaccattttatatgttagtttgcttagatagaataatcaataataaggacaagcataacactgaagcaagacaaaatgacctaccttcagctgagcctgcaaattttctacctccttttccatagcaagaatgtgctcatttgatacaccaactggaaatccagtataagagttgctcattacttgctgctgcagggtatttaactgtgctctcaatgatgcagagtcctcttctgcctgtaaatcataagattagcacactaatgatatgactaaggatgcacaatttttcaaaataccctgtattgctcctcttctgcctccttcagtcgtttcttcatgctccttagttgtgcgagagcatcctcctacttagcataccaggtagaagtgataatggggattagacatatcagaatcgtgaataccataaacacgaagacagtcaagtaccttagcaacagctgcggcatctttctccaaagaaatgtcattcacagcctttttcaaggagggtactatattccgctcctgcaaacagcgaattaatccccaaagtaaaacgcgtgcaaaatgtaagccatatgcatcaaactgcaacacaagtaccaaattaaaatgcacaatatgaaactcacaaggtcgttcaagcggttaacgagggaatccttctcgacttccttctcagcaatctagacgaagctatgctttgttaatactacttcatccttcaggtaactgtaccacaacaatactgaactgcagagaaaataccttggataacagcatttggttttccctctccaatgctatgttcccattttcaagttctctaactcgaccaagaagctaccattcataccaaaagccttagttatagtctagaaacaacatgagaatttggatacgtacttgccacgatcaatgttcatccgaactattcgacacaaaggaaaggggggcaaacctcagctccggctcctgggttccctacagaaaacaatcgccattaagcccacaagattagcactgaactacgaactgttccaggggaagagagggatggaccaaccgtaagggtcgacaagggacgccgcggcggccgggttgtgctgctgctgcatcctctcggcggctctcttctgccggatctcctccagctgccagacaaacgcgcacacaaaccccaacacaaatttgagcctcaaatcccagatacaaacgagacgcggatctgaaacgcctcgcgtcacagagaagcaggagggagaggagaggagaggcatacggtgcggcgcccccgcgaggcgtgattggcttccatctccggcgaccggccgacgaaccggtcggctttctggaagctcgggatccggaggcgcgacgcgaaggaggatggccgatggcgggggctcctccggtatcgcctcgatcctgtgatgcccggagaagagaaggggaagaaacccaaactcgtgggcctagccaacgtgttggccttctagagttcacaagccggcccgtacgagcccgatcgggcaggttattcagtacccccatgcgttccaaaatggagtaacacaatcctgaacaggcattttatctatgtacatagttaaaattagttttttcatcctaaaaataatccaatcctaacgaagaatttgaacatacatttcatatcttgtctagatatttagtctgaattgttttttcttcaacggagggtgatatatgaacacgacaatgtactcactccgttctcaaataattcatgcggatactattcaatttaaactttaattaactgtcatttttatagataatttataaattactagaaatgtaattatatcatcaaaatgtgtggcattacaaatataaccatcaacctttctcaaattcttttcttcttattacgtcgtgtaacaaaattcttttcttgtaatatactgacgtgcaattattttgcgcgttcgcgaaaaataaccatcaacctttcatttatagtaatataatcacttaaaactttcatttatagtaatataatcacttaaaagtgatttatggtcaaagcaggatggctctagtaaattgtcagttatttgttttagttgtgtcagttattcaagaaggaagagagtattatccactccagtcaaatctattgggtgcattggtggcggagaaaaaacacacacacaaattcaattcataattaacaggacttggacaagttagacagcacaactcaaaatcaacgatgacttggacaacatatgcagtgtaaaagcccaaattttaatgaacaaaccatcgaggtagcagtctgctttacatgtccacaaacgaccatggtcgggccttcagctgccaacctgagctgcctgataatcaggcgtaccatgcaagcacaccgagctcacgttacagtaggcagtttgggcaagttacactggatttttcgctacttctccctaatcggagcacgttctcagacatgacatatcttacacgccctcgtttgggccaacgaatatatgtacaggatgaaagaatattgtacaggtgagcggtcagtgccgctggtattgcaacgggacgagcctagcgttaacggcttcaatgtatgtgcgcaggcggcgtcgatcatctcttgttagggacagagcggggttcagggcgagtgacggtgcctcagtcaggagaaagcgcagcatggatactgccttcgagtacagcaccatggcagatgctgatttccccatcatctcatcaacctgcaatttagcataacaaaacacacaaaaagagtgggataagagtgcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45608 - DNA, 8237 bp, Oryza sativa
  unsure (1)..(8237): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaaacgggcctatgaatttttattaatgaaacacaatcgtgatgaagacactcatataaactagatgattcccccacgctgctgcgggaattggtataaaacttttgtttgcaaatttcatgataagaaatttagaaggcattgggtatatataaaaatgctagctataacttaagtcaaaatagaaatacacaagattataatttataaaaaaaacttgacatatagaaaaacaaagatgatattatgatagtatatatgttgatagcgtgaataatcgattattgaactgtcttgtcttgtgatcgaaacagacatgccctatataggcatagttcatttttctttaatataatttagagacaaccataaatgtatatgctagtctatatatgatatatgttcattaattaagaatatatgtacacaaaattaaaaagaatatgatttggtaccataccgtttagcttcatgcatggcatttggtagtctattgtttgcttggttaattgagggttgcatggttgtgcataatggggagaaataaatgtacgggatgagtcatgtatcactaagagaaatttgagccaaccaaaataaatccaatggtcaatagtagagtgactttgggatgatttgttatacgttaagtttggatctaatggacatagatatataattaaggtgatgtggaagcaccacatgagaggaaaattgtaataataacactaagagatcaattctataggttatatagatacatatataataacccttataaacatatacatacacacgacacatatctaactctacgagcaccttcaaagattggatcaatatatatgttaatagtgtcgaaatcaccacaaacgccacatcacacaaaatcatactcaaaacagccaacgacgaacataatttctctagttttttaaaggacttctttttagacgaggccaaagttcatgaaccgaaaacaaccactttaattatttgttggttttcgtagcactttgctaagatataattaagttgtataaatatgtataagtttttggttcaccataaacatgatgatctgaaacacaacattcgtgtgtcgtaggtgcactactacaaatttaaggcacctacaacttgatggtacactcatatatgtatatataccctcacctgtataacttgatggtagttgtcgagatgcgagtcgtccggacgagcggcgccctctcgtcgccggcggccagcttcgtctcggactccggcgacgccgccgcggcataggcatccttcttggccgggcatgtcgccgccggcaagctctcagtggccaagcctgctgacggcggcatgtgctctctctagcttcaaatatattcctaatgcattcgaaagtcccagtatagggctagctagcgatttatattcgtgcaaaaataatgcgttatcacgtacgcattcatgcacacttatcccctgtacatgttgtttttttaattattcataaacatatcctaccttttgctttggctaattaagtggcggcaacttttaggttcttgtgtcatgcaaaatgttaaacaagcatagcctagtgttgatatatttcccaaatttaaccgaaagaagtcaggtgtctcctttggaacatctagaaatataggcgtatatatagtatatgattgtctaattttgagctttgactccattaaaaacattttgatctttgactaacgattaatccaataaatctagatttttccataaaagaatgataatataattcttcttagttattactatgatttcataaccatataagcgaaattatataagagaaatttatgatgaaatattcctttttaggacagtcaagagctataaatgaaatgtgacgtatatatctgatattccccaaaacagtctgtataggtggcacaattgtgttttgtcgccttgtcaaataatttcacccctagagataattaaaaggtctcgcatgcttaaatattgtttcttctacaaaatatgaaaaaataaatataaagacggttttggccgtctctattgatcaccactatctcatagacatggttagtaacctgtctagggcaatggtaataccttagagatgggtcttagaactgtctgtgattacatattataaaacatctctgatttgtcctaatataagtcaaacttctttatatatatttaactaaatttatagactaatttagcaacatctggagagatggaaataaaacataagtcatgtttgtcctaactcgtataatgtgtatgtacacatctccataagacatataagacatgtgatccactattgaaataaacataacaataaataaaggtgctcatgaaagtaaatatacttcaggagagagagatatatgaaagggaaatagagtgtgggacttagatggtatgctgggcccacatggttgtattttttgggttggtgttggtactcacccagaatcatcacctagcatggaagatgttgcaaatattattctgaatagagaatgtctcgagctttactacgacctatatagatgaataaatatgaaaaaaaatataaaaataaagtagtgattataataaattataaatgatatgagatgtttgtatgagttttaagatatattttttattgaataatgatgaggcttgtttgcatgttaagttttaatgggttgtagctatatgtgtgtagtgttgtatcaagttctcttcacttggtaatggtaagcaagcacactatataatcatgcatgctgttagttgtagatccgcgtaattagtttaatgcatttcttgctgacgatcgatgcatggaaacagatggaactctcaaagtgtactaatgcagaatccactttgcatctcaaagtgtactaatgcagaatccactttgcatccaccaaacatgcaactggacttggcaaacacatattccattcaagaaacggaagagccttcctacgcaccgtccactgatcatcactactcttgctgacagaaacaaacgagatgcccgcactacaagaggaaccccctttagtaatacatatatgtattgctaaaagtctctataagtattgctagggtctgcaccaacgtatttaatatgcgttgcctatgctgccgttgctaggatcaattacaacacatagacaaccgttgataacaagtggaaataagcgttgctacttagcaacaattttaataggtttcagcaatacttatatatgttgttcccttgagagatgaacagttttatataatcttagcaatggatataatcaagttgctgcaacatgtacaaatattgtaatttgagctatccactgtaggtggcctttgaccaattattttgtcaggcaagagacccatgaactcaaagcatgcacaagtgacaatagtccaatcaatcatgataatcgattatatattaaatatagtattttgcattacatagacaatcatcagtataattcatggcattaaacctttgttcagaacattaatgcagaaaatagaatctaaagtatataaaaaaaacacatcttgttgcccccattctccaccttgcagccatcatcattccgtgatatgtacaggtgacctagttgcgtactggcagtcacgaaatttcccccacatcttcacccatttatcttgtcaacctataatagaaaaaatatataagcattaatataccattatgaagacgaaaagcacatctccgaagaaagaagtaagagataggaacatacaaaaattgcaggctacgcaatttcaagtcctacaacatgaccaacaattttgtagcctttgtatggcctaatcaaatcttcggattttgccaatgcaagatcgacatgaaccattaaaaattcatttcctagctcaacacctccaactctgtgtgttggatcacagcttacaatagtggcaagagccacgtttgtattccgatttttccaactttttaagaatactttagttccaacctgaagtgcataaatacatccatcaatattatcaatgtactttaagaaattcaagtatcataaataatttcacagtaaaatacctccattgaattgtcagtgataaagtccattttgttgcactgttgtttctataaaaaaaatttggatcatggtttgcaatttaaccacaagatagaaagaaagaaagaccaaacagagccaattattgttctccaattgaatcataatactagtgaatcatgcatgttatagtttgaatggactgatatttgtaaacatggtgaataaaaaaacaaccttgtatgcaccaccaactttatgtgcatgtaccatatggctttcctgattgtcaggtttcttgttctataggggagggcaacaaatcagtgctaaaattatatatattaagaaattttactttcaaacttttctatcaaataatttttgaactaaataagaagtgaaaactaaccttggcacaaataatctccatctgtttcccatggtcatttaggccaaaggttcgtttgttctagaataaaagaatacatcacattgtcatgaactatagtaaacattcatagttagttacaaacagtaccaaataatataatgctatgtatccatgataaccatataataggatgcaaccatggtgagttcagaataaaaatataaattgaaagacaaggaccttgtgtgcagtagcatgcttggttggtggtgtcttatcctcatcttgaacatggctttgtgaattctgttgtcaaagagagcatatattcccagttacaaaatagtgcaactattcccatgtataaaacaatgaaatttatgtatattaccatcacaatgttttcctgctcaacatgacaaatttcttgcaagggaccgtcaccatacactttctatcacagtggaaaataaaaggacattaagaccagattttattaaactatttagactaaaatgttagcaaggtttaccactgttgaattgtcagttaaaaagtccattgtgttgcattgtcgtttctgaaaaaatagagagaatttacagtaaaaaccaacatgctgtgtgtgctattttagttgttgtgtagtgttcaataaatagaaatagcattttgaacttgaaacaattagactaaccttagaagcagtactatacttgtttaggcttggtctaacaagcttgcgggtaaggttctctttgttctgcaatacacatgtgtgttatagtttcaaagagcttatatctgtagacatggtgacttaaagtgatgaaaaaataaccttgtgtgtacttgtaactttgtgtgcattcaccatatagttgtcctggttgttaggtttattgttctacagtggaaggtaacaaataaattttacaaatctatatatacatttatatatcgaaattaagctactttcaaacacttattgactatggcattgagtttgaaaggataaagagagaacttaatcaacttaccttgtatgcactagaaatactcttccctggttgcataagctcattctggtccaaatttcctttgcgctgcaatggaatagctcataaaattggcacaaactataatgttccaattatttgtttactctgacatcatgcactccaattaataaaaaagtgaaattaaccttgtttgcacaggaagtaatcttcctttgcttcccactgtgattctggcccaaagactgtgtattctagagtaaaagaaggcatatgattataatgaatgctatgtaaataatagtgaatatatatatatataataatattttaaatgcaaaggcaaggaccttgtaaacagtagaatgcttggttggtggttgcaaattctcatcgtgcacatggctttgtgtattctattgtaaaagagagaaaataaatgctattcccaagtaaaaaaacacagctattcccagttataagatggtgctatatcacattaccatcaaactgttgtcctgctgatccataatgtttccctcctcaaacatacaaatttcttgcgaggggttgtcaccatacactctctgtccataacagaaaatgaacagagatctataccacagtttatgagataatgcagaaaatgttatgatatttcttccataaagatacataccctcctttttgaattaggtacgtcatcacaaatagcttttttgtttgttgacgctccatctaaacctccctgttacttcaattaggtaagttagatgcattcattgggtcacacacaagctcatataatttttttaggactcaactcccttaaattcacctgattcttttgtgccttttccaacttggttgccttctcttttaattgtaaaagttcagcatcattattctcaacatggcgttctaacttttccatctgcagtctaatagccattacatcttcactggagttatcctccactgtagtaagatttatattctgcaaacgtcgggaagttggcacatcaagcacttgtttaggctttggaactagtccaagaccatgcacacgcccaggcttgtcatctcctagtatttggttcaatgcatctcctttccaagcagtctttcctttactagcatccgctaaagctagttgttcagctataagtctcttcaaattatcctaaacatatgaaaaattaatacgaataaaacaacatatgagaataactgaaaaatatctatggttgagtgttaatagtataccacatgcccatttatattcttgtcacttttgcgcttgtgtgtgtggacataaacaacagctctatgtggtttcttctttgcaggatctttttgtctctatggaacacatgaccaaatcagtaaagtcttaacagtagctatacatgcttgaaatggaaatagatgaatactattcaagacatgttttaccatctcttctcttgtgtgagcaaaactctttgtccctgctgtgtgaattgccttcttcttttggcagtttttcttattctgctcacttattctctgttatggtctcgtagagttagcaatcaaaaaagaatattgcattgttttgtttagtacagagttctaatttgtaagaccattacagaaatgaatatggtacatgtaccttcgatttctcgttcatccaatgattgacaagagcaatccactggtcagaaagcacaccttctaggacattgttgcaattagcttccttagtctcattcacatcaaaatacaaatcttttagttttgctttatattgccaccatctttctacaattttttttaatatgaactcttccatccgaggagcataaaggaatctcatctacatatagcaacacagaaactcatatggccatatggggatatgcataacataatacaagaagttagcaaaaatgttgatctgaaaaggaattaccttacttgcttaagtatgtcctttttaacttttagttcatttgtatttttctctctctttcctattacatatctccagtctgtgtagcctaagctacacagactaccattcctagctaccattccaagaaatttacccaaaattccagcttcttcccctaccgcctgattgagatcattgcattgaaccacaattctaagccctttcggaaggttccaaacatctttcagttttgtcgaaaggttccaaacatctttcagttttgtcttgccacgtgtttcaggtgctccattttcaactgttcggtgttaaattgcaaagacaaaagtgatccttagtaatcagggatacgagtaataatgtcattatttcttaccattaggactgttaaacttagcagttacctcgaacattaatatcaacatcagtatcttcattgctttcatcatcaatatcaacatcgtcattagtgtcttcattgctttctccatcattgatatcaaaatcgtcatcagtgtcttca

SEQ ID NO: 45609 - DNA, 13467 bp, Oryza sativa
aatgctataatatggatctgtttgtcatactcactaattcatttgtccattttataggccaacaatttgaaacaagtaatgggtagaaataacaaaatttaattggctgcaaggtaaaactagatcacatattgtattgcttacagttgtgtgaagcctagccgtacgtagaccaggctccttcagctatggacggtcagtgcatctgactccaaacctgaaaatagaacacatcaaattggtaagtattgtagtactggaagggaattagcctccattgcaatttggcgactcagagaggtagtaagatgtgcagagggaggcagagattccggggcttggaaacattgccgccaaccgcgcggggtggagcagagcgaagtggacagccggtgtcgggaggtataacccgcatcaattgcagtgccccggtcacccagcacatcggctgggggcgtctccggcccgccgcatgccctacgtcatccatgccctacgactggatgaaattcggacgtaacatattttggttagttgtttaatttatctaagcatgaccgaaaagacacgtgtttttccatggccaatccggtccggacagaccgcatgaaaaagacatgtaatatatttttggtcctaaaatatagttatttaaaaaatgttagcacgataaaaaaacacgtgtttttcgttgtcgacccggtccggacagaccgcatgaaaaaatatatataactaaataacagtgatttaatattttaggacaacaaaaaaccacatgttttttcgttgttgacccggccggacagaccgtatgaaatctggacgtaaaatttgtgttaaaatagtagttagttaatttatcatagaacgaccaaaaaaacacgtgttttttcgttgttgacccagtccgaacagacgggatgaaattcggacgtaacatatttttgtcttaaaatagtagttatttaatttatattagaacgactgaaaagacacttgtttttccattgtcgatctggtctggatagactgcatgaaaaagtggcataatatattttaggtgttaaaatatagttaattaaaaatgttagcacgacaaaaaaaatcatatgttatttcattgtcgacccggtccggacagaccgcatggaaaagagatgcaatatatttttggtcttaaactatagttatttaaaaaatgttagcacaaccaaaaaatcacgtgttatttcattgttgacccgttccggacagaccacatgaaaaatatatataattaaataacagtgatttaattttttaggacaacaaaaaaccacgtgttttttcattgtcgacacaatccggacagatcgtatgaaatctgtacataaaatatttttttgtcttaaaatagtagttagttaatttatcatagcacgacaaaaacacgtgttttttcattgtcgacccggtccggacagactggatgaaatccggatattctgaaaataagttttcaaatggtttatttttaaaattttaaaataaaaaagttcaaaaaattaaaaaatttctggggcaacagaattttttttcccgttcaaggagaggaaaaagtttttaggaattgccactagagaaatgaaaaaaattatgcatttgctagttctcgaactagagttgtcaatacagtagaagaagctaagtaccactaggctatgtccccctttatttattttttcacgttagctgcaattgagaatataaatagacagaatataaatagacttctccaggtatttatataagatggaaatttaaattctgttagcacgaccgaaaaggcacatgctatttcgttgtcgacccagtctgtacagaacgcatgaaattaagacgtaaaatatttttggtcataaaataatagttatttaaattatatttgcaagaccgataaaccacttgttttttcgttgtcgacccggtctggacaagccgtataaaatcaagatgtaaaataatttttctttaaataattgttatttaatttatgttagcacgaccgaaaaaccacatgttttttcgttgtcgtctcggtccatactgatcgcatgataaaatccagacgtaacatattttgtcctaaaataatagttggtgtggccaaaaatatttatattgaaaaaataagttttcgatcagtttaattttaaaattaaaaataaaaagttcaaaaattctcgttatctagccagctaagaaggatagggaaaaaaaattaggaatcgcccctagaaaaaaaataaaaaaaatctaggctggcatatttgttttcctcgttatctagccagctaaggagagggaaaaaaatttaggaatcgccactggagaagaaatggaaaaaaatgcatttgttaggatttgaactacagtcttcgatacggctgaagaagccatgtaccaccaggctatgtccacttcatgttggagttgtccgttcgacttacttattcacgttaggtgccattgacaacgtaaatagttttcttatataggtggaaatggaataacagaacacaatagatgcaaagattataaacgcccattcctttttctcatcatataaacaatatgatatcctggatatttaaaaataagatctaaccaccaattctgtatataactaatgtagaacattattacaggacttatgtatgcaaataaaaagttgaatcgatctggctcaatcacttagacaatccaaggaaatatacgaatgacattttcatccagaaaagctattgtggtgaagaagccttcatcgcagtaaatctcaatccaaaattactgccataaaaataaagtgctccccaagtgaagatataaataatataaggaaatcattgataatggacagatagatagtgaaaaaccttcataacctcacctttaattagttaccatgttatcgacagttgttccttctatatctcttcgaatccatgtctgaccatcatgtgcactgtcaaatagctccccaagattattgacatggtatggttcgcattccacatcattccattcttcgcccagttcaaatacatctctgggtttcatattccttacaatagaccaccctggatttaaatggtcttcaatgtaaaacacttggttgacttgatttgcaaatacaaagggctcatgctcaatcttttcaccggtatgaattttatttgagaaattcacaagtttgcagccaaacttatctattttcactcattttcctttagttacatcgacccattcatatttaaacaacacaactgagaaatttccatagtagtctaacttaattatatcaagtacccttccataatacatgatatcaccaaggatagggttagtatcactggcggacgtgtagctcgatgtttttacagtcacaacaactccactgttttgagtcaccctggcataacgctttgatctgaacctatacccatgggtattgaatgctctatgtcgttttgctacctcaattggtccacgtgctagccatctaatatcctcatcaatactatcgatacctctttgattctccaactgcaagatctacaccaaaccaaaagatgtattagtatttgaaaaagagaaacataaattttgagacttacataatctctgaaccaatcagggaattgttcattttgcatgttctcaatgttttttggagttagccttttgcgtttcttcctttgcaaatcagcagcatgttctctgcaaaacaaataaacataaatttgaagcaaaacacttacaacacataaaaaaaggctatgttaggacaatacgtacttcagatatggcactatagcatcacagttgtatagcacatatctatatgcttgcaatttctctctatcagttaaggagtacgccgatggttttcccaatggttttcctactggaggaaacaaagtggattcttgcctactcatgggagtctcaaattgatctggtttgtcattattccttgatggtatgttatgcttggtagagaaaccttccaagtatcgcgaacaaaatgccatgcactcatctgccaaatatgattctgcaattgaaccttctggacgcgctttgttgcgaacatacgacttcaatttacccaggtacctgtaatatacatacaaggcacaaaactaataagttagtattgtatcatatgacatatgagaaatattataaattgtatgctaatatatttttagtacctttcaataaagtacatccatcgatagcaaactggcccagcaatcttacattcagtagctaaatggacgactaagtgaaccataacagtgaagaatccaggaggaaatatcatttccattctgcacaatgtgattttaattgcttcttccaaacggtcaagctcatcaacatggagaacttttgaacatattcctcgaaagtaagcagataagtcaaacaagacagatgtgacttcatcgggaagaatacccctcaaagcaattggcatcaattgttgcattagaacatggcaatcatgtgttttgagcccatgaatttttccttcagcagagttcacacatctagatatgtttgaagaatagccacaggaacttttatatccctaagaactttacagaacaattgcttctcacttttggacatagtaaagctggcaggtggtaagtagaacttgcttgaagttctttgttgtggatggagctcccctctaatgttcatttccttgagatcaagacgaacttggagattatcctttgactttccttctaaatttagaagtataccataaatattgtcgcacacatttttttctatgtgcatcacatcaagattatgccgaagaagattgccatcccagtaaggtagtgtgaataaactacttactgccttataagtttttgacttcttaaaatcaccgatagcatttatttcatccaataccggacgcccatagtaagtcataggctctgtactaatctctgtggttccatcaaaagaatttctatcaaaacgaaattcatgattaggtggcaaaaatcgacgatgacccataaaacaagatttcttcccatgtgccaaacgtttggaccatacatttggaccacaaggcgggcatgcaaattctccatgcaccatatgtgaagcaagcattcctaaagttggcaagtcatttatagtccacagtacagctgccctcaaattaaaagtttcatttctaaatgcatcatatatggaaatgccattgacaaatatgtctcttaaatcttctagaagcggctggaggaaaacatgaatgttatctccaggacttttgagcccaggaattattaatggcattagaagattaggttccttcatgcagagccatggtggaagattatatattactaaaacaactggccagcaactataggtagagctcaacataccatatgggttaaacccatctgtagctaacccaaatcgtatattacgagaatcagatgcaaattgcttgaaccttttatcaaagttcttccatgccggagaatcagctggatgtcgaagcacaccatcctctactaagcgctcttcatcatgccaacgtgggagcgatgttgtttctctacacatgaacaatcttttcagcctctcctttattggaaaatatcataagactttgcttggcgttgctttctttctttctttcttcgttaacttggtttctggttttttatctttccatctagaagccttacaagttgaacaaaaatcatcattaaccttctctttccaaaacagctgacagttattgggacatgcatgaatttgttgataatctagaccaaattttgaaaccaccttcttagcctcataaaagttttttggcaattcttttccatttggaattgccatgtgaagaatatcaagtagatctccaaatgatttatcacttcatttgttcatggatttcatattgaacaaaagcactagcagagataagtgtgatagttcacatccatcccataaaggcttctctgaatctttcaccaacttataaaatgcttgagcttctaaatttggtccatcagtgtgtgtacatggcgaatctgcagaatcactcataggcatgtcgtcatacacagtcctaagtgcatcattaattaattcgtgcatgttagcacgcatgtcttcattgtgaggctgtggttgttggttcctaatttgctcctctgaagactcaccatgaaaatcccattggtcataactctgaagcattccattgcacaccaaatgatcatagacatcattttttgaaagtagcatagtatgtacgcatgtttcacatggacaataaatctttgtatcctctaacttatctttatatgcaaattcaagaaatccatctactccagctaagtactcaacagaacctctagggtagcgcaaaagaatcttgatggtttctaaatccatttcgacctatataaaaaatttgatatttcaggttcttgtagataataacaatgacaaggaattgtctcttatgatcatgacgtagcaaaaatagggcaattagaaaagtaccagtataaaatcagtgtcagctaattttgtcacaacctaatagacctcctttatacactgaaacaaaagcttttactctgcaaaaatagagaagagctaaatcaatttacagaaaaaacatccagcaatctaatgtcaaagctgtcatctccaagttaaattccttactataaattacctctagttaatctacagatgatgactccagaagcacatgcgtttaaaacctatgttccaaatatccgttcggatgaacaagaaaaatctgcaggtgttattaaactcaatcagatagactcatgatgcaacaaacctgaataattaaaaaaaattgacattgacctggatctgacactgacctggatttggggccaaatggggaatcaacctatgagaagtggctaagaaaaggaccgtgcttgccgttgacccgctgtcgtcggcctcggcccgtcgccggcctgccgcggccgatcccctcgcgggctcgccgccgccgctgctgagaacgcgccgctggccgccgatgtgcgctgccgccgccgccgtcggtgtgcgccgtggcagtgatgtgcgagagcgtgagaagaaaatgagatgcggtgtgggaacaggatggggcggcgctctcgtgcgtgttgggtgaggtgagagacacgagaggagaggagagaaggtgggagactaaggttgcctgctaaactgctaatttcacagatcgtattttagttgttatgatataaacaactaaataaatcatttgataagaaatgtgattagctcagttggttgggttgcgcatattctatcctagagacccaggttcgaatcctctgtttgcatctttgccccactaatttattcctatcaggtatcagcagccacttcgcttgtggaatttttttaaaaaataaactcgcttgataaattttttagaaaacaaaaacaacacttttcccaataaactcgcttgataaattttttagaaaacaaaaacaacacgcccaatacacaatgtaaaaaaacagctcgctcaattattattattttttaaaaagcatgcttagtccaaaagttttaacaggaaaaaaaaagcaactcacttgataatttcttttaaaaaacaattcgctagaggtccgaaatgtaaaaataaatatctcactcgattattttaaaaaatacaataagttcgcttattccaaaagtttttacagggcatcaagaccattgcaaattcagctctgcaacccatgttctgcaacacatattatctattacaaattaggctcacccactactaagcgttgctagggtcgcattttggcaatgcatccttaatgcgttgccaagcatgtattgctagagggggttcttgttgtagtaacgcatcagttatcaaactaacaaagtataagtaaaatattactacgaaagaacatattgacaaatctattaacttaataaattaacagaaaatttagccaccatgtcctctcacgacttagaaattcccacaattaatcaagattaaattacactagtggaacaataacttggtaggtgggtatgatttagtggaacaacttgtaaaatgtaaaaaaaagtataaatttggtaatcacgtgcattttgataaaaacactgttacatatctatgattcatcctattaattttgttgtttgtattataagaatatgtttcgtagtgctcatcatcggaaacaatgaatatttgattagtcaaatcgcttgaaaattatattagtttgcacttagttttgacggtcattatattttttcagtttcaattcgataggttgtttcattattataaccatgcaaatgcaatacatttagacgcttgtcgagaactcgagatagcctaagtggctgctttttctacatcaacgtaaggttttcggtaggatttttcgtccgtccctttttttcgcatttttttctttttttcgccgctttttcttaggttgatcgagaaatattcaatcagattttatgggatgattggtttagcatcgtacggatattcaatcagatttgatgggatgattggtttagcatagtacggatacgagactgtttccagatattgaagacgacaatcggttatgcgagctaggcctaccgctttacatgtgggctaggtcaaatagagacaatgcaactgctttacttgtgggctaggtcaaatagagacaggccaaacagaggaaggtaacgggctggactaggagggaggtaacgggcaggactaggactgaaaagaggaagaaagacccaaaataaagagtataatgtatgctatacacaattgtttttagccgttgcaacgcacaggtattttttctagtaataaatagatagatatcaaaaatggcaaagtgcacaaactatttttaattctaatagtaccaacattgcaccaacatcctaatcctaaatgaaaattgcagaaagggctaaatagttaaatataaattcatagctaaaatagctactttggtccaaaacaacccaagaactgcttgcgaaacgcctccttgaggttctgccgggtgccgctcttgcatggctcatcgtcattgtcgacgctgcatttgcagatcatcatcaggccatgcaggtcatccggcccgagctccgtggacatcgtcgccgccgccgcggcctcctcgacgacggcgacgtcgcagtggatggcgaactcatcatcggtgctggaccactggctcgccaggacgtcgtggcggatgaacgtgaagcagcagtactccgccttcccggtgccgtggaacgacgtcgcgtagctcctcacctcgttcgtcggaggcacgcacggctgcagactgaccatgcggaaccggacgttggttcggatgccgccgccggcggcggtggcggtgccggggtcggcggcgtggagcttgaggcacacggtggagtagccgttgcccgaatatttatttgctcgagttggggtggaagaagaagctccaggtgtgacctgcggcctggaacttggacgactcgatgtcgtatttgctgccttggtgagatttcttgatcgcgttgcgtattttgatcttgagaaagttgcaaccggaggtggccgccgaagtagaggtggccgtcgacgcggtgacgacgtcctttgtcggtgacgacgacatggcaagctaactagcagctacctggtggtgtgatggaaataacatgcttggagacattgatcatttcatcaatttaaatgcctaatgcttagccgcacgatcagcatgtgttggatgaaaagatgcttgcatacaacaacatctgctgatcgagtcaatcacctgaagacttagttctcacgtgaagagagaacgtgtgcttgtggccgtttggcggctgcgtttctcacggagccgatccggctttgacgcggaggagcaacggattgagcgtgggctgctgttcagtgttagctctatataggagtcaaggagacgtccttgaaggatacagaacacaatagccatctactctgaaattcctctactgccgccgtgttgcgtcgccgtcggtccaagccggccgttgtgctcgtcgtgcaatgagcatcccggtgagcggtgtctccgagccttcgccgcattcgcacctgcacgggggcggtgtaaaggtttctgggcaacgtatttctacgcggccgctcgacatcatcgattgactgcactgcttcgactcgctgatctccgtcgatccattcagtgagtgaattctttcgtttacaaaggaaaggaatctagttttgatcgtacctgagttttatatatgcatggtactgttcatctagattaaaatattgtggctagattaccattgtgattagcttaatgacctacttagcttggttatttatgccttgtttgatatctagcatgatagaatttatgagtttttcttgtcctatcatgtcgcaagtaggttatgcttgctgtatgtgctttcaaataataatgcttggaataaaattaatggctaagtatgtattatttccaacagtggtggtggtggtggtcgacggcgagatcaatcggggacgaagaactcgatgcagggttaacgttggttaaatagattataggagaggtaattaaccacacgtttgacgtacgtacgcccggctatatgccctatccgtattgtagtttggttcggatcatgtatagaagaaaattaagcctggtaattatattagtagtatatctttatcaacttcgataaagcagttgttactgggatatacgtacgaagcagttaatatgcaacacaagttactacagctattaggtcagttaattttagttgggttccgatcggatgcaaaccgttacaaacagttacgtttagagacgggacaatatcaggttgttacggtagataggaatagttttaatgtttccatggtacataatccataatccatgtttgagtcggttataaaaattgaagatgttttttggttcgttatacgtgtttgagtcagttttaattttatgttttggttttaatctatatgtcctctctatctctctcttattataaaaattgaaaatatttttgcctattttagtacgtcgtctgtgtaagtttttaagtttgtttgcttttggaaatacaaattgaagatgtttccgtgattcgtcatccgtgtttgagtcgattttaattttataatctatatctcttctctatcgctatctctatcttttctccactattataaaaattaaagatatttttgccggtattttggtatgtcatctgtgtacgagtcggtttttaagttcatttgcttttggaaatacatatccatatttgagtcggagtcggtttttaatatcgtttacttttggtaataaagaaggaaacataaaaaaaatctgcttaaaaaactcgtatgctaatttaagacgatcggactccgaactgcagcttatgattttgtaaaagaaatataaatccaagcgaacttcgacagtgaatttcatcttaactaaaccatataacaattataagattaaaatagacttcacccgttgcaatgcatgggcatttttactcgtggattaaaaagtatggtaccgaagagatatcttttaaccagaaagtacgtactggataagttattacactatatatatatatctatatctatatatgtactcatctaccaagtttatatagtgtagacgcaaactactcactaataaaaaaagaaaacaaataaagtccaactatatatgcaatttaaaatatctcacattttgaataacaattaaaataagagtccatgtagaaattctatttagcaaaaactgaaattgtgattaaaaattaagaaacaatgaatattgagataaaaatccatgtagagatataatttagggaaaaatctgaaatgcagattaaaattcaaaaaataagtaatattgagacaagagtccatctctaagtctctctgttcctaagtcctggttcccaactccctccgcctagttttccacgcgcacgcttcccaaaattgctaaacgatgtgtcttttttaaaaaaatttctatacgaaagttacttaaaaaatcatattgatctatttttaaaaaaatagctaatacttaattaatcaatggactgctccatttttcgtgcgcaggagatgggttaccacccattccagtgaacacagccaaaatacaatttaggaacatctaaaattaagattaaaaataaataatattaacagatatagtccatctcaaaaatacaatttacaaataagtaaaactcccattaaaaaaatattatggcgaaaagaattcatgtgcaagtacaatttcgaaatatcttaaatccaggttaaaataaataatattaagagaaagaatccacatgtaaatataactttaaaatatcttaaatataggttaaaaataaatattatagagagtccacgtagaagtaaaattttaaaatatatataattcaaataaaaaataaacgtaatagagaaaagagttctggcagaggtacaatttagagatatttcaaattcagtttgaaaataaataaaattaatagaaatggtccatatagaaatataatttagaaacaatttgagctggagttaatattattgggaaaagatttcatgtaggagtataatttaataatattttaaatctacattaaaagtaaataatattgacagaaagagtttatatttttttgaacgactcacacgagacagtgcgaagttctattgatagagcaggaaaaaaattacaagactacaaccctggagggtcataaccaggaaaaaagaaaaaatataccaccacccacacatcgacatcgccaacacaccagcccaggagaagactaccaccggaccggacgccgctaagcgtgaccgaccgccactagaccaacaaggggacacagacggtatcacccctaggggatgccaaaacgacgtcttcaagaagagaagcgacggagaaaccgccgccgcagtctatcgggactcaaaggagacaagactgggctttcacccggcaaccaccctttgaggggtgagacagaacgacaacgccctcaggagggggaatgaaccatcgttgtcggtctggcagaggccggactgggttttcacctgccgctcaccacctgcgaatccacggctaacgcaccgatgctccaccaccatacaagctctaccgacatgtggggcccctgcaccggcgtcccccgccggccagccttcgagcaccgaagaccgcgccacacccaccgacagct

SEQ ID NO: 45610 - DNA, 33735 bp, Oryza sativa
ggtgaccgcagacgcggtcatcaccaccgcagccactgttgccgaacgcccagccacctcgccgtcaccatccttacctcgctccctactcctttcccgcctccattgctatcgtcagcgatccgcatccgccaacgtcaccaccgcctccacggccacggccgctgtcgccgctgccaccgacgccagccatcggctctgcaaaccgctgcgccgccaccctccgccaccaagcagccagctcgacgtcgccgccatgccctccgccgccgtcgccagccgacgctgccgccgtcctcaccgcgagcagcaaatgccgcgagcacggccgccgccgctgtcgccaactgccgctgcaagcaccaaatgccgcgagcaccactgccgctagcaccaccttgagcacgtgttggtattttttaacgacatcactagaaatataattttggtatattatggttacagagttcatccgcaagcgcacgaatataccattgtagcatttcacccgagagtattccaagggtatcgtatttattttatcccgtggaaagatcatgtagagagaactcaactaataatttatatattacttgtgataatcatattctaaacaggggttaagataatccaagggtagagtgacacacaagcattactactcatcctcataataatttatctaagctaagtggaaagaaaagagaaaagaaatctactcctatacttctagtatacatgctatacatacattctagttaactgatttactagctaataccctctatccgatgccctcctggtactttgagaagccacccctgattgccgagttccttacgacagcccgtcatgactatccaaccagggctaaatacggaggaataccctccccaggaaattaacttaggattacatataggcgtggaggaatacccgtactgagctgtcaccatcagcagcccacctctcatccgcaatatataaccccaaataatgatatcccgtaatctagacaccacgtctaaactaccagatactactctaatatcatcgtcatgacatagagtaattgcataagcaaacactatacccgcaccaaagcatctcccagataagctaatcgtacattcagtataacatgaacataatgtaaataggtactcatatactcggaaagtatttcaataccataaatgtatatataagagtattctaataaaagtacaaagcttacaaaagaggaaaggaaagctgctagagctatacacgaactcttctgaaggcttccagactcctgactcctattctatttctattccaccagttagatactactaaactaaacttgagaggaaagagagagctcttgcttgaggtgtgtgttgaggtgaagagagtgagctccttatataaaggtggttatgacggttgtggaaggggaattgtccgaagtaccccgcaaccgccatcaggagaagatctggagcgtccctgccaaaccccacagccaacggtggagaaatgggttcggacgaaccaccaggtgcggccgaaccatcaggttcggccgaacctggggctggctcaacgagcccacaatttggctggtggcctcctggacttctcttctccacagacttgtgaattttggcccagtttgtcgtgtcaattctgagttcttggcccattcatacacaagtctgattctcgacatcgtccgattgatttatcatttgatttgatgttgattctcctccattttattgttattctctgcaaaaggttagtatacctaatactagtggaatattattgctctcatatttttgcattgcaagcatcactagttctctcctattttagtaatattgacggtagaaactgatcgataccgaccgtcagcagcacaaccgccgccgccgtctccaaatgccgccgcgagcaccactgctgcgaggaccaccacgagcacgatcgccgtcgccgtcgccaactgccgcgagccccaccgcgagtaggaccgccgtcgccagccggccaccctccagaccgaccgagaggcgcggatctgggggacatcgccgccatcgccgccatcgccaccaccgccgccatcgccatccccgccgccgccttcacgtccttagccaccgccgccgcctgcgcgccctcagctaacgccatccccgtcgccatcgccatctccaccgccttccaccaccgccgcccagcaccacgtgcccctgccttcgccgtcgccctccccgctgccagttgccaccccgccagatccggctggagcggcctggatctagcggccaccatcgcccgccgaggacggctcccccgcccgcccgaagcgttgtcggtgagaggcctcgccgctaccgtccggccgcttgggcggcggcgaggcggagggggaggagggggaggaaaggggcggctgggtttccgcctcccgtgccgcccgaggggaggacgacgcaagaggccttgtgtcttgtttgctcatattaattgggaagcagccaagcaggagcatatgcacgaaatgctaccactggtgacctatggcggcaggagaggaacacacaactggctaaggccaactagcatggtgaaggtcgctgccagtgggattggaattgggatcctctgatgtgaagtcagaggaacgtggtgactgacatgtgggccttagtttatgggcccaccggtcgaaacatgaattcggcaataataaaagcgggtagcgcacgagacctaaaagtggatggatgcggagacaaggatttagacaggttcaggccctctcaatgagaggtaatacgctactcctgtttggggatttgaatccaccgggtgtagtatagatctgatgatcaggtgtgtcatgccccctagagggcctcctgcccaccttatataggatggggggtaagattacaagatagaaaccttaaccaatacggtatcggtttcctaaatctattttacaatattatcaaatcaagactttaggccgctccataatataaaaggaaacgtaatacccaagtcatgatctgttacatattccatagatataagttatcccctatgactagtcggataaccatgccgtgtgggtatagggtacccataatctccacagtagcccctgagaccttcacagtcgaaaagataatattctctcaaactaattactccaaagccgagtgcttcaatcatctttgccatggtctcccgagtacttttaccaaatctaaagactgtggagggttgaaaactaaagtcaggtgcatcgactagatgcacctaataggtgtagcccccgactatgtggttaattaaacaaaccaagcatatagtcaaggaataaataatccaaccaaccgagtggtttcgataattgtagtcaaccaagcgacttgatattaatatgtagcatatgcggtgtgaatccccaaataatataatccaagtgatataccgacttctttgtaaaaattgatacgagcaacctaaagttgactacatcattgaaaattcacatagcaaaatagctataaaaaagcttgaatgctatgaataaagaaatttccaaagtatcaggcatacgccatgcgcacactgctttaacagatatgcttaagtccctaaaagacacatggtttcaccacactcggaaatatacggcatatatggtgtaaaatccgagtaaataaactcataaaggatttaccaaccgcctggaaaatgaccaagatatataatcagcctaagccataatattggtcaataaaaatgcacacttacgtggcaaaaagcaatgatattgtatccaatcaattgcttaaaaacccaaacagcaccttgacttatataaaaaagtcagcggggcagctgtataaagctttactgtttgacaccttttaagatgcataataacaactcctaaaaatttgagtaactgcggtataaaaggattttaaagcattgggcacttgatcacgcgcactttggcctaagcaaaaagtgcctaagtccctaaaagaacgtgacaggccacacctgaaaatatgggctgcagacatattaagcctaggacaaaaaatatgccttcgaaaccctttaaaggatgacgcatgtaacatgctcccgagtaataaatcttccgggttatatagaccaagtgtagctcgtatgaatagcttctgatctgagtgattatcccttataggatactccaaaatagatataacaattgaatcccgactggcgcaagtattcggttgataacccttacgggaaataataaatagtccagtctttgagcatagaaaatagacccatgatcatgaattcatgttgcatgtatccggaacaagtccaaattgaaggtatgatacttgtgtttgagctaataagcccctgagtatatagcttgtccttttgtcgtaatcataattgtccattgatggtagctgacacagttggcatagagacaagacgaccaatatagagataatattgcccaccagaggtggcaaaaatattggtggtagtgaagatagtgataccaatcaaaagtgatgaagttgcacagccgtggagatgaagaaaccagtcggcaacaatcaggtcagccaataatgaagatgaaggcgcccagagataaagttgtgtagccatggcagcgaaataatcagtcggtgacagacgaggcagatcaaagacgatgacgaaatccaccaatcatgaagatgaagaaaatagtcggtgacgacaaacgcaaccgacaataatgatgataagcagcaacagagatgatcgactatgatgacgaagttgcccatcaaacagcagtagcataggctatgttgaagaagcttgacaggatattgatgaagatgacgatgtcggtgatccagtcaatagcaatgtagcaaccaatggtaatgatgaagacgctcatcagcgtttgcatagtagatcaaccgtgaaggcgaaataacaagccgacaatgacggaagtaaccggaggcgaggacgtagtcatccattagcaacggcagagatgtcacggccgatgaagtagaggtgctggtgatgaagtcactgacaataatccatcaaactgttgagaagatatcgaagcttaagtaattttcttgatgtgtgtataatgaagattgatgcaacaccccttgatttgtaaagatggcagtagaacttggagttgtagctgttgcagatgcttcacttaaaggaaagtaaatgctgttgtccaactcatcgaaactgagctgattggttgataactctaaactcccagacatgtagatagaatctcaaacttgatacttgaaaattttggagtagattgtggcagcgtggagaagccaaaattgccggtgaaatcattggagctgctgaagtagaacacttgctctgaagcgaagacaaaacttataactcccgaagtagattccatagaactcgttggctgatttcagagtcttgtatttgtgtagcccccgactctttggttagttggaaaacaactgaacatagagtcgagaactgtagcttcttgtcgtcgagtagtcattgcaatcaaaagtgaagatgcatgttgaagatgtccgagtaaaaatattgaagatttgaacaccacttgttataataacatgacatcatatttagtgacgcatgccaaaatgtcgaggctcatgtagacgtcgtggttggtgaagtagcaaaactcgcgaagtagcagcaatagagtttgccggtgccgaagataataaagatgaagtcactccaccatgatgacaaagttgcatagtcgtgatgaagtgaacatgagtcggcggcaacataaccagtcggcgatggaataagtagaatgatgacgaaaacgaagacgtccttgaacggcagcaaaataggccagccatgaaagtgaagacaccatgggcggcggcaaaggcaatccgatgatgatgatgatgccagtcaatgttgacgaaaacacgtagccatagaggcgaacaagccagtcggcgtcagacaaggcggccagcaatgaagacgatgacgtccatcaatagtggtagcggtatataccagccgtagaggcgagggcactagtcagcagcagacgaaacgaccggcggcgaagatgataaggccaatcaacagtattagaatcctgcagccatgaaagtgaagaaaccagtcgtagacatagacaacttgagttgaaggtgatgacgcatatttgtggcggcggcgacgtggccagccatgaagaccatagcatcaattagcgtcatacgaagcggccggtcggtgaagatgtaggcgtcaacgacggcagcataataggccagccgtgtaggcggagacaccagtcggcggcggcgaaggcggctggtttgtgaaggtgtagacgcccaacaacggcggcataataggccagccgtgcaggcggaaacaccagtcggcggcggacgaggcgaccgatcggtgaagacgtagacgcccaacaacggcggcataataggccagccgtgcaggcggaaacaccagtcggcggcggacgaggcggccggtcggtgaagacgtagacgcccaacaacagcggcataataggccagccgtgcaggcggtgatagcagtcggcggcggcgaaagcacgctggccagacgctcaacaacggtggtgtgaccaaccaaccgtataggcgaaaacaccagtcggcggcgacgaaggtaagccggttggtgaagacgtagacgcccaacaacggcggcataataggccagccgtgcaggcgaagacagtcagcggcggcgaagacaagccagtggtgatattctgactgatccattcctgaatcgtaggagataagtttaaagctatgaatcccttttatgcatatctggatctggatcttacagaacaaacatataagatgagtagtatctgatgtaaatataatactcgaggaaaattcaagtattttaaaatgtttataatatgtatttctcttcttgtcaattttgatttccccgagcagatgactccgtacgtttaaacactctgcctaactagtcatagcccccaagcatcgagagtcggccaaggcactttccagagatgcaaatgagtgacatgagttcgtcattaatgaaacaaagtttcacggatcagaatttactcactactggagagggaaacactccgtagtgccaaaacacaccgcaacacacaaaaaacactccgtaatcaggttactcagtgccacactccgcaattttcaccagggagtgatgttgtcttcccgtgcatcgtagcggtgtgtttttatgcatacactccgtaaccatccgaaagttacgtagtgccgtagaaactcggtaaccttttcagcacaccgtccaccggaactgaacagcaacaaggaacgggagacggagcgtttgcacatgatagcacacgttaactttacagggtgtgcgcaaacacaccgtaagttttccctggttacgggtgcagattagtggcactctgtaacattttaggttgttaccgggtgcctcagcattttgatatttgaggggcaaattaataggaatatacagcttcatttctattaattatctatagcagaattccagcatccatacacatcacatgcagttacacataaaacacaataatggatttaaatgcatttgacatgcatgttcattcaattaatcaatatgacaacaatctgatatgaaataataacaatacaaatctcagaaacagctacaactgagatgaaattgagcactatcttcaaccagtataagcatgggcaaccaaaaggccgtgcaaccagaaaaaaagcttagacgaacagcattgccggcagtctggaaaaagaaaaggacttaataaccatcaatcattgtctgtttttcatcctgggatagcttcatcactctaaaatggatgccactatcgccatcagccatgatgtaaccccagcttttaccattagctatagtgtgcttcctagttttccatgaaattgccaattgcttagctcaactaatgaagtccatatgactgcagcatcaggaggtgaaggatctgatgattcacaaaacaaattcaacatcaaaatcccatacatcaatactatgttctgatattaagaaagaagtatacattgttacttagttctggtatgtctttctagtgcttacctttgccaggagcctagaactaaagcagtgtaggtcacattaattgttccaaaggtacaaattagttcttacaaagacacccaatagtattcatgctaaagagagcaattagacatagcctagatagatgaatttactaagacaaccagagagtaacttcaaaaaatttcagaaaacctcggcttgaaccagtgaaatgctaatgatctagtgctaactagctatatgtaaacaaataacataaacactacctttacaaaaatcttaggtattgttcaatgaagaattgtactatgcaaactactatttgtaatggtattgacgaactgtaatatcggaaacattagtgtaagcacatcaccaattatgatttctaacctggaaaaaaatgtaaagggacgaagagattacacttaaatcgttcctgcaacatcattgtcagaagtaattgtgatatgacctccattacatcctatcagaatttccttacctgcatatattttaaacaaaaggttagtacacttgtgaacttataattctgatcagcaactgcagataatttatggattggttgcaccatgtatgctacctatcatattgcagtcctctgagactcggatgtcttcacgaccaatggttgatgtctacacaaagaagaaaaatataatataccaaatcgactttagaattggatcgatgttgttccaggttgtctaaaatatctgtaaggatccttgcatatcttgatgtagctgctcagtcagtagtaaagcttagaagcataactttaatactgatatacatacacccagccctacaggccaaagatgcaagacttcaattactgagatacatacacaaaggcctagggcaaaaatatggtatttgattacagaaagacatgagctgaagcataagcaagcatcctctaggaaaaaaagattcttgtggaaccaatgcagacaaaatctgtcattagaatcaccactgaagaagcgaattttaaaatactaaatcccgctacaaacatcactaagcaaaaatcatgtgcatctacattctacaattttattattctctattttcagaatatgcactgcatcacgaactaatcagccactaaatctcacatcacatccattcactgtcatcagatctgaacaaacacaagatttggcctctacctccaccccacaagactacatcccctttgccccatcagcaaagaacagccaggagcccatcccaacccctctccccatccccttagcccctatcagcaagatgcaaaagaagaagaggaaacattaggagaggggaagaggaaggaggggaggggcaagacgacctcgtactgttgcttccttgaggctgtaccgcttgtgactgccgttgcagctgccgcagagcacgtagcgctcgccaccgcaccggctgcaggcggcgagggcggttgcgccggcgccggctacaacgcgtcggagctcgccggactcgtggaggcggcggacctcctcggcgccgccgaggtggcggccgccgacgaacacctgagggagggtgacaccgcgcgcgcgggggaggagcgcgccgagctcctggaggtagcgggggtccatggcgaggaggggtcgacggctgtcaacggagaggagaggagaggatagaaggggaagattaggttggtcaaagtgaaagtgaaaatatcaggaggggagagagaagaggagatgagatgaaaacatttgaagccaggaggaaggaaaaaaatattaattttaaaatattaaaatttcgaatcgaattttattatactaaatgaactcatgtgtaaaagttgtcaaaaataaagttgtagaactcgttgaaatctaccatttttcttttggtcatttttccatccgactttgattaaactatataaaatttaaattttaaaatataagaaattcaaataatttttcgagtagtaaatgattttaaatgaaaaaaattgtcaacatcaaaattgtaaaacacatcaatatcaacaacttttgttttggttatttttctatatgactttgtttcaatagtttgaatttgaatttcaaattatgacaacttcaaacaacgttttcaaatagtaaatgatttcaactgaaaaggtcatcaacaataaagtggtataactcatcaagatctgtgacttttattttgatcatttcttcatccgataaagcgatttgtaacattgttcataaaatgtacatatctcttatatagttttataaactatcagagagatatgtaaattttttgaaaaatgttactatcactttgtcggatgaagaaataacaaaaataaaagttatagatcttaatgagttatataattttgttgttgatgactttttcagctgaaatcatttactgcttcaaaatattatttgaagtttagaaattcaaatttttaattaataaaacaaagtcacaagaaaaaaaaagccaaaaaaataatagcagtaagaatataataacatgatagaacatgattttagaaacatttagaaaaaagaatcatccaatttggagtttatatgagtgagataaattgagaaaatatgtagtgcaaaccacatatacagtggaaacttggaaactaccgttggatcgagaaatggacgtccgagattcgtccacatcaccatgagttaaaattcaactcccggtaaaattttaactcatgagtgaatctgcgagttaaattttaacttatggtgacatggacgaatttggacgtctatttctcgatccaacgatagtttccaagtttccactacatatatggtttgtactatatatttttctagataaactagttttaaatttttggcctgaaagttgggagttgggaatttatattggcggtgtaaccgccaagaaaaatacatattttcttatcggctagggaatagccgctaataaaatatgtttattctttgcggctagtttgaaccgccaaattaaagtgtaatcttggcggctgatttcaaacctccaagaaaattacatggccgtcaaagacattatgttttcttgtagtgtaatattttctacacaaaaaaatataataaaaatattttcaacacgggatctaataaaactattttggtatcctagatgttacgtttttctatgtcattagcaggattaactaagttttcgtttcgtttttctatgccatcatcttgaaaaatcaatttatttgatctttcaaaaagcactatatatagatttttttttaaaaaaatatataccgtttaatagtatagaaaacatcacgatgaaaaacgatgtagtaagtagcccacacaagacggttgttttgtttcttctcttaaaaaaaaaagagaagtcacgttttatctgggttaaaaaaatgatctgcgaataagattttttttttagtttttataaggcaaaattgattatatagcatcgaaagttcacgtttttggttttatagcaccgaaagttaccggttcactttaatagcacccaaagttcaccatgttcccatttttaacacttctgtcaattctctatcgttttccgtccgtcttgatcagccacacacacgatatgacgtttctacccctcacaagtgcaagtataatgcatgtcaatgaggggtagaaatatcatatcatgtgtgtggctggatcaataacgataaagacgggcggaaaaattgacggaagtgctaaaaatggaaatagggtgaactttggatgctattaaagtgaaccggtaactttcggtgctataaaacgaaaaagtgaactttcgatgctatataaccaattttgcctttttataaccctccagctaaacatgtggcccccaccactatctgctccgttatactacgttacggttaccgtgtgtgttatgcaatagttcaccgtaagtatcaggtgccgtcatattttctgctattgttctgttcccgcccaaggttttcgttcccgcgccattcccgcaacagaaaatgcatgtgcgccaaaaggaacagccgtgcgcgccaacgaaatatgtcggtgctgaaggatgcggggcccacgttccctggtgtaataatattatagcactctgtattttccctgtgttccccagtgtttggactgaacgctacgtgatagaacttgttgcgtagtgtttctctaatccacccggtaatttacagagtgctaaatgaaacactacgtaactttttgctcacactcgggagtgtctcccgtcctggtagtgactactcgggtacttttgcaattcttaagagcagaaaataaattatcttatctctatgtttttgacttttcccaagtaatacttagcaccttgcgttactcggtctatccaacgagcctccaggtgctaggaatcggcctaaaggcaattatccatcgacaaaccaaacggaaagcataggaagatagaactccataactcgataggcacttttgtactcaaattatatcacaagcaatcaagataaatattatgaaaattgttgaaaatataatataacatctgtagcccccaactcactagtcaacggcgaaccaattgatgtagtgaggcaaaggaaaaggaaaatatcatctaaagaaaattaacgatgacttagctttataatattccccttggtgatggcagaggtggccaatgtaggaacaaagtcatccatcaatggcaatgaaaacaccagccatagaagcagcttgaggcgactgatgatgaaaacgaagacgcccatcaacagcggcaaagtccgccaactgtataggcagaaacaccagtcggcggcaatgaaggcgagccggcggtgaagatgtagacgcccaacaatggtggtgtgaccaaataaccgtataagcaaggacaccagtcggcggcgacggaggcaggccggcggtgaagacgtggatgcccatggacggtggtgtgaccaaccaaccgtataggcgaggacaccagtcggcggcgacggaggcaggccggcggtgaagtagtagacgcccaacaacggcggcataataggccagccgtgtaggcggagacaccagtcgacggcggtgaaggcaagccggttggtgaagacgtggatgcccataaacggtggtgtgaccaaccaaccgtataggcgaggacaccagtcggcggcgacggaggcaggccggcagtgaagtagtagatgcccaacaacggcaggcataataggccagccgtgtaggcggagacaccagttggcggcggcgaaggcaagccggtcggtgaagacgttgttgtcatcagcaacggcggtggcgaagacaagccggcggagtagactcgtggccgattgaccgcatagcgagacgcctcgagtccatgaccggcatcaatcgccccagtagtgccgcgcaattatatgcaagtaacaaaaacaaaaaatatcaaaagattaatatgatatttagagatcaatctaatgaacaacaataagttggaagggaaaaatcctggtgatgtcggagtttaatgcccacaagcaaccaggaactccgtagaacttgggcgaccatgtgcatgacgatcaaaacttgggtgaaatcgcgcgacatcgactcgccgccacaagttcatgcatttaaaagaagaccaacagattagacgagagcatatacatatatataaatatatataacagctgtatgtgcatatatgaagaagattgatctctgcttttgccatgagtgtatataaagcttctccctgttggttgatgtgcttcaagtcagcatgtgtttccttctggtaggctcggcagtgtccatcaataggcaccacatgccatcggctcggttggcatttagggtcacacaagcacgagaaaagtttcgtcgcttgaggacacggcagaaaacttcgcctccctctcagccgaccaacccatgaacacaagaaaataccagaaagttattctggaattaaaaatcaatctaaaaataataatagattgaaacaacaaacctggtgatatcgaaaattggttccatcgcacttgttgacgggaaactcgacgcacccctacctggcgtgccaactgtcgaaacatgaattcggcaataataaaagcgggtagcgcacgagacctaaaagtggatggatgcggagacaggatttagacaggttcaggccctctcaatgggaggtaatatcctactcctgtttggggatttgaatccaccgggtgtagtatagatctgatgatcaggtgtgtcatgccccctagagggcctcctgcccaccttatataggatggggagcaggattataagatagaaaccttaaccaatacggtatcggtttcctaaatctattttacaatattatcaaatcaggactttaggccgctccataatataaaaggaaacgtaatacccaagtcatgatctgttacatattccatagatataagttatcccctatgactagtcggataaccatgccgtgtgggtatggggtacccataatctccacaccacctgttagtgaccacgtcgggggaagttcatgtcagaggatctgcttccgtgggattgctaggagggttggcgagtagatgatctgcggttctggttgatctcctgttaatcttctcgtataaatggcaagatggacaataaactgaacggccgaacttttgagccgccaccgcaggagtgcaggacgactgatggtttggcaaaagtgatggaattgccaccacatctgtgcgctgtgttttgcattttgctgggatgtgctccctccctggggcagtttggactccttatctgcttttagtttctttattagccttctgaactatgtagtgaacctgtggtagtttgcatttcgttaatgaaatgggggagcaatgctctctttctcaaaaaaaaaaaagaaaatctaccaactcactttgctatgtcaatcgatccactgtgttctgataatttaagagatacttcgatggatttccattgatatgctgatacttaatatctagttaggtcaagctgtcaactgttgaatgctgggtacggctagaacgaccaatgtacgctgatgttttctagtggcacatgcagcctacatgtggtatacacaggttgtgtttagtttctgaaatcggagagaagtttggggaaagttggtagtttggaaaaaaagttgagagtttatgtgagtagaaaagttttagatgtgatgtgatgtgatggaaagttgggagtttggggaaagtttggtgtgaactaaacagggccacagtgaatttaatcattgacaccctccgctgtcgcgcctgtcgatcctccgctgctcggccacactccggtgcccatcaatccttcggtatggtactgcacccattggggctacacagcagcgcccatcgatcctccgccgcgtgtcctctcgcttgttggcgcccgatgaccccccccatcgccacctgtcaagcttcacctctttgccgattcatcaccgtgcgcctgttagattgtagttgatggctgccaccaagctttaatttgcatctgtttcatatccaaaaaagaggagctcgccggtgctatgggccgccgtctgctacacaaagacaccactggaaaaagcattttcgctgatgttgggtatttttttcgcagacgggtatgacaatcagagtaaaatccccaccagcgaaaatgagtaccggggaggagttggccgttcgccaacgaagatagattattgcaagcggaccacataagggagccgcatgcaaaaatcatctttgcaggcggcacacatatggacccgccggcaatattcacatgcaggcgggctccttaggcggcgccttatgtggtccgcctgcaaaaatagccctataaagtcttcttcttccttgagccttgttcatttcattcgaggtttctttctcctctaacaccaaaaatatatgggagaaggttttgaagttcaaatcttcgggggatttttctatggtagttagatctacacctttccactcttgttatgcattttcttttaataatttcagacctctctttgtgatggatctatgcatgcaaaattgtgaagaaaagctcaacgcttttttcttttcattttttgttactttcctttgatatgtttgtgcttgatgtgtgtacactacttgatgtctcatcctctagtgatttaatgtgctaatataaagtcccaaaattttttattttgccctcacatccatcttctagatttagataggagagagaacaaaaatgtccatctcttaatatggtccatgttaaaaatggattttgctcccatctattccctcttctttcatgtacattttcccacttttgttggactttcctattatattaatttggtatgtctctatataccaaaaataaatataatttgtccatgaaaaatatataataattattaatagttctctatcatttttagtgaaatgaaatttggtatggctatgtaaaaaattaaatgtactatgttttcaaatatttgttgttcattttttgtaatatagttgtacatgaaatttttgtagatatatggataggaaccaatggatatatcattcgttgaggtttttggctccatatatggattaagtgtctaaatttattggtattgccaaggaacacgctgaacagaacaatatgacggggattctttgtccatgtgttgattgtatgaatgaaaaagcgtgggaagatgttgcaaaagtaacggagcacttagtaacttgtggatttatagaaaagtacgaaatatggacacatcatggcgaacatcaagtggatcggcccgaaaaaagaagttccgccagaagttgaagacatggagtacgccgatggttgtggtgaagacaaaatcgatttggaggaaatgttacgtcatgcagatcctgaggtgctcattgggtcggctagaggtttagataattttgatgctttatagaaggcagcgaaggatgttttgtacgatgagataaagggctgtgacagtgagttctcaacattacggtcagttcttgaacttatgaggttaaaggtgagatatggatggtctgatagtagtttcgacggtctgcttgaactattgaagaaaatgattccgaggtctaactcattaccatccaacacatatcaagcgaagaaacacatatgtcccctttcacttggtgtggaaaagattcatgcatgcgtaaatcactacatactctacaggaaagagtatgcttcattggataaatgcccaacatgtggtgctagccggtacacatcaaataccaatacttgtctagaagagtctgacacatttgagggaactaagagaaaaatcctgcagcttgtgatgtggtatcttcttgtcaaaggctgcattaaacggttgttctcaaatccgcaagatgcggaactaatgcgctggcatcaagaagggcacaagaaagatgggatgctctgacacccggtgaatgctcgtcagtggatgcatctagaaaagaatgtgtttgacaacgtaattggaacattgttggacatagcaaagaagactaaggatggtctgcaagcgtagcttgacctagtcgagatgggaattagggaagagttacaccctcaagaaggagagaagaatggcaaagtatatcttccaccaacttgtttcacactaacacccgaggagaaaaaggcattttgcaaatcactccacgatgtgaaagtgcccataggtttctcatcaaacatcagtcgactagtctccatgaaagatttgttggtatctggttataattcgcatgtttgtcatgtcttgctcaccgtgtttcttgccattgcaatacaggacataaaaccagaacatttaaaggttgctatcgcaaggttgtgctactttttcaatgcagtctcatagaaggtcatcagttaggaagagttatcacttcttcgtacattcgcacatgagacacagtgccaacttgagatatgtttccctctagcattttttgatacgatggagcacctcatcgttcacatagtgccccagataattgcgcttggcccgttgtacctccatcaaatgtggtcatatgagcgttacatggctattttgaagggctacgtccggaattgcacccatccaaagggatcaatggttgagagttacaatacagaagaggttgtcgagtgctttatcgattacctcaacaatggaaagacaattggaatacatgtacctcgacacgagggtgaattgactggtagggggaccaaaggaaagaagagattcgtcgcccatgattacaaaacacttcgagaagctcacttcagcgttcttcatcagcttgctattgttgagccttacatcgatcaaaacatcaaactactaagatctaacaatacgggacgcacaaccaagtggatcatgaaagaacacaagcgtctcttcatagaatggagaaccaccgaggaaataactatgaaaaggttggcatgtggtccatcaagtatagtcaattattgggagggatatgacattaatggatacacgtttagtacaagagctcgagatagtaagaccgtcactcaaaacagcggtgtacgtgtggaggaaattgattccctaggagaaaaactatcatacttgggtttattgaagaaatctgggaaattgactatggactcatagtgcaattccccatatttaagtgccagtgggtaaaatacccaaacggtgtcattagtgacaagtttggtcttactgttgttgaccttgagaatgtgggtcacaaggatgacccttgggtactcgccaatcgcatggcccaggtgttctatgtgacagaccctacaaatttgaagaaagaaatagttccatcaggaaaacaaaagatcttgggagtggacggagtcgttgatgtcgaagattacaaccagtacgatagtatggcactgtatactcaatttgtacaaaagattaagcttttggcggcatctactgagaagaccgtgaagccttacatacgcaaggatggtgtggggaaaaatgtgaaagagtaacgtttgtacatgtttgcaatgattactatgcctttaagtaattgtttggtatgtaatgatgatatgttttaattgacaaacaatttattatgtagtccaatttacattttttgaattcatttacattttatatatgttttttaaaatcaattacattttttaaaaataatttacatttatttaaaatcatttacattttttaaatgttttttaaaaccatttacattttatatatgttttataaaattaatcacattttttgaaatgattttatattttttaaaatcatttacatttatttaaaatcatttactttttttactgatttttaaaatcatttacttttttaaatcaattacattttttatatgctttttttagatgtttttaaacatcatttacatttttttttacaaatttttagtacttttccaacttcttattttccttctgaaatcatttttgccggcggggtgtccgcttgcaacaatgacaaaactgattatgttttatcatcttcatcggcgggctgcccgcctgcgaagatcgcgtgcctatataaggggtttatacaggttcaggccgctgagaagcgtaataccctactcctgtgcttagctgatcttgcaagagattataagatctccttgttggaatagaaggtgttgatgatgaggggcagaaggtgctctaggaaaaaaaaagggcttgtcccccctcgcagtaggcctggacctccttttatacctcaaggggttaccacatgggcccaaaaacctaacttaggggagatggattacaaactatgcattaaaatgcaagtcttgtttcttcacttggaaagccatacgcacgtcgtcttggtcatggggcccatcaaaccacgccgcctgacacggggggcgcccctgccagtcgccatctaatgggtgatgacttctgggatcccgttggcaccgggaaacaggagcctcgcattgactagagcggatgaaccgactccggccatgacacgatttgacgggatagggcaggctgcacgccgcctgacacacgtggtagtgtgcaggcacattaccctggtcccatcagtcattcgacctgtcactgatcggtcacagaccggtcaggcgcactgcatgccacattaaatgcggcgtggtgcgccgcttaggtcgccttaaatgcggttaggtaggcgttggggcgcacacctaaccccacacacgtggcgtcctgcggagggggtcggggcaccccgacccctagccatggaaggggcagccgccaccctaccccggctcgatcccttttggggagtgccacgtgggtaccgggggcagccccctccctcaagtcttaataccctcgggcgaggagggggctgccgccactccaccccgggcccaaccctcctcgggggagtgccacgtgggtatgagggcggcctcctccctctaaacatgatacccccgagtctatatcaccaacaatatggatgtggatgtggcgatcactccgtgtaagtgatcgtcggaagacgggtggagacatgagcgccacccgtaacacaaaacctttgtgaaaaccaaaaacctaataaaacaaaatgattttgactggggcggcatgaatagaatatgggtggttctggaaacggcaagtcaccgaccctggttaattaaggaccgagtcaagaagctatgtaggaaacgaaccgagtacaaccacatttcttaaatgggtatagactcggcggactaagaaatccttgtggggcggcacctcagtcatggtaggttctggatgcttgatgattgtgatgaggaagtgttgtgatcagttaatgacatcaaaaacctaaaacgcaccctataagtatatatattatatatctccctgaacccgggaatgccaggactcccctcactgccggctcgaggtggtatgttttgttaggagtgcaatggggacccatagtccttggggcaggtgccacaatacgagggtgactgaaacaccgggtcgtgacgagtttcatgtgttgggattaggctcatatgttgggcaagtcacggagtgcgggattaaaagcgtacatccactgtagtgtgaggaaaactaatctattcgaatagtcgttgtcgtgattaaagagcatcgggacttacactactcttgactagcctcatagattgttaatcttgcttagattaggaaaagatgtgtgaccttgcccgatgagtgggaaggatgtagtgaaggagaatgtgggaaaaactggttgcgagggtaaaccggaccaagcgaggattggggaaggtggatgaaccctcatggattaacgacaacttcaacaataatgttgttttcagttaaaactgctaagtcataggtttgtgaaatgatttgtgaaatctagctttatgcaaacgaaccaaggcatccttgaaatatccctgtgagcactatatgcattatgtagtggtggcttgctgagtacggttggtattcacccttgcttaattaaatattttagaaggagaagttggagccgatttgtacgtgtgccatgctgatgaagagatgtcgaatacggtggagtagggacctaggttcaccagtcgctgcctgtggaataagatggaccgtcgctgcttcgcttccgctaccgtatctacttcattggatatttggtcttatagatgacaatgcttggtctatttgggtgccactccagcaacccttgtattattaatgtattataaagcctgtataacgatatcggctttgtgatatacaacgttgccatgtgtataccatctactgatccagggaatggtattgtaatcacatgaggtttccagtgtacaaaaccgggggccgacacctcaccacagggtggataacttgttcatcatccagaatttctacaatggtgtaagcatggccatggtaaggctgtccatgtcggtgtggcccgtggccccccgtagtgcagcggagggtggtcttggtggtgcccgagccgacgtcgaatgtgtgcgtgcagcagtcggcctcgatgaggtggacggtggcaagatcctcctcggtggtgtgcaggtagcgcaacacctctagggtgggcatgtagcagaagtagcagatcaagaaccccacaagggctttcagcaaccgccgacgccatcacgttagccgcaggcgggaggcggctgacgacgttggtgacaatgttggatacgggatccaggggcccaaagtagaggttgctgtcgaggatggcgggtagcagcgctggcatctcatcgatggggaggcgcacgatagccgcagcgtagaacccatggatgagtcgtttcagcatcgatttgtcaccgcggtgtgcatacggagttgggccttgcctggtcctcctctcactcttccatgttgctgcacacatggcgcctatctttagctagctatggttgtctatctttcacctcctccgtcttcttacgtacatcgctggttgcgaaaattaatgatcgtccatgcaaaatcacctcctctggttgcttcatgcatttccctgcacaattattgtcccttcaccaccccccaccctccccggcaagcaaatatgtcggcagcaattttcctttttgttcttttttttatgaattcggtcaaagttttttcatatttagttacattttgttaaaaaaatcaaataactttgtgcaaaaagtgacaccaaaattccaaaatttcagtccaacaggaaatagaaaaccctggaaatgtattcactgattaagatccattcagtggatgtccctttgtatatattttctttatcaaattcagtcaaatgactgaatttttgattgatggtatagagtatagtgacatctctgactttacaattcagttatagttgtcgattaatagggaagtgatttcgaaatttttgagatgaacctcaattaagctattttgaggcaggaaattttttcgcgagcgagagagctaatagttctgttttatgctagataaccgcttgcaacacgctgacccttattaaagaaccacgttgaatacatcttcattggagaatactacaccaacatttctcgaattcttcatcgagttggaagacttgaactgaagaccctttcttttgccatgatagcctgaaaattggacaacgaaacacagttaactgaagttccactgaatacataatactaaccgaagtgtttgtagggtgaaggttttcgcacttcttttccccaatctgtacgcagtgtgatgaagaggagcatccctactttactgatactgccacacacaaggccaagccaaagaccctgttttatggaaacagctagcagtttcagtcatcatcatacaaaggtacaccaaaacatttctatgaatcaacaaaaaaacaatctgcactgcatatttttttcaaaagagattgagagagtagtgctacctctccattgagatggaggacaaatgcaagcagcacagccgtcggaataccaaccaagtaaaacgcagcaagattcacatgagcgccaatgttctgcttaccacatcctgtcaaaactcctgaaacatttggaggtccaagtaattttattactactgatcgacttaattgtatgaatcaatcagttcacccgaaaagctcgccgacaatgagaaaaaaaatgtacagctgaaatattttgatgattgatcacaagtagaaatatggtatggatttgtacctgaaagagcaccattgatgccatctatgaagaaggagaccgcaaggacggggagcatacttgcaatatatgccaccacttcctcctcgctgctataggcatttccccagacattgcgcagaaaaatcatggctatcactagcacgaggcatacaagcacggtcatggctatggcgactcgcgctgccatccttgctgctcgaggatgcccgccacctagttcgttcgagacgcgcgtgctgcgcaagtgcaaaattggtggaactaatcagttctaaatatctaatccaatgacatgtaaactgaaggaagaaagcatgcttgccatgtaaataaaataagggtaaactgaatttggtcaaaacttatttaaatttcatatattgtcgttcagaaattttcgggaatttccccccaaaaaaaaagaagaagcagaatagaaaatgttccaaacgaatttgcaaaccctgtaagagaacaacacagtagggcactgttctaaaagatgacacttgtatgaagaaatggattttagactttagagtcgaaacaaaccttaaagatgagccaatgccacgtggcaccatgaacaggagagaagaagtgctcaagctgcaaatcaaattggagttaacaaaatacccatgggaaggaggagagctgatttgtatctgtgttgcttgtgatcaaattaccagattgacagaacagaagtttcaagctgaggattcggcagaatgcccgagagcagcacaagtatctcaaacgaccaccactccaagctgcacacaaccaaatcaaccagttaatcaatcctcacataaaaaatttcccaaaatttgttcaagcaagctcgatttgctctctcgatcacaaaacatgttccaagatttgctcaagcaagcaagaaaccagcaatggtgtcaggactaagacgtgtcactgaccagaccatcatggcggacggcacggcgagctcggtgaaccggcggagctcgcggaaggcgtctatggagaacccggtccacgtcgtctcgcaggcgccggacagccgcacgtagagagcgaggacggcgaggttggtccagtacgtgacggcgccgctcagcgcggcgcccttgctccccatgccggccttgtgcaccagcgcccagcacacggcgacgtggccgaccgccgccacgccggagctcgccatcaccggcacgacgatgccctgcgcctgcaggaaccggagggcgcaggcgagcggcacgtaggccgcgagcgacgggatcatccaccgcgcgtacgcgccggcctcggcggcgatggccgggtcctgcccgaagaggaggaggatctcgccggcgctggcccagacgagcgcgatggggacggcggccgccgcgagcaccagcatggcgcgctgcgcgtagacgccgagcagccggtgctgccccgcgccgtacgcctgcccgcacagcgtgtccagcgcgctcgacatgccgaactgatcagatcatcccaccgagaaatcagtcacaaatttgaccaagaaatcggagagatgaagcagttcttgcatgcgagcaaggtgttcgacgacaggtgcgtacgagaaagctgaagccggtgacgttggcgagcgacgcggcgagggaggagccggcgagctggagctcgccgaggtggccgacgaacatgacggacaccatctggaccgagttccgcagcacgaagctggccatcagaggcccggcgagacgcagcaacctcttcacctccgccgcggccgccgccgccgtcgacgccatggcttcgtcctcgccatctccgccgcgtcggatggcgagcagtggctcctccacggttggctcgtccatgtcgatcgaatcaccaactgtgagacgtttcttgggctgatgctaggctgaaaatggtggattcgttgtccaacttatacggagcataataagttggtgtgttgacgagtttgtgacggtcaaatcggagaggtgtgattcattttaccctccacatgctgggcttccattatttaagagtaaattctatcacacttattatatggtccaagttatataaattataggaattttagcacgtgaaacataacctcgaatattatggttataaagtttcacaaaaccacgccgttaactattttagacatactccattactcctatatgaaaattttgaaaaacggaagtaacatttgcttgatcaaaatcaaaatggctaactgtttggttttctaaaactctagtgaacataatacttgagattacgtgccacaatatataatagacagggttttataaaatagtaaattttgtaacatcctaatacattattgttgactaagatggtacatataccgtagtcacgagtatcaacataatcaaaatggcaacaaatatagtgtcaaatcatcaaattttatgggcaataatggaacagtagctgcgaaggtttgtgtggggaaaatgtattccagtgtgtgtgcactggaaatcacgaaagaatattcaaaagagaaacaagctttagttggaaagaaataaaaaaagtaggattactttgtgaaggcacttctgaaaagtgaaaatgatggttttgaatgtaacttaatcattgtgtaataatactgaaaaccaaaaacttaatttagcaatgagcgggaaaatactggggacgtttcttgggctgatgtttgcaatctagggctgaagaaagtggattagttgttcaacttatagggagttaatttaatgttaatttaattaaagtggaatttggaatgtgtttggacggattcgattcgatcagtggaaggggcctctagcaactcactactgaaaattctttcgtttagttactcagttgacgtgttgacttgttttgtttgtaccgcccaattcttggatgccaaggcacaaatacctaatgtgatttgcatcctaattcattatttgtaggcgtcagtttaaaaagtaagacgtggtgttgtccggtccgagatcagtcagcaattttgactcggaagaaagatgactttctaaaacttgggatgcaagtctaaatctccaacaaaattgtaaggtttggaatgaaacaggacaaagctgaaagcaacccttttttacgacccacacggtataggaggaaaaagaatagaagattaccgtcctcgaaggctataatcaggaaaaagaaaaaaaaatcaccacgtgctagcgactccttagtccttacacaccccaagagaagcactagcaccaaattgaccgccggcgccgctatgcgagaccgatcaccgctaatcctacacagggttgcaaacgcccctccgagtagggctccaaaccaggagatcatcgatgggctcccgatcatcatcaggtagaaggcctgaggagggagagggcgagagagaagatctactcgtccctcacacaaacctgatgataatgactcgagagaacgccgattacccaaaggatcgaagctcatcaggcaaggaaacaaaacctcgtgaacgatgcctccaaggaggtcgttcgcttcctgttgatgaaaaaaacatgggggtctgggagttatgcttagctccagtgcagatccaaatctcgctttcgagttcaggacgtgccaattggtttgaccctacaacaaacaagaataaacaagaaaatcaagttaaattacgatagccggtcggcttatgagctgataacgtatcatgtaaacctagccgatgcaatttgtccgaattggttgtaaggtgtaggatgaataaaataagacaaatctaaaatatgttccatcggctgtagatacaatcagacatgttccatgattcaacctttctatgagatgtaagcaaatagtatagattgaatgagatagtgtagattgctcgtaaatcagatcaaacaaattaaagattaaatgtagtttatatcatagccgatgatatgatacttttggttaagataggtaccgtatcggctaatactccaatatagccttatgcaagaatatcaatctaaataaatatttcaagagcaagcttgatatatttaaatagtgtgatacacttgtatgagggacagatacaacatgaaaaacatgattaaaggatttaaacaaagctaaaaaattatatcatgtaagatcggttgaaaccccgattctatccctattagcaatcaagaagcaggttagtttctataattctaagcatgactaaggctgatgcagcacaaagtatgaaaagaagcataaagtctaaacaatcatgccttgactgattttcagggtggtggatatgttagctaatccaaaccgacaaaacaaattagccgatgccggcaaaaccgtaaataagacatggccgatatagctaatcgagtcatcaggttagattaactaagacatataataaccagcgatcgaataggatagattagaacatctaaaacaacgccctaatccaccaacgcaagccactgtgacaagccattgctctcgtcagaagatcgaagccgatgccctaactcgaagcaagaactcgtcgaaaaagtagaaaagtaaaagggtggcgatgcgccgagagtatatgaatggttgttgtttttttagaagaccctaggcatatatttatgcacgtagtacaaaacctatccatatcgggcacgacacaaactttgaaaaaaaaaaacacaccagcccattacggactctaacatagactcctaaaacacctaaaggaaaactgacttttatcctaattaatagatgcaattatctccttggcggactcgatctttgcttggcaatattaccaaccccttcctccgaatccgataggaacacaacttgctactatcggcaacactcagccgatatggtcctgtcgatacttgttaggcgatccaatccctgtttggccaaacaaaattacgccgttaatttttcccatcccttattcctttttcaatggaatataccaaattttaccattaacacattcccctaattctggagtatggatagacatgcttcggaattcatccgtcacaggacatttaacaccagcccattagggtttataatggcccaaatagcccatctcagcctttaacaccgtaatttataaatagcaacggtcacctctgccatcatcgtgctgccactttatttcttcgtttcctacaccaacaagctctaatttcctctcttctcaactccggcaaccaaaacgaaactatcaaaccccctctggcgaactccaccattcattcaaatggcgacgactagcgacatcctagaggtaatatccgtaaaactctcctttttcctctttatttaccgcactaaatccataaatccctcattctctggttttcgcctcgtgttctttgttgtcatctcttttttactactcatttcactgtagcaaatgagagatcaaatagtgattcctctagtcgatcaaccattatattattttctcggactgatggggcaatgaggatcccattgaatttattaacgcggagaccaatcgaattcctttcaagctatctagcccctgcatttccgattggaatttaagattcagatcttggccctccaaggttcccagctagagaaactagtatcggagtatgctggaagccaagcacaaagtctggtccaatataggcataactcagtgcatcgctctatctttggccgagccggaaaaggttgagtctctgattgcatcggctacacatttttggtccgatactctgaacacaccttcttgttcaaccatgggccgatcagtcccaccttgctcgatatcgtcatgctaactggtttgaacatcacttcatcggctaatctttgtagtctgagaataaaatgtgttaacaagctagagaccaaatgtgtcagcggctggtcagcttgtatcaccaagcatgccagaactggagcagtaaccgacagagagcatgtggcctttcttaatttctgcttggagagatttgtcttctgcagtgcgactattggagggtcagcccatcggccacttgggcagtccatggtggcttgtacaactctggcttaagttctacaccgtcaaaatcactggagtgcacgtcactgaatcaagatttctggcttatttcgcagaaggtgatgaaaaatctcttcccagatgcacgtcacttggcgaagcagcaatcatctatcttagcagcaaccttacgcttgaaaatgtcatgctctggttcaataggttctacactggtttccctagggctgcaccagaaactggttcccttatgaagaattcgaaggctatgaacttccatcggacttcaatctgaacaacattaactctgatgaagcaagccgagagatatttataacggctatcaccccttgcattcttcagaccggcatttctatgggacaccactctcatatctcgtatgaattctatcacccattagtggtggcccatcaacttggtttcggccaagtccctatcaaagtttacttcatcaaaaagatacaaactcggggaacgatcacaagtgcacttaagtgcgattgtctcccaaacctcaatggtccaaatcttggtcccttcattgactgggacagccgtactatcggcagtagaccatggatcaaatggtggggtgaatggaagcgtcaccttttcaacctccagtctacaacttcctcgctttacttgatcctaaattcgttcctgatgatgctgaggtaaaatctttgtgcactcaattcttcctctatttcaagcactgatcatctgtccatttatatgcaggaagacgatgacactcccatgaccagctttagtgctctgccgataaattatgttcccttatcggtatcgtcaagacttggtgcaggtgcccctcccacatcttgcttacttcaagaggctatgagggagccgataccaagtctgaagactaagcgcaagaagccggccatgtggcacaaaagcaagacgcgtgttggtatttcttaatgacattactagcaacataattctcagcaatggcgcagaaataattctggtatattatggttacacatttcatccgcaagcgcacggatataccattgtagcatttcaaccgagagtattccaagggtatcgtatttattttatcccgtgggaagatcatgtagagagaactcaactaataatttatatattacttgtgataatcatattctaagcaggggttaagataatccaagggtagagtgacacacaagcattactactcatcctcataataatttatctaagctaggtggaaataagagaaaagaaatctattcctatacttctagtataattctagctaaccgatatactagctaataccctctatccgatgctctcctggtacttcgagaagccaactctgactgccgagctctttacgacagcccgtcatgaccatccaaccggggctaaatatggaggaataccctccccaggaaattaacttaggattatatataggcgtggaggaatacctgtactgagctgtcatcttcagcggccctactctcatccgcaatatataaccccaaataatgatatcttgtaatctagacaccacgtctaaactaccagatactactctaatatcatcgtcatgacatatagtaattgtataagcaaacactatacccgcatcaaagcatctcctagataagctagccgtatatttagtataacaaggacataatgtaaagttggtactcatatactcggaaagtatttcaataccataaatgtatatagaagagtattctaataaaagtacaaagcttacaaaagaggaaaggaaagctgctagagccatacccgaactcttccgaaggcttccgaactcctgattcctcttctaattctattccaccagctagatactactaaactaaacttgagaggaatgagagagctcttgcttgaggtgtgtgagtgaagtgagaatggcaactccttttatagcctcccaatgacggttgtggcggttggaatggtcggaaatgccctccaactgccatttggggctaatccacaccgtccaggcgaagccctggatcggatggcgctaaggagggttcggcttgatccagcccaatttcggctggcggcctcgtctgttgcttctcttcacagacttgtcaattttggcccagtttgtcgtgtcaattctgagttcttggcccattcatgcataagtctggttctcaacatcgtctaattgatttatcgttggtgttgatgtcgattctcctcctttttatgatcattctctgcaaaaggttagtaaacctaacactagtggaatattattattctaaaaaatatatgtattgcaagcatcactagttctctcctgttttagtaatattgatggtcgaaactgatcgataacgaccgtcaataacgcgcaaaactggcttgtcctcaccatgggatggataaatggctcatcatccagaacctctacaacgagctgacgcagttggcctaagatcatattgatgctgctgctggaggagccttcttgtcactcattgttgctcgcacatcagaactaattgagtagatggtctctaaccaagggtggagcaaagaacgactccaacctcattagtggggcatgcatacagtcaaggagatggacatgctcgccgctaagatggacctcctcatgaaacgcttggacgaatgtgctcgtgacaaggcagaaatgaatggtactacccaaaccttggacatcccaatgacgtgccagacttgtggcagcactgggtattcagggaatgactacccgtttctgtggacagaagaccggcgatcttgcgtaacctcaaggagagcgtaagcatggccgtggtgaggctgtccatgttagcatggcccggtccccccgtggcacagctgggggaggtcttcgtggtgccagagccaacgccaaatgttcgcgtgcaacaatcaacctcgatgaggtggacaatggtgaggatatccgcctcggtggagcataggtagcacagcgcctccaggctaggcatgtagtagaagtagcatatcaagaacccgacaagggctttcagtgaccactgcaccatcacgttggccggtggcgggaggtggccaacggcattggtgatgatgttggatacgggatctaggggcccaaagtagaggccgccattgagcatggcgggcagcagcgctggcgtatcatctatagggatgcatatgatatccgtagcatagaacccatggacgagtcatttcagcaccgatttgtcgccgctgtgcatgcggagttgggccttgcctgctcctcctctcactcttccatgctgccgcaaacatggtgccatctttagctagctatggttgtctgtctctcacctcctccatcttctcatgtacatcgtttgggaaaataatgattgtccacacgaaa

SEQ ID NO: 45611 - DNA, 6032 bp, Oryza sativa
  unsure (1)..(6032): unsure at all n locations
gatagtatagagtatagtgacatctgtgactttacaattcaactataatagtcgattaatagagaattgatttcgaaattttgaagatgaagaacctcaattcagctattttgaggcaggaaatttgttcgcgagcgagagagctaataattcttttttatgctaataaccgcttgcaacacacttactcttattaaagaactacgttgagtacatcttcattggagaaatctacacctacatttctcgaattcttcatcgagttggaatacttgaaccgaagaccctttctttcgccatgataacctgaaaattggacaaatgaaacaaaattaaaccgaagttccactgaatacatgatacaaaccgaagtgggattccctaattaagatccattgagtggatgtccttttgtatacattttctttttttcaaattcaattcaaatgactgaaattatgtttgatagtatagagtatagtgacatctatgactttacaattcaactataatagtcgattaatagagaattgatttcgaaatttttaagatgaagaacctcaattcagctattttgaggcaggaaatttgttcgcgagcgagagagctaataattcttttttatgctagataaccgcttgcaacacactgactcttattaaagaaccgcgttgagtacatcttcattgcagaatactacacctacatttctcgaattcttcatcgagttggaatacttgaactgaagaccctttctttcggcatgataacctgaaaattggacaaacgaaacaaaattaaaccgaagttccactgaatacatgatacaaaccgaagtgtttgcagggtgaagctttttgcacttcttttccccaatctgtatgcagtgtgatgaagaggagcatccctactttactgatactgccacacacaatgccaagccaaagaccctgttttatggaaacagctagcaggttcaatcatctggtttcacaatgcatcatcatcatacaaagctacaccggaacttttctatgaatcagcaaaaaaacaatctgcactgcatattttgcataagggattgagggagtagtgctacctctccatttagatggaggacaaatgcaagaagcacagccgtcggaataccaaccaagtaaaacgcgccaagattcacatgagcgccaatcttctgcttaccacatcctgtcaaaactcctgaaatgttccgaggtccacgcaattttattactactgatcgacttaacgatatgaactatccgaaaaactcatcgatcgataatgagaaaaaaaagtacagctaaaatgttttgataattgatcgcaagtagaaatatggtatggatttgcacctgaaagagcaccattgatgccatctacgaagaaggagaccgcgaggatggggagcatacttgcaatgtatgccaccacttcctcctcgttgctgtaggcgtatccccagacattgcgcagcagaatcatggctatcactagcacgaggcatacaagcactgtcatggctgtggccactcgcactgccatccttgctgctcgaggatgcccgccacctagttcgttcgagacgcgtgtgctgcgaaagtgcaaaattggtggaactaatcagttcattgtctaatccaatgacatgaaagctgaaggaagaaaagcatgtttgccatgtaaataaaacttaagtagtacaagggtaaactgaatttggtcaaaacttatttaaactaagaaggcagcccgggcatatgtgcgggctttccattttaatgttctgtaaaacaaatattagagtaaagttaatattcaatttcgaatgggttttagttgagatgatattttattttattttattttaaacttcagagatctctcaaaaaggtatttgggattgctttcaacattggttatgactgcattgcaattactgtaggaacacgtggattgtaaactaaaattacttgaaactgtgaaatctttattttatggaatttttaccactactacatgctacgaacttatgggtacgcatagcacatatcctgtcaccattaccacaaccacttctaggacacttgggtgagcaagtccctcattctccatcgccacgctttataaactgctaaacaatgcatttcgtgcaaaaatctttctatatagaagtttctttaaacagataaaacaaatatacaatggttagtagttacgtaatcactcgctaatgacctttgtagattttgtgccatggaaaatctcacctgagttgttgaaatgaaagtgtccttaaacaatgcaccatactatatgctacaaacggtggtaaggtgttacacataagctatttctatgataccaaaggcaagacatgctttgtacgaccccgatatgatgctcggatcatcatctatcctttattcattatttgactaaagactatagtgaatttaaaaggatggatgagggaacatggtcggattcataaaaataatggcacaaccaattcgtgcataaggcatctcaatattgaagtcaactgactatgtgtaatttcatggtaaaagagagaactttgtagtttttttaaaagacattagatatataaccatgtataataattgttctataccgatttatgtaaaaaaaaggaagccagatgtttttcttctcttatactaagaatttataggatttccaattttgttggaagtatcaagagaagttctagatgtttagaagggattagagtgtgtttaatggacattgaggagattttctcganattctagggagttgcccgcttacttggatgaccatccttttgaatgttattgcaaaattattttaaaaatgggacatgtaaattaaggataaattgaaggtcggatgatttctcttttaaataaatgcctgtaattctctttctcaacaaacaccaaaaaactttcatcgtctattagataaaagatagattatataagtacaaacatacatcatatatattagtcatgctagaaacatttgtgtggatggatgttttcatttataccagcctactctttaatcctttttcctatatagttggtacccactacaagttattcatgctataaagctcaaattctgtgaggccacatcatcaagattatattgattattatatcatctcgcgtctatgcaaatcaaccgttaaatcaagttcttctcagccaatggcatgtgagaggaccaatgctttttgtcttcctcttaattacctcatgcatatcattatatctccctttattactaaccactaaacaatacatctcccacaggaagcctacaccactacatttgtgtctacctctttcttattccctttaatttttctattgcatctactagccatatctaggctgatgcaatggattttcttggaatatttatgcttgaacatgcttcctcagtcatctaaggaggaaatgtcaatggtccaatgaaattttggtttgccactgtcatagatgacatcgaaaatttattgggacatattacaacactcgatgatctttacaaattgcaaggatatctatatatgtctatctcctatggtgattggtttttggtattctatcatgatcttgcttcttttcatatctgatttcttcgtttatcaccaagcttcatatgtcaatgtatcacaactatggtaacttaaagtattgagggattggtccactctttgtgttaaaaggctgattaaaaggctgtgccaaatctttgtgtttttcagacttgcgatcactgaatttgtttctccacaattcctcccatttactcataggtgaacatgctgtttcttgaaattactagattcatgcacccaatatgtttttttaagatcatataccaacatatgtatgcaacattatccatattttctctttgttttctcaaaaaagaaatatttcattagttgtttaatatatctgagtgagatcttaagccaatttagtacataataaaaatagtgtcatgtttgcttactatttatggttcttcaaaataggagtatcttaattggaatcatgtcatttctattcatatagcaatacaatgtacagatagaacgttcaagcatgttgatcatgcaattatgataaatttacaactatatgttcccttctatgtaatgatactataccaataatcaaaagttctagaattacatcttacaaattcacgatatagctatcccgcagcaacgtgcagggtatcaactaattggtacttatgcttactcctactttcttagtatctatacacatgacatgcaagatgcataagatgttaaatttgtgcaaagtaagaaatatcggtgttcttttgcgattaattagaacatcgttatttaggcacatgacgtagtgatgaccaaattaaagatgaaattatgggagggtttttttttccctttatcagaattccaacattaattttcatatttttacctcagtttttttttaaaaaaatctatgggttttggatttataagcaaacccattgaaaaaatctagatggatagatttgtggagctacgaatatccagttaaaaaaaatcatgaatccaaaacaatattaaacatgcctttttttcagccttaacctattagcatctaatgggcagttgtgactcagttgctccatacatatggatatatacatggcactaatatttgggggtatagtagactgagccctacatattaatggttttatcggaagaatataactaattataaagagtagaggatattcgataaatatttatggtatagtagaatattctattttttataatccttaaaaaatggattttgataggaaaaaaatacttcccataaatttaaactgttattttttttccaaattttctatatttttctccttttttagactctctactaaagggtctctcatagacttttagggatcagtagcacaaggtttttttatccgtgttagaatatatttttattaccattggaacatggccaaattgcattctgtaggacgcttgttcctttcaaaagggagcgaacagaaatacactaatcggacagaacaaaaggttaggagtagaaagataccgatgagttctgatttctctgatgaacgagaaaaggtaaagtgaacagctgtgacgctacggagataataaaacccagttaatcgtgaactatatatatacgtacattcatctagaggactgcaattttgctcccatcgtgaactatataactgcagattgtttggaaacttggagaagctgtggtgccagcactgaattaacgtgagtactagctgatagcctgatatacctcgtgtacagatgggagcaccatgccggtcaaccggtgcaggcccacatcattatacacgatggtttcgattttacttaaagcggagaaataagaggagaggatgcagggtggccgtgcccatagtaagggggtgtttagggcaatagcagtataagctatggggcccttacccctagcccaaagtcacagctcaaagacacacatcccacagtgcaagtacccatatatgtgtggctaaatgggatgaaggtactatatatggaaagaaacccagcccacagtgggcgttacccgaggcgagtggtcatgaggagcggaacgaattaattcctaacctacccttccagcgactcctctcccagcccttcccctccccccaatccgccgcacccgccgctcctcgtcctcccaatccgccacacccaccgctcctcctcctcgtctactgtggcgctccgctccggccgcctcttctcccgtcgacggcgccgcctcgtcccggtcagccgcgccgcctcgtctcccgtcgaccacgccgcctcgcctcccggttgaccgcgccgcctcgccgaccggcaagggcaagggggaggaggaggatgaggaggtgggggagtagatccagcgagcggcgaggaa

SEQ ID NO: 45612 - DNA, 23290 bp, Oryza sativa
gggcagtagatctggcggtcggccaccaccacgggcctcgccgctgcccaccgccgatcctgaccctgccggcgccgccgctgtcagctccgtcaagaaatcaagaagcgaatcactgttcttaatatttttgcatgttctgttctccagttcttgatgagaaaaatcaagaactgctctcctgttcttatctttgcttgtcatgtgtatcttcagttcttgtgatgtttgttcctgtgatcctactcctatctatacttgcttgtcatgttcttatcttcggttcttcgtttttcttgctttttcttgattcggtggcgggaggaagaatggttgtggcgggaggggaaatcgctggggcgggatggggtttttcgtgggcgaatcaggaatttcttcactggatgcggcatgaggtcacgacgcggcaaagaaccgaagcccacagcgcaggctcctctcgtttttttggccgcgcgtggactcgagcaaacaagttctgcgtcgctcagtatggacgcgaagagcctaacttggtcgcgggcactcgtttcacatcggacaaaatcctccgtggcaccccatagcaccggtcctaggtggagcactgtgaaaggcccttagatccaggggatataaagtattggtgtgtcacatcagatattatatagggtgtcatatggggtgttcggaccctaataaaaaaataattgcagtatccgtcattaaaccacgagacgaatttattaagcctaattaatccgtcggtaccacatgtttactgtagcaccacatttttaaatcatggagcaataaagcttaatagattcgtctcgcaaagtagtcgcaatatgtgtaattagttatttttttagcctatatttgatacttcatacaggtgttcaaacattcgatgtgacagggtgtaaaattttgggtaagaatctaaacaagctctaagatagaggggatcggaatttgttttcatattttagggataacatcaagtggttaaaaataacaggtccaccaatataagtgacaattaatggtaagatttttttcttcttcttagaatttttaattagtatttttttttgtaatttattaaaatgacatgtggtggtttaggaacgtttgtaggaatcccacgtgacggcatgagagcgtttgtaggaaatttaatgaacctttagtatataatagataatagataggtagattgatagatttcaaatatcgtcgttcagaaattttggggaatttagaagatttcaaaaatctcagtcccacaaccccacaaaaaaaatacaaaaagtgcaagacaaaattgcgaaccctgtatgagaacaactcagtagggcactgttctaaaagatgataatgaagtaatggagtttagaggcgatacagaccttaaagatgagccaatgccacgtggcaccatgatcaggagagaagcagtgctcaagctgcaaattaaattggagttaacaaattacccatgggaaggaggagagctgatttgtatgtgtgttgcttatgatcaaattacctgattgacagaacagcagtttcaagctgaggattcggcagaatgccagagagcagcacaagtatctcaaacgacgaccactccaagctgcacacaaccaaatcaaccagctaatcctcacaaaaatattcccaaaatttgttcaagcaagattaatttgctctctcgatcacaaaacatgttccaagatttgctcaagcaagcaagaaaccagcgatggtgttgaaagattccaaacaatctgcaagcaagcaaacaagatttcctcggcttgtttggtaattcgagggaaggggattgggagtttatacgagagaattgatgattagattaagatggaaatttgatttttaatcccaatatcttgtttggtagaggtgatgaaaattggtagggagtttagttagagattaggtcattaataaaaacggatagctgagatttgcttagagaaagtaaaggaggaattctctcacaattacctgcccctacgcgggtattgaaaaggagagagttccttcctcaattctccatccccatcccactaaaattcccatgtctctcaactaaacaaaacacttaatagcctcatccctctaaactcacaatctcttctaaaaactccatccaagaaagcagagagacacttgatgggtacatagggctccttgaccaggtcaaagccaccacggagagtgctggacgtggtgctgccgtattgctactgttgctaatgttgtgcatcatttttgtttcttcccgttcaaagaacgagtttgcatcgcccaccgccttatcgacatctgcacgtctccgacatcggcatcgactccaactttctcttcatcatctagccccacgcaactttggcttgatcatccgttcaaacgcctggctacgacgagatcttgctgccgatcatctacgagcaagtctactacgctatcaaactccgggttgccactgcgttgccccctcgggctacagtgccaccgccccgtgatctacctgtactggttgttacagtgctaagagacgccctttttagcatggctttatcaccagtggacttctcgccgttgcatcgatatggagctgcagctatatgttgtcctcttggacaacagcttcaccgctttcgtcgtcttcattgccgttcgagcatcaacaatttcgtgttcgcactggtcatcgccagctactcgggttcttttttgtctacttcgagcatagccaccgtgtctctaagttgccaccgtcgccgctctaagccggtggtccaactacttctaaatggctggcatgcaattaaataaaaattacaacctacttctattccacaccagaggcttgagggggcccttacgtgagggggagtgttggaatataaagtgaattgcccatcattcttcatcagcttaagcttttaggttgaactagtcagtgcatacaactcaataaatggtgtcaggcgtgccactgaccagaccatcatggcggacggcacggcgagctcggtgaaccggcggagctccctgaaggcgttcatggagaacccggtccacgtcgtcttgcaggcgccggacagccgcgcgtagaaggcgaggacggcgaagttggtccagtacgtcacggcaccgctcagcgcagcgcccttgctccccatgccggccttgtgcaccagcgcccagcacacggcaacgtgggcgaccgccgccacgccggagctcgccatcaccggcacgacgatgccctgcgcctgcaggaaccggagggcgcaggcgagcggcacgtaggccgcgagcgacgggatcatccaccgcgcgtacgcgccagcctcggccgcgatggccgggtcctgcccgaagaggaggagatctcgccggcgctggcccagacgagcgcgatggggacggcggccgccgcgagcaccagcatggcgcgctgcgcgtagacgccgagcagccggtgctgccccgcgccgtacgcctgcccgcacagcgtgtccagcgcgctcgacatgccggactgatcagatcatcccaccgagaaatcagttacaaattcgaccaagaaatcggagagacaatgcagttattgcgtgcaagcaaggtgttcaacgggtgcgtacgaggaggctgaagccggtgacgctggcgagcgacgcggcgagggaggaaccggcgagctggagctcgccgaggtggccgacgaacatgacggacaccatctggaccgagttccgcagcacgaagccggccatcagaggcccagcgagacgcagcagcctcttcacctccgccgccgtcgacgccatggctccgtcctcgccatctccgccgcgtcggacggcgagcagtggctcctccacggttgactcgtccatgtcgatcgaatcaccaactgtgagacgtttattgggctgaaaatggtggattcgttgaatcgttgtccaacttatagggatgagcatataagttagtgtgttcatgggtttgatatgtttcgtttgtggcggtcaaatcggagaggagtgattctttttaccctccacatgcaggcattccatcattgtttaagagtaaatcttatcacacttattttatggtgcaagttacataaattaattataggatttttttagtccaagttacataaattatacgaattttggtacgtgactataaaattttagtaaaccacaccgttaactattttagacatattcctatatgaaaattttaaaaatagatgtagcatttgtttgatcaaaataaaaatgactaactgtgtatttatgtgaaactttagaaacataatacgtattatcatgtgctacatatcaaaatcattgtggttttatacagcttggatcataatagattcggttttatgaaatttactctcgaagagaaaattttatttaacatcataatacattatcgttgactaagatggtctcatataccatggtcacgagtgttaatgtaatcaaaatggcaagaaatatagtgtgaaatcatcaaattttacgggcaataatggaacagtggctgccagggtttgtgtgtggaaaaggtagtccagtatttgtggaccagaaatcaggaaagaatattcaaaggggaaaagttttagtttgagagaaatagaatagtgggattactttgtgagagcgcttttcaaaagtgacaaagatggttttgtatgtgacttaattatcaaaatgactaactgtgtggttttgtgaaactttagaaacataatacttgacattgtgtcacatatcaaaattattatggttttatgcagcttggaccatgatagattcggttttttgaaatttatactcttgaagagtaaattttatttaacatcataatgcattatcattgactaatatggtttcttataccatggtcaggagtgctaatataatcaaaatggcagcaaatatatagtgtgaaatcatcaaattttatgggcaatgatggaacagtggtgccagggtttgggtgtggaaaattaaggtagtcgcgatccagtgtatggaaaattactgaaaatcaggaaagaatattcaaaggggaaaaattttattttgagagaaacagagcagtgggattactttgtgagaacacttcagaagtgaccaagatggttttgaatgtaacttaatcattgtgtgatatctaaaaaccgaaaaactggtcagagtgttaattagtaatgagcgggaaaatactggggatgttccttgggctgatgtttgcaagctgaggctgaagactgaagagagtggatatttgtccaacctatagggagttaattaattaattaattaattaaagtggaactcggaatgtgtttggacggattcgattcgatccgtggaagggacctagaaacgcactactgaagattcttgcgtttagtcactcagttgacgtgttgacttgttttgtttgtaccgctcaaatcgtggttgccaaggcacaataccgctctgatgtcgtttgcatgctaattaatcatttgtaggtctcattataataaatacgacatgtgtgttgtttggtcttagatcagtccgcaattttgactcaaaagaaagtttgactttctatcttggggtgcaagtctgaatctccagcaaaattgtagtaggacttgggaatgaaacaggacaaaacagaaagcacctgcataacatattttgcgtatgaccgattattccgatagtgttgttgtgagtagacatgtgaagctcatagcccccagggaactggctcatagcctcgtagcctcacggaactgtctatatatcactccaaagatttttttttaaaaaaaaagaaatcacgagtataattacaatgtaataacaatgtaattttactataattgaaccagttgtatgcaaattaaaacaagatcactcgctggtttgcagatgcgcaatgacctcaactgagaggcacacatctcaacgcaaattatacggtccagaaatcaagtggtagctaaaaaatatattgtttcgaataatatatagcaaaatcaaaacctcaaaggtgaaatgaataaaactagactgcgattttttatcacctccatcacatcctaaatatataagtgatcatgcccctctctgatgtgaccatggctactatagatataaccgtcgttcacatcaaaatcaagccgtccaagttctgcaatccagttcggccacctgctacagtgtctacttcaaacggccgccaaaaatgcatgcgagctccgttttgggtccatgagtacttgctggaaagctctcggagtcatctttccaatggatccagcttcatcgccaaattccatcctagtcggccgaaatcacaaaaagaaggtgctgcgtcacctataatgggcctatgggcttgtaacttcgtctgggaccccggcccaagtggggtgcgccccaaccaggtggagcatgaccctagggttcccttaggtcgtcctcccacctccttaaatagttaggtacccctttagagtttcttgggttttgtttagatgaaagtttagccattgctacttcgcttgcagcgcgtgtgtcggctagaccgtccgtctgcttgtattcgaaaccccaacttatcgtgtgtattcattcctatttgcaattcagattgtttttatcttgttcttgcttgtttctttgatttgcttgcaggaataaggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcaggccaacaacagccttgagtgtcgagaggaactcagggttcatcactctccattcgttttcaaatacaagcggctttgatatcccgttagtacgcctgtgataatcttgtttacacccaaatttggcacctaggagtaagataggaaaaattgccaaattttagaaatctgccggtttcctccgagtaggccagtctgaccgccgtgtgttggccggtcagaccgccggttgagggccggtcagaccagcggcatgtggatggtctgaccggcaggtccgagtccgagtgtgtgtttcgccgggtctcgaagttttcttgcttgaaaaggcatgtttcaggtttcctttggattctatcccgagatggacggggaggagagcctatagagggcaagaccaacccctatataagggacatggccggttcaattataacagatcaatctacaatcaatcaatcgaatcgtttttcatattgcttttagtttttgctttagttcatccatctttgtcgatttgcgctgtaaatcgttcgccggcgctgcgagagtgcgacatctctttgtaggtttgtcctgaaaatcttcaattttgcccacgagacgggtagttatctaaaaatcggctccgctagccggtttagttatcaaaacccatcttggtctagtttttgctagattaaggtggttggcgactctaggattaccgcaaggcgttaagtgctgcgatcgtggttgtcaacttgtcacaaaaaattaccaactatttctacagatatctaaagataggctagttgctcagccatttacaaaacaggttttggccgactgcaaggacagttcctgtagtagtggatctaactgacaaatatggtttacaacatatttttccacgaagtttgattcgtttagtttattttgctcttcatgtttgtcggtctatcatcgctggctatttcgtcctcaatgatgatctaagaagacttgtttgggttaaaaagaataaaaaggaaggtagtttgtgtatatcttattgatcagtgtgttgccgtatttaattatagtccgagtcaccgatttgtttggtgatgccgctttgatgatttctcaaaaatggaacgaagatgggtggctgatccttcttttcatttacttttgcgcgagccaaaattggctaggttcgtggctatgctcgtctgctggcataacggagtatttatgaaaaatcctgaaattttcaataaaatcaaccatatctctctaagaaaaacattaccatcacatcacatcagatattatagttggcctataattctatacttggcaagcaagttccaccacgtgcaaaacagtaaattgattttttttaaagagaataaaatatctttagaactcgcgaccggctgcctgcttgcgtggaactttccaaaacatttcactgcagctgaaccctataaacagacttccggacgtcctgtcatcttctcaacttcactgtttcatcacaatctttagacttgagaattagggcctatttagttccgaaacaaaattttcacagtgtcatattgaatgttttgacacatgcatgaattattaaatgtagacaaaaaaaacaaattatatagttcgtcaggaaattgtgagaaatcttttaagcctaattacgtcataatttgataatatggtgctacagtaaacatttgctaatgacggattaattaggcttaaaaaattcgtttcgcagtttcatggtggaatttataatttgttttgttattagactacgttcaatacttgaaatgtgtgtccgtatatccgatgtaacatgtgtgagcaaatttttttccaactgaacaagcccttagcggaatacttaggctgtgtttgtttccttcttttcccaacccacgtctctcattttccacacccactcttttttagaccgctaaacggtgtattttataaaaattttgtacacgaaagttgcttaaaaaattatattaatatatttgttttaaaaaaatagctaatatttaattagttatacgttgagtcactccgttttacgtattagagggatcagttcccatgtctagcctctaggaaacttagttgatatatagcctgatacagataggctgatacgcatggacaagccactaagccagccgccgaggcggaggcgccgctgctcggcgcgctcgccaatcacaagcaacgcgagagcaccgcggcagcggaggccaagagactggtgagcctggcggcgccgctggtggcgagctgcatgctgtagaacatcatccagatggtgcccccgtcatgttcgtcggccggcccgcctcctcgcctcgtcgctcaccaacttcaccggcttccgccttctcgtaagtattggtcgaacaccttgctcgcgtacaagaagtgtctaatctctgcaattttcttggtcgattttgatcatcagttcggcgtatggcgagcgcgctggacacgcgccgaacgcgctggacacgcgctgtgcgggcaggcgttcggcgccgggcggcattgccttctcggtgtccacactccacaattcaggcccatatgtgttctgaatgactgtttaaattcatcagtaagtgtgtttgtaatagacttactgagatagctggagatgtcattttcccaacccatactgcttttatacctggaaggctgtgtgattatacatgaggtgctccatgagatgaaaagaaagaatctggaaggaattattttgaaaattgatttcgaaaaagcatacgacaaggtgagttgggacttcttgatagaggtgatggttagaaaaggcttccctagcaagtgggttaactggattaaaacctgtgtcatgggtggtagaatgtgtattaacattaatggagagaggactgatttctttaggacctttagagggacttagacaaggtgaccccctctccccgcttctctttaacttggttagtgatgccctagctgcaatgttggatagtgccaaaagggaaggggtcctcagtggcttagtttctgatatttttcctaggggtatcacccacctccaatataccgatgatactgttctctttgttgctaatgatgataagcaaatagtggctacaaaattcattctctactgctttgaagagatggctggcctaaaggttaattaccacaagagtgagatttttaccttgggtctgtctgacaatgatactaacagagttgccatgatgtttaattgtccggtgggtcagttcccaataaagtaccttggtttacctattggccctgacaaaatcctaaaccttggttttgatttcctgggccaaaaacttgagaagagattgaattcttgggggaataatctgtcccatgctggaagagctgttcaaattaatgcctgtctctcttcaatcccttcctatgccatgggtttctaccaacttcctgagggagtccaccaaaaatttgatagcattagagggagatattattgggctggaaacaaactgaaggggaaataccatatggtaaagtgggaggatctggctttcccctaagattatggtggcctgggtttcactgagactaggagaatgaacattgccctcttggccaagtggatcatgaaaattgaatttgaagatgatagcctctgtatagagttattgagaaggaaatacctgcatgatggggggttcttccaatgtaaagagagatatgcttcccaattctggaaaggtttgctaaatattagaagatggctgagcctggggtctgtgtggcaagtgggagacggctcacacatcagcttctggagagatgtctggtggggcaataccctctgaggatcctgtttcctgcaatttttgctgtttgcaatcaacaggagattttagtgtctcaggtcaaagaggggggtctggattgcttgtcttgtaggaggtccttttgtcctgaggagatttcagagattgaaaggacctatgaaagaagtcataggaaatattgaaacttctgattccagagattgtttaggttggggcctgtcagctaataaaacctacaccaccaaatccctcaatagagccctgacttttagaggtattagagaggtaaacactgagatttggagatgcccttgccctatgaagattaaacatttcctctggttagctctcaaagatagaattcaggctgctgagcaactgaaaaagagaggttgggatggatcagagttctgccagctctgtgatgttttggaaacaactaatcacattctttttaactgtgatatggctagatttgtttagtgtttttgccgagatgtcctcaattggaataccattcctagaaactttgatgatttcttttctctttgcaatggggtttcagaccatactcaacttagaatcatttttagtctgttagctgctatttgttggaatctctggattacaagaaataacatggtgtttagagagaaactggtctattctccactaactattccttttcaaattatttctaatcttttgcagtggagaaaactctttcgttctgaggaagaatgcaagctggacgcgctggtggaaaggatccgccagcgcgtctgggccaacgacggcgagatccgccagcgcgtcgaccaggacgcggacatcgccgccgaggccggcgccaacgcgcgctggaccatcctatcgctcgtacgtcccctaccacatccggttcctgcaggtgcagagcgtcgtcgtgccggtgatggccagctccgccgccacggcgatctgccacgtcgccgtgtgctgggcactggtgttcaaggccgggatggggagcaggggcgccgcgggcgctgagcattgccatcttgtactgcatgtctgcatcaacctcgctatgcttgctctctatgtcaggctcccagctgcagggagacatggacggggttctccatggatgcgttcagggagctccggcgattcaccgagcttgccataccatcggccatgatggtttggagtggtttggattattccaggtgttgtttcgatgggcctcaatctcgatccattcacatgtgtgggccgggaatgtgaactaagttccaaacccatatatgtcgatggcaatgggcttgaatagaaaatgatatagagaccgagcgcttgctcgggtggcaagcgtcgccggtgggcacgctgcccgcgagcgttcgaacttcgaacaccaggttcgacactcgtgctcgcccgggggaatttttcccctctttccccgggtctaacttcggttggacccggctaggtaatagggtacacacacgtgtgcgcgtttagtgggactgcacgtttcccatgcactgaggcccagtgcctccaatctcatttctagcgtgtgttagggacacgcacgcgtgtgtatgagtgtggtgtgtgtaagtgtgtattcccttctaaaaaaaagaatagaaaataatataagttgagttttcacaatgcaatctttggttacttgatttatgaacaagtctttttttttgtgtgtgcagcatggagtggtggtcatttgaattagttgtgctgctctctgggcttcttcccaatcctaagcttgaaacctcagcgttgtcaatatggtatgcgatgaaccctaagattattaattgcatataccataaaggaactaattatcgaaatacatcttcctcttttctactttctcacttgttaattatgtagtctcaacaccggttctctgatgtttatggtgccatttggtctctgcacagccataaggtatgaaattctcactcagttctgaatattcatttaaatatatgttccatgtttcactcaatcaattctgaatatccatttacatatgttccaaatttttctgtacatagtctgattgatttcctttttaaattttcattggtagcacgcgtgtgtcgaacgaacttggagcagggaagccttaagctgcaacgctgggaacaagagttgtcatttgtatggccttgtcttaagggtttatcatcacctgcacgatgattttgctacgcaatttgtggggatatatgtacagcaatgaggctgaagttgtcaaatactttgctcgttctcacgatatcctttttcatgatttctactgtgtaagtagagaataccggagcgtaactctaattgagaacaccacttcgtctgagttttatcagcatctctttaagaaagttaaaacgaataatatcttccaatacaaatcaaattagttacggcaagtccttcagatgaaatccaagttactatattaccgacacataaatcaagtccaaatgtccaatggcacaaatatagtcaaatcgagcatctgtgacaaggtttttttttttgtaacggaattgctaaagctctatcaacagaaaatccaacctcaaatcttgcaaattttggatcactggatgtggttcacgattcgtgctcttcttctccaactccggcaaccacctcttcttctccggcaccggcgaacccaaactccggtagagggccgacgaattagggttccggggtggggtggggctgggaaggggaagggggaggaggaaggcgggggagttcgccggctttagaggaatggccgtgggaggcggcagcccggcggtggcggcgcatcgggcgggcggcgaggcggcggcggcgccgccgaagccgcagggtcaggagcaggcggcgggagcaaagcggaaagagtggtaggaggaggcggccggtggtggcaccccgccgccggcgacggggaagacgacggacagctcgccgctgccggcttgaggcaaaggagaggagaaggagggggaaggggagggggagggggccggccggggtggcctcgccggcactgttgacacctttcggccagccggcgaggccgggcggcagcacgctggggtgacggcggcggtggcggaggtggggggaagcactaaggagcggcggcgtgaagaatcgggaatggagagaggagagaggatttttagggtttggttgcctgcacgaatcttaaagcaatcggatgctccaaaatttgcaagatttgtaagggggttttctgtcaaatgatctatagacaatcccttttcgtaatggattatagtccgaaactctgtgagatgatgtagaagacaatgaagtattgtatcactggaggagaaaccgtttgtagtcccgggtggtaaccccctttagtcccggttgtccaaccgggactacgaatccgggactaaagataaaaataaccgggactaaagattgatctttagtcccggttcgtattaccaaccgggactaaagatcggtcagccacgtggccggccaaaccatctttagtcccggtttgtgttaccaaccgggactaaagatcggtgcaccatttttttatttgcatggccctgtttgctgcatggttgattttatatatatatatatatatatatatatatatatttatatatatatatatgtgtgtgtgtatgcatatgtgtatatgtataaatcatatattacacacatatgtataatttaaagcacttaacattttatgtgcatatatgttaccaaaatatatattaacactaaagtaaatgtgtacatatataaatatatatatacatgcatatatagtacaattcatttgctcggtagctatagctacgacttcgacgccggcgttatgtcagaagaggaaggaccggcgttatgaattgtcaatccatcgtagtagaattcaccatcaggattaaggacttcttcgttgatgaatcccatcagttgttcttgaacagccgtgataaaatccttgtgtgggagattatccctcatgtgaatacgctatcattcgaaaaataatgacatatcaatatatgaaattaataaacaacttaacaaatcgatacgcaatgaaattttgaatggtttatgtatacgtacatcgagctctcgtgttgtgcacatttggtttgataggcagtgggcatactcagtagccgcataagttagttccctggtcctgctttgcacactacatgagaaacgatgagagatttaatatactctttatattaactgtaattagagattcaattcaatataattttggatcatgcatgtactcactggaaaatgaaacctccgtccaagtttttctttctaagtcccgcagaccaattgacggaaccgatcccaagccctacatatgcagttgtaagctatgattaattaattattacccgagatcaatataatagcaatagattccccgcgactttggaatagatgacattatattacatgtctatcagttggaagaccttgtcaaaaatcgtctcctctttattcattgagtcgtacatagtggctctgcatgcgtccaagttgaagaataacaggacccggtggaatctggaatatgcgtgagatgagatatatatgaaaatatacatgctatatgtatgggaacgaaatttgtttgaacgacaataaaaactcactctatgttgtacggcagtagtatgtacgtcttgaaatgctgctgcgttaggagatggacgagattgtcctctgtgtctttcttgtacttgtcgatcatttcggtgttgattttccaaggatcgatgaacccagtatcgtagaccctccgccgtcgggccctttgaatctccattctacaacgttgaaaggaaattattattgcttacatatatgccaggagctaattattgaacgaaacaaattgaactcaaagatactcacaaaatccatgcgctcagaagagagacgtcgagagcgtccagatggtacagatcgaagagatccttgaaatggatccagagaacatcttctccttgcaagaagtcagggtttctgatcctcgctccgaacatctctctacccttggcgctcatttccatgtaccgttcatggaatttgtacatctgtgtcggtagggactgcagctgctcaggcgtgacaagcggtttaccgagttcaaacttgtatgccacttccgcctttgggataggtgcgcctcgaatcagctgatccacagttagaccggtgtctgaaatgaattctgttatgccaaaatcttcgccggtcaccaacggctcgacctcttggtttggttgttctccaagctgagggactggtttggacttcttgtgataggctctctgaagtgttcggtcatagtccgatatctgtaaggcctccttgtttgttgcggacattcacttgaagaagttcttctcgctcgggtcaataggtatcttcttttcaggactccgaggcttgagttgcctcttcacttctcctgccacataagcatcaagctcctcttgactgcaatcgtacggtggctccttgtttttggtggcgtcaactttcgccttcttcgttgcccttgtgcgggcaggcggtggagcttggcgagaccttgtcttgggaggtgcaggcggacacggtggaggcggaggaggcggaggagctggaggagccggaggagatggtgcaagaggaggtggcggaggagccggaggagatggtgcaggaggacgtggcggaggaactggaggagatggtgcaggaggagatggcggagccggaggagatggtgcacgagacgccgcttgtcacccagggaggatgatgtaccgcttgtgccatagtataatggcgtggcttgtgtctcgtagatacgtctcaacgtctcctcctggtagtccaactcgaggtcctcgtacgcggcttccaccagctcaacttcgaccctcgagtatcctgctggaatcggcctgcagtggtaagtcccagaagggtccgttgggatggccattcccgacgccacctttacgtgatgagaggttatctattagtaatcaacctaagcagtaacttgcggaatgtacaagtcaaaaatcatcaaactacgagcataccttgattgataagttcttgaagggaatatgcagctcacatggtgtccgctgcgtgatctcatcaatggggcaggtggtttcatcctgggtttgcatggcgtctatgctctgtgatcctacttgccccgttgaggcgcagctactacgattgcctgatgggctgaccattgcaggaggaatgtacggttggggatcctgggacagatgtgcggccatacgttcatccaccttcctcttgcatgctgagctcgtagctcaataccctgtactcaagatctgcaatcttcacctcggtatctttcttgctcctcatccgactcctgtacgtgtggatgtcctccttaaatccaatcttccagggaatcacgcctttccctcgtgttcgtcctggatgctcgggagtctgtagggcgagtaacagctcgtccttctctctgtcgggtcggaatgtgccctgagaagaggcttccactgcgtccgttagtcgactggcagcctcgcgtatctgatcgctgaagacaagggagccatcaactgggttaagcgttccaccgtgagcatagtaccagaacttcgatcgatccggccatttagcggtggccggttcgttacccctctcaatcaaacttgcctccatctcctcccacttcggcattgcgacgctatatccgcctgaccccaagtggtgatggtacttcttcttggcggcattttctttgtttctggccatcatcgcttgcccttgttgccctgtcttgtaagcaacgaactcgtcccaatgatcccttagctttgggaatacgtcgaagtttggtgttagtctcttcaggatgtatttcttgtagagatctcccttgaatctctggaactgttctgccatttttctttagagtccactgtttcactatgttctccgtacctgtgggtagcgtgaacgtctcgagcattgtggtccacagcatctctttctctgagtccgggacaaagctgtcattatccccgcgtgcccttgttctgtgccagtacaccgtgctgacaggcacgttgtccctcacaacccaaccgctgtggcgtacaaaattcttggctgcttctgctgggccactaggtcggccatcttcgtccacctcagttatgatgtgccgaccctctatcttcttcgcagcacctcgttgtccgcgtgccctcttctgtccagcggagggatgacttccactggcctcctcatcgttcccctcctcgttcccctccgcatccctctccacgttcccctcctcgttcaagtactggtttggatcctcgttcccctcttcttcgttctagtactggctgcttccctctgcgattatatcatacagtatatgttcctcatcgctatcagccatctgtgcatacaaaaaatatttgttagatctataggtcatatttgctaaccgtaatattaaaactctactaatcttatattaaatctctaataatcttatattaaaattgtaataatcatatatgctaagtctaacaatcttatactaaatcggtactaatctcatattaaaattgtaataatcatatatatatatgctaagtataacaatcttatattaaatcgctactaattttatattaaatctctactaatctcatattaaatcgccactaatcttatattaaaattgtaataatcatatatatatgctaagtctaacaatcttatataaatctctaacaatcttatattaaaattgtaataatcatatatgctaagtctaataatcttatattaaattgctactaatctcatattaaaattgtaataatcatatatatatgctaagtataacaatcttatattaaatcgctactaatcttatattaaatctctactaatctcatattaaatcgctactattcttatattaaaattgtaataatcatatatatatatgctaattctaacaatcttatattaaattgctaataatcttatattgaaaatgtaataatcaaatatgctaagtctaacatacttatattaaatcgctacaaatcttatattaaaattgtaataatcatatatgctaagtctaacaatcttatattaaatctctaataatcacttctttacatcacttgcctgcgcgaattccttcgatggctagctaccacttcggcttgaggaacgacgacgtcgtcttctctgcaacattaccaggaaaatgtattagtctaaacgggccaagttacatatatataatcatatatgtattaccaggaaaatgtattagtctaaacgcgttcgttctcacacttttagtacaagtgcattcacgatcgtaagcatttcgttcacgttcgttcacgctcgttccagttcgttaacgtttcgttcacgttcgtttgcatttcgttcacgttcgttaacgtttcgttcgcgttcgttcgcgttcgttcacgttcgttaagcgttcgttcacggtcgtccacgtatcgttcacgttcgttcgcgttcgttcacgttcgttcgcgttcggtcacgtttcaatcacgttcgttcatgttcagcaatgttgggcacgcgcggcagtggtgtggcggcgcggcggcggcgtcggggagccgtgggccggcccggcggcgtgcgggcgcggcggcggcatgccacggcgatggcgtgggggtccggcggcgtgggggcgcggcggcggcgtggagtcgcggcggcatggcgtagcggcccggcggcgtggcgagctcgaggcgggggcagcggcatggcagtggcgacggcgtcgtcggcggtgacggccgcgtcgaagtcggtcgtcggcggtggcggttgaccgcggtgtggcaatggcgtcaccaacgagctaggcggtttatagagagagagagatcgagaacgagagagagagagaggcagcggcggctctcacccaagagatgtggcggcggtgtctgcggcagaggcggcgaggaccgccaagcgacgacgagagacgacggcggcaagatagagcaagaatgattacaaccacagtactcagcaagtctcatcgggagatgcatgattaatgcaaaggagtacaaggggtaataatataggggttaggttttgcagtaaagagcatttaaaagacacttagttgcccaaagctattttataaacacgattctagagctacacaatattattaatcaaggccgtggaccctcacgaacctgccttaacccaaggcctacgatgattcggaccgaactggcaacccgacctgggtcccagctcgtcccaagccaacccaggccaaccattccacattttagttgttaagcaagttttaagaattaaaccactaacttggatacattgctaagcttgcccataaccgagcgcgaggctattcgaatagatttactctgatcagaggtgtacatctttacccacaagacacatctttacttcgcattccatggccttggaacccgttgtaaacatgtgacataacccttcacccatcctagccgtgaacaaaagtaccgacccaaccctgcctacggccggtatcccggacaagtaggccaggattgagcccctagcaacaggatctagaccgggtgcgccacacacattggggtgagaccacccgcgtactagtccagtgccatggcatctcgactaacgggcaccaacccatgtagccttcatttgcctagacatctcgattaccgagccgcagctcgtgtagccttcatttgcctcagagatatccatcatcgcaacgacttcatccacctctatccgtgtccttttgttcaggactagactgagcaccgagttaagccttacccattagacatgtggttagtatagtagtgctttgcaacagaggcccgaagaccggtccttatgatagccgaggtgctcctagcaaaaccatgcacctcgagcctagcctaaaaccattttggaagttttgaatagaggggggaggtgtgtgtcaattccatcacaagtcaaccatttcacaatgtcaaaatgatatgagaactcccaaagtctaaagttatgaaaccacctagtgttgcctaattaatcagcgaagcatctacataaattcatactagtggaaccatgaatagattacccactagttggggttttattttcctagggtgaacaaggtgataaataacaatagcaataataataaggtcataacaaaggttaataggcatggctaaataaaacaatgataacgcgggaatttaaataaagcgataattcattaatttaaatcaaaataattttataaactgggattcaatatgctcaaggataatgcgacttgccgtgctcagagagaacagccttccgaaccttcggcgatgaccgcgaacctcgctaaccgccggaacgacagaagctacgcggagaacacaagcaaagctacaagcctataaagaagcaataacaatacataaaaagaaagcgcagggttctttaggttataacaaacattaaaagacttgaactggtcgattcggagttcgtatgaccaaggcatggtcatctgaagcttaatgctgttatatggagatttgtggattattataattaggttttgcaactataaaaaatgtgtaagcgctagccttaaaaagacaggaaggctgcgctgttgacatgcggaccccacatgtcatcctaaggaaccacgatagaccgagtacacagagacggtccatgggtcgacgaaagcagaccccgtgtgtcaaccgaggcgagtggccgacaaatggactccactagacaccacgcgggctgcacacgtggaaaccatgcggctaccgagcgggcacactaacacggtcaccacacgcacacacgaacgactaccgacactggtacacgggtaccggggtcgataaccgcacaacgggcaaggggcaacaccgaaaagacgaggacggggcagcgggagaacggacccttaccaccacgtgatgaggcgtgggaacgacgacgacgaatggctcggtagagacggacggaaacgacggagatgaacggacgacactttggcggcgatccttggatgaaggcgagacgcggccgacgcaacgcttgacgacgcggagccgaggacgaagacaacgacggggctgcgacgcactcttgacgaaacgcgggcgacgaatgagcacggcttgacgaagggagggccgacgacgagcgggaacgacgagaagacgacgagggcagccggcagcagctgcacggagacgaggacggcgtggaacgcgccactgcgttgtcgacgatggaggcggcgccacgggacgacgagccgacggagaggaacggccgaccggaggagacgttggcgaggacgaccggcgcggtggcctccgggcaaagacgggcagcggtcggggtagaggacgacgcggcgacattgtggtaggatggcgacgatgacagccgctgcactggtgaggcggcacaggcggctggaggcggtggagtggtggcgacaccactggtcattggcgaggacgcgtctccggtggtttccccgcgaaacggaggcgatgccggggaagaggatgcacctgcgaggccgagggtggcgacggcgcacggtcgtggtgggaggtgcggctggaggttggccggcgccggagagagagaaggagaaggcggggagaggcggggcggccacgggagagcgcgggagggggctaaaactggagaacggaccgagggggttccattttataggatgggggagggagccgggcacgggagaggtgggaacggcagcggaaaagtcggccggtggccatggaaagcggccgggattggcgcgggcgttccgggtgattaaaagcacgaatcaagggggaaatatgggggaaagagagaggaataaatgggtattacttccccctatttaattttggaatctccggtttgaatgaggtggatttggaggagggaacgagctagggttcacgggagagagtgaggaggccgggcggctggaggaaggagacgacgaccggcgcgtgggccccacgcgggcgcgcggtcagcgcgcgtgcaacgcgggaggggagcggcttgggccaagagaaggagggagagaaggaaagggagagaaaaagagggaggaagggaggaagggaggagggggattatttttagtttttctttttagtaaactttgatagttgttgttgttgcttagtaattatttccggtgttctgaaaattcaaataaaatttgagggctccttttagaccaaggagaatttaacgaaaattcttcgggccacat

SEQ ID NO: 45613 - DNA, 1517 bp, Oryza sativa
atgttctcaccaaccgggagtaaagatcttttcctgctatttccaaattctttttaaacccggttagggttaagaaccgggactaaagataatagcactgaattttgaatttcattacatatgtgtttctaaaatagtaaataatacattacaattatttaaagtcgaacaattaatgacaaaaccttcgaaaaattattgttgtatgtcgtagaataagtggataatatataataagcacatgaatgatttaaaattgttaaaaattctaataatcatatatatttagcatatgcatgatattaaattgttaaaaattctaattaacatatgtaaatagcatgcatgatttaaaatttataaaaattctaataatcatatataattagcatatcatgatattaaattgttaaaaattctaattaacatatgtaaataccatgtgcatgatttaaaacttttaaaaattctaataatcatatataactagcatatggattatatcaatttgataaaaattctaataatcatacataattaacatatgccatacaacaattgatttgtatggatattcaatacatccaaaatagtttacatcgtgtacacaacaattacggcaatacatcggcggtgacggttgacagcacgtactttctcctcactattgttccttccttgtgatcgctacgtgagtaaggggtgtcttcatttgataggaggatgctagggtcaatcatcaccgtgaaagggggttgcccatcaaactgattataatcctcgtcagtcttgtcctctactccgacgatttttctttttcctgggagaaccacgtggcgcttcggctcgtcaggccctttgcccttttttcctttgctagacatgtccttgacgtaaaaaacttgcgttacatcattggcaatgacaaaaggttcgtccgagtatcaaaccttgttaaggtcaaccgttgtcatcccactgtcatcaatcgttacgcctccaccagttaacctaacccattggcaccggaacagagggaccttgagaggtccatagtgaagttcccatatgtcctcgatggcaccgtaatacatgccagttgtaccatcgtgtcccatggcactattctggttcgtgctcttcatgtcttgggccctcgtgtagaatgtgtacccattgatttcatatccctggaatgtcgtgatcgagccagatggtcctctcaccaggaaggctagtttttagttaatcgtctcgttacccatgagatgttgtcgcagccacgcggagaaagtattgatgtgatgccgtgtaatccatgcatcggacttaccgatgtttctggcgtgaactagagccaagtgctcctcgatgtagagagccaccaatgaagattgttgcagaaccatgaaatgggctttacggaataaattgttgtctaccgtcattattgctttcgttccgagagtcccctttccccgtagtctcccttcatggcgtgattcaagtaccccgat

SEQ ID NO: 45614 - DNA, 14237 bp, Oryza sativa
  unsure (1)..(14237): unsure at all n locations
ggacaccttccttcttccacaatagtttaagatcttcgaccagtggtcttaggtacacatcgatgtcattaccaggttgcttggggccttgaaaaataatcggcatcattatgtacttcctcttcatgcatagccaaggggggaggttgtagatacacatcgtaacgggccaagtgctatggccgctgctcatctctccaaaaggattcatgccatccgtacttaaaccaaaccgtatgtttcgttcgtcctttccaaagtctttaaattttctgtcgatgttttgccactgcgaaccatcggcggggtgtctcagcatcccgtcctgttgacgctcttcagcgtgccatcgcatcattctagcattccccttgttcctgaacaaacgccttagccgtggtattatagggaaataccacatcaccttagcaggaattctcttctttgttagttgcccgtcaacttctcctggatcatctcgtctaatcttgtatcgtagtgctttgcaaacagggcatgcttctaggttctcgtactcctcaccgcgatataggatacaatcattcggacatgcgtgaatcttctgaacttccagtcctagaggtgcagactatcttcttagcctcgtacattgtctcgggcaatttgtttccctctagaagaatgttcttgacgagtttcaataaatcgccaaatgccttgtcactaacaccattttttgccttccattgcaaaaactccagagtggtatccaactttttgtgcccctgctcgcaacctgngtacaacgacgttctgtggtcctctaacatcttgtccaatttatgggcccccttttcactttcgcagtcctccttggcatcctgcaacatctaaccaagatcatccgcaccgtcgttaccatcagcatccctttcctctcgcctgtttgatttccttcaaatccagcgtattgagcaaagtccggaatattgtcgtcttccacttcatcttcttccatttcaacaccttgctctccatgggatgtccaacaattatagcttggcatgaaccccgactcaaacaagtggaaatgaatagtcctggatgtagaatactccttctgattcttacacttattgcatagacaacaaataaaacccttttgcctgttagcttcggccactctaaaaaaataatgcacgccgtcaataaactctttggaccgcccgtcagcgtacatccattgccgatccatctacatgacatgaaaaaaaatcgtatacaaataattattcgtacaataatgacagtcatacaataattataaaataattacaaactctttcaacagtcatacaataatgatatatcattattcatacaaaaattatgaaatattacaccaaataattcttatttactatttctaaagttttaaactaatattaatgtgttgtacttcttttaattttcattttagtttgttttctattattcaagattaactttcactatattttccttctcaactattttataaaaccttctttagcaaataaattaaatttctatatattctttcttccccacacaaattttctctctcatcaacttacaacaaaattttggagacaaaaaagtgtgcaaaacatagctccgaatgtaatatgaaaaaaaacattggaggattaagttgctaaccttttaggcacctccaatttgtatataatcaccaaaataaattcactagaaattttggcatgacctcccctctttttttaagaaattttgaagcttgctcgggctggaggaggaagaagacatatatatataggggtgggactttagtcccggttggtgttatgaaccggtgctaaagatcgccgggatctttagtcccggttggtaaagatcccgggggagcctgacaagccctgacagcatttgaaccgggactaaagacggttggtgttaccaaccaggtctaaagatcaaatatgcccgttaccctttttaaccggaactaaagatcatctttagtaccggtttttgttgtaacagggactattgtggaattaggccgaccgacgaaagatggtttctccaccagtgtattttaactgtgggaagttagctgttatggaaagcagtgtgaagattcttgtgtttttgtctaattaagccgtgcttaagcgtgcggcttccaagttgttggagatcggatcgtagagaacatccaagttatctgattcagactatttagattgcgttctgatgagaccatcaaagttccatctatctctatcgatgcttctacatgtttgcataatagctcatctaggagtattgttcaggttggatctttcttttgtaccgtgcaacaacgaaagaaaggagaaggcctagctgcgagcagtacttttataggttaattaaggtaagtgctattagcggcatcgttaccattaatcacataattagattactttttatttgtttgtttgggcctgctcgagtaggactctgatcctgtattgcctgcgtgcaatataaaagcccaacgtggcctgtaatcagtggcggatccagaaaatcgattcgttggtgtcataacgtgtatattggtgtcatagtatgttaattatgtttagatcataatgttataacatatggataaacagttttgctataggttttgccgacaccgcttcagtggcgaatctaggatgaaaatagagggggtgcttctaatatcctatgtacaacccacaatgcaatgaaaacatactaaaacatgcctcagcatgttgtcctgatggctgagttggacccttcaacatatatgccctcctcacttgatctataatctccttaggataatcttcaatttgtttgcgacacgctggatcggcaacaatttcactaggatctaaaacatgcctcggcatgttgttctcatttgttagattccttcgtgggtaaaaattatgcaatgtttgattctccatccttgcaaattaactgtcctatgtgtgcttaaaataaataattgatttactgaaatttactgcagtgatgataaaataaactgaaactgaagagactagtgttagagtagagagcaaatagattgatttacctgtactggttgtggctggttgtggcgttgtgctggccagccgggcagcagatgatgagatcgttgtaggctgcaactgcaagcaactcgtcgactcgtcgtcccgtgatccgtcctgcaggacctccgcggtggcgcgatcgttgctgccgccggcgctgtcgcctgacgcagtgacgcctcgactccttctgtatcgcgcctccttctgcgtggcgctgtgacggcttgctttctcggtcgccaaccccatgggccaggcccagcttgcgaggaaggggagggggggggggggtgctgtcgggtggagctggggctccagccccaacagtacatccgcccctggcccctgcctgtaatgagagttagtttttgcttttggtgaagtcgtctagggtttattcctgtcgaactggaggatggcgatcccatcttgttgatttgccgctgccgccgtgaggtgtggagggagcacacgtccaggatacttctccagggagtgttgcttggagtcaggtttggttccatcttctctaatcgtgtgtattgccacacgggtggagttgcagatcgttgatatgtatcagtgctttaaaactactatctgttattgctgtttgttttgagagacaaaatcaattcactgcgacgctcatatacatactgccggttaatattgttcttactgctttgatctactcatttgtttaagttggaaaaataatcgggactgtctagtgcactgtcgacagatttttggacctccgatcttgtcaatttttttaaccaacagatctatatccaacagctaatattatttgacaaataaaaattaaaaatacataaatgaacaaacacaaataggtttggaagcccattttcaaagggctcaacacaacccgacccaatcaaatagcctagattgagcccgaatacaaaatttacatcaaatgaaagcccaaattaactttgtagtcaatttaaaggcccaaatcaaagaacaacggctcagaaaggatttagagggagaaaaaaaattctttgaaccttcttgatatgaatcttcatcagaataaatcacaaaacttaactcaaatcttctgatattgatctacatttctgtcgaatgagattgaactgtaaaaattaaacaacaagttaaagtcactctgaggacccttctaatgcagcacaccacaactcaaattagataaccaaaatgtagagttgcagacacattactgtaaaaatgtagaaattcagagaacagaccacaagtcaatcagaaatagaggagtcaaacacattattgcagagctaattaattaacaacaaatttagaattaagcccacaagtcaatcagtaattcggaatacagacatattactgcacagcaacaaaaatgtcagaaaatttagaatttaggacacacctcaaatcagaaatcagaaatgttcaattggtgatatattaagtagattgacttcagactgttcacagatcgaaatatttgagtgtttagcttcggattttcatatgaatctccatcaaaaaacttcacaaagcttcatcactccaaaaaaatatcttcttgagttatgggtctacattttatacataaatcttcatctgtcaaaattaatcaccagttaaattcataacaaaaaaaattcttgacttaaaactttacagaaacatcacagaactttacaaaacaaattaatggtaggaatttatgtactcatatgtattagttcagaataagaaaattagatgcaatacctctattaggcaaaacaaacatatagctgcaaataaacagatgttagagtatttagataatcaaatcaaacttcaaaactaaaaattataatataaaactaaattaaaaattgctcctagttgtcataaaccattcacatcatgcacaatgcttcataaattgagaatattcagcagcattctaatttttttcttaaattacagttattttgtacaggaattacataaaacaaacattgtaattttaataatataaagatgtaactgacatcttgtagactaaagactttatataaacatcacatatcatattatcttagaattcaattgttatgtgtattcttaggttgcacaacataatgacatatgacttttgcattgcatattttctggtcatattagaactcatgcaaatatgtactgcatatgtactgtattcagaaccgaacttatatcaaaatttggatttcagagaatttatattacatccaaagtcaacagcaaatatgtcaaaaaaatcagagtatatcagatttaggcatgtatctagaaactgcacaaagtatatctatatatcagagaatttatattacttatgtaccaactgcacaaagttcatggaaaccagatttcagatgaagcatatcagatttcatatactttgcaagtaaagttgcaggtacaagaaaagtcaaaagatcaaattcaggagcaaaagcggatcacgaacaatgcatagggggaaagagttgaagtcaaaattcaagcacttaataaatctgaagttacatttaccactttttgaatcttgttttgaatcttcttctgaatctgaatccagtggcatgttcatttgtttcttgatcttcaaattgcgtctaaaatccagaattcggaccacacctcaaacttttagaatcttcttttggttttttgatttggatgttgatgtacaaagtacttcgactctgctatcaaatggaaacaaaatgaaacattcagtcaaattggtagacggaaaattaacatatgaaaataccagtgcagaaatcaacaatgaaagcgtcttgctcgattttttgtttcagtgttgtttcaggctaatatgcaagataacttatcaaaaattagtatactatgaatcttgcatactaaattgttttagtttcaatctttgcagcataagattactgactaaatcaaatcatcagatactatacttgcaattttcaaattgacaggattaagtttcagaatttggcacaccaatcaagatacattattttcatagctgaccaaaccaaactccatctgaatgaggaacatacaaaataaactaaatctgaatctgaaacttacagatacagtaaaacgttaaaaaagtaagattttaactgaaaaaatcttacaatatcatagataattaataactgaaaaattatacaatctcatagttgagttcgagtttgaatgatttcatatgttgttcattatctacaattatttgcaggaatctcatcaaacaaagggaacttatcaaaatattacaaaaatggtggaagaggacaatcgacagtctggaaaaaattgcacaggtttgcagattacatattttctgcttaattattttgaaaacaagtgaattgagcacacacacacacacacacacacacacacacacacacacacacacagatatatatatatatatatatatcaaaagtgatttctggaatattccatttgaaggtattaaagatgggaattttcaagatagtcaagaaacatagacaaagtacatgtatgagccatctttataaaattacagtatttttatatcaaatttacagttataaaaacctgtaattttagattcaatttcatgtaaatgatacaaaatcaaatattatggtcacaaaaatcaaacctgcagatataacaaagctcccctgtcagtgtagcaaaatattttagtttcaatatggctgcaccatagccgacaacaatcacccgcatcaacaaaacatcttcaaggttcagagttcttaattctagtcaggattaggtgcaaaatggtatacacaaatgaaatggagtaaaagttcatttttttttatgatagtttgatacttgccgatatgattctgagcaactttgttcaggtaggagatgcagcgcttacttaactgattaagactttctccaccaccctaaacatcatctgaaacagtgataaacttttcaaagttatatagtactacagctacaaaatgttatacacttattccattttttatttaacagacctagacaaagttacatttctgggttataattgttccaaagaaaaaatacggtttggaacttaccggcaattcttggtttctgccatcaaagtacaaaccatttttaacttcaaaattagcaaagcctttgaaaacgcctgggcttttattcacagtgtcatcccacgtcaaaccttgcagatatcccatgtgcctttctcttagtgattcagtcaacactaactgaaacaaattattggtgttactcatagaggaacaggcaggacaaaagtaggctagaactcacatttgatacatcacaggctttctctatgatttctgcagtctcagcagcacgcttcaaatcagacgattatacaacaattggcctagcttctcttgccagacgatgagccaccttacaagtttgcatcagatcgattcatttcaaacacattttacaaatccacagcaattgtacccataaactacaggattcaccaaataggagatccaccgattcgcatacaaataagaaaaaacaaacactcaaataactcacctgagatgccagctccaaatcgacgcttcagccaaagaaataacctacaacccaaacaaaattgagattaaaactcaaaatcacaacaaaaaacaatgaaaataggggcaaaagcaacaaaaactcaaaagcttcaaccacacacacggccgaatcagggaagaagcaaatcactgaagaaaaaaggttgacgaacagatccgccgtctcctcgcaaaaatagagattaaaactcaaaatcacaacagcggtgatacgcaaccgttgatgaattctcgacagcgaacaatgaagaagagaacaaatccacataaaaagttaaggaaaagagcaaaaaaaatggatccatataaatcaacaaaataagacgactcatcatatttaactcgtagaaggagatctagattgctgcaaaacacagagaaaaccctataataaaaaaaaataaaaacacaaattagttgaacaaatcgatgcaatcaccaccttacttggcactgaggcacgcaagcacggcacggcggtgatacgcaaacattgatgaaaacttagcggcgaacagtgaagaagagagcaaatccacaaataaagtaggggaaaagagcaaaacgtagcagaatgcaagcacaaatgctaatgaaaagaggaacaagcaaaccacaagagacaagccggcgagacgccggcgagaagccagcaacgagaagattcgccaggctaatagcctcgacggagacgacgagagaaaagaggaaaaagaaagaaatttcgcctcactctctccccgtgtcaaaaggaatcagaaagcaggcgcggatttcaaaattgaacagtaaaggcaggacccactaagcccaatccaatctagataacccaatccagcacacagagcaaacccagactatgcacgaatcacagaacaaaacgaatggaccaaaaaacgacagattgagcagtcaataatctgttgacagagatgtagcaattccgaaaataatctggttggtttattcagttgttggtaccgtgaaagagaggaaaaatccgggcattcactgccgggtgctcatcatctattatctttattctagaataaacaaacctactactccctccgtattttagtgtatacgtcgttgactttttatttgaccattcgtattattcaaaaatgttatgcaaatataaaaatatttatgtcgtgcttaaggaacatttgatgataaatcaagtcacaataaaataaataataattatataatttttttaataaaacgaatggtcaaacgttggttaaaaagtcaatggcgtcatacattaaaatttaaaatacagaaagagtataaaataacacatcataatactatgaatcatagaaaggccacaaacgaaggcaaccttactctaacagctccacagcttaattattagtgataaaaaagcaacatatagataaaacttttatacatgtgttatcaagtgacttaaaagccaatattaaaaaataaaatactttaaaattatcctaaaaccaactttaaaatttaaaatttacaatttgacagtgattccatatagaaaaaacaatgagactgtgaaaagcacgtgtagaattgtcaatacctaacctgtcagcaatcttgtccgagaaacagggatccaagccaaaatcgcagtgggtcagtttgttttttttttaagtgaaacggtggatcagtttgtgacgaggacatcccttccaacgatacaaccacgcctattgcacagcaaggaccaatgactagagctcgagctcatgaacttaattatcaggtaaagtcattcctagctaatcatacaagttcttctcagaattgggtgctactaaatggttgttgtgatctacttgttgttaggaatatgggagaggaaccaaatcgcaagcagcactagcagcgctgatttgatgaagtcaatgctcttcactccggagggcaaacggggcaaatgagtacttgttggaaagatctcgtcgtctactttcagctatgtgtggcctcaccatcaagtttgacccaggctgctcagaatgacgaaaatagttctttacaacagaaacttgggcttgggccttgtatcattacagcccattaggggtccacagaacctagggtttgctcccacctcctctcctggtcattcctccacctatataaactcctagcagccaccattttgcactttgggttttgttttgatgtaagtttagctgcagctacttccttgtactcgcgtgtgtcggctagaccacccggatacttgtattcagaaccccattttggtttgtttaagtttcatcatttgacaagtgtcgtgagctgtttccttgtcaacttgttcttgcttgttcttcgattgcttgcaggttcaaggttgttcttggcacggcaagaacagcaacaacgtggagtcggtgtaccggttgctaaggcgcagcacccctgtggtagttgtagtcggaccgccaacgtcgtatccttccccaaatcgaagtttatcctcctctcatcgaaagatcgggaacccccgttgctgcatcaagtggtatcagagctcaagttgctcggtgagagattttatcacttctttgtttttacctacagcccaaaagaaaaaccactaaaataggtcagacccgaaatcaccaaaacatgttgagcctttgctgttctacttagtctttgcttgctgagttttcgattgcatcgattggttgagttgctggttctagtagtttagtcctttagagtttcgagttctgctcgcgatttcgtcaccgcaaacacttccaccatcacttcatttatcttcatcccgctgccaccatcaccaccatattcaccacgaaatccacctccaaccccaccaaatttcgtccaccacaaccagcagcaccctcatcaccacatcagccacccccaaatgcatttattgctgcctccaccaacagccaacccttttgcaactttttgaagtgaatcagcccttcccaagaaagcatttaagtgctctcacttttgacttgttggctgaatcatgtaactagccaaccaacccatcattacttcttgtttcgatttgttggctgaagcttgtgaaatttcgaaaatgtttgagaaaaggttattttgctaaggcttgttttgacttgttggctgaagctttgagcttgctgtacaaaaaaaaaagaaagaaaacaaaaaaaaagaaagaaaaaaaatcagaagtgaagagaaggaaaaaaaaaggaagggaagagaggaagttgttgttgttgctgttttgtttgtgttattttcgtgctattttgagtggctacgcttgtgactaggctcgcgtctctaaagggttttgcctaggaccagcacaataccatcgttgaatgattattcaacttgctttgattaatgtggttctagctgtaccttgatattacttgcagccacctatagctccacaaatttttatctactatatcacaggatcgtgcttgttgtcggctccggtactactaaccgttgttgctgttcttgctgtttgccaacgccttttacataacaaagtaagaacatgtaagaactcgtttgcacaagtttggtagaagtggagatggacaacacctagctccaatagttgataggacatatttcttgtgaattgtttcttcccattaaccatgacaggaggatcgggggagcaccctcaacattcaccacgtacaaggggcatcatacaacattttgagcgccaagtgagggagcatgctgaaggccttgatgaggatgttagggtcgccaatgatcgccttggtcaattggaggctgctcaaattgacaccaactccaagctttcctcattggagaggtcccttgtggctgtgaatacttctcttgcaggtatcttgaatacgttggagagaatgggccaagatggtcatgatggatcggctaggcgcaaccacaatggccatgatgctaatagcagcatcgcagcaagggaagaactggagtacgctgctgacactgagcatgatgaggaggtacttggtcgtccacaaagacaacagcgccggcagcgccatggcatgggcgctccaccacggcaggaggtacgtgataatgatgattctttaggcaagatcaagtttaccattccttgctttgatgaaaaatatgaccctgatgcatatcttacttgggagttagccattgatcagaaatttgcttgccatgattttcctgagaataaacgtgttagggctgctactagtgagttcactgattttgcatccatttggtggagtgaatttgttcgttccaatccaaataacactccccaaacctgggatgcaatgaaaagagtcatgcgagctagatttgttccttcatatcatgcacgtgatttgctgcacaaattgcaacaacttagacagggaaacaaatctgtagaggagtattatcaagctttgcaaacaggaatgcttcgttgtggattggtagaaaatgatgatgctggtatggctagattcatgggtgggctgaaccgagaaattcaggacattctagcctacaaagaatataattcaattaatcgtttatttcatcttgcttgtaaagctgaaagggaagtacagggacgaagagctagctttaggactaacatttctgcaggtcgtgctagctcttggacatcttccaacgttgctgcaccgtcaactcgagcagcagcaccatcgtcctcaaacaacaagctgcgcccctctacaacaaactctacaccatgcccgagtgaaccaacaagaggggttgctgctacaccttccaagagctcatcatcagtagcttcatcaggaaggacaagagatattcagtgcctacgctgcaagggctatggtcacgtgcgcaaggactgcccaagcactcgtgtaatgatcgtgagagctgatggtgggtactcctccgctagtgatttagatgaagaaacctatgctttgcttgcaactaacaatgcagggaaaggtgacgcgccccaccaagatgaggaacacattggggctgaagctgcagagcactatgagagcctcgtggtgcagcgagtgctaagcgcacaaatggaaagggctgaacagaatcagcgccacaccttgtttcaaaccaagtgtgtgatcaaggaacgctcttgccgcgtgatcatagatagaggaagctgcaataatttggctagtgctgaaatggtggagaaacttgcattgagcacacagccacatccgcagccctactatattcaatggcttaatagcagcggcaaggtaaaggtaacacgattggtaagagtacattttgccattggttcttatcatgattcaatcaactgtgatgttgtgcctatgcaagcatgttctattttcttaggtaggccatggcagtttgataaagattctttacactttggcaaatccaatcaatactcctttgtgcataatggaaaaaaacttgtgttacatcctatgtctcctgaagttattttaaaggatgaacttgctagagctagcaaacaaaaaaatcaggagcatactaggagtgagcatcttattgcggctaatgaacttgagaagcataagaagaaacccaccaactctgttcaaaataataaaaatgagattaagctgaagggatcttgtttcattgcaacaaaatcagatttggatgaagttgacactgacactgttgtttgctatgctttggtttgcaaagaaaccttattccaattgaggatactcctatttctttgcctcctccggtcactaatcttttgcaggagtatgctgatattttcccaaaggaggttccaccggggctgccaccaattcgagggattgagcaccaaattgacctcattcctggggcctctctgccaaaccgtgcgccatataggaccaacccagaggaaacaaaggagattcagcgtcaagtgcaagagttactcgacaaggggtatgtacgtgagtctcttagtccttgttctatccccgtgcttttagttcctaagaaagatggctcatggcgcatgtgtgtggattgtagagcaattaacaacatcacaatcagatatcgtcatcctatccctaggctagatgatatgcttgatgaattgagtggttcacttgtgttctctaaaattgatttgcgtagtggttaccaccagattcgcatgaagttaggagatgaatggaaaacagcttttaaaactaaattcggcctatatgagtggttagtcatgccctttggtctcactaatgcacccagtactttcataagattaatgaatgaagttttacgtgctttcattggcagatttgtggtggtatattttgatgacattctcatatatagcagatcaatagaggatcatcatggtcatttgcgtgctgtttttgatgctctacga

SEQ ID NO: 45615 - DNA, 1631 bp, Oryza sativa
ttacatgagcttaccaagagaaatgtcacattcacttgggctgcagcacaaaggaatgcattcgacactttgaaagataagttaacacacgctcctttactccaacttcctgatttcaacaaaacttttgagcttgaatgtgatgctagtgggattggattgggtggtgtgttgttacaagaaggcaaacctatagaatatttcagcgagaaattgagtgggcctagtttgaattattctacttatgataaggaattgtttgctctagtgcgaacattggaaacatggcagcattatttatggcccaaagaatttgttatacactctgatcatgaatctttgaaacacattcgaagtcaagcaaaacttaaccgtaggcatgctaaatgggttgaatttattgaatcttttccatatgtcatcaaacataagaagggaaaagaaaatgtcattgctgatgctttgtctagacgttacgcaatgctatcccaacttgacttcaaaatttttggcttagaaacaataaaagagcaatatgcgcacgatgatgattttaaagatgtgttgttgaattgcaaggagggaaggacttggaacaaattcgttctcaccaatgggtttgtgtttagagctaataagttatgcattccagctagctccgtgcgtatgctattattgcaggaagcgcatggtggagggttgatgggacactttggtgtgaagaagacggaggatatccttgctgatcatttcttttggcctaagatgaggagagacgtggagaggttcgttgctcgctgcacaacatgccaaaaagctaagttacgccttaaccctcatggtttgtatatgcctttgcctgttcctagtgtgccttgggaggatatttctatggactttgttttagggctgcctagaacaaagaaggggagggacagtatctttgttgttgtagatagattttctaagatggcgcatttcataccttgtcataagagtgatgatgctacacatgttgctgatttgttctttcgtgagattgttcgcttgcatggagtgccaaacaccatagtttctgatcgcgatacaaaattccttagtcatttttggagaaccttgtgggctaagttggggactaaacttttattttctactacatgtcatccccaaactgatggacaaactgaggtggtgaatagaacattatctacaatgcttagggctgttttgaaaaagaatattaaaatgtgggaagaatgtttgcctcatgttgagtttgcttataatcgttcacaacattctactactaagaagtgcccttttgagattgtttatggccttctaccccgtgctccaattgatcttttgcccctcccaacttcagagagagtgaactttgatgcaaaatatcacgctgaattgatgttaaaactgcatgagaccactaaggagaacatagagcgcatgaatataaagtataaacttgctgggagcaaaggaaagaaacatgttgcttttgaacctggtgatttggtttggttgcatttgagaaaggataggttccctaatttgagaaaatctaagttgctacctagagctgatggtcctttcaaagtgctacaaaagattaa

SEQ ID NO: 45616 - DNA, 1202 bp, Oryza sativa
  unsure (1)..(1202): unsure at all n locations
nnnnnnnnnnnnnnnnnnnnnnnnnnnnnnnnnnnnnnnnnnnnnnnnnnnnnnnnnnnnnnnnnngatacttttcctatctgtgaccaacataccggattgagggaaattaatttattggctgtcagtagagagtagaaactagagaatacttatcctagtattttttttaagaattgcacagtacaatacaaacactcacaacgcacgcgcactcacccctatgaacacacgcacgtaaaccctacctctatgagtatcttcgaagactgggccggcaaatcctggagagattgacgaagtcaccacaggcgcctcgctgtccatgggtacgccgcctaccactgaaagcacaacgttgttaaatcctaaaaaattcgctcccatggggagtcgaacccaggacctcaagtgctactgaggcagtgaggctgttgtaaccactgggctacaggccctttcgccctagtatttatttatgtagatatgatgctaatatttttttttggacatttatagtgatattctttagatatattgaatatagaaatttagaaattgtacttaaccacaaatttgggcttttggagggtatgagtagttaataccagtgtattttggattattggaatttcgttgaaatttcggagtaaatttgacttgcttcaaacatgtgaacttttccattctctacgggatttgaactgattatactagttcattttccattacaatcaagtaaatttgtcagactataatggagttcgatatgcaagttctcgagaatggagagagtaagaagtagaacacatacaaactgcttctattatgcctgctcgacaaactgatgcagcaacgggggttcctgatcgttcgatgagaggaggataaactttgatttggggaaggatacgacgttggcggtccgactacaactgccacaggggtgctgcgccttagcaaccggtacaccgactccacgtgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccgggtggtctagccgacacacgcgagtacaaggaagtagctgcagctaaacttacatcaaaacaaaacccaa

SEQ ID NO: 45617 - DNA, 25575 bp, Oryza sativa
  unsure (1)..(25575): unsure at all n locations
nnnnnnnnnnnnnnnnnnnnnnnnnnnnnnnnnnnnnnnnnnaaaagatagtttggtccttcactcacatggagaagctttcaggggtccgtaagctgcagagtctcacacacctcgaactcaaggggggaacgtgcaacccgcagaatctggaaaaactgaaaagaaaagtcagtgaacacagcaatggtattactttcacgctcaaactacctgagaatcaaagtcagtgaacacaacaatggtggtattactttcacgctcaaattaccttcgatcgtcaaggataaggattgttgatgctgctcctcctgcttgggaggtatttctattacagtgcttctactatgaataaagatgaaaggaacttgggaggtatttctattacagttgcttctactatgaataaagatgaaaagatggtacagttgcttctactatgaataaagatgaaaagatggtacagttgcttctactatgaataaagatgaaaagatggtatttctattacagtttcttctactatgaataaagatgaaaagatgatgaaataaggccttcatgttcttcctacttttatgtattcagtgtattcagtgttgatggcaacattgtaatcttgtgtgcatttttgtttttaagattgttttagttgcatcctgcatttctgttcctgcgtgtgttaattcggcatgccgagctgatcactccaaacgtggtgggatggcacgagtttggtgaatcttgtgtttaattcggcatgctttgtatgtaaaatctccagctttggagaatagtaaaaaaaagagaaaaaaaacagaaaatgctgcagcttcacgcagcacaaaaacttctctgctcgttttcagtttcgtcggagctaagcgagaggattcctgctcgcgtgctgtaacggttcttgtctgatggattttcttaatttcttgaacatttttgtttgaattttaaaaataaactactatctaaaaactcttataaaaaataaacatgcacatgccaattactatagctccacagttcatggcttgcagcctggcatacaacaggtttacccatgtggcagcgttatcattctacatgaccaaaaatttcaggtttgacattagttcttggagggtttatttctaaaattatatttagaaggccaaaaaaacagaaggtggcttctaatattccactaatgttggtacaaagccaccatcataatttaattttatagcctgaaaataatagaactatattcgaaaatattaaggataacaaaattgtcctacttgatcattgtcaaaacccaaattttgacacattttcataggtaggtagcaaacataaataacatacctaaaaactattctaaagccaaaataactctcgtcatagacaaataaaaaaaaaagcttgttcattggtcatcagggtaaagcaaagcttttctctatcggtcactcttgcttgtgttttttaatgcagtaagcttccgttttagtgacttgactgcagacattgtttccagcttctccgtggatgtgccatcaggtttctggtcatgagtatcggtaggcacatcatcaggtggcaatgtacctctaccactacctctacctcccagagatggttcatgtgctccctttatcccagcttgcttgcgcataaaggccgcactcctgtaagtaaccatcagcaacagttagcaatttaacatgtgtaaaactgaaccaagaagatgcagaattgcagatcatgtaggctacactagtagtatgaattctgaagtagtctgatgggcgaatgcgcatagtataccttttgtactggggatcagtaggatccaccgcaaaccaatgagaattgaacatggctgagaacctctcatctttgctaagatctatgtcgggaagttcgtcctcaacagattgctctttacccttcttgcccttcgtaccctttttgcgcttcaagttataaccctttgcaccgttgcctgcatccttgtcagccgcaaccaaaagctccaactcttctctggttgcttcatcctccaaatgttgttctgggagtttgtcctttcctttcccctttcctttatctttggcctttgccttctgcttcttgtttggcttaatttcttcatcagacatttcatcatcaaagaaatcgtcatgttcatccaggccatcttcgctgctatagccatcatcatcatcatcctttgaccttctcttcctagatttacgtttctctttcattttctcttggtgcttctcccagacagtcttctcattgttgacctttctgtcaagtatacgcttgctaaggtcctcaagctctgtgttgaatgttatctccatgtcctcgccatcagtttgttcctcctcggatttgtcaccttgtagtagaagagccaacctctcctcccttgttaactttcttttggctccactttgtagagactcgtcaccatgattatctgcaccttcatcgtctgatgcactgtcatcacttgctaagtacatatcaagatcatctaactgcagcaaaaacatgaacaaagttaccaaaactgtagaccaaaacaaaaataaaaggacaaggacacaacaacaaaggtactatatccattcaactcataaggcacagaaattttaagattcaaacttcgttagttttgaccaacaattaggacattcaaataactatttagtgatacaaaggcggtacctgctagatttgtatttcaatgtacttacatatggacatgatttttctatatagcaacaatatattgagaaagaaatgtatggtcacatttcaatttaaaagattgtgccaaatcaatttgtgcctaataaaaacgaataaggaaaatatcatccctacacgataggcaaacatcgagacaaaccagtataactcatagccgttcacagggaaagaactttcacataaaaagggagatgaattgcaaaatattattgactttagtgccagcggcccagctcatgacatgttactccataattgtttatcatgttattggacctaccaaaaaactataaactcgtaacacaaacaaaataatttatataagaatgaacctgatcatcagtgaactttcgcctcaagacctttttgcgttctggttcatcatcgtcccacgtgagcttaaccttgctatgttgcaaagcacgagtttcaaaattaggctccttgtaacttggaggtgcctgcataatatcaaacaaatcactgacaaactaaaagtaattcttttagcacaattgaaaagcaagttatactaaacttaaaagatgttaacttgaacaatggaaaaataacatggcaagtcacttttgaagaaggaaaaggatcagttttatttcaatgtttcatgtttcaaccttattatataccaaaattgctgatgatacaatgtagtaaagtaagatacctctgtagcaacatcacgagcaggatgtttaaattccatagagtcaggaataaactgcaagtcgaacacatttgatgttttcaataattctgtaccatcaagattcatgtacaggtgatttgcagttgcactggaatcacacaccacaactgcatagtaatacctacaacaagataagcgtacgcataagattggtattacattgttgtataaaaaattgaatagatgagaatgtctcctcatacacagacagtgataaatacatcaagcagaaaaacatatatttacacataggatttgaacatgttaaagactgtctacaagtcccagaaaaacagataaaaaaaaatccttctccattttgttactaacctcagtctgtttagctcataagtacgtagcttgttgttttcagcctcagaatcatgttcagtgtcactactatcttcttcttcttcatcgtcgtcatcatcatcaccaccactatattcaccatcactaccattgacatcaacaagggcagctgggcccttagttgactcaattttcatgcgctcaagtccaaattctgatggatagactgacactgataagactcgcccaccttttgggaggcaagatgtcatcaccatatacaggtcaactgcctattggaaggacgcaaacaaaatatagtattattgtacaatgaaggatgaacaaaactaatcaattgaaagttgcaaggagacaaaataacaatgtaacaactcagatcttcattttaacaaccaggattttgctaagttggatttgccctctaaactttccaaagtccaagcatttttagagtttggatatgtgttcgccaagtgcctcagtgtgcactgctctgtcaacaacatttttttacaagaacttagatgcaactacatttgtttacaagaactagcatcctcaataactatgtttgataaaataagtgaatttatatggtggactattaggtcctcaactaaaagaaaagagagtagtacacatagaaatttcacctgatttaaacagaacataagaaataaacataaacatctttcagccataaaacatactctgtaaatgctgctgccacctagcagacaatttttttccaaacatcaccccaatggcacaaaagtgttcgatagaagctaccaatgcgctcataaaagcaaaagcattaaaaaaatgtaatcacataataaacaagttttttcagtaaaattattggtttcaaggtaattcttaagcatccagtaacaaagccttttttaatatttctgtaaattgtttatgctaataggtttgcttgacaaaaaaataattattttcaatcatcacacaccttaatatgatcccagtccatattaacaacagcaagcctatgggtttccttgtcaatcataggtgtatcatcatgcctgcccatcaaataatgcgcaatgtcactgccgacagagtactgtgaaaaaaaaggaccatgtattagatataatgcaagaataatgttgcaaaacattgtttttttttcttgaagggcgaaaactacataaatattgcaatcattaatcaatgcttacaaaatacaaaaattacaaggctaactcaaaaaatagatttaagcggcaggatggtggataaaaatactaacagtggcatgtcattgtcagctgagtacatgagtaaagtagggtctttgacatgtgggtttatgtccaatcccttcaattggacatttggacaaacaaagtgcacttgagtcccaagcaattcgaagggattgtgtcaaataccacaacacaaacacatgccctttgttttttttggttagtcgactattaaaaatgcgtagctacaaagacgcatatcttggtacaaccacatagctctataacctacacattcggcccaaaaaaaaaagtttaacagttcataacacttgtaacatcagattgaacataccgtggttacaaatgaccaagaccatatattgatagaaaaacaagaagtacttaatgctcttaaaactaaactcagactcaaaagtagtcccctacaaatcatgctccaaacaagatatatgcaattgagttcttggaggagctaatcactatcatctaccatataatatgtagaatggacgagacgtataaagtaaataaagtacttccatgctacaagcgagagaattgaacgaaatataaaccaaaccatcaaaaaattgtaagcaaagtaccacctcgtcgtcatcgtcctcttcttcgtcctcatcgtcgtcgtcgtcgtcgctactggagctctcttcttccccttgctgctcttctgcgtccccctcttcttcctcttcttcaaccaacttggccttctccttttcctcctcttcctcctggttgagatagtactgcagcatcgggttctccctgccacccttcttgcggcgcctcctgccgtgcttgtccaccggcgccgacgacgacgagaacctcgggtccgtcagcatgctggtgaacctcgagtcgagctccaccttcgcctccttccgccgcatcgcccggaacctcgggtcggtccgcgccgccgcgaacctctcgtcctccatcgcccgcctcaccttgtcgtccccgcgcctcgcctccgccgcctcgccctcccccttcctctccttggacctcttcccgtgctccttctccccctccccgtccttgtgcttccgcttcttgcccttgctccccttcgcgtcgctgcggggagtcggcgcttcgtcggaggcggcggggcgctcatgcttgcccttcttgtgcttcctctcctccttggagttagatttcttcaccttcttggagctcgcgagctcgtcggagttgcccggcggcgccatggcggcggctgcttgcttgcgagtggcggcgacgcgcaagggtaaacctcggttttatggaccttacatgggccgacagttttggccaactaattcacccgagccggcccatgtaggcgctgcagtgggcccacctgtcggtgtgcggggcccacccggtgacgagcctctctcttccccttcgctgtctgttggtccaccgatccacccacgcatcgattcgctggacgtacgccacattgcgcccatctctctcgctctcgctcctcatcgcgaagatttcctcggcggcggcggaggggatcgacggagggggggatggcgacctcgtcggtggcgggggacatcgagctggaccggccgaacctggaggactacctcccatccgactcgctgccgcaggagttccccaggaatctccatctgtaatcgcgccctagccccctctctgttccccgtctttgttttcttcgctcgttaaccctagcttgggattatgtgggggattttggcgagatattttttaggcgattctttactctcttctgccatcgtgcaggcgcgatctgctggacatctcgccggtgctcactgaagcggcgggcgccatcgtcgatgtgagtggcttacccgggtcttaaaatcgccccccccccccccccccgtttcgtgcgttctcaggttattagatggtgatgttctatgagatggcaagagcagataggacgtttataggctttgatctgtgaggtttagcgaaaggagtagagcaatccttttgtggaaacaaggctaggcttgcttcgctcaaatttttgaatttgtacggttttcatatgattactctcatactctgttcttgcgtcaaaatctccgaaaatatgtacaatttcgtcaatattgcatatagttagatttaccttaaatttcctattttatggcctcccttgaggacaatttctggattgtttcgcgctttgaacactctcgtttattactgaggaaaagagtattttgcttgtggtcagtaatcaattttgtataagaatcaaaatataattaatgttgtaatgttaattaaccctaagttcgatgttctttacaaagttgtcatctaagccctgggtatatatcggtggaacaagaaaaggatgtctgtctttgacactattttcaaaacttcaagttaaaggagcagtaaatctcccttagttaaggtttaaaacaggaacatgataacattttctttataatgttgttcgtattagacaagtatatgggtacttccatagcctgttagtgagagtatgccaagataatgacttgacatctcatgcatctttgtttcatatcattttactactgtgcatacgtaacttcagttgtgatgcggtgtgggataaatagcagtcgttcttatggcaattcttcttgttgtgatcgatgttgtctagctttctcattgcttgtgtttacactgatacaggattcattcacacgttgctttaagtcaaattctccagagccatggaattggaacatttatttattcccattgtggtgcttgggagtagtgataagatacggaatactattcccgctgaggtactggatccttataatctgaacactatatttagggcggcagttttgctaattagtttacttgttttgtaagtgtttgcaatgtatccttctttgttgacttgatattttgtagtacaagggtatcctagcccatttgatctgtaaaacctttgtccaaactggcaatgaagtagatgtttttaaccatgtgctatgagtttttttggtcagttacaatcactttccacataacgtcagaaatcagaatatttcaagaccaactttgttcaggaaactcatttgaattttgtgtgaaatgttggagagaatttttttttcggtatctttgtgtatgtattactactaaaagttattttctgtctctggatctagcttatattcttttcttttgtcgaatattgagtcactctcatctgataactgtaaccatgttatgtttcaggggcctaactcttctagttggatggttagcattctttgctgccttttttcctgtacatttcttattgaaaggtcaaaagatgagaagtaaaatagaggtgacttatcttatctcccatctatgtcaatttctggttgtagatgtgtgtatgttcatatgcagccataatatgtcataatattttgcaacttaggttctttgtttattcaaaaacactgtaatcttttttgcagagaaagctggttgaaatgatgtgcagtgtttttgttgcttcttggactggagtgatcaagtatcatgggcctcgcccaagcacacggcctcatcaggttacaaactttctttctcttagaacccatgttaagtagtttatgcacttataggaacatgtggtgcgcaacactgttgccaaacatcatagttattaacttagccttgttccccggaaatctcacctggataattcaggaaaagttatcctttctatcacaaaatctcctcatgtttcacaaggtctataattccaatttaaatgcaaacatttgcagaaaccattctttaggtacacattgtcattccttcattatgttttacttaattaatttcatgttcatccattaatgaatgacggatatcctttgcaactctcttctaaattctaattaccacaggtatttgttgcaaaccatacatcgatgatagatttcattattctggagcagatgacagcatttgctgtcattatgcaaaagcatcctggatgggttggtcagttctcattcttcaggatggattgttgatctctaccttttgcattgctagattgttgataaaatttgctttcctcccttgtacaggatttattcagaagactatcttggaaagtgttggttgcatctggtttaatcgcaatgatctcaaggatcgtgaagtggttgcaaaaaagtataatttttcatttccaatgcattacttactatatatagttcagtttattaagagaactctgtcaacaggttacgagatcatgttcaacatccagacagcaatcctctcctgattttccctgaaggaacttgtgttaacaaccagtacactgtcatgttcaagaaggtaaagttgtaaacttgatatgttcttttgaagtgactgaataaatgaccaaatatgcatccttgtgtaactaactttcaagagaggcttcaaattttggttcatttttaacaagcttcaagcagaaaaccagcccttacagtacgtacagcataaatatgacatctttttagattgtaaaaaatatactaacaaagtaagtgtgtcttgtgaattgtggctggtcgtaaataaatatactgcaagtttcaaacttaaaaagggtagaattaattgtccttatatttaaaaatgcatgagttcacttaaaattaactcacagctgtacatatggacagagaatgcaaaaagaaagaggtactgcagatagcacaaatattttggcagatagataagagtagttgagtatttctagtagtggtacgaacatactcattgccaatcatatgcctgacatgtttaaaagatagcaaatgctagaaagttgtcatcttctaaatagctatcaaatgatgagttgtcttcattcttgttatgttttaacatttgctggaattgaccacgatcagactaatgatgatttgtcttcattctcattatgtttttccagggtgcttttgagcttggctgtgctgtatgcccaatagctatcaaatacaataaaatatttgttgatgccttctggaatagtaagaagtgaggaatacaatcaactgcacaaatttactttgttcacatttatcttcttctgtatttcacttaatatcttctcgtaatttttgtcaggcaatcgtttacaatgcacttggttaggcttatgacatcatgggcagttgtgtgtgatgtatggtacttggagcctcagtatctgagggatggagaaacagcaattgaatttgctgaaaggtagcataaaattggattctagttttttttatgagaaacatactgcctttttcatacttaatggaatgctttccacagagtaagagacatgatagctgctagagctggtcttaagaaggttccgtgggacgggtatctgaaacacaaccgccctagtcccaaacacactgaagagaagtgcgtgattcttccttctctctttctctctctctctctctctctctctctctctctctctctctcactaaaagcagttgaatttctaataaggttttcaattttcaggcagcgcatctttgctgactctgtgttgcggagactggaggaaagctaaacagatatcaatcaactctggtgctcattggtgagtccaggttactaatgtcctagtgtgtatctgggtctctggagtatgtggaaattaccactgcagttttgttgtaaattgtttgcagcttgacagaatcaacatttaatagcctgtattagccaagattttatgattggttagggttaacacataaatattataccttcccaaatgatgtattaatacttaccctctgcctgatgccctgatcattctcatcatctcatgggtatacattgtgaataatctttcctgagtccatgttaataatgattccttaactatactgagccatcggtagaacaaagaagtacatctccccataaagttggggggtaaaacatcactattttgtacaattgactgcttgcagaaaactatgagcaaaaatggtagattgtctagttgtcataccttcaaccgttacactggacattaaacccttctccgatcccagtgaaaccttgaaaaacaatcagctattttcgatcaatcgtttctctgttcccccttattttcctctttacatattattcattgtcatcatcacgctcttccaaacttataaacggtatgatttttataaaagttttatatacacaagtttcttaagagtagtacttcaaaacagctttttttttactttataatagttcattaatccgtttgtaccctcaaaatattctctcaatatcaagtagtctatcgtttatagtaccatataattagacaaagaacctggcacatacactcgcgctacaacattaataattcagacagtttaataaaattaatgtacagttacaaacaaattacatttgtcaacaaggggtaaaaagtaataatcaatatcactcgaaaatccaaacgatgaaaaatataaaaccactcacaaagaaaaatcgaggaaaaattaagatacggtccatccaccctagaagtagagcgtacactgcttgttcttgtccccctgctggagcgtgccgtcgccacgcaggccgaactcgcagtccaccttcatgtggtgctccctggtgtcccacatctgcacctggaacctcaccgtcgagttgagcagcagccggagcgcgacgctgccggccgccgcgtcgccggcgaaccgctgccacgccgggtcgccgggcgtcggcccggacgccgtgagctcgccggccagcggcgttcgcccttgggctgctggtagaatggctggaccaccggccccgacgcgacgagcaggtcgttgtagtacaccgacccgaagatggtgccgtagtggatgccgatcttctggttggggttgcgctcgtcgacggtgaacctcaccggcaggttcacggcgccggactgccggttgaggttggggatggtgaagtcgtcgaggaagaacctgggccggtgcggccggaggctgagccacagcacgaacatgatgatgccggcgacgagcaccatggtgagcagcacggcgcagaggaagttgatgcacctcaccgccggcctctcccggtacatcggcagccggtacggcggcattattgccggcggcgagctgctgcttaaactaaacctgcttgccttgctgcttccttctgatcagcttcagtagtgtgctgttcgagctagctaccctctgctgctgctcttggctttggacaatggacatcttctcatggcgttcgtgatgttttatagctgcgtctgtatgggggccgtgcatgtgattaagggtgtggaaggcaagtaatattcttgccttgctgcccaaaagcgatcgagatgccaacattcgatatccagagcagagcactgcgtgattcctggctagttgatcgagccctggccgttggacttgtgctggaaagtgaaacggaaactcaaatagggatcaaattctcttctggctgatggatggctcggtgaacgtgtatgttgtaaaggttcaggtataaaggggattggtactctgatgagtgatgagcgaggctagctagctctctaggagtatatttctgtattttattcttgggttccttgcttaaggttcttgctgatatccggatgagaacaattggcgaaacttcgcccgtgggtaaacgcaaaggcggatgctgcaaaaccatgattcgttagaaaccatgggaaccttaaactgcactggttcctacttcctatacaatggttgttcttctagcgacgctggataaagtaaaataaacaagaacactgccctaaagtaaaaagataagattataagacgtctccgaggagactagcatatacttcaaatgtaagtatttttttaggttaatatgggttaaaaaaatataaaaatgattagaggaagtatgtgattggttgagaagagaaagtagataaaaaagaatggttgtaattggttaagagaagaagataagtgaagaaatagtttcagtttagataaagtattgtactaaaaatagctatattttacgactgaggtaatataaaatattgtactacccaaagtctgtggagtgaagtgtaaagtgatattttggtagttggggagttaaagtggtcagtaaaagtcagtcgggtaaagtgttttcggaagcagttttcccctttctatgctgtggacttttgtgtctgcatgtgtcaaagccttgtgaatattgggcccaaaatcgtcccttgggtgggctgaaaactgaacatgtatccaacatgggcttgaatgctgacaggcagacagcaaaggtatagaatcatccaagtatatagctcatcctctcaagctcataatgttgacaaaaaaataaagaagaaatgtcaacatggccaacatctttttttctggagaagggtggcagcggctctgccatttcatacatggagaagatcagtgcaagagtacattaacaagtcgatgattaacataaaacaaatcaaacaatgccgagcaagttattccctcatgaaatttaccttgtagtagtagtaataacttaattagacaccaaacaatagaacatcattagtacatgacttagtaataacttatatcaaagatcaaatctctgcccatcaattaatcagagcacagttcttcctgatctctcctgcggctcccgtcaggaccccgacattgcccatcctcaccatggacaccccgaatcgccggaagaacgcctgcctgctcgacctcgccatgacgcgcaccgtcgccgccgcctccctgtcctggagcaacgcctggtcggagtggaagaggcccctccggctcgccaccagcctgtagtagtcggtgtcgaacgtcgtcgagctccccggcaccatctcgacggtggtcgcgttgtcgaaccgcggcgggcaggcggcgcggaggaccgccgcggcgtacgcccggtcgagcgtcgggtcggcgtcgcccttgccggtgaagttgtagagccgcttggcgaaggagacgcagtgtgaattgcctatggcgtgagcacctgaaacagtgatgtaaaggaattaatataatttactgtgttaattactgtctcccttgttgtcagtgtcatcttacggttcgagaaattgccagggataatgatatcttaatcggaatgtgacttgacgctttgaaaaaaaaggttaaaagatgttcaacatttctatgatttctgaacacgcaaatgtttaataagaaagcaagaaagcaactccatacagaaaaaaagtcagaaatgtcattattgaggttcagttcattctgtcattttgacccgacctgaagaccaagattgtgcctgactctgacacggcatacagcaagaacagtacagcaaatcgcacgtagctttagaatcgtccatggttagcactactatacctgataggatcgcgaggtcttgcacatttaggcccttggaaccgaactgctccttgagcttagcgaaatccgcgaaagaagacggtaggttggccacggcctccgccgccgacgacacgcggccgtcgagccgccccgtcgggacttgccaaaggctcgcgccattgatgttcccggcagcctgaaaagacagagcacagcaagaatcggatgatcagatcagcatcagcttttgcattgctcatcgtctctacagtaacaggagaattcatcagtggagcgagtctcaaaccatggagacagcgtctctggccgccagcgccaggatgtcggcgcaggagacgacgccggggcactccttctccagcgccgccttggcggcgtcgatgacgtagaacccgtccaggctctggttcggcatcgcgtccttctccgccggcccgctcgccgccgtcgcgttcagcaacaccgatccgtcacatccctgccaataataattttaaacttgggtaagttctccatccacatttgcagctgtcaattacaagctgatagcttaacttgttcttgataattgatatactccctccgttacaaaataaatctaataatagaagtagtagagatagagaatgactaaaatactcttaatcattgataaaaatagtaagagtgatgggtgggtaaagggtattgaagaaataaaacttctcgttttacatacggaggataaataagatggtagaagttagtttttgtgagataaaattcaaataagttgagttttttttttacggagagagtatatgctagtaatttttaccctgacgaagcagtcgtggaagtggaggcggagcagcggcgcggtgacggtctggtcctttgagaagtagagcttgacggtgtcgcgcacgatggtctcggcggcgcggcacgactgccggtagtgcccgaccgtgagcgtgtcgcaggtggccgtggccgtgccggcggacagcgccagcacggcgacgacgagcgtcgtcaggatcagcttcatcgcgagcagctgctgcatggccgtcggcgtcgtcagagatggacagagatcgacaggccaaactgatgatcgagacgagaaccgaattcgatctctcgatgaatatgctctgtcatgcttggcagagctatttataagttttgtccaagtgcctgctcgaagctggatgcaattggacgaggctttgactttcactgtagagtttctttttttttttgcctccttcaccaagtttttagctacctgattccagcaaggcaaccacaggcacatggagtcatggatagggtcgtgtattacaatcatgtacgattcatgcaattaaggagaaaaatatggtataaatgagcagtcccatcagtaatccttaattgttcttgtttccattgttcggaaatttcaccaaacaacttaagcaaattggcaaattgagaatcacatttgacagcgccccgttccaaaacctactgaattattatatatcccatagtgcaagcacttcgatcgaccgggaaatggattttaatctctcaagggaatgctttcttgttattgcatatcgtctaaatagtcgtcttagattacaaggataaaggataaacggaggctgactgtctgactatataaatatcttgtatatcagatttttgctaaatgggtaaagtccattttttgttcctgaactcctcgaggtttaatttttaccctaaacaatggaaccgtttgtaacaccttatatcattttttgtggctttggatgaaatgaaggtggatttcttagtttatattcttattatacatattttacccgtgtagatatcaattaggtcgacaaccataaaatttacctatttgaatttcatgtttgcaaaaaaaaaaaacacatgtacacacaccaatatttcttatcaaagccaccttgaaatatggtttatggtgttatttttgtcttgttttgaaaattgagattgaaaaaataactagttttgtagttaaaagtaaatgatagactttttagttcgaacaaagttcagggcaaaaatagaatttacccttcctaaatctacctactttaactcaaagatgccagctgaatcaaaattattatcatgtctatacattctctctcttcttttcttcatccaccatgtcttatgcagatagcacaggaaaaatcaatgacatgcatgtgcatgtgcctaataataaaaaaaaataatcctcaaattgttggacatgctttagcaagccatatgcatcaaaaaccacgttataggtagcgtgatctggtgctgtaagtatgtgatggttaacaactgattctattctataactcaagtgcctattattatttttagatgtgaaatatatttattccttgttgtcacattcaatgacaatcaaactttcaaaatttaccaacacatcctatggccacatgaaaccctagtgtgatggaagtagtgcaccattggctccattttcaaagctttacaaagatgtagtttacatctgtaacgtcccgcctcccccaggccgggcccacttacatctgatagttttcataggtcatagactgccctcacagaccaacacatgtctgggcccacttacatctgatagctttcataggtcatagactgccctcacagaccaacatcccaaattgctccaggccaagcacgcttaaccctggagttctttggagactggcttccgaaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgacccccttaagagagatcgacgcccccgtcgatcaaccctaggccaagaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgatcactcgtgtgcacccgggaagaatttcccggtcggtcacccatcccaaattgctccaggccagactggcttccggaaaagaagttgcaacttgttgatatgagtattctattaatcctattaagccctaggccgggatgttacaacatcctataacagaaatagtaacatgcacatgcataataacaatgcaaaaactatacagtgttggaccttctttagcaagaagccaacaaaaacatttcaaagcaatttggcttcatagcatttgatggttatcttctctgatccccgtacgggattcggtccatatattcggggatttctagctgtgaacaaacaaccaaataccgcattatatcaattagttagacttttatatgcaaaatagaattattagtcgatcatgaagacaaaatcaaataattttaagaattaaccctacaccttaattagtgatgctacttaaaaagtcttttttcggacattaggcttttatcttcacatagacgatccaaaagaaaaaatacttgtggaaatggttgaggttgtcttagggtcataaccgcctgttaaaaaaactatttttacgggttggtctgaaattcccctttaaaaatatgtatactttttgggcagatcccaaagaaatccacctataaaatctattttcgtggaccatgcattctgtacaagacgttaaaactagaagccccactaaaatacgaaaaaaattataactttttcatgtgaagtcggatgatgacaaacttaatatgaaaattgtaggtcttgatgaaacctataactttgcagtttaaagttgtttcattttaggttgtttagtgtggcaaattttttgttactattctcgtaactactttttagttttccaaacaacgctggatggagaaatgttctatattgaaattatcgagctcggccagatctacaactttgttattaaaagctattataaatgagatcgttcaggtggctaatattcattacaggctttgatatatctattattacggggaattgttcagaaagttcaaagtttgaaaatttctagaaaattcatatttggcccaatcgaggtaaaccaaaagttttatagattgttatctttatttattattttctttgatatgagctacttaatatttcttttagtatgcccattcattatgcaatatatcaacatatagagactacaggacataagtgaacaatcatatcaaaagaagtattttaaggaaacatcgacccagaatgttgtaaggttgagaacttctgttcaccttaatcggacataaaatgaattttctaaaaaagtaaagtttagtcattatcaaagaataaagaaaaaagggttttgtcagcagacttcttaacgaaacaccctaaaatgatttttacaggcagacattttaaagagtcgcccttaaaatattttttatggtcggttcacataagggaaagccagtaaaattttgcgtctatagatgcctacaaaaatctaaaatattttttttggggggttcttttttacagttaaaaaaaatcaaaagcatgatattcatttttacatgtgattccttaagagagttgccagtgaaaatcaattttcacgggtggttgtggaatgcgtccataaaaatcatgtgatttttacatgccattagttataggccgattgaaaaacacccatgtaatgaattacggaccacatgcaaaatatttgggtcgtttggttcttaactaacattgccataactcactttaggcaatgttagacaagtgtggctttgccacatttttttgtggcctacaaattgtaagccacacttgtagcaaagttagacaaatgattgagtctatgacatgtggggtaagatgataagaaagtgtggcttgccataactatggcaatgaatcaaacataaggctaaggaggtgtggcatcctaaagtgtgatgtggcaagttaaagcattgaaccaaacagcccatactatctctatccaaaaatataagaacctatgatcggataagacatatcataatattacgaatatgaacaagctttctatttgtgctaagatgtctgaagcattgaaccaaacagcccatactatctcaatccaaaaatataagaacctatgatcggataagacatatcataatattacgaatatgaacaagctttttatttgtgctaaaatgtctcatgtgatattatattattatattttggaagagagagtgagtattttcgtaccagtgtacgacaaagctaggatcgactccattggctccattttcaaattaagctttacaaagaagcagcaatattgctgtattttgcagcctatatgtatcaacttgcactttctttcgctgtcctgactttgttgtctttatggtttaccttttggactcatctgttacgaacatggaggccagctcgaagtgcatgcatatggaatgccagtccggtcctaatacttgcacagttgaccccgagcgcgtggttgccacgtgcacgcactcttgcacagcagtgtgtgccttctatttgacgctattttattttttttatttttagcccaagataatgacatgtcacggcagagtaaaaaagtgcagtgtgtagactcttctggaatgcctcgtacggatcagtttacacgcatcttataaatttcgtttagtcatcgctgatgacatatttgagtactacttatcccatgcggctatgcatgtacgagatccgtgtatacgaatacacgtattgccagtgcatatatgatcatacatgtgcatgtgccactgcccactgccatacgagactttggatcctccaagtgcatgcatgcaggcaggctccaattcgtgctgcaacttcaacaaaataaattgattcgcctcgcctagctgatgttacaaaatggcggacgtatccaaaacgaataatacttggatgaaacaactgaagctcaaaagagtcaggggaaaattaatgactacaagtttgttattgatctgttcgacttcatcgaaaaatcccagcctcggctcgcgccagaaatatgtttccaacacacagcaacgaacatagccttagtacagcacaaactagccacttctatcaacgacaaactggcctactagaaacagcgcgggaaagttaaaaagctcaagctcgggttagatagcactgctttcttcaaagcgcatgcctacaacaacttcggacgaacctccatcaaatcgatcaaggcggcaggcaccgaagtttctgaccacaacagcaaggcacaagtcatgttcaactattactcgctcatcctaggatctgctgaatccctgcaatggtctcactacttaaaaaaaaaaacgtataagtcggcactatacctttaaacgaagataggtatcgattttagagaaaaaccaacatcaataataataatataggtgccagtttttttaaaaaaaatccggcacctataatatattataggtgccggtttattaaaaaatcggtatctataacatattacatgtgcccgtttttttaaaaaaggcacacatgaacacacattccatcaagaacacacatgaacaaacattccatcaagaacacacatgaacaaacatcaagaacacatatgaacataagaacacaacttgaacatatgcttcttccaccgtcccggccgccgtcgcccggcaacctctgccgcctccacgccatccgtcccctgccgccggatctagcggagggaaggacgtcgtggagacggctgcggcccggcgggggtgggagggtcggcgcctcccccccccccctccgccagatccggcgggaggggacgtgcagtggcgacggcagaagaggcatatgttcatgttgtgtttttatgttcatatgtgttcttgatggaatgtgtgttcttgatggaatcagttatcggctcaactgcagtcgagccgaccttttttttttcaatcgtggaacctcaaaggtgccggttcctaaaccggcacctttgattcaccatatcagtgccgcctccggggtgtcgattgggaaatccggcacctttggaagtttcacaaccggcacttaagggcttttctgtagtagtgtcttttcagcttggaatgctctacgacacagttcagccttcagccttgagcagtctgatgggcggcttctccaaggaagaaacactctttgcaatcaggcagatggacagaaacaacgcccctggaccttatggcttcgggccaagtttttaccaagcaacgtggcatctcctcagcacagaagtgatgaatctccttgaaagattctcgctacaacatgtctatcttgaaaggataaatcggccatacattgttctgattctgaaacctggaaaagagaatacaccagatggtttcaggccgatctctctacaaaactgctcgatgaaaatcattacaaaagtgttggcaaacagacttcatcgtattctgcaagagctaatccattttgatcagagaggttttctcaaaggaagaagtatcactaagaatttcatatttgcgactgaactgatgcaaacctgcttcgtcagaaaatgcccaaccctaatcctcaagctggattttgccaaggcattcgattccatcagctgggatagccgcctccagatcctcaccgccaggggcttcaacaccacttggaatacatggattcagaatattctttcaacctctaagttagtaatccttctcaacggagtctcgggacgctggattaactgcaagcatggtcttcgccaaggagatcctctatcgccacacctgttcattcttgtagctgatgttctccaaagactcctccttcacaatgagaatctcacacccgatgtgcccagacagcccctgtgtgacaatacaatacgcagacgacactttaatcatatgcaatgcttgggtcacaggtgccagatcaatgaaattctcaactgcaagaaggaaagcttccctttgtcgtacctagctaggactacctctgtctctccccataagctgcgagctcaggacctcaatccaacaattgctaaagtgtacaagtacctagctggatgggaggcaagcctgctctcatatgccgagcacatagtccttatcaacttagtcctgaacaatatcccagtctttgctatgttttcctctaagctcccaggttgcaaaacgacacactgctaatcaagatgttgttccatccgcatagctcaaattcgtcgtggtctatgtggctctagtaggaagctgaggacaaatcgttggcggatgacttgaaccttggacccctctggcgctccctccaatctctcatcccgacggttcaagacctttcaagcgtccaggtgggggatggattccgcacgtccttctagtgtgactcatggctctgcaatcaacctctcaagcttcgcctcgctgcccttttctctcatgcagtggatcagctagccactatcaggactgttctttgcagaggactagccacctgtcttgttcctcgcttgtccttagtagcccagtatgatttagctctacttaaagtggaattgtagcaggtcattcttcaaggctgccctaacaaaaggaaaagtaaaggaactccccatcttgaaatcatcctggccaaacaaaactatgactccaggataatgctgcactaaatctgtccaaactggagcttcgtctggaacaacagagcgccactaaaggtgcaattcttcgcctagcttctggcaaaagagcgactccctacaaagcataatctcatcaaaaagggaattgtttcagttgatacatgtgatatctgtgccaatgcctcggagaataccaggcacttcaacctgcactgccctcgggtcaggacaataatcagcgtgaatatgatgggtcaggacgtcaaaaacctggcgaacattaagccctctgggggattaccggcactccattttcaagttttcttcatgttatatttttggacgctctggaaccatagacatgatgttgtctttcgaaatgcagccccctaacttcagttggttttgcttaagtgtgttgaagagtgtgggatatggctagaacgaattaagcgcaacgatcgctttgtaattgcgatttggaagaacattttctcctcttccctccaacctctaaatgttgtgtagaactgcctttgtaacatcaataaaattcaggtggggaatccccccggcccccgcgtgacttgtctaaaaaaaattagtacagaacaacaccgtataaaacgacaaattatcttctatttttgaaatagatcgagttaattttcttttggagaaaggctaatcaattataatgtgagttaaaaagtttttctctcagtttcacaacttgcgtcgagattgttgcaccacttgcgctccgtgtcagttcctgtctatctcatattgatctgtagctagttttcgtagtttcgttggaataaattttttagatgtttaggacatcgcaatgttgtaaaaaaaagtaacattaaagtctctaaggtgaacaatatagctattgtgacattgaagctaagtcataacaaaaaaaaataatcataagtttgcgattggtcgctagcgaataaaaagatcagagaatctctcttctccctctgctccattctctctccacctaataaaaggcttatttggatagtttttatttatttatgaatgagttacatatattatttatcgagaacttaatttcgtgctaaggtaacaactacgatcaactgacaataggacctattttaatgctatatgttgcgtaacaaatattagccttgcccttagatctatttagatatatggttttggccggttgtactccccgtgatgtttatggtggtattagaattgtttagaggttaaagtactctatgtacatctttatgaacaacggatgtgtttgcaaggtttttaacaaaagatttaaaaatttgtctcctaatttttgatcattcaatttatcggtggcactagctatatggtgaggatcattgactttcctatgtgctctgttggtttgctataagaatgaagttgttggccaaataagataatcaccgtaagaactaagatagccagataggagctattgtaagttgtaaccaaggcctcttatactaagtagagtaagagtatataatacttcctccgtcccaaaatataagcatttttagacttcaacacagtcttcaaggtgctactttgaccaataatatctataaaagtaagatgttttaaataaaaggagttgcatattatgatagtttgtttaatgataaatctagtaacatctaatttacattattgatcttttttttctattaatactcaaaattaaaaatgtttgacttgacactattctaaaaatgcttatattttgggacagaggaagtaatacttttcacagcatgatagaacatcatagctcttttttttttgaatgtgttgaagtatatatgggactgtgtacaaaatactcgaatgttttagctaggtcaacgatcatattttctaggtataagatatatagatcaaacagttaagatatctcccttccggtcttctccttcatcctactttgctgtatcccatgccacctcctacctctctagtgacatctttggcgctaatgaggcccaacaattaaaccgtgctatcactcccaatggttaggccccttccaagcca

SEQ ID NO: 45618 - DNA, 67828 bp, Oryza sativa
  unsure (1)..(67828): unsure at all n locations
gatagtatacattgctgatgcccaggtagaggcgtcttaagacatgccgacatgcatgtacctctcctctactcttgcagttgcagctgatcctgtcaagctccaccaccaaaccactttgtcctgtaagctcatctttcccacggttttcactgcccccactgccgtccctacatgtatacacaataaatcagtatgtcttttgatcataatatccaacatgtactgttattaattaacaatatgctactgtaggatgtagccgcaaaccgtgccatccttctcttattatatggatggaggtcttgagcatgaacagtgagacgtacaagagaccaattcggatagctacacacaaagacgtcgtcgatcgtacaacttttctccatagtttttaaagctacacacccttagaatcatcagtctctttcttgagcaacagcacacacgccagaaatgccagctgcccggccgacattggagtagagaggagtagagagcaccaagtcgtcttcttccccccggcaatgcaagacgacgtcacgacgaccctgctgggaaactagtgctccatatacaaatgtccagaaagaatcagttcggtcggtcagatccacctgatcgatcgagtagctctgaaaaagcgagaattttatcgttaaattattccaaaggcgcgtggcggacacgcacgggacatggatctcgggcctcggctggggggatgaactaattgtgggtgatcaaacagttgtagcgatgaaataatttagctgcaagtggaggtcagccaggctggttttcatctgccattctgcgttcacgcgggcgacggcaatgcaactgccgatgtcattgctcacattagcaccggctctttttttctaaagcttaattggttctctgaatttctgagaccacacggcattcgattattcgatcgatacatcgcttactatgggcgatcgagttcatgctactactgtcctgctactctctccattttaatttgtaacctaagattgaatgaaacttaacctattatactacgaatgtaatataaacataggatatgttcatattcatagtagtacatattgagtatcatctgaacttatgatactatattatgagatggggttaataatatatatactatctccgtctcaaaatataccaacataggtatagatgaaatacatcttaacactacgaatctgatatatgggctatctaaatttatattattaggatgtgtctcatccaatagtaagaggttttagcagattataggagtataggtcttttgaaaaagttgatgtgtgctttgatttgattatttaccacaccttctgaaagcaaatttaccacttgcaagaggcctgactagcatgtctgtcaatggcaggaaaactgatgtgggtaagtgcgactaaccagctgtaatcacgaacatcgatcacgactagataatgaacgtacgtcgacaaggaacttttttcaaggcgagtgatgcatatgtatgacatgtacgtccattcagaagcgtgtgctgtgagagttttctgcagctcgatctacgatcgatatgatcgaatccagagtagtatccaacaggcagtgccaatactgtacgcaagaccaaattaaaacgtactcatatccaacagcagcagtgtactatctctcgctgcaaaccatgacttctttctaatctttccagttgcaagccgatctactgataatataactaacatattgcatacgtacgtgaaataacgttatccatgcttagcttaattcaaagtttgtttttatatatcaagcaggtgctcattgacattggtgagaaggacgtagaagtaacggcgacacaacaaaattagtactatacgttaatcttgctccgatcctctgccgccaccccttcatttctatacccaacattactttcactagctaagcatctactccctccgtttcacagtgcaagattttctatcattgtccacatacatatgtttaaattcattaacatctaaatgaatataggcaatgctagaaagtcttacattatgaaacggaggaagtattatttttcatatatatctgcaggcagcaagcgtacgcataatcacagcttaatcagccgacatgaaagtatttaatcatacagtaccacattaattaatctcccgcgaggaaacatctatcccggtcaaagcctgagcatgtacacttaaatatagttaattaaactagctagctcctccgatcctcttaatccatcttcataaaaattcgtgcaaaagcatacacggcatgcactgttcgtccgtacgctgccgtctcatttcgctttcgtagaacttgctccagcaaacaaaccctgctataaatatgtacaccatactcttcgtctccactgcaagcaaagctagaaaaaccaagtgaaaacctcaaagctaggcaccacgcgtcaacgcatcatctccttcaatcgtctccttgtagtggctagtgtgctcgatctgagctagctttggtctctttgccatgggaaactgcaactgcttggagagggcgagggcgaaggtgacggcgtggggcgcggaagagggcgacggcggcgaggacgagttctggggcgccacggcggcggagttctccggcggcggcggcggcggggcgcgaggtggtgtaccgtcgacgaggaagaaagagatcatcaaggacggcggcggcggcggcgagggttcttcttcgccgacgaggcgcgtgaagatccggatgaccaaggggcagctgcggcggctgctggccggcgccgggaggggggcggccgtcgaggacgtcgtcgcggagatcatgagcatgggcgacgtgcacgtcgagcccgtgaaggcggaggagggagncgacgaccgccggccgccgctgtcgccgtccaagctggagccgatacaggaagacatggacgagtagcaggagcagccatggaggaggatatgatggagatgagcgtgagatcgtcggatggatcgatcatctggagatggacggtggatgtttcttcaccgattttgcatgcatgctggcctgcctgtttgttttggatcttgtttgtatcttttctttgctctagttaagttttgtaggacgtacgtatcatgctatattagaggtagaaattaggggatatgtatatactaatagatgtgtacgcgactacgcgtgcacatgtacatttttgtactggtatatgtgatgatatatactacctccgtttcaggttataatacgttttgactttggtcaaagtcaaactgtttcagctttaactaagtttatagaaaaaataataatattttcaacccaagataaatttattataaaaatatatttaattattgatttaatgaaactaatttggtattataaatattattatatttgtctacaaacttagtcaaacttaaaatagtttaactttgaccaaaatcaaaacgttttataatctgaaacggagggagtagcatattccttctgtgttttttatatgggaaatatctagtgataacttcaaataagtgaaataccctgtgaaaaccatgtctagaaagttatctcaattttcaaaaaaaaattactaaagatagacataggctgataggcatgaaatatattaacgtaacaagctaataaaatagcgtatagcgggttgataacagattatattagtgtctgggtagcggatgtaagctccaataatgaaattaatgaaacaaccttaaatttagattggactatatcaatactaacataagtttcacttaaaatttataaatttagattacacacttaattaattactcatacattacatagcataaaaaaatatgaataaacctatagagggaaaagataaagaagatacaccacgttaagttttcctatccatacgaggaaaacatcgttacatcttggattaatattgccattaatcacaatcctaaataggggtttgttcgtaaattttcatttcactactgattacaatgcaaaactaagggtctttttgcaaacctttggatcgctaccaataattgtgatacaaaatatgggaaatatgtaatgtaaactccctatgtagtgtaaatatgtaatagtataaactccatatacagtataaatctgcaaactaccgtttcatcctatggtagtttacaggtttacatcatatataaagtttgcattatattttttccttacaaaacatgccctgtttttttttttgatagaaacatgccctgttttttatgaaaggaattgaatttctgtcgttttatattggtaggaggagataaaagaaaaaaggtttacagttttacatatctgttacatgcagtgcaaaggaaacaacaaacatctttcgccaaagccatagacaaaagttgtgttttcgaactagtagattctatgtgctaggccgtgagcgtcgaattcttgcataattacaaaatcaacctgctcttcattttggcttgtatcttgaaaagttattctattcctctccagtgagatgagacactcctttctcatgttgtctggtgactcttgagtttggtcagagctaatcactacctattttcccgcgctacgtgtcgaacgtccggagatttttttgcaaatctctggacgatgttgcattatatgttgaaaaaatgttgcaatgttttattgctcgaaaaaaaaatgtttcaatatgaattgttttttgacgttacatctttcactgaagatagtttcaccgctttatcaaaaatgtttcaaacgaatgcagcacttaagaacgctgattgcaacgacaaaaaacacattaggtgcaacattcaaagaaatcaaatgcacagaacttttgaggaacatctagaaaacacattactgatttaagaaacgtattgaaaagacagattgcaacatcacaaacacactgtgtgcaacaaaaaaagaacacgtggtgtgcaacaatcctcgctagctcgaccttgtccgagcgccgccgccggagcccaggcacgatgaaggtgtgctccgtcgcctcctcccctcgagctgccgtaccgccgcgtcgtcctcgtccgagcaccgccacgctcctcctctccggcaccaccaccgcctcgtcgcaccgcgtctacccacttcgtgtcgatgctagcacaggcatggagagaggagaggaaaattgatggttggaaatgaggataaggttgactgccggggaaagaagatggagagagtagttaggtaggagtgggacccactaggttagcgtccgattttttatcgcgcgccggccgacgtacgagttaaagcattttcgctagaaaacaaggtgtattttgtaaaagttcggatcgtacggttccaaaatacctcggcccggcccatcataaaactttgagcaggtcaggtaagcgcatacgtcaacctgggcctcaaaagtttaatggtccttaacttggaagacccctcctgcccatcccggcccggcccatgatttcaccatccttctctgccatcgaccggccacgctcccactccgcacaccgccgccgccgccgccgccgccgatgacgacgaccgccgcgctcctccacctggtgatcccaggttagcgatctctacgcagtacccaggtatgcttcgttctctgttcgggccatctttctgcctctccaaacccctccggacagacggatcggagagctaatacagaaggagaaggggggcaatgccgaatgcgtgacggagatggggaaatctgattctggaaatagctatgggtaggagcggagagagtgatagcgatgatcccccatcgatgatcagtatctaggatttccagttcgacagggagatgcagcctttttcagaagaagcaactttgcctgtgcgaagactggagccagaaagacacacagcatatggtaggttaagtgatcatcagttcatcagtaggatttagtttataggatgattaccgattgcatctcattatctttgaattgtgtgtttgattaatttggatactggcacagggggcaagcatcatgcatcatgcttccgttttattttcccttctgtattctgaaactaacgcttagcattatgttcttgagttcttccattttatttttccttttatagctcataaccattatctatgcagatatctgttacgaataattcggattccttggaacacctttatgtaagtttctcgagataccaatttggttttatttacctttttaaattacaggaaggaactgccaacagggctgtttgagaaacacgtatcctccctccaccaccaaagtttgattactattgcttaatttgatccaaagtttctacatagtatctttgttttctttttctcgtatggtgatctaatgattgggaaaaaaatgaccagtagataatgcaaaatcagtcatctgatcaaaatttcaagtaattttcaggctccttttttcttttcgaaactgaccaacgtttttcctcagtttgttgagtttttttagataatggatttttcattaatccggtctctatatccacaaagatatacacaaccaaaacattacacgagttcttggactctaaatctcacacagaaaaacacactaacacaaaagagaaaagctagaagacttagcttcaaccttcatcgaatacttaatctatccaaccaagtgcgagagggggaagaggagaaacagaactagtccgtgctacccgttgccgcaccatctccgtctctgtagaactcaaccaacatatgctgccaactgctatgcctaatgtcctctgtcgctgtccaaaaccacttacgccgctgccgcattttgaacgcccatagtgcgtcacgaagccgccttgctgcgttaccaccgtcttccgcacaccatcgaactcaccgtagctcctagagcatcgtagagtcatccagcatgatatgcaccttgcctttactgccatcaacttgccaaagatgctccattgccgtccacacctatccgcaagcagaccttgacgccgacgctcacgtggcagcttccccctctaggacgccgccactgagaacctccgttgccatcatccttatctgcatcaagcaagtcgatgaccatcgcaccattagcccggccctgtcaccaagatatcgacgaccaccatcccccaccctcgcttggccgtgaacagaacggggcgtcggagctcgccaagtcactgctgcccctaggacgccgccatcgagaaccttcgccgccgtggtcatagactgtcgtggccacaccacaaccatcgaccaccaacaccatgctgtcgacctaccatcacgggtggagggctagcctcaccactgtccatggccgccggtggcagagtaaggggtggatgactagcctccgtcaccttccaatgccaccgccgcccaccaacacgccgacgcctcctgtacatcctagtcgccttagcaatcacgaccacacatcaccggagcaccacctccactatcagctccctcagccaccaccagcaccctcaccaccatcgcgccggcggaccgccaacgggcgtcaccgccatcgcctagccggccgcctaacgggcactgccgccaccaacatcggcacctccatcaccgttcgccggagcttcaccgccaccgcatagacgtccaccagagcgtccccgccacctcctggccggccgccaacaggccctgccaccaccaccatagcgttgctcgccagatcgaaagttgacccaccgcaccgccgccatcccagcaggcccgcacaccggcgagccgctctggcggcggcgaggttgaaaagcggcggcggtggctagggtttaatgggggagaggaagagtttggtttgggggagaggaagagtccaatcagtttgttgagttggcaatcaaaagtggtaaaatagaaacaatatggtagacccggatggcaaatagtgttatttgagaatgcacaattgagaagatgacaaacagtaaaaaaaacttctaaaatgcagagatctctaccacatacttcctccgtttcacaatgtaagtcattctactatttcccacattcatattgttgttaatgaatctagataaatatatatgtctagattcattaacatcagtatgaatatgagaaatgatagaatgacttacaatattgtgaaacggagggagtatatagtactgatttgttaaagggtgatccaaagcaaaccatactagtaagaaagaaaatcacacacaccccacacaggactcatatatgtccaggctttcaccggaccaaagatatgcacgttaattatattcctagtaattgacgacggagcacttcctccggacctcgccatcattccccggcggcggctggaggttccccatattcaccatggcctcgccgaagtcaccgaagaactccatgtcaaagagccccgtcgcgtgcttcttgacgtaggctccggtgaagtcgtcgtcgagcagcacggcgtcggaccggaacagcccgcggcgccgcgcgacctgcgtgtagtagcccgtgtcgaacttgggcgatctcttgggggagatctccaccatgacccccgggttgtcggcgttggcagtggcactggcagcggcgccgcacttggaccggagctcgttgaggtaggccgggtcgagctccgggtcgacgtcgttgagcctgttcccgccggtgtagttgtagaggcggtcgtggaacggctggcagtgcgagaagccgatggtgtgcgcacctagaatggtcacgttaagtaattaagatcgatgattgccgcagtcgatctgatgataattgatgatatcttgtggcggagctgcacccgataggacgacgagatccttggcagtcaagttcttatgggcgaacgctgcttgcagctgtgccatgcctgaatttggtggcgggagatcaaccgtctcggcggcgttcgatatttttccatcgagccgcccagttggtacaggccaaaacgggccattactctgaattaggagtgcacaaaattatatttagttgcatcatatttgtatgtactccatctcatagccgttgctataaactcgagtgctttcagattttagttctgcgttttctgattaggccagctttaacagagaaatggccttataggattttttttttccccgatgttgtatgccgcatgcatgcaggatggaaatggccggtaattgtggtttagggcctgttcactttaatgttattttcaacattactaaattttggtaaagttacttaaaaaaaatggctacatttagtttgctaccaaaatttggtaactatctaagaaatcctaccaaaattttggtaagttgccaaaattttgacagttatgctaaaatttggtaaggttttttttaacatcaaagtgaacatgcccttaagctcgaaatgtgtcccacaacaactgagatattgagtcgcatcaagatagctgagttacccaatgaacagcgtccctggcggcaagggcgaggatgtcagcacacgaaacagtcccaggacaagcctgctccagcttctccttgatgctgtcgatgacgtcgaaccctctcaggcctgcactcgtttcagcttctttctcggcgtcgacggcgccgccggccaccgagtccaacaggatcgacccgtcgcatccctgcttatatcacaagcacacacatgagtacattgacacatatcaacaccactgcataagcactactactcatctacaatctctgaactcagtatctactcaccctgacgaagcagtcgtggaaatggagcctcaggagagcgccggcgagatacggcgccacggatagaacagatgcaacctcctgcctcacggtctcttctgcgccgttgcatgtgtccccgtaatacccaactttgagctgtgcctgcgcagcgctggacgagacgagagctgctgctgctgctgctactaacacgacaaagattgctgccatcatcagggggcttcaattcctgagttatatatatgccccccagaaatttgtgctaatcgatgcaggatcgatcgagcactactatgttgcagcttatataggcagtagatacgttgacaaatcacaaatggatcgaggctggagtatcttcagtaaagtacgggctagctagctgttggaaccaaaccaagtactatcgtacatcgaggtaattgaatatgatgtattctttctttcggggtgccaaattgctagtttcatagaacttgcataattgggggtacacaaatgtcatcacttggaaatgatttttattatacctgtcgagcgtacagtgattatggttgtgcattcttacatataaatatttgtttattaacatcgagctgattgtcaaagcattttgtttaggattaactcaataattctcacacggaaagaaataagatggaagaatggcataaagttagttaggaactgcttaccgttacaggcatatatataaatatttgattactccaccccctctttgataagtctgtcgggcgcttggccgcctagagaggctggaacatgggaatcgccgggagaattacattcgtgcaaccggttctctcctcgcaaccggtatacctcctaaccgtgctagaagtgcacaacgagtcactggaggtcctagacaagcagtgcaagcattatttcctccgggcgggatgtgaaaaccttatgagaggaaaatcaaggtcaactcgacaaaaacctactcccccatcgctaatggcgccctaggagtgctcgacttggtgaagttctattgacggaaaacacggcggtctgaccgatgacatcatgctggtcggcctctgggtgaaaaacccgagccgccagagccgcagctggtcagaccgagccagcagcggtctgactgagccttggccggtctgaccggccgctctatggctgtctgatcagtccccgtgtctcagtgcatttaatgcattgcaacggctagttttctagccgttgtaaagtagtcaggtctgaccggaagtgcacttagttggggattttgaccccaaacggctagttttgtgagtgggagtataaatactcccccaccaacaacaaaggggctctcttggcacttgcttcacttacatacatcccttgcacactctctcacccactccagtgcttgtgttcatctatttggtgtgattgagggttgattagccaagagtcaagtgcgtttgcttcattatagagctagtgtggcacttgatcatctccaagccaggtcatcgcttgttactcttggaggttgccacctcctaaacggctcgtgaaggtgtttcccggtaacctctccaaggagattgtgcagaaggcccggcgcctgttgtgagtggtttggagttcaccaccttcggagtgaatgaagaactacccttagtgatcaaggcttgggtagtccacttcgtgggctgactccctccttgcccaccccttgacgaagagggcttgaggtggcttcgtggttttgaacggtgaagttgggctcgcctagaaaaccggcgagtttctgaaccttgggtgataaactccttgtctcttgtctcatttacttattgcatttacatttgtgcaatttactttaatagagacatatttgagcccatatcaccctaggattgcaaaacttaacttaggtgtgcaatttactttcacatagacatatttgagctcatatcaccttaggtttacaaaacataacttagttgcgtaattaactttgtacctcaccaagcctagcaacttaggttagttttaattatgtgtcgtttagttttaaatcgcttgttcacccccccccttcttgtcgacatcttgattctacagggtcagggacaaggaggaggaggcgttgttcccttcgcgcggcgagggcttgacaataaggctgttgatgaggggggcgcaagtgggggaaggtggcggcggttgctgcagcacggtgtcggcgtcgatctcggcactggtggcgggggtcggggatgagcacgccgctgccacggcggcatccgaggaggaggaggcgtcgttccccttgcgcggcgagggcttgacgacaaggctgctgaggggggcgcgagcgggggaggcggtgttggtctcggactccagcttcggctccggcatcggacttcctcgctcccccgccgccagcgtgaccgctcgcctccgccgccgccgctaactaggaggcgtcctgctgtgagtctgccgccacagcgttgctgcttaagcccgccaccctcgcgccgccgcttgaagaaacgggagatggggagagaggaggaagaagagatagggtgagaatggcatgtgggtttcacgtcgcccccaccattttttattaacttttttggtgtaactgacatgtggggttacaatttttattattttctaaatcaaattgccacacaagcaccatgtcaaagctacgttatatgaagaccgagtcaaattagccacgtaggcgccatgtcagctaaaactgtcatccaaaccgtcttgggacatatatattgtaccggttttgatatttgagggacccgttgtatctggttttctagttgaaggacaaaaatcggatttgttgataagttaagggaccttagatgaacttatttcgtaaaagttcggatcgtaaggttccaaaatatctcggcccggcccatcaaaaaactttgagcaggcaagtgcatacgtcaacctgggcctataaagtttaatgggctttgacttggaagacccttcctacccaacccggcccggcctatgatttcaccatccttctctgccatcgaccggccacgctcccgctccgcacaccgccgccgccgacgacgaccgccgcgctcctccacctggtgatcccaggttagcgatctgtacgcagtacccaggtatgcttcgttctctgttcgggccatctttctgcctctccaaacccctctccggacagacggatcggagggctaatacagaaggagaaggggggcaatgcgtgacggagatggggaaatctggttttggggaataggtgtaggtggcggcggagagggtgatagcgatgatcagtatctaggatttccagttcgacggggagatgcagccttttcagaagatgtaaactttgcctgtgcgaagactggagccagaaagacacacagcatatggtaggttaagtggtcatcagttcatcagtaggattcagttcaaaggatgattactgagtgcatctcattagctttgaaatgtgtgtttgattaatttggatattggcacagtgggcaagcatcatgcttccattttattttcccttctgtattctgaaactaacgcttagcatatgttcttgagttcttccattttattttttccttttagagctcataaccattattattcgattatctatgcagatatctgttatgaataattcggatgccttgaaacgcctttatgtaagtttctcgagataccaagttggttttatttatctttttaaattacaggaaggaattgccaacagagctgtttgagaaacacgtatcctccctccaccaccaaagtttgagtactattgattaatctgatccaaagtttctacatagtatctttcttttctttttctcggatggtgatctaatggttgggaaaaaaaatgacaagtagataatagcaaaatcagtcatctgatcaaaatttcaagtaactcaggctccatttttcttttcgaaactgaccaacatttggttgggattatatcatactagaagaaagcaaagactacataataacaagaaggagtcagtcttcttggcacgctcctgccaaaataaagttgcaacatattactgcgattactcaggaatcaaatatcaaatatcctcgtcatcgccggttagtaggcttgccagtccttttaacctcctgtttaccatgcccaagtttcttcgtgatccggtcaatgatgcgtgccgttgtggattcctcatcacggaacactctatcgtcccctttctttccaaatcttccaggtgatgaagactgatgtggatgaacatggatttaaccccattcttctcacttccacagtaatttgcagttcctgaactcccaagtaattttcagttcctgtactccactagtgaaggggatttcactcaccaattttcgtcgggcaagcttaggggcccagccaaactggtcctatatatctctctgctcttaggccacttctattttctttcattttctatgaagtgcccattcttttttccgactgaataaagcttagtgcagttggagcaagggcactcttatcatgccacatggtgatagatagtggtgtcacaatcgatttcctcacaccccacccagttctcagccatggacataaaagagcagctagctagtagcatgatgaacacgagaattaagaattatatagatactgctgctctaccaccctctttggtgcacgttattattcagagttgaaacgaccacttgagatcaatcccttttggggttttttttggctccatgataaagaaagagatcagaaagcactgcaaaagtgccattcatttcgtgctcgttgatcggtttcgttagagcaggtacaatagcaggctataagccagctataaacatattttaaagagataaaggaagacagagaagagcagcgggctacagatctgtagccagctgcagcacggactacaagacgtaatatgtgtatgacaggtgggaccaagtattaatagtatagtaagcaactattgtatgaattggctattacattggctatagaagatttggagctagtagtgggctgcactattgaccttgctcttagagcaggtacaatagcaggctataagccaactataaacataatttaaagagataaaggaagagagagaagagcagcgggctacagatctgtagccagctgcagcacggactccaaaacgtattgtgtgtacgacaggtaggaccaggtattaatagtatagtaagcaactattgaatgaattggctatagataatctggagctagtagttggctacactattaaacttgctcttatcgtgctgcacgaaaagcgccatggaagaaaggcaccatgagcatacctcgatcgcccaggcgttggttttatcagtcgacctgcaatttcagattctctgaacctttctggccggtcgaattctgaattgtctccatacggccatagtggagcacttggattcgttggaggacaccggccgtttacttggtaaacagtcactgctcactgctacatatgccaggtaaccctgtgtgtgtagcacatgaaagtaatggagtctgatctgtgtcactgtgttctgtgtggcctgtttcaggaaatgaccttggaaacagtctcttatctctgcgaaaatccaagaaaaatccttagagcaggtacaatagcaggttataagccagctataaccacatatcgagtagaaaagagaagagagagaagaaagcgggctacagatttgtagccggctgcaacacgaactccaatacgttatgagtgtatgagaggtaggaccagatattaatgatgtagtatatttttatagataactattgtatgaataggctattagattggctatagatgatttgaagccagcagttggctatactattgaacttgctcttagctccaaaatggactggaagtaccaagaggtaaagcaatgattggaaaaaacttttttttttgagtggacaatgatcggaaaaaacttggcttattattactgattttactactccctctggttctaaacatgagttactttagtcttctcaactccttcaaatgcgaattactccagaaatttcaagtcgtttaatttgtttacgctattctttcatccttgctgaaaataatcgctaccactcttgaataatgagtttagcatatatttttactactacactttgatcctgtttgggggagcttgtcccagctgcagcttttcccaaaagctgcttctgctagaagctgccctaaacagtccacatcttctgagaatctgtaattacaaattctgaaaaatgaactaagaacccagaagctggagaagctgggtttcagagcttttctagattctcagaagctggctaccaaacagctgcttctcagaatctaaaaactcccccaaacagaccctttgaatccaagctattacactttgaatccaagctattataccagattgtgaggttaactggccttcaatttattctttggtgaactggtggtgtactgcagatgaaacctcaaacagagctgttgatgtgctgaatgtgcttagagacccatagactggctctgtggagttggaattattttgttgcacacgtttctacgagtgacttctccacgtactccctccgtcaaaaaaaaaaaaacgacaaaccctggatttccatgtccaacgtttgattgtccgtcttatatgaaatttttttataattattattttcattgttgttagatgataaaacatgattaatattttatgcgtgacttgtctttttatttttttttcataattttttcaaataagacggacggtcaaacattggacacggaaacctagggtttgtctttttttgggacggagggagtagtcctaccttttgttttgcaaggaaggccatcatgtaagcaatcatattaattcttggaaatggtgatgtgataacactatataatcaagaatcctatactagtatgaggtaaacggtgatgagtcagctttaagccgaagatactgggattgattccagaatatgacgatagtccaagagaatgtgattatgtgatctccaaaagatggcacctcatggtttagataagaggagaaaaggtcagaaagtgacagcagccatgcattaatgcatatgaaaacaaattaacggtgaaagattacttgctcgatctgcatgctagcttaatccactgacgtaattgtccatgcacatcgcctcaaaagagttccaaaatcaattctttcctatggtgtaagctcacctttatccatatcctgatgacatgtcaaagcagcagaagatacaggcatttcagctgctgaaatttaattccttccaatacagaggccggcgatatgtaattccatataaattaatgaagaagatgaagatatgtgttggctttcagcagagttttgtacagactacttctgtttgtccacatccctcggatggatcaagagatccctgaatatttttatatctcatcttcagaatcaataatctccatgaatcctgatcagatcgaggtcgcctatctggcaatgattaacccgtacgtgacagacgatacagatcgatagcttccatttgcgctttcctcttctcttcctccctgaactgaactgcgtatcacactgtcacagaactgaactaaactgggctgaactgcaagagaagtcaaaggccagaggcctctcagtccagccacaagatgcggcgaagtttatacgctaagatcacgcgcgctgtggccccgtacgcatgtgcatctcatacattccgatccactactacttgattaagcatatgtttattatcatagtatcatatacagtaaataattatataatacctccgttttttaatacattataccgctgacttttgtcacacgttttatcattcgtcttatttaaaaaatttacgtaattataatttattttgttatgagttgttttatcatttaaagtactttaagcatgatttatattttatatatttatataaaatttttaataagatgaatggtgaaacatttgtttaaaagttaacgatgatatttattaaaatgagagggagtatgtatgtacgcagctagctaactcgtggattttagctgtgctgtcgtcagttcgatcttacagttgtaaagcacacaccattgttcccggcctgtaattaacctgtgaggcactagtccccgtgatgagtgccgcaagagatgctgagattaattgctgctacgagcataacatgcctggtattggtcctaacaagttaacaaaaagtgcacatattaattagcttttgaagccaggggagaaaaagaaataaaatgcaggtattttaggatattgtactatatattaataaaatgcaatggaggctatcagaaagctagctagtgatggggataagattacccttcatgatcatttcgctatcggaatggccaagtagagagcgccactgcaccatggtggatctattgggtgccatagaatggcccccaccaaatccgcaagtgcagtgaacgtaaacattctcccctcttcttcagggaacgcacgcctgagaatacaaccaagcctgtcagaccagagcaaagatcaactgatcaagcgtgcggcaaggaagaaacattgcaatcctagcatactcctctggttagtacatgaattggtaaatgcgcatgtaggtctcggccacggttttacttcattcgctggaacgatgatataggcatataggtgtttctttttttattaagatggagatgaagtccatgcccgtaaatgataaagtcgttagcatataattaattgagttttaattatttcaaacgtgaaaaatagatttattttatattttaaagtaacttttaagttttcgtataagacgcgtattttagcagtttgaaaaacatgctaacgaaaaacaatgaaaaatctacatctaaattagaaaaaagagaaaagaacgggagagtatcaattttgcatgtcaatctaattaatttcctcaaataattttcttaaatatggtcacctcctaatccatgtccaaagctgccctgtgctaatccatgaagaggacattgcagtgtcctagagagtgcatttttatataaagaaaactaactgtattcaaaccaatttagccagtagatacagacatgcattatttcatttatcaaagggaaaacacataagtgcacacaccattatacacatggcacatcgaagaatgtgtctcctatcacatggttaaaaagagatagagattaacgacgactctttaaccttactgaaaagttttattgaaaaatgcatctgtgtatgcttaatttatttttctctatttcgaatacttgactgtggtgttttatatccataatgtacttattttttcctattaatcaaatattcctttgcttttgcatcttggaaaagtgagagaaaagaaaaggggaaattggtgggtttggggaaaatactcacacgcttgctgaagaaaaagtgatggcaggcaaactggaaaagtggtagccatcgaatgcctgaggatatttgcctgccaaaagtgccaaatgttttctcccgataacgccctcggacccataaaaataagtgcattatctcttttgactcttttaatagatcagtccccaagaaacattggaatttgcagatctaaaattactttccaacgtcttggaaaccatctgagtatacaatgtttcatacgaataacatcgtatatgcttcactaaaacattttgaggtaaatattcatttcttgcttaatttagtaaggtaggagtattagcctctcaaaatgaaattgggataagctacaggttataagttataaccaattttaaatttcaggattactttacttttttttcactttcttcgcttaatctcaacttctaaatttctataaaaaggttttgtcttaaaaaagtcattcctgttgcttcaatcatatcctttcgcagtatgggcagccacgggaaaaaagacgccggacaaaccttgagcttctatgctaaatctttctactcggtctatttccaaatatgtttaaaatttctcataaccgttccgaatttaatttttgttcctccttaatctttgtgaagaacttagaggggtatatattttaagggtctattcattttgaagaaaaaccaaaagatttgggttcctaagaattaactcttatgagtatcattcggttcataggaatatactacatccgtcccaaaaaaaaagtaattctagtttgtttagcatatattaagattttataagaaagactataatgcccttattaaatgatgtataggtaagagtgagagggtagttaagggtaaaacagagagaaatttgagtgagaagtgattaatgggaccattggtactttacagtgacaactatttaggacagattcaaatcctagaaatacaattattatggggcataggtagtagatatagaaaaaccaaatgaaaattttctttccctatagacaaaacatagcaaatttttcatccactcaaacatcttgaaaaattcctatgaattaaagtgtggcattcttattcctccactttcctattcatatgtgttaaaattcctccaaaatgaatatcttatgatggagtacatggaaacattttgtaatttccatataactaccatgggcttctgtgaaaaatccatcatgtataaataacctgttctctcccattccccatcctctcctctgctctccatttgctcgcggcagattgagtgtgcccgtgtgagatagaatctttttgcccttcaaaaagagcaaagtggcagtgcttttccctccggttcctcgttttggtagtattccattgttcctattaccacttcccaacgaactaaccgaagccccggatacaacaaaagagaagacgcaaaggaatcatcagaagcagcagcagcacgcgaccatgggcgacgccgcctccaaccaacctgtaagttcatcttggtttttgccgttttgctttgtgtggttcttcgtcctgattaattgcgagaggtgaacgagttttttgaccttgtgtttactggaaaggatggaggattttgctttgtgtgttttttgctgaatttttttgttgggtgtttgcaggttcttgcggcgagcgatcttggccaatcgaacttggacgccggcgccggcgcgggagcagtcggcggcggcgggttcatcgccctcgacgtcagcgccctctcctcgctcgccggcgacggcccggacaccacggcggcgccaccacggacaccggtaagttggatagacgcgagcgcgcgcggcgatggcgacgtcggcgatgtacaattgtacatacatacgagcctccgtttcttccgttcgtttccaaagatttgattgattctttcctctttgtgtggttatgccgcggacgcgacgcaacagaaggtggtgaggtcgctgtcgaggaagggggaaaggaagccggccgacggcgacggcaatggcgccgccggtcagtccacctataaatctcatccaatcaaagatttcatcacttttgatatcaatatcttcagagttttctattttcgcttggcatttgttgggttttttttttcaattccatggagattttgtaatactcaattcgatcctgacagtgacagatcggttaccttgtcacaggatttagctagtaatccaagctgacaagtgacacctatggcgaattagtttacgtacgggtcaggattaatcgaggccgtgtgtgacttttggcactctcatgtgcagggacaggcaagaggccgccgctgtcgccgctcttcgtgcatgtggcggccgccgacgacatgggcggcctcggccggctcgtccacacgccggtggccggcacgccgggagggaagtcccggcggctcgggcggcagccggcggcgccgtggctcgatccccggagggtggtcttcttcttcgccacactgtaagtcaactggcaatagccacttatagcaaattttatagcagaggtgatactcatctctaattttgttcacgtcatttacttattattaattaatacaacaaattatctctaatacacttgctccaatttaccataatatttctttctttatttgttttcacttaattcattggtctgtttctcttatttctctgtaagtttgtatagaatttgtccggatgacttctcctttttttcccttctcttttccacttatcttttccacctcatcatgtgatccatagtatctcatagtatcttgatgcaagagctaagaagtccatagtacttgctctaatcatttacaagtgataatactgatagtataagaaaaagaataagttcaaaacggtaaatatctgaataaaatatttacgagttgtgcagtttcccaatagctagaagtagaaccatttcttttgagctgctacaagtacactcttgctaatttcttgctagtgattaggcgaaaaccgtggtacttaaagaaaaataattgacgaatttcctaaaccgtagggcacaagagtttaattgtcctgttgtccccaacaacgcaaaaaaaatgtggaacatggcctcgtattagcggctgcattaatctgcagccttttcagatcgtagtaggttcgctgcgaccggtggatgaatgaatgggtgatgcgtgcaggagtttgcagcacaaagagcggccgggtttctcgttggcgagtctacgtgtcagaactagttttagttgtcagctccggtttggctacagcgatatacgggagaaaagacggcgactgacgaacaaccgttctcgtgtacagtatgatgacccttgctttagaaaagaaaatccttcattttttgagtgacttttggacaaggtttactgaacctttaaaagtcactgaatactgcttccgagcgattttgttgataactgtgataaccccttggttacatgtgttctttccccttctttgccaactcaccctttttttttccacactcatgttatggaatgatgtgttttttaaaaaagaattataagaaaattacttaaaaaataatattaatctatatttcaaattttcttatattaacacttaattaatcacgtattaatgggtaacactgttttcgtgcgagaaggtgtagttcctaagtatggaggtgaacaattttagcaaactcaaccttactgacgaaaacagtataaagttgaacaattttaccaaaaagtttgacttctggtttgatttttttattcaacttgactagttatcgagcgatttatcaatgtgtacctattcggtaagtcagataatggagcggccatcgtcacatttatcaaccctcctttttttggtttggtttggttgatcttgtaggtagaactctgaatttacgaaatcgtttcattcatcagtactgcactcttcagagatggtgaatgctcatgtaggttttctgcttttctgcaggtcaagcgttggaacgttgatcctgctttacttcacactctccatgagcaagatgggcggcgacagcggcggcggcggcagcagcgatgctcggtgaaacgccggctgttgaaactgaagaaaaattttcgttttgttctcaaacctcaatgcaatctgtaaaggaggcatgatgttgctacaaagacccaggcatcaaaaaaactgatgctcttctaagggtcaaggaagaatatagagtgaatggcagtgaagagatcaggctgaatggggtctgatggtgaagtatgcgatggtagttgcattctcttctctgttgctgtcatgatttcttcagttatttttctcttcttttttttgcataaaaaggggtacatcatacatgtcgctttgaagcgatgatactagatttttcatccttgatgttgttgcagacacacaaacaatcaaaaatacaaatggacacagatgtatttgaaagaattgtcttttactcatatgtcatttccgtaagagtggtagtacatgacttcaacaaagagttaaacgaacgaacaaagaatatgacacacagctcacaaggtggtgatgatctacaaaatgaattaaaaccctctctatgcacaggtgatgctaacctaatatgggacacgtgaaaaatgccggatagtgggtagttttttagacttttggattcacttcacagctgcagaatagacttaaaagtccctagcaaaaatcttttgatactcaacgtgagtgttaaccatctctgacagataatcgtagattctaattggagccaccctgcaagaacagaaacagatttcttaagatattcagctcaatgcagacaaattcaggacacctaccttagcaacctaaaatgaacgcttttttttcagaagatttttcaacacaatgaaaataacaatgactatatccggcatttttcaggatgcaaccatgcagttgattgacagccacagctgccattacatactactcaggaaatagatgataaacgtatgtagtttgccatttgaaaagactgaattgtgaatttattcccactttttatcagacgcaaacatagtatcaagtgtgcaacaaggactatatctttggaacattttccccttgagctgctgctgcaatttccatctaaccagatttctgatcagctcaaccagacttcagtgactggaggtatggttcaggatggccctggtctagcagacaaactacaatattggttgaagcacatcttaccagagctccattctggtacttacaaccacatatccacaagataatttgcgtagtgcgaaaagcagccacaaaatagatgtcactccaaacaataacacccaccggaatgaatgcaacatgtgtcagaaaaatgatagggaaataaacaacagaaagaagaaaaagaagagtgaaagtagcacaggttagtttcaactttcaagtgtcctaattggaaactagacccactttcggcaacttctaaaaatccctcctgtctaatccaagagtgattcttcaacaaaagatcctagtggtcaaaactagaagacatcacaatgaaattcgtcatggaggatatctatatcttgtccacatgtaaacatatttactgatggctacttatttctctgaaagcattatgagtctagtttatctggcaaattttggacagtgcaacctagtgttttacctgattaattagcaatgaacttatgaccaaaacaatttctgctgttgaataactcagacaatgaaatatacatttatttgctgtgcactatgccttattcatttagatacagaagccacctagaaggtggtaacacaaattaagagttaataaaaataagtgcgggctaaggtactcttgacatttatcaaaacacatgtactttacaagacgcagaagagatagaacgtggtgctagtaccgttttgatatgcgtggcatggcgcacttctgtttcctatcatggaatatcctcacaacgacagcagctgtttcctctatagcttttccagtgacttctgcacaaacacaaaacaaactacacttcaacatatgaaagtacaaagaaaagtgtttccacaaagacaattaaattgatcgtaccgatgactggccatataggatgctgggcgaaaatttgattggcatgatccaactcccccctgacatgttccatttcagcataattgcttttttgcccatgaaatcctagagttttggcccttgccttcctgattgcttgaagaaccacagggtttattgtcaatccaaaaatcttgtcttgatcaatctcaaaaagggactttggaagattcactcccattacaattggaacatttgccactttataccctttttgagccagatatattgacaatggtgtctttccagtacgtgaaacaccaacaagtacaatgtgtgcacggttaaggttctgtggctgagcaccgtcatcttgtttgatggtaaaatcaatagcttcaattcgtcggaagtaatcctcagtaagttgacccttccggctaggagaacttcgtggaattccagatggagcaacaccaatatgggaagctatggcttcaatagtaggacgaagaatatcattggatggaacaccccaaagctcacaggccttcttagttgcctcagccattgaaggatcagcaagagtatataaaaccagtgctccttcttttgctgcttgctttactatctcaataagtctatccatgtcatcaatctaaagcaaatttgtagcaaaagacaaaataatcaatatcaagaaaactacacagctagcttcatttatcagtcaatgcaagtgcaaattagggtcagtgactaatacgcgaggtttctaaactaggaaaccagaataactccttttgtgcaatagtgattcaaccagacatacaatgatcatggcaaattggcaataagcacacctccatgcctgaatatccaaagtactatggtattcatttgttctgtgtcctaagatacgtgcaaacaagtgaacactaaattttcaccgatgaaacaaatagaagtgcatgaaggagtaaccaaccattcagttctcaatttacacaacttttagccatacacaactccatgatccacaaaaatgtcaatgtctgcatcactatttaataaaagtatgccgcatcaatattcatcttaagttccatgtggaaagtctttcctccattagagcacaagcaatttgtgcttctaactggaaagtctttcctccgttagaacacaagcaacctgtgcttctaactgcgagcatattttaatagcagccattatcatctagtagtgatagcatgaaataaattttatttcttccattctcaaacaaatataatgtgaagtaatcccaagtactcacacgctactgaccttactctaaatctgatctataaggctattaaaacaagctgaaaagaagcaggagacttatctccacaccattgattatggtgtagattaatcagacatatatatacagaacatcgctcttattatacaattgtattttcagagtaaacccaagagttgtataacaaataaaattatgctttcaattaaactatagtctagcttgtgaaagaagattcagctggttcttcgaaagctagatgctgataattaacagtgaaatcaagtatctcaaatccctaattagccaatcctgataatgtacagcaaggcaagggacaggtatgcagcaaccagtccgagagaataaagtgtacatgtgcaccgatcatcggtaaaggataacagtttatgttatacagcacaaatctacagctaaaatccaaaatcccctttattcccagaacaattgatatagtttctatgcactatgttggcatatcatgattttccagcaagaacgaaaaaattaaactattgtacgaagcagacatatctggctggacagtggagaccatatatatcccaaaaattgaagaatcaagtcaatagagggcggcaaaaaaaataataaaaaaaaagagacaaggagaaagaaatggatctttaccccgttgaagaggtgtgtgttgacggcgcagccgcggtcgacgaggcagtgctcgaactggccgagcgcggcgttgacggagtgctccgccgtccaccccgtcccgtcggacaccatgtagatcgacttcgccgcctcgtccctcccaaccaccccgtagccatcctcctcctccaccgcgaccttcgccgccgcggacgccgcctcgtcggacgacgggtgcggcctggtcggggtcggcggcgacgaggccccgccgctgccgcggtcccgtatcgtcggccactccagccgccgcccggaccggtgcgcgcgggcccgcgaccaccggtgcagctgcgagctcccgagctgcgcgggggagcgcggggtggtggccgacccggaccccgaccccgccgcctcccgctccggctccttgtccggccccgggctcggcagcgcggcgggggtgccgggcgtgcacgagggcggcgtcaggcggcggccctgtaggcgaggcgacggcgggaggagcagcgacggcggcggcgacgccagcttcgcgcttatcatcgagccgaaccgcggggacgtcgacgacgacgacgacatcctcgattcccctactgagcttgagcttactacgcgcgacgaccgtacgacgaggagagggattttttcttcttctcgttttcgcttcgtgttggcgacgagccgacgacgtttgggtggggttgtgaggcgcgcggcgttttttatggccgagacgacggtgaaaagagaggaaaaacgtgggacgccgaccgggcgccaccggggttggactcggcgactagcggaatgaatagaaatgattggtgtttcgagacgatcgagctggtttttcggcgtctgctctgcttgccgttggaatctggtctggacagcgtgcgtttgcacgggtcgtacagcggtggtggtttcgttctttgttttggcctccggcgtcagtgcgtcagcccgtcaccatgttgattggatgcgggtggttttatggatcttcagggaatcagggctctgctccgctgatacactcgtcgttcatgtgttctctcttccacggctcgttagatatggatacgcatacgcctgttctattggagagtataattggacttggacccacatatatgttgtttccgtgattcaaaagtcatgtaggccaaacacagttgtgacagagtgaagtttgtgatgttttttaataccaagtataagtgaggtcctaaggttgagtattatccaagacttagtaattcgatactgtaatatataacttaaattttggatccttttatagtacacttggtggtagtagtatagtataatttaaatctaaccattgatttatcttgtgttttttttcctccatcaattaaaacgtaggcatatttttgccaaagattttagttgccgatgttgccgctgaaaaattcgtggccggagaagcctcaaccctgtagcagcatttgtgcgtttgtggtaaaaatatggctgaatgatgtcggggccaagggtgttggcctcgtttcttgtgtgttcagccgatgactaactgccgcgtcagagactgggtcatgtgttgtctcttatcatttttctcgccatctcagaaatgaaacgtcttaattaggaacaaaatatcttcaatacaccaactcagcaagcgtgagttcacggggtatcaactgttcgtcaacaagttaattcatatacatccacataaaatcaagttggtatgtattaagctgatggcaagatctagttgcgatggccacgatgcgtcgaaccagtgatatggtagtcgacggcggtgcaagagcgacagctgcctgacgatcgacgatgttgacgcggattctatcgaatcaaatgggttgtccatcagttccatcgtcactgttgcactctcaatacgcagtttgtgcccggttccatctaaccaccgataatatttagtttttctttactattttgtacccatgctcatctctactacacatactacaagtgggatgtagaaagagatttagtccatttgattgaatcgagtggacggcctatattcctccaagggtatctttgaaatgtcctagatttcacggtagctaagatgacagtatccctagaataaattatcactacaccttgttgattaataattcaataaataaataaatattgtttgctatgtactactcccccgttttaaaatatgtttctgattcgtagtaaaatatagatacatatatattttagaacggatagagtatgtattgtgccaaataaaaggtcaggaagcaaccctgtgtattttccaacctcataattttgcacatttttctcttaagtcaataataatttatgccggtaaaatattttaagcctagcattagtacataaatacatcaaggtgttgaaagttgtagagatagcccctctaactccaagactccaagagtatattagccaagtcttaaaaggttcgtattcctaaatatgttaattcttgcgtaaaatacaatctatattatcgtacaaacaataatattgtgccttacagttataaatataataatgtatagttttgtcgcccaattgtgacaaagaaggaattctgtcttaaaattttcagtaaaaacaaaacaatgaaaaaaaaaatcttatgctgccgctgaattgagctcttcaactatgactacgtaatgagctgcagtaaaatataacagtggcaaaaaacaaaacattatcacctttgccggttgcaattgcataatcagtatcctccttttttctcttttctcgattgcgcccgccctgccaaagtgccaagtgcgaaggttttactactagcggttggcacacaggatgacgcgtagtacgtctccggtcatatccaactcctccgtcacgagcttacaccccccaaatccccaatacctcaacatccctctcgccagttgaccaagacatttttccagcaactgatgtcatgacaacatcaggtgaagccacgaggatatcatcggtagcctggccccaaggcaacaaagacttgagccgcatgcagtgtcgacggcacagaaatctgccgcttcttctgccgcgttgcgcccaagcagcactgcagcagcagccgtgttcgcctgcaggtgagctcacacgcgggcgccgtacgtggagcgagtcgcaccgtttctgcggcagtcagcgccgagacctcgcggagacgcggacgcgcgtctgaaaaccgccaatctcccgccgcccctgccgacctcagcgcggcctgtggatttgggaggaaaataatgggcgcagcacgacgatttcggccgctttctgcctccgcccccgcccccacacacaccgaccgcgatcagcggcgacgtccctatcgcactactagtacgtactcctgcgtggcatagcgccgtagccattgtttcggcctgctagctgctgtcatcgcctgatcggtcgccgtgtccacgaaggattgaggttaaatgcacggtctttttatcaaatccagtgactttggccgtatttagttgttttgataaaaaaaattgacgtgtactggtaagtatttgaagtattaaacgtaaactaatagcaaaataaattatagattctgtctataaattgcgagacgaatctattacggaaaagtatctagaacttcttccgctggcccttgcctaaatccgctatatatttgacacggatttgccgtaatgctggaactatggcgaatgcatctatcgtcattaatgcataaataaatataccaattagtagtgattgaattccttctatggttatacatgagaaaccagtacgaatataacctacatgtccaatcgaactatgagctagaggttttttgactttcgtttgagctatctgctcttccactgggagagggtttgattgggattgtttaagcaattctcgtaatcgtcgaccccttgccaattgattctgacttgttttatcgagagcagaggcgaattgtgcaaccgttgttatatcgctcgataatgggcatctcaagccttttccatttgaaggtacgaatataaaaggactatgtcaaacctacgaaatagagatggcctacaaggggccatgggattaaacaaagagaggcaacttatgatcaagaagggcattagtgactattttatcggtacctgccggtgatgatttgagaataaataaagaagcgattgaaacaactggcgagcgaatgtttggatcatatgctgccttgccgcctaattaatctgtcattagcaaatgtttactgtagcaccacattgtcaaatcatggcgtaattaggctcaaaagattcgtctcgcaatttacttgtaaactgtgcaatcggtttttttcgtccacatttaatactccatacatgtgtccaaacatttgatgtgacggaaaagttggaagtttgaaggaaaactaaacacagccttcaacagtagaggatcctgatcagtccatgaagacgtcgttgcatttgcctatgatccgcaaatgagtgtagacccaaaaatgttgtcctagaaaaatatgggaaacaaaataaactagtatatgttggtatatatatattctccctgtctttttcttttaatatgattaaccttttttattttataaagaatactaatatacattatttttttaccaggtactaatatacattattatatgctcgagtttaactcgagctcgaaccgagtttgcttgaaaactcgaagatggattgagctcatctcaagcttgtttcggtgaaaaccctagtccatggccaacggtgccaacctacttctcctatataggttcagtcaaggtgcatgttgccgtctataacgttattttgtcgtaagtcaatttcgtaggctatattcggttgcaactgctacaattcagccagcacacctgttgcgctgatacaaaatacaaaactacaaagtcatcgtcgtcttcgttacaagattgttctacctcataaatttcggtggttagtggcacactcgcatgttaacaccacttttccttgtatcctaattaaggttgtgttctaaggtgagggttgggaaccctcaccctagcatacaaaatagagtggtagattagtacataattaattaagtattagctaaaaacttaaaaaaatgaagtagttgtataatttttaaaaacaacttttctatagaaaattttggcaaaataagacatcgtttagtagtttgggaatcatgcgtgtcaaaaacgagcaagaggttgggaacgttcacatacgaactcagcctaagtatcaccacccaatttatcagtctttagtacactttgttagccaattacattgacgatttggaatacaaaaggaaatactagccatagacctcgccaaaaaaaatgctataacaacaaaaaaaatcttatagaaacttcataggactgtcacagaagaccgaaaaatgattaagttctacacggaacaagtaaattttgcaacaatccaaacagggttccgttgcaaataacctcgtagggtggcaaatgccacaacatcaatatttgcacatagatgtgcaatagttacatgtacgcacgtggtaatcattttaagctaacactagtacctctcactaacaaaaacatccccgcccactgatttctaatggagattagcttatttcttttcttttagaaaaaagttacggttgttcagaaagtatctcaagatacctaaattttacgctaaaaaattatagttgaggaacattacttagaggtatcaaattttacactagaaaatacattacctcctagtaaattgtatttaagatacataaatttgttcggtgggtataatccagtacatacacgaacttgttagaaggtgcgtgcaaaccaaaaccaaaagaacacaaggctaatcttgccaatttgagtgttaactaggatactacataaacatgtacacgagaaaaatgctacgtagacataaatttgtccagtaaaaagtttaatgcggcctaactattgtacagataaagacataaaaaagagaagcaatgcaaagatagaataaagaataataaagcacaaatcaaattgttatatcatgtctcatgccaacctatatgtatacgttgtgtcctaataaacgtttaacttggtaaaattagccatgacatgtccttttggttttggtttgcgagttcatacaccaaaatacattttacaaatttttatactaaattatactccctccgtactcgtaaaggaagtcattttggaatgcgacacggtctccaaaacacaactttgacttcttgtttctacaaaaatatttattgaaaagtgatatatgtatacttttatgaaagtatttttcaagacaaatctattcatatgatttttacattttcaaactcaacaacttaagagttattcatgatttatattcccaaggtttgacttaaacattgtcctaaactacttcctttgtgagtacggagggagtatccacctaataagtttgtgtaccgccaatgtatttttctctttttttaaccatagattagctttatctgtaataatggtgaagaaaagtccatttgagatttttctaaaagaaccaagtgatgaaaatccagttttgaatcacctaaaagaaatctagttctgaacctttagtaatgctttcccacacttaaatgatgtgcctcgaaatgatctagaattatctcgacgccacttaaatagaaaatcttggttaggagagggggaatgttttgctccatttcattctaggattcaaattttgtggaatttgatccataaaatgagtttgcttttgccccattttgtatttgattttttttgtcttgattgatgtatttgtaatattgcactacaatgtatatgttatttaattgaacttttaatatttgcctatcttaaaagagcggagtcatcatccttcgatcccttccttccaccatgtgcaacatgcatgtatgtggaacataaccactagattcaatgctttatcctcaaccactctctaggccatccctaattatatggacatgacgcgttacaagtcatggacatgttactagtctttataatattgtactaatgttgtaccaacatataaagtgaaccaacatgcctttcccaagtccaactgaatgcggagtctgtcaccaccaccaacatccacaagctcattcatatccaagccaaaagcatgatgtttcatttgaaactttatacttttctactagcttctttatttcttcaaagtcagtggttcagtattgtggacaaaaagttcaaataccaagtgaagattttttttcttatgaaacacaattgtcttagattgaaaattggtaaatcatatcaaacatttttgtacttgaagtttaagttcacattttctagatgcaaagaaatagacacattgcattccaaacaacattattttgaaaatgctcaaaactggggaggtgtgtgtgcctgacttgaacaagaaggtgaatgagacacaccttatagatgtctctatcctgtcaatttgaaaacccaaaagtattttctctgtttatcaagagacatgatttggttccttgagactacaagagcttatttcatgacaaactaagagaacttctggtattgtagtcttccaatgcacgaattaatcaaaacctttcaccattacttgccttgtaattctgacactaagaaatcagtaattcaagtattatgtgcaacgtggcaaaactattaaattgaaagtacattttgtagtgtgaatacaatcataaacctggatcgaatacaacaccactacatttataatagagtatatgttgaatttgccaaggaaatgaccttggtgcttcatgttttagaagtcaaaaacagaaaacaaaaggaacaaattatacacacatcatttttcatgaagagcccaatagaaatgttgctccaattagcccaatagtgtttttcttgttccatttgttctaggtccatataccttgggggttgtaagttcaagtgccttaatttggttttggtgattaataacaaatctaactatatgagactaacatttttatgagcttttctttgactagcctcatttggatatgaaaataaaaatgatgggaggtatgtattaaactccacatattctaatcttgtatctcttgtggatctaaaatatagtgtgagctctctcatttcttaattaattatgtgcatatgcattctttcatatccatatgtatgcacaaattgagggggaggttattctatattttgtttattgtaatatctctatcttgatttgaaatcatctttcatctcatctccctatattgtttatatcgggttattatccatcaccaaagagagaaaagattgaaagatcttggcttaaacaatttgtgtaattgttgctttggtgatagatgataaacccatgtttatgggattaacttctcctttacataagttgtcaattaggttatttcccaataatgagatgtagtagacatgcattcttttgtgatggaccttaatcatgacaaggatgaactgcatggaaataaagcgatatatatcactttttatctcctactttttgataggttcatatatatgatttccatgttattcgtatataagtgtgagactaatgtttacttgagtcttatcttatttagtctcatttacattaagaacatgaagatcatgaaggtatgtgtttttgtttatctttatcattgctacatgccttcgtgtataggataaactccattggttcttctttacttatgcatacacttacatctcttgtatatttttttgtatgcatatatttagggggagcaaatcctatacatttattgtgaatgttctagatccatattatttgcctattatttatatcggatatttgcacttgagcttgcgtacgagtatatgatacttgtggtgttaatgaatacctaacaaacatattcatatctttcatatgcaaccggttggtcatcaagtggatgatgataactgatttgttggtactaatgttctcctatgaactgtgcaaaggaataggtcccaccgtgatgaggctaatggatgacatcatgggttgatggtcaccaagccaaagacattgccatgttgataagaacgaagtaagcttatgatgagaagaaagtcttaacaaaggatgatcaagacctcggcataaacatgattcaaccgaatggtcataagtgttgatcttggctcaagcattaaccacaagttggatggcgcaaggcaaaggtataatcaagctaagaatgttttcttagtttgttcccggtcttggtgtttggtgtagatcagatttgttagataggcgttgtactatcaagacgggtctatgaagcgagcatgtttcatatgcatgtaggtgcatttggtgggattgtctagctaagtgtaatgagttttcttaagtcccaaacaaagaaagaagttggtacatcctataagtttgggtagcttaatgtggtattctccggtggagtatccttcggagtgtgagccctttctccttgctttaagttgtgtttcatggatggaaatttcatgagttggatatccctttgaataagcttttcatagagtccaagaacgtcaaattccgagacccgagtcaagagatatcatcattttactaacagctggttgtgctgaaaagtgaactgcggtatgaccgcagcccttatggcggtctgaccaatgtgtgttgtctggtctgaccgctgatcctgattttgaaggaggtctcatcttgacgatacagagccgaagacggtctgaccggagccgatggcggtctgaccggcatgcctatggcggtcagactggctagccatcgcccgtgcattaaatgcactgtaatgactagttttctagccattacaatagagagcggcatgaccggccaccccatggcggtatgaccgcccaacacctgggagttcgggtttcgcctccaacgactagttttggtggttgggggtttatatacccattccccagcagcaagggtagggttttggtactccattgcattatcttgaacccttgcaagagctctcacacccttgtgcatttagtttatctagtgaggtgttggagagtgagttaagccaatccaaatgcatttgcttctttgttagagctagtgtggcacttgatcatcatcggcaagcatcctagacttgttactcttggaggttgccacctcctagacggtttggaggagttgcccggtgacctctccaagaaggttgtgtaggaggcccggtgttgattgtgagtggctcggtgttcgccatctccagagtggaggaagaacgaccatagtgatagaggcttatgagaccactttgtggtttgagcggtgaagttggactcgcctcaacggtgacataggaagttggcaagctccgaacatcaggtgaaaaaattctttgtcacttgtcttctttattttgtgcaaatttactttgagcaagtttacatactagagtttatttgcgctattatcaccctaggcttgcaaatctcaacataggctagcttcttagtgcacttgcttgagattagttgatttagattttgaattgtgcaaaaccgttttgatttacgcttccgcatacaaaactcggttttagccaaaagttttaaaaccgcctagtcaacccctctaatcggcctcctatcctacaggggtctcagcccaaagtgaaccgtcacgcgctccatcctctataccctatctctactacctacccgctcctctctataccataaataatccccctccctcttcgccctcaaccattcttcacagccgccgccaaggctctaggttttgtcgagctccttcctttgccataggctcagctcgtcaaatatgtcttagagtcgcgaagatcctcttgaaacgcttcggatggggtaagttcttcaacttttaggtgcttcttttagatctattttattatattccttttcgagatgtattttccaatgatttcttctttagatgaactctagatgattcatttttggatagattcacgggtgacttctttttagatggatttttttagacaattccatttttagatggatgcgattctttgttagatggatttcttagacaacaccttcatagataggtgtttacatacttggttttatgttttacccttttttcatatataattctttcgtagataggtgtttacatatttggtatttatggtttacccacttttctttaggtaatgccttcgtagatatgtgtttgcatacttggtgtttatggtttaaccacttttccttaggtatctttttcgtagataagtgtttacatatttaatatttatggtttacccacttttgcttaagtaatttcttcgtagataggtgtttacatacttagtggtttacccactttttcttagatgattccttcgtagatatgtgtttacatatttgattatttatggtttaaccacttttccttaggtaatttcttagtagataggtgtttacatgtttaatacttatggtttacccttttttttttttgttgtatctacatcttttttatttataggtttacccctttttgttgtatccacatctttttatttatggtctacctgtttttgttgtatctgcatcttttttttatttatggtgtacgcactttttcctcacaattaatgttgtaggagcgactggtcaaccctgacggggtgcttggtgatgctgatcgccgagcgcctactggccaacgacgtcacggactacatccgcttccgcgccgtgtgcagcccctggaggcagcacaccgaggacccacgtgtcggcgacggcctccgccccaagtacctccccaggtcgtggatcatgctggaggagacccccccggcggcggcgccgttccgcaaccgcctcctcaacaccggcaccggcgccgtcctcgccgtcgacgtcccggagctcaaggaccacgacgtcatgggccccaccctgggcgggctcctcacgctgcgggagcgcggcggcgcccacgtgctccgcctcctccacccgttcacgcgccacctcaccgagctcccctcgctcgtcaccatgatccacgcggcgtcgcacgacccaaagatggtggagcccgagtaccaccagccgacggccatcggcctctccgacgaccacaaggcggtggccgtgttctgcggcctggtaaacaaggtcgccgtggccaggcccggcgacagccactggaagtgggtctacgtcccgcacttccacctggagtcggccgcgtcgctcgccggctgcttctacgccgtctcgcacgtctacatctaccagctcgagagcgacggcgcgcgcggggagccgaagctggtgcccgtggcgtacgtgcccgtggacgccccctcgttccgcctcacgctggtggcggacgacgagagggagaggctgatgctgatgaaggaggtgttctacgtgcacgcgggcgaggaggtgccaccggaagggcccgacatgctgacgatgcccagggtgtgcgtcgcgtacgcggtggacatggcggcgaggacgatcgcgctgtcgaggctgggcgcgcgcgcgctgttcatgggcgacgaccgcgcggtctgggcgtcgccgggggcgttctccccgggcgtcgcggcggacaccgtctacgccggccgccccaacaggctcttcaccgtgcacgagtgcggcatcgaggccgaccgcccgctgacggtcgtgctccacacgcacggcctcgtgagcgggctgacgcggcatgccgtgttcgagagcgacgacggcgaggacctgaaccccatgggcatcgtcgagaccgtctccagctacgtcgccagcgaccgcggcggcgcggcgcgcccgaccatgtatgtcgccagccatgcccgccgcggccgtggccgtggcgtgtagttcggctgataactgtggcggtgatgactgatgaggaattcgctctggaatttcctcctgaaataataaaaatagtggttggttcttcctgaaaaaatggcatgctgcgttcgtggtttctgtgaaaaaaaaaaagttccgtatgtcggtatgtgctggatagagtaatcaggtatactgatgatgatcatgatgagtaacagcagcagaaacgttacctgaaaccaggtcgccgtttgcagaaaagcaggaccagcgatcagtagtcttaccgcatagagaatgcaggtttacagggcaccggtgagttcccaactcacgcgcacgtttttcaaactattaaatggtattttttaaaaaaaaaattatgcaaaagttgctttagaaaattatgttaatccattttttaaaaaaatagtaaatacttaattaatcataagaaaatgtgtcgctccgttttgcgtgcgaactcacctccccaacacagccatggaatgcacggtatgtgcaaataggaagcaaatgataagttctttgtgaagacattatattacacctcaattatgataaatgtcacggaggtactcatatgtggtaagtaaagcaggactaaggatcaaaaacaagatgagtccagaactgcctcaaattaacttgagtgtacatagatactcagatacaggctttcaggtctccactgtgatcccggtggccttcataagatgtttagaaacagagtaatatagcagcattcactcgaacaagtattcgttaaccgaaacctacataaacatgtttgggtctcatatatcatttcaacatggtaatttgacaatgaaagctaaactagttacagatcctcaacatcctgcttggatgatgtagggcgaccttgatactccagttttgtacctaaacttgctgtgataaccctgaatttcagtcttatcttctccattatatcttgaacttgctcgtcttctgggttcgacaacggatagcttctcaacagtgcagctagttgctcaatgtttttcctgacccgagctgagaatgcatcttgatcaattgaaaccaacgacgtccaaacatccagacatccctgataaaaacctagttcttcacctacctgaaaaccattctttaaaccaacctgccttccctcttcttttccagacaccaagccctcactataaccattcttgaaacccgtttgatagtgtgtctcatctaagagtactgatggttcaaggaaatcaaaatcatccttaggtttctgatccatggtattaataagaacctaaagatgttgcagtaaacagttccttagagagggattccaaaaggttgctcagtaagaaaatgtatgcatacctaaatgcaacaagacaaaaatattaatatcaaagaaacgagagatggaaaagtgcaaacagaacttctgctgagttatgaacaaaaatgtgttgcacgtcaaacaaagcaaaacaaaaaaatgatgattcactaaactacgtactctagacgtttgaaactttacaatttttttatgggtatatctaacattaacgtcatgttccacttcatcaagtaagagaaattaggatgtcaccattactattgactttttcttttgaaaaaggttatattgactattgaatgcagtgcgagccaaactgtatgatgtcaaatgttatgacttcaacaagcagagtcatacaacctcacacaaaaataagcactacacaactcattcgaaccatcataaatcccttgcgtagttgtgttggattaacgccaaggttggacagaagataaacaaggtggtagctattcaaacaaagtggtagctaaccttcaggattcaggaataaggatacactatattctagtaatattcaaaacttccagctcctaagtttcctaagcagcacgatcacatttttttggtagaaataccctatattaggctattactattagctttcaatataagctaggatcaacacttattatttaaaagaacaccatgatcactaaagcatagcattaattaagtcttcatcatacctctaaaccttcaattagtatgatattctaaggattgaaatgcccaaaaaggaaataaaaaaaaaggaagataaaacctacgtttctccagctttacagaacagtaagtttccccaaatctcgcttctatctttacgatgctcttggcttctactactaccaaacaaacaaaccaaaacaagatgtaggaaagccataatcacgctagatgtcacaactactcgagaattgaaagcagtcaagctgaattaggagtcatgatttcagttaccctttgctcactaaaaacaaaaaaaacaaaaaaaaagttaccctttgctcagttgctcccggaagaaggcgtcagtttccgcgatacttctggaacacgccgctgcagttggagtccttagccaccgcgctttccgccgcctactcagggcagaggcgaaggccgctgatagcaacggaactgcgctttccccggtctccgcgggcgaaagaggcggggcgccgcacggcccctccgccggtggaccaggcgaggcgccgcagctggcggggggacgacgcggtggcgcggccgctgggcgccgccgctacgaccggaggaggaaggagggtaggagactcacgtgtgtggcggcggctccagcccagtgacctctagatgaagcttttgggtctgatttagttgatgatgggcttttttgggccatggagtttctcgacgtcagccttgtagaagttgataaatgggctaaagcccatatagatttggtggttgggctgcaatcacggttcgcgcgactcgagctctcgaatggccttcgtcttcgtcttctccggttctctttcccttccccatcctcctccccattgcgctgggtaggattccaatgtgggggactagggtttagggtttggagtcaatcccagaccgcgcccatgacgtcctcgtctcgagtaagttgcgttctgtattatcttcctctctctctctctctctctctctccgcgcgtgcgattttttttgggggtgtggttttggcgatgatatgcgcgtgcgattttttctccccgggtgggtttggggatgggaggcgtgattagaatcagcgaatcgcttcagtgcattgcgctgtattctgatcagtgtttttccataggagatttaagattttgttgttgagctgatgtgtgaaaactggtgtattgcttaggtaagggttggcaatctagtccccctcaatgaaggaaatgcgagctcgtcaaatggatcggtgtcaagcattcctatctatctgggtgccaatgttgtagggaggaatcatttggtggtcgtcgacaagagagtcagccgcaagcatctgagcctacatgcctcggcggatggttccattgaagcggtagtggtgagtgtgataaggcatggggatattccaattaactgcgcagtattgttctgatggcttttttttcagaaaataacttgttgttcattggcattggatgtgcaggaaggaccaaatcctatcattgttcgatctgagggccagaggaggaaggtctgtgctcaagagagagtaaagattgcacatgatgatgtcctggaactcatccctggtgaatattttgtgaagtatttgaatgtgggcgataaccataaaagttccacatcaatgggttcaagtgattttaaaaaggggaagaggctctgtgaggatgatactgtagttatcaaaagaaatcgtcagattatggaagatgaggctttggcaagaagtttacaggtaacttaagtacttaacctttctagttgcactgcctgtattgtgcagtttgtttaacttagaagagagcaatccatggttttccgtgtatcatatttccgtttagtctgatcatggcttaatctgggcaatgctgtagttttaatataacataaatgatcctagtgctggacatagaatacttagggcacgtttggatctaaggctagcattagcctagcctggcctggcaaggcccagcgtttggaaccataaatatatcgcagcttctgggggcaagctagccctacgggcaaggaaaagctcgctcgcagtggagagccaattcggctctccttcgacgacaaacttctctttagactaactaactgcccgtcaaaaactaaacaaccaaacaactcagtaaagcaagcctagcaacgcagcaacaacctggtttgcctagctgggctatagctcaaggtgacaaacaaccaaacatacccttaaagaatgcctttaaaagaagggattttccagtgtatattctgataactttatcgtggataaactaatttaaattatgtcagacaattgtttatgaaattgatcagtggctatctttatatatttctggtaggaaaataaagtctttacgtcttaattcatagactccaggctgtgacactgaaagatcctgattcataaatataccactgaaagatcctggtacacttaaataccatccaaaggtgcaagcgtttagaaatgtacttatctgtggtgaatatttatcaaatagtatctaagtattggatgtttggatttgctttctgaaactcagcattggatatgctatccttgtatgcttctgttgtttagtgttggcatattttatattttgcattgtaaaaaatggtgccccttagcttgctgaatattagtttagctgtatgttttctttccttgtgtaaaattaccagtatactattgaattgtagtatagtacattaccatcttagtttcattactatttcctgtcctattccagaaaagctttgcagaagaaagttcaactatttccggtttgggttgtgatcaaatgttaagttcacttgatagtgctggtttttctgagagaaataacgagagaatacactctgttgattatctgaaagatgtactttcattgacttttcggctcatgcgtgtccaaggtcttccttcatggactaatacttcctcagttaccattcaagatgtcatacaggtatcatccatttaacaggagctcttgcggaagttatgtggttgatttcgtttaacatggcgtgccacaacatcttttagatatgatctgttcaggacacaaatgttgcataagaacaaatttcttagcctgctcatcattaccaacatatttgttcaaaaagaaaatcattaccaacacaaactcttgctcatataccatttgtgatttatcactatatagcctcaactcatgtagtctgctgtttgaaagatggaattgttctctagttggaccttgtaaagatttctgtctatattgtcaatggtatcgtgtatggtgggggagcaaaggctagttcttattctgctgatctgttcagttttcagggatactgtgttgcatatcatttcccaaccatttctctaaaacaaatgttctcttatgttcacactctattcatgcattgccagattcatcaaagaagtatactagttcttacatgatgaatgaattattagggtgaagtgcttcttgctgtactctcaaattatatggtggacatggaatggctgcttacaggtgggttattgtggtggaaatcatacaagtaatattgtttgtccttgtatgagggctgcttcctttttaccataagtagtgaccttttttgcaaacaaaataaatttggcgcctctgccactttacagtttcagaagtcagaacactcaatcatgaaaccaactacgatcctgtgctatttatatttgtctgctccttttaattttttttgtactgcacaattaatactaaattctacgtgcttgttggtaagaggaaaagcagtcctttctttgttgctgaaagtaatctgccacatttttttcattgaataagcatttagtttctgccatcctggtagctttcccctcaatgttttgtttgctgtaactattcattggtataattctttttgaagtgaaagtagctgctggtaacaacctaactcatctcatattcttcattactgataaattgatgtaactatattggtcactctctattggtttctagaatcatagtcatttatgttattgatttacctaaattgtttcctgtgcaataattttggaagctcatctttctgagcctctatggctaggattacaatttgtatgtttactagttaattgtaaagcataatatatttgtggaataaaaaaactggactacaaagataagcaaaacatgtacttttggccttttattttgctatttttgattatgattctcatttgtcttctattttccactacttcatgtatctttttgttgacatgcacttagttatgaaatgtatgtatttactaaggagtttggcaaccagcgcccatctgtgttccctatgctatgtggtgaaatatcactgtgctttcttttccagtcattgccattatctacatcctttagttttaatgtaaataacattgcactgtgcagcatgtccaagcttaaggaaagttcgacatgtcctagttatacatggagaagatggtgcatcagtggagcttctgaaggtgacaacattactagagtaattcatgatatttttgtatttcctttttctcatctcatattcatggttgggtgacagaaagtgaagccagccaattggatccttcacaagcctccacttccaatttcatttggaacacatcattcaaaggccatgctgcttgtatatcctcaagggattcgtgttgttgtgcacacagcaaatttgatacatgtcgactggaataacaaaactcaggggctatggatgcaagattttccctggaaagatgcaaaagatgtgaatagaagtgtttcctttgaaaacgatttggttgattatctgagtgcaattaaggtagcagctagcagggcacttgtctttgcttcttgattaacgtatcactccaattgtgtttcacttttttagaaaagaagttaaatgttgttttcttactgatatattttaaattatcatcataatgtgttttgccggaggttaccagaataaaaattaacaaataactgtgcacttctcgaacaatcacagttaacactggcaacttctgtttctactcttctgctactcaataaaaagaaatcatattaaatactactgaattggttcacaaggggatccactgttctcatgttagtaaaacactgaattggtaaaatatgcatatcatgattttgttagagagagatcttggaattgctggcaacatgttgcaaacttatagtaagacagtagctgtctcattgctaaaagcaatgagccatgttaaagaataccttaaaataagtataatgaaagtttcagcaaatcacaaaacatggtcttattttctgtggaacattgtacagagttctgtaataagtacctctaaattggagtgaatgaaaataggatgtctcgggctgtctagcttcgaaaagccccagttcattctaactattacttttgttctagtttaattccctaccgttgcagtgtactaaacacatcttctctatgtatgttgtaatgtattattctcttcatgacaatgcagtggcctgagttcagggtaaatttaccagtggttggtgatgtcaacatcaatgcagcattctttaggaagtttgattataagagctcatcggttagtataatccattaatcttagtttacacttagtgtgcagtgctcagctgtaaacatctcgttttttttttctccatgcaataggctgacatgaaaaagaaaaaaaattgaagtccgctttgcatgataaatgctggcaattacttaatcacgtgatcactgatttatgcttgtgcctccgccgtaaataggctgctttatgcaaaagttcccttttcttcaataaatgaacagatttcatcatcttttagcactgtttttattgcttgtcctacaaagtatttactgttctgaaggattttcagttcacaagaaaccattctattgctccttttgttatccattttaaaatcttatgttggaccttaccagtttggttgcatttgaaattaatctatgcattttttttctgcaccttctgtattgcgtgtttagtgataaagtccacatatgccactgaaaacttgcccaatcctcctattgtcagtaagacatcaatggcaaataaggaatgaagtgatatttaaagcgaaaaatgaggaattgcctcatcattttggcccttgatctttctctccctgttggatgcacaaaaactaaataaactgtacatggaagctcagcagcactcgcaaaaggtctattagttttacatagaagcaaacatactagcacacacaccagttctcctctctcgtgtattcataatttagtctcagctgattttacatcttataggtcaggttgattggatccgttcctggttatcatgttggccccaatattaaaaagtggggtcatatgaagcttaggagtgttcttgaagggtgcacatttgaacaacagttttgcaaggctcccatgatttatcaggtatctttgaatgtgtgagttatttatccatttatcttagcatttagcacaggcaacttttcgaagtgatgtagtgaatgccttaataaccctgttaaggttgaagcagaaatgcttaagattgagaaacaaaaatcacatggtgcctagtttaccttaggaaagaccttctagtaccttaaccctgcactttgtagcacactaatgccattaatagaagctgtaaaaaaatttgcactaatggtcaaaggaatatgtacttagttaatagctgtttcttgttttgtattgcaagaatgagcgagactataaggagtgcgggatatgttatattgtcacctgcatcatcacggattaattggacttaaaatctggcattcatctcccctttctgtttcactgaaagtttatattgtaattttttactcgcctattacttcccaggcttgttctccttaaaggacatttagcattttaattctcttgtatgcagttctcttccttggggtcacttgatgagaaatggatgagtgagtttgcattctcactatcagctggtaaatcagataatggttcacctttgggtattggtaaaccactgattgtctggcctacagtggaggatgttaggacatcaatagaggtataaacctaacatctgtaaaaattctctaatcatacttcctgtatattgcatcgtaaaacacacgagcatgaaagctccttgtgctttcttgatctgttgagaaccttcttcagatatgatgtcctatgatagatcagtgctggccccaaaataacaaaaaagaagtataaaccgattgtgttccctctcaaaatcagcatgttccatgacctgaattttttctaatccttttacccgagtactagtatcaccgcttatctgattttcttttatgtcaaatgtttcttatgtagggttatgcagctggtagttgcattccaagccctcaaaagaatgttgaaaaagatttcttgaggaagtattgggccaggtggaaagcggaccatgtgggtcgttggtatgttccctgattccttcaattatctaacaagctattgtcttgttcaaatggaacttcctaatggttaccttgcccgtatggtgctgcatatcacaagaaattgtttggtgatgtttctttaatcacgacagccatgtttggaggaacggtcatttgtgaccaaacattaaattgataggttggtgctgttcaaccttaattatgtgtccatgtgtaggatcaaggactagagagagagggggaggggtgaataggcgatttttaaaataaatgatacctaatcaaaactaacctaagttgctaggtttggttaggaagaagtctaaccaagcaactagattaagttttgcaatcctagggtgataagggctcaaaaaatctgtataaaagtaaattacacaaatgtaaatgcaataagtaaatagaacaagagacaaggtgtttttcaccgaggtccggaaactcgctggtttcctaatccctgttgaggtgagccctacttcaccgctcaaaccacaaaacctcgatcactagggtagttccttcgctctgaaggaggtgaatttcgaaccactcacacccaacaccgggtctcctccacaaccttctcggagaggccaccggacaactcctccaagccgtctagaaggtgtcaacctccaagagtaacaagtagcaaccaaactcgtagatgatcaagtggcacactagctcaatcgatgatgcaatgcacttgacttcgctcaaactattctcaaacacccacaaaggatgaagaagtgctcaagtggtgtgagagtgaatgcaagaggtttatacaattgaacaatgtgccaagagaacctccttgctgctggtgggggagtatatatacccccacacataaaaactagctattgggggctgaaacacgactcacaggagtctgtcggtcgaaccaccaagggatgttcggttagactggcctctagtgcaacggatagaaaactagccgttgcagtacatttaatgcaccttcagtctaaccgccataggctggccggttagaccgcgggtggctccggttagattgagctaccaccgatcagaccgtcttaagctctagtggctctagagcgccaagtccaggcctcctattttgctccaagtgctcccgatcagaccgggctgggcccggtcagaccgcagcggttagaccaccacaagggcgccggtcagatcggctttcaggacttggagcctgaggcaaccgcgagaatagaactctatggtctaaccgcccacaaggcctcggtcagaccggagcacataccacggtcagaccggcatgaaaccttcggtcaaaccacctgaggtcagagaataaaagcagatttggaccaagagaagcacccacatgcatgtgacctaatatggcattttgataatttcctcaccaaggttaccacccctatacagcaaagctattaagaaacctagcaaatttgatcatccaacacctcaattgataaaaacgaaaagctatatttatcacattcatctcattgcttggccatcagtttttaatccgtggtaatcatccttcatatgcacatcatgtggtcctaactcaaactcttactcaaattgaataggtagtccataattagcgcttgtcattaattaccaaaatcaataccacataccaggggcctaatgtttcttctatatgatctgtagtgctgtgcaaaatgagttttatattttctctacccccaaggttaggcaaggcaaatttatatttaattgcaaagatagcgaagaatatcattgtaatctaaaaagcagcagttcattgaagtagtcatatatactaataaaaacaagagggagtaatgattatgattgtctatattttatagtattccttgagcatatttagttgatcgatggatatttgttatagcttgcaaaggttggcatccctgccatacctagatctgtaatattttgatcctttttagagtgtttattactttatcactgacttggactgacattctgatttgggttttcttaccagtcgtgcgatgcctcacataaaaacttttactcgatacaatggtcaagacattgcgtaagcatccatataaactgttttgaactctagaattaataacagtatttccattgaatcattgtctggaatctttgtatatcctcatcagatggtttctactaacctcggcaaatttaagcaaagctgcttggggtgcgttgcagaagaataatacacaactgatgatacgctcatatgaggtggatgattttgttccattgttgaattgaggaaattttctgaacatccagacttttacaggaaaactgctctgcaacatagtgttggtcatcatggaatcgtagcttataccttgccatttgatctcttttcagttaggtgtactgttcttgcccaaaactcaccaatctgtaccacaattttcatgtacggggaagaacaattcaaacctggtactatctaatttctccttccttttgtattataataatgtgatcactttgcttttttttttcatcattttaagttccttacccagaataacctggcccctgggaaagagatcaaaaccaaactggtcacactctgctggaaaagcgacgaagaaaaagaacaatccacggaaattatcagattgccagtgccatatcaacttcctccaaagccttacggcacagaaggtgagctggattaatttaacgattgatacaacttcagtggagtaacaatagtaaaacacttagaaatgttttttttactttcagatgtcccatggtcttgggacaagaggtacacaaagaaggacgtgtatggttcagtctggccgcgccatggttagctaagcggtatgcggacaatatatgatcaatgaaaggctaaccctgctccgatgtcgacaacaagaaggccggtagctgatcgcctgtcagtgcccactactcaaccattagcaggaagtagtactatttcctgggagagattagatatttctattactaatttgtacgagcacaggatattttctttcttgttggtacgaatcgtgtgccttgtctgcttccgatcgtgatgtttatgcctccatcctcttttacagagtagtactcctacagtccgtcgtcatccagcgatagcgatctgaaattttaacgtgcaaaggacgctacctaaaccagctttttccagaaatcccccgtgcttgttcttgcggctgtccttgccttgagccgctccatgaaagcagcaaattagtggtactgcgtaaaagaataggggcaattgactcgacgatctcgcttccgtcgtcctgttgtgatcctagacgagaatcgtcgtcggtgatcgatcgggtgatgcgaagcgttcgtccaaatcacggtgattcaatcaccaacccgccgtatgaacgaccacgagcacgggggtgtgcgacgcttccctcggccgcatccgccaaagggtaaacgccgccaccaccacccaccaagcgacacggcgcgcgcgcgcaccgcatgaatcgcgtggtacgtacgtacgcccccatcccaccaacgggccaccacgcgacacgagacggcaccacggcttccgccccccgccgacccctcgcaccaagagcccacgtaccgcaccgcgcaccggtgccggtgcgtgctcgcttttgcctccctccgcgagccgggcgcgccacgcgacgcgcgcgcgcacacgtcgcacgccgtctcgacgtctcgctcgctagtcgctacccgcgtccgccccacgcaacgcaaggagtgaaagaacgcgatgccgcccgcccgcccgccgccacgtgaacgcgcggcgcccctatcaatccgcgggcggcggggtccgcgcgctcgcgggggccccgcgtggcggtggtggtgggtgggtgggtgtcaccgtcgcgaatctcgaatccgcgaaccgcgagtccgggggggaatcgggtccgtccatccatccctcccagtcgcgtctcgcgagtcgcgacggcttcgctctctcacctcctcggccaaggtgggccccgcctagtggctgctcgtatcgattcccggatacgggagatcgacgatgctccgctatgcgccgttgccgtttgggattgattgattgattaatataattaattttggtttaatcacgtacgtttcgtcgtaatcccggcatagaccgcgtctgatgctgcgggttggaatgaccattagcgtaggtcggtcgtctggtccggattctctgcaagtagcgggcacgtagtatgcttcattcctttaggaagaatcgtgtcaccatttcctcgtaatttttttctccatccgtctccgtcctaaaagaatgtagtagttagttttagttagttaagcaacatttcattaattaatacaaagagaatgaaggaaggaattactacttcttcgatgacaaaagagaaaaaaatatgaagtattttctatgcaataattatagctatttttttattacgaaatagaggcatgttcgtacctagagagatctaatgggctctacttaaaaatacaaacaaatttttaaatatgttcatacacaatgtcctattttattttgttagagtatttaagaattctattataggtgtggtctaatatgaatttaattttaaagttaattggatccatatgccattgtactttgataaattgaaaaaataccactactattcacaatatcggctaggtggcatcgatattttgtaaaatttgaaacagaccattatatacatcccaaacacagttgtaccaagttttttatattgtattttcatacttaccagaatgctccctatcccttagaggctgacaaggaggacccacacgttaaacttatcttcttccccgattattcctctagcttgacgattccgactgcaacaacaacagtggtggagggctggcactagagcttaccagtgatgacgtccccgcacctggcttcccgatggtgtggtagatcctgcaacggtgtgcttgagcttgagcgtagattgcagccccagaggcgaacagcaacatctagattgtggcagcgagcaatagtagccccagtggcggcggtcggtcctcgtctcattatcgtcggtgagtcccagcaccgacccattcaccacatcactgccacggagttcgagggagttggcagcattcctcgtgtgaaaaccccatcgctagcctctcgacaacgtggcggcaaggtcaatgcaggcgggctagattggggcggtgaggagcagtagtagaagcaaccccagtggcggtggtcgtttctcgtgtcgctgtcatcgacaagccccaacgttgacctctccaccactgacaccaccttcaatctctccaccactgtcgccactgccactctactcccgtcagtcttgctgtactagtggaagtgttagggaagataaggttgacatgtgggttccactagttagcctataaggttttgggggcattttggtttatacgaaaatacggtatgaaaaaatcaagtccaactacgtccgggccgtatatagtggtatattttctcttacaatttgagaaattaaaatttttacaaaatataccaatggcacacgaccaatatcaacggatagtagtgatattttttcaattcaacaaatttgcaatggcatggattatagtaaccataattttaatttgtgctcatcagttcaatattgcttttttactttgtgcctcacacaagctatcttctctctggccatcactaacaataggggtgaaaacggtacggaaacggacgaaaacaacttttatcattttcgttttcattttttttttctgaatcggaatcagaaaccccggatatgaaaacggaatcgaatattattgaaaccgaaaacggagcaaaaacgaaccgacgcgaatacggtatggaaatttatcggaatacaaaaacccctcaaactgataaatctaattctcaagtttcaacgatcaacaattcatcataaaacacaaattatataagttcaattgttaagtctcaacagtacatcacaaaacacaatgtatgaaataaattatctatatttaagagagtaatgctgttgataaatcccaaatgcgggaaaaaaaaattcttatgtaacttcagatttgcataacaaatattttttaaaaataacatctaaacaccatggtattcactgttcagtgctaaaaaaaagaacccagggtatttcagtcataaaattttcagaagtttcgagaaaattccaaccgacagattttattttcaaaaataggtccggaatccgaaaagtttccgcaccgttttcacgtcctaactaacaatatagggaacgtgtgctaaatataaaatgagaccttatatatgtagcgctgataactagaactatgtaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagatatttttttttaaaaaaaaatagaatgaagatattctgaacgtatcggcaaagatttaaacatataattatataattttatagtttgtgcattcgttatatcgcacgtcattaaggacatgtcttactccatctcaatttttatttagtaattaaagacaattgacttatttttattatttatcttttttcgattagatgcaaggtacttacgcacacactttgtgctcatgtgcatgtgtgagtgcacctcctcaatacacgttcaactagcgacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccgtctataaattcctccccccttttcccctctctatataggaggcatccaagccaagaagagggagagcaccaaggacacgcgactagcagaagccgagcgaccgcctcctcgatccatatcttccggtcgagttcttggtcgatctcttccctcctccacctcctcctcacagggtatgtgcctcccttcggttgttcttgaatttattgttctaggttgtgtagtacgggccttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacatttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatgaaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagtttataggtaatacccctatagtttagtcaggagaagaacttatccgatttctgatctccatttttaattatatgaaatgaactgtagcataagcagtattcatttggattattttttttattagctttcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttcatgtctgatctcgacattcagatcccaactgccttcggtatgcatgttgttctcttccctctttgtgatggtctgagtgcctggaatatttgtgctcatcatgttttcctgaacatgtacagatccctttgctgaggccaatgctggagactctggtgcggctgcaggatcaaaggactacgttcatgtacgcatccagcagcgtaatggccgtaagagcctgaccactgtccagggattgaagaaggaattcagctacaacaagatcctcaaagatctcaagaaagagttttgctgcaatggtactgttgtccaggacccagagcttggccaggtgtgtgtaataaccgaaatttgtggtgcctgatctttacgtttttctatctttctgagctagtttttctgatcaatgcttcactctgtaggtcattcaacttcagggtgatcagaggaaaaacgtatcaaattttcttgttcaggtagggatcattcttcttgtgcatgcttactgcaattagatgtacacatgctgtgatgtatgaaaagaatacgtcttgacttgttgtaacatgctatgtcccgcaggccggcattgtgaagaaggaacacatcaagattcatggtttctgagcaactgccaaaaccattgcaaagactatagtttggggtggagtatacttggttgtgtacatgcctgcgtgttccattgtacacacaaaacctagccacctcttgactcttgagtgtatgcttgttacccgtgtgttgaagtttgtaagaggcaccatcactatagatgatggcttgtgtccctctttcatcaagattgaataatatatgctactttgagagcgctatcctgcttgcctgattgtgttaatacttacatccgtcccacactcccacaatataaggaaataaggtattttggcagtttagagcaaaattcccttatatttttgggacggatgtcctcttttctgcatttttttatgttcatatgttcctgaagagtaaggtggatcttgatcaacctgtcggtttatggtgattgatttgagtggaatagaatgggccaacgtccggcatacagttatgcttcagctagctccaggagttgtggttttagattgctcattttctcattctttttcatggacgatagctgaactgctgaagtagtgaagtcggcatgcactggctactgtatatgtatatggcaattgatactagtagtagtgtcagctgaagctgcatgccttctactgtggagtactagctgttgatccaaactccagaccgtgaactgtttgttttttcattactgctgggtacggtacactagcttcattctgtgcatgagtcattctccggcatgtctgcaggacatctcatgatacttctggcacttcaacagtgatatttccagtgtactgcaatgagtttattcttatggttatgtacagtactcgtgctagtaatagtgtattgtacgaaatgaatatgggtagtactagtagttacaggattcacaaagctgggtaagttagaaatgaacatgggtagtactagtagatcacaaaggttcaggattcagaaagttggatctgattctcgaagccttcagtgcttctacgtcgccttcatcagtcagcatgtatgtgtaccatcttttttgagtgatttcttcccccaagtttcaacaaacaaaatgatgttacgaccagaccatcaaggttgagaaatcaaatgcaatcttgtcccctgttcagtcagacgtgcacgtagtacatcacagcatttttcagtcccgaattcgctcatcctgctgctacaggtggtcaaacagtatagttcaacttcagactttcgtggtgcttcttctctgtcaatgtgtacaacctattgctcatgatgtgttcagatagataagattatagtgcaagatgttgccgtggaatccttgcaggtgcgtgcagtgacttgaacatgggctgcatgtgttcctgcccctgaaatacggtgagatcgatttggttaagataatcagtgttcctaaccacgtactgtagtagccgttaacgttgtcagccaattatcaaatacgctgggacatctctctgcatgacctggtgaccatcagagtagtcagtgcctcattgtgcttgtaattgatctactactagtattctcttcaaaataaactgcgaatcaaaccccaacatattcttttcttcagtaaaccccagacaaattttcatgccaggataaaatccttgtcacacgaaaacaaaaccaaaaatatgtagcttatgtctctgttagaacaacacgagatcactggagagtggagattatggccctccacggtcattcctgccgttgaaacggcgcacaatctttttggatgcttctttctttccccctctccatcttttctttttctcacacacatgcagatgcccacagatcgctcatcacttcatcagcagtagtaaccttttccttttgctatctccctttttcttccgattcgtgctcgccaaacgaaaggaacatctcgtcacattttccttttttcaagaacaatctcgtcacatcatgatgcattttccagcctatcctcaccttcatcacccagatctgtggcaggagagaaacattatttttttctctgacatccatgcctaacgagatgtgagatctggacgcatgtttcgcccatatgcctctgtactgtagtacatcttctgatcttcatcttggctgtcatctcgccattggatcaccactaaaattacccccacactaacacatgctttacaacgtcatttgtcaggctagtactacgatgcgtgtacactgaaagcagcaaaggaaaaataataattttatccatttcatcatccaaaaagaatatggtttccaacgtgacagccactctacgtggcccaatccaaaaatagtagtactgtagtagttacagtgaatctgagccgcacgatcgaaggacgatccgatcctggccgcacatcgtacggccatgtacgtcggcggcggcgccggcgatggcctcacgagctggtcgtccggagcaagcattcctccggcggggaggggaaccgcttgcggtcgtcgcagtagtcgtagatgacgaggttcctcgccacccaggcggagtcctcgcgctggccggcgtcgagcgcccacgccggcggctggtcccaccagctgttgccggtggacgccgcgcagctgggcgggctcgccgccgccgtgccccaggagcacgcgtcggcggtgaagtcgcggtaggaggagatgaacggcgccttggtccagtccgtcttctccagcccgccgcgcgtcgcccagtcgtcggcgttccagatgctggagaacacgtacatcggcttcatgatcgggaagaaggtgttgggcttgtccgagttccggtactcgcggatcggcaccttgtccacgaagaacctgatgatcaatcaccaccaccattgcaaagaacatcagaaatcgagattaattgacagaaaatggatttgggtgggcacggcacggggaagacgaaggtggtggcatggcattggcagccattgcttggttctaaacagaatgtggccaagtagcagcaacctggagtgctcgtacaagcggcagggtttggcaatatctgcaggttcaattaatcgccatcggagcgacccatttcaaggggtaggtaggtaggtgggcgcattcaactcgtagtcgtcgtcgtcgttgacggcggcggcggcggatgctatctccggcgagcccggatggccacggagtacgattgaaacaactagaagcttgattactattgttcggttgatcacttacacgatctgcttggggttccagaggatggagtaggagtggaagtcggcggtggggtcgaaccacagcgagtggcgcatctcccggccgccgacgccgctgcggtacacgttggtctggatgatgtagggctcacccgtccggttccccaggaactcgaagtccagctcgtcgcgctgcggcgccgcgtccacgtcggagcacatctgcagattacgccgtcgtcgaggagctcggtttcagtttcagttcggagttgacacaaagaagacgagctagctagttcatcgtacgtacgtagtaggcggtgacgacgccggcggagtcgttgccggcgagcttgaggttcatgctgaaccacccgaagagatacctctccttcgtctggaacccgacgcctgaaacacaaacccaagaaacagggcagcgtcagcattagccattgccggagtggagctcgaactactctcactcaccagtcttgttgtcgaggtagaggtaccacgtctggccgtcggcggaggtcttgacgtgatcctcggctccggtgatctcgaagttgtcgccgaacgtcggcgctgccgccgccgccgacgccccactgaagcagaaaccgcacacagcaacagcaaaaatcatcgccgccgtcaacccaccaacccacggccgccgccccagcgaccccatcctcgatcgtcctcgacacccgagccggccgagctcacgtagcagaggacagcgaggcagcagcagaggtcgatcgatagtgagagcagcacagagagacaagaggcgcaccaccgcgtagtattataggcgtgagagagatgtgaagtggctactgtactaaaaaagcctaaagaaagacacaagttggggcttgggcgcgccccggggttcacgaagcgtgtagtttttgccggctgtttccgtctcggcgcggcgcggcgtggtgcggtgaaaatcgcaccgttgctgctgctgctgccgcgcgcggccgcaccaagcccctctttttctatcgagaaacccagctgccttctccctttgtttatgcctttctccctttgtttatcgcgaccgttttttgagttggagcgatagtggattatattatggggagggagggcaactagttgttgtcactcatcagtcatcacgcatggtgttcgatcagatctggggcttggaccggtcagggtatctcatatatattctcatcagttttatccgctccgtggtggccgtcacatgaagttcgtcgcgtcgtgttgacgaggcacgttacatactcctgtcctacgagtgtactagtggatctgtggatggatcatggatggtggtggattaatggtgagatggtggtactagctagcagggcatgtgactgttgatgacttgatgcgagtgagaatgagcagtcagtcagtctgctgttgattgcgagagccgagaggagaggaaggggatcaagggaggattaaaggcggtgcaccgcccaaccaacctgccctctgtgcctctgccctctgccgcgagagaccgggtgacggaggaagtgagcacgaacaggaaacccctagtgcagattcgcagtaaaaaaaaagaccaccagatttacggcagttttggattgccaaaatttcttcactatgatatcacaatttagctatattttaatagcaaaccaaataagatgaatataaatttattctaccaagtaattggtagtgccaaaatttacatatgttttagcactaaaaaaattagtagggcactgatccaaacaagcccttatttatttcatgcattgatgactggaaggggccgtgtttgaaagttgaaaccacacgcatgtttgttcatcggacggccacgtgctctcatgcatccggaccgttgatccgtgctcgtgtactacacgtttactcgtgctgtacttgtaagtcatcttttacagtacactggcaatgctgttagatttttcacgtcccgtttttatttaccccctttcttttggacgtctgtcctttttatccctttcttgaaaggcaaaagagatgctttcttgcaaattgcgtgggtcgtgtctggctgtaggacctcggccgacactcctgacgagggcgcaacgaataaaggagcatttgttggcttctgcgtgtggtgcacagttgcagtgttgcacaagggagatatctcaagactcgaggggcagtaaaggaaaaaaaaatgtttcagcaggagaaagaaaaaggacaactcatgtagacatctatctggtctgaatttttcaccaatatctacaaataggtcccaaaaagtttattgtagaaatggacattttctcgacaccaacatacgccgtggtacaacatgacaacgctaatgaaattgacacctatttgtaaaagaattcaataaaatctatttgtaattaaaaaaaattaaaaataggtcatcgacgccaataatatgacctatttcatattagtgacttaacttccactagagggcaaggggagatgttagaccacgtgccaataacattggcgccatgaaaatggtccatttttaaaataagttttttgggtctatttattaaatcagtttttttaattggtcaaaaggtgaaaaatccagcctacctagtactagtacattgcaagtgtactgtttcttataccttctactgtgcagctgtagcacagtacactcttctttagataatggaaaaatatatataatgcaacctatacataagtagtataaatctggaaactactgtacaattaaaaaaaagggcatatgagatgtgtttacgttactatgagtaaactttttactatgataacatggataaatatcatacgtacatttttagattttgcggtattttcaggtttgcacttaatttttttctcagaaaacatatttggtacagtacgagtaaagcgcgggaggggggggggggggttcagaaacctgaatgaactgcgagtacttcggccgtttgggcaaccatgatatcgccatacttttgtccctccgatttcaggtgtactacactctaatcatgggtcaaagcctttatttgcaactttgataaattgggcctatgatagatggctagctagatgcaaccaaaaccaaacgggctttggttctcagttcaaggctcaggtggatggacgttgggccagttgagaagttgtcatccaagggcccttcacacggtatgggctgtagttggatcacatcaactcatgggccatcacccatcggtagtttggtcttaactcagcccatctagtctacttcggccacaaaacaccaattcaatgtgacgtgtgatagttttgcggtaacgccgtaacaatatactaccttgctaagaatgaaaattttttactccagaaagaattttccatgagagatatttctcgaactaaaggaccacgcagccatggttgctggcttgctgcttgtctgttcttgtacagaggtgacaaaatggtatggtagggccaggaaactgttggtgtatgtgccaaaaacgaaaacgaattggaaaggaatcaatgatggagatatgcctttgtcaccaatatcaaatttcgaatagtctggaatatcccactagctccagacatgctgaggttgctctggctaacattgttgtgaaaatgaaaattgctataaccttattctaaacctgattagtgactgattaattcctttttctgaaactgataaatgtgtgatactaagaagggatttagcatcaattattgagagagagaagaaaatggtgagaaaaccactgttgagatttgagaaggactcgaaagcagggcagctggccagtggctttgctcttgatagctttctatatcgaccgttctcattagtgactgattaactggaccttttgtttttcgacatatttccagtgaatagaaatgctgaatgcctccagatattatgggttctggctagattttctatgagctgttgcattttcttggtcatgtggtcatgctgctgttctaaaacaaaacagagtttctcactctgtccagtgtccacatataaaaacatgcagccatcatattagcatcaacctgaccaacaaatataatggcactgaatcatttttatttcctcatcctttttattcattcctcccagagagacggatccatggaagttttcttgccctcatcaggcaagcagagcacacacacacggtggcagtggaagtgctatgaacaagacgctaatcaacatccagagctaaaacaaacaaggggatcaatgcaaatcccgaaaaaaaaacacaggggaaagtccacatcttcttctcgtccccaactcctccgtgtcaccaccacgtcttgcggatttttttttaccctgttctattcgctcaggcgtccacgatctcgccgtcgtccttcgacgccaggatcagctccgggtgcgccgccgccgccgccgccttcttgatcgtgccgtcgatggcgttcggccggccgagcgccttcagcgccaggtgcgccgccttctggccggagatcatcatggctccgaacgtcgggccctgcaacaacgaatttgttcaaatccaagaacgggggagagattatggtgaagagtttgatgtttttttggtgcgtaccattctcggggcgccgtcgatctcggcgacctccatgccggtgacgatcatgccggggacgacctcgcgggtgaggcggacgatctcgtcctcggcggtgttcatgtcgagggcgcgcatgccggcacggcgtcgatcatgccgatgtcctgcagccgcttgacgcccgtggcgccgaacggcccgtcgtggccgcaggagctcaccaccaccctggactccatcacgt

SEQ ID NO: 45619 - DNA, 3797 bp, Oryza sativa
gcggtggtggccatggctgccatgcgagaggaggaggagctgagcttcttgctctgggatgaggagagtgtgtgtgagtggatagagcgtgggttggcgggggtataagaagaagaggagagcgcaaatatctgggagtgccgtccacgtgtcagcagtatgggcctctgggtttcggattgattggaggagatattttgggaaggtttagtgagggtttttggactgtcttcaggagaacgggacaagtgctgctaagtcacggactcacgggaacagtggtgctgtgttcagtgacagtgtccgtgataccgtgacgactaaggctgtgtttgcaatcctatgttcccaacccctctccctcgttttttgtgcgtacgcttttcaaactagtaaacggtgtgttttttgcaaaaagtttttatacgaaaattgcttaaaaatcatattgatctatttttgaaaaaaaatagtaaatatttaattaatcatgcggtaatgaatcgctccgttttccgtgcggggagtttagttcccaacttcccatatcggaacacaacctaataatggtttttggtgatcgattttttttatggctacctgtagtgaggggtactagtggtggagcccgggtggtcactcgacctgtacaggagctggctttgtcgctgactgtaataacatatcgagaattttttagtctgaaagaaatccaccataatatgttgttgatatcgtctaatatcgagaagtgcggttttaacttcttgtcacgcgttggtaaacctaagtgtctgtccctaagaaaactatctttgccaacttcttgatggatcgccttgactgttttgttgcacgacagtcgttgggaacaaagctcatcttcacaaattacatggaggcatggggtatactagtggtaaaggttccgggggatgaaaaccttctagttttttgggtttgacgatcgcgagcggggatcgcactacatgtttttgttgagcaacaatcatcgtttatttgttgaagttgtcatatttaggtctttggacgtagatctaggtctaatttcatatgatagcggctatctctgtttatgatagtaattgttttccctaaaaaagttgctttgttaatatatcctatcaatcaattgttttaatttctctttttttctaaataattcttttagaacttagttgtatttctctgtttttttcctacatccttgttcctaataaaagatgagaaacacccaggggtctttcggctagctccacaaggtggtgggctagacgacttggattcgaagcctcaacccttctaattatttgatattaggttattctctaatattcgcgttcctaataaaagataatgatacactttcagggataaataatggatgttttctgatctggtatatatttttttcctctcgaactaatctgatataaacgaaaagagacaaagtcatttttatttgttttttatcattgcagacaagcttaaatgatctacctaatttgaaatgtctcacagatcaatatgcatgatattgattataattagaatgattttactacagggacagtgaatttcataacttgaggctagtagatggtagcttctcttgcactgaaaaatctctggtaaatatctgcaactgctccagctttgtccacatatcagacaagtgtcatatcgcctttcttcgagtgatttttctacatctttttcaagacagatatttgcatgtctgcaatcttcaaaactatgcagaatgaattgaggccgttgaagttcccatcatatctcgtcagcaaagcatacaacttgctgatagggaccatacgacgaatgaagaaattccaaatgctacactgctttcagttacattttcttaatttatatgatgattgcaattactactactactatctgggtaaaacaataattgtcatgaccttccgctgcagaagtgattgaggcccaattataatctagtaagacagtgcaaagccatctccattcagatttgtgccacacatttttgtccatccaattcctgaaagtgacactggatcagacaggctcttttctgaagaaagatcacgttatatggcctgttctcttttcctggttgtgatcatgtgatccttatatcatttctttgaagatgacccctgcattgtttactggcaaatggcaacatatagtgatgatatatttcttatgaaccacatacataggcacggaggtatgattttgacttcagatattttacagcgaagtagtctgagtgggtttaaattattttacttttcttttttggaaatatcaaacctgagaagtaaaaaaaaacagagacgaagttaagttttgagtgaaaagcacagggaaaagaactttttttttcttttataaagagaactacattcaggggttgcaaggtttgttttaagggtaattttaccatccttgagaaaaatactaggtgataagttaaagtgagttcaaatttaccctttcccaacttctgctctttcgtttttatgcacacatttcctgaactagtaactatatgttttttaaaatcttctatatgaaaattgctttaaaatattatattaatccattttaagttttttttctaatacttgattatcatgcgcaccattccgtttagaatgcgtgaagaattagctcccaacccatgataacaaacattcttattgggtacttcgagttatcaaactttttagtgtcaaatttaggtatatcgaggcatttttctcaagtaccaaatttttttcttatattaagctcgaatgtgtatcatgaaaaaagcagagaaatgtttgcatcagtgtgagggagaagctcatcccgaacgggaatacatcacgatcaacagaagaaattggaatgcaaagtacaaactatagaagaagactgaattgtttctcagaagccgaaccttgttatgaccctgaaactggcaatcattccgggctgcacatccaaaggcatgaactttgaagtggttaatccattgattctgcttgcacttagtggctccatccgaggaaattcggatactacatccttttttacagaaggacttgtttgattaagggaaattaatttcacatcaatagacgtgaagtagatcccttttaaatcctcttctattcctttaggtagtgtttggttgcaaggatgggatgagatgggatggaatgaacccacttttagaggtgtttggttgagaggtgagtgggacgggatggtccctagagaggaatattcctctcagatccgggatgaaacggtccgccaaaatcggccggaccaatccatcccacttcgacggagcccacggcgtcacctcccgtagcctcccgctcggctccgccgccgcctcatccgcgtcgacctccgcctccgcgaccggccgtcatctcgtccgcgaccgcctccgcgaccgaccgccgccgctcgtcgtcagctcccacagcctcccgctcagctccgctgcggcaccgccccggccgcccgtccctcccccagcgccgctccgtcctccttcgcctgctccctccaccttgcctcgcctccacgaccggccgccgcctcgtctgcgactgacctccgtcgctcgtccgcgttcgcctccgcgactggccgtcgccttgtccgcgactggccgccattgctcgtccgcgcctcgtcgcctccgggaccagtcgccgctcgtctgcgcctcgcctccacgaccggtcgccgccttgtcc

SEQ ID NO: 45620 - DNA, 7006 bp, Oryza sativa
  unsure (1)..(7006): unsure at all n locations
atacttgtataaaaagcagggttgagaatatagttcacttggtgtaaatagcgcctacgagaacttgggcctaacaaaaagtgcaacagtttgtgtagcggttaattttggcccatggtagcggtccagatggtagctgtcctatttctatagagaaagtctatactcactcttgtccttaatcggatcgcttccctcaaccacaaaaccatgtataacgtcggggcttgctatctcgtgcgcgcaccaacaactaagctggcacacgtgccggctggcggcccacgcccctcccctacatgcgtttctttttttcttttttttgcgattttctcctattttcaagcctcttatcctaggcgtgttttaatttctttcgtgttctttttaatttttttaatctgcaggcacacttgttttcaaatctttaagttgaaagattttaaattaagttgaaagttttggaatcttgacttgaaagttttccaatctaagctgaaagtttccaaatttcgagttaaaagttttcaaatccgagttgaaagtttcaaatttgagttgaaagtttttcaaatttcagatgaaaagttgaaagtttcaaatttgagttgaaattttttaaatttaagttgaaagttttcaaatcttaacttgaaagttttccaatctaagttgaaagttttcaaatttcgagttaaaagttttcaaatctaagttgaaagtttcaaatttcagttgaaatttttaacatttaagttgaaagttttcttgacttgaaagttttctaatccaaatcggaagttttcaaattttgagttgaaagtttccaaatctgagttgaaagtttcaaattcgacttgaaagttcaaatttcaagttgtaattttttaaaatttgactttacagtttcatattttaagttgaatttttaaatttcaggaatgttttaaagttttaatataaagttttaaatttgattttaaagtttctttcacgtgtagatttctttcagcctgttagtaaaaaaatacttatagaaaaaagaaaaaaactaccttaaattttaggtttgtttttaattttcaatagaaagttttaaattttatttgaaagtttctttcatgtgtagatttctttcggtctgttagtaaaaaaactcccagacaaaaaaaaaacttaccttgaatatcatcaatatccaatactagacagagttagttacaagagttagttacagtagatgcgcgcgtctcccggaaaaaggaaaaagtccgattgcggattgggtgacatcgtgtgtgtgctacttctcttcccgacgtgtactcacggtacaagaattatgtgtaacgtctcccccaactcaaaaaaccggtgcaaaatcgattcctcaatggttcggtaagaggttgtgcggtgggcctcacctatcagttacactttttccccttaccccacctctccctctctcctctatcctatgagataggctatagggaaagcggctgccgccaaggaacaccggcagtagagacgaaatggcgcatggaggaatacaggagggcagagaatgaaattttaaaatatgcactattttcctcgattttgtatatatacatatatgcttttgaaaattttatagaaatatacatccgcatcaccgtgccgtcggcgcagctcgaagacgcgccgcagcgccaacacacgtgaccgggacggtcccgtgaggcccggcgccgcgtcggcccgttcctctgatgcacgtctgccagagcctggcagtggcgcagaactggcatgcactacgggtgcgtttggttgctcgtattcccttagcctggctcatctcttccatccaggctgagtctggcctggttgagaggatacacatgcagctgtttggttgcccgcatctgatgaacctggatctgttgagatgatgtttggttggttgcagcaaaggattggtggaatggttgcatgcaggagatgttgtttggttggatggatgcatcttgggtgtaaacaccctctcctatgagtggtgaggttaccctcataagtttgtggtgtgaaaattttctcaagtgtctacttctgtgcggtgaggttactccatgaggtcgtgttaaaattttatttgctctttggcttactattatttgtgagctaaattgcttaaaatattgctatgcacgtctattttatttggttggtctttgagtatatacaaggaacagatcaaatattttggtctttgagtatatacaattacattgatgttatacaaaactaaaccaattggtatattagtaacaaattgttatacatatgcaatctggtaaatgacaagtgcatatagtatgttcttatgcatcacagatcagtactattaatcatcaattgcagtattttccagcttgaccctaacaaaaaagaactaagtgcaggaaatatgttattatgcattacaaatcaacactattaatcttaatcatcttggaaatatctcacaattgcatctcttcatatgcatcggaagcatcttggaaccataacaacataaaaaaagcaagtgcagaagcatcctttcatatgcagcacaaacagtggcgtgaagcattcatcagtggcaataatcatcattgaagaatcaaggcagagattcaacaagggtcatgcaataccatgcagtttacactacaaaagccattcaggtactggtgttcactaccaccttaatcaacaggtagccaacattctacaaaagacatatatgtggtgtccactaccaccttaatctgcatctaagcaatattacataatatggtgtcccagtaccacctctccataatagttagttaaatagttagatgctctcagggtgatgctcattcaggaacttcctaacccaacgagcacgacaagcctcattcttctgaatgtatacaaggctttcagccttctccttagttagataagctagaataaggtccagctgatcctcactgaaacctggaagatccatcactgtgttgcacaaatcagggtgaacctcagtatgtgcagtagcgcctattgctgaagccatgttgttcactgaatctgtcatattgctgatgagagcaacttcaccttcattcaaagcagatgctctcttcctcttcttatctgaggtagaatcctcatcagtaggcccaacaccacttgctcgagcagcaattccaggaccttcagcacccacaccacttggtccagcagcaataccatccccaatagtgccatcaagaggtcccagaccactgtcagcctcaccagcagggtttccaagcgcttcatttgaccccatagcaaatctcccagtggcttgcctatttgaaaaaattattgccatttgtgtatagttctctaaaggcacattgagaaactcagcatccttagggtgttcctatatgagaacattagatttaaagtgagatatgatgtgtactaatgcagtgtgttttgtatgtgatagttagacacaaaccttgacatgtcccatgtagtgctcctcttctaggataatcgttgaggtctgatcatcccaaagagccccactaaggtctttgagcctagtgatacgcacccacctttgacgccatttgcgaagatggttatacacttgggttccactaatttcaattccatagtgatcagacaaagatctagcaacttggttaaggtgagcttcattgaaacccttgtcagtcctaacacctgttgctataagctcaaccatgcgccttagcattaagctagacatgttggttgtccaatgcaaggctccatggtgtccaccatggccaccattcccgccaccagcctcagccatcctatatttaccacatgcaaatgaacaaataaatttaacataaatcgatagatgtaataaacagcatcattgcaaatatctcgaggtctcaaattaatagataacagtgcaacagggtacaacaatcatcatgcatgaatagataacagtgcaacaccatcctaagttcacagatagagagttacaaattaatccctaagcatgttagaccctggacgaccctctattgttccacatagcaccagccaaatcatccctaatttgcgccattcccctattgtcttcatctaagtcatcgggctcctcatcatcgctatctgagttccaatcactctctagtggcacatggtcatccatcccaaactgaagtatccagttatgaagtatgcagcatgcaaggaccaatttgacttgggtcttgtatggatggaaaggcttgttatagagtattctgaagcggtttttgagtgcgccaaatgcccgctcgatcgtgacccttaaagaggagtgtcttagattaaacaactctctcgaatcacgagggtagtttcttctatcatactccttcaaatggtatcgacacccacgatatggcggaaggaaccccggtctagcagcatatccagcatcaacgagatagtattttcctaagagataaaagctatgagtgtaataatcatatgagataaataagaatccttattaatcgttagttttaacacttctattacctgaggggacactaagaccatcatccctctccaaggcatctgcaagtatgagggcatcatgtgcagatccttcccacccagcaagtacgtatgtaaatccaagatcaaagtccactgcagccattacattctgggtggtctctttcttcctacccctaaaggcagcagatattgttgatggaactcgagcaagcacatgagttccatctattgcaccaatgcaatcctaatgaccagtgagaaatattaggacatgattgttgaaagaacatattttgtagtcaaaatgctgcaaacaaatttttaccttaaaataagggttgaatcttcgattggatgtaatttttgaatgaggctcagatgagggtggttttatcatctcatttcgcagctcaccaatagagaataatacctcagcgaagtatctactgatagtttcaattgacctcctaaaagtgggttgcaaagctctaaatctgtggttgtggcctacaacaagaagaaacatggcaacttgttcttccactgagctatgtatactgtcccgcaacaacgctctttctcgtaacaagttacacagctgaaaaaatggggctctcttcattctgagctgatttaagcaatttgtatcatctgtatgatagatgaaactaagattggattgtctagctatgtccctttcggacaatgggccataggagatcctaggggtacgtcgcatggctcttcttgtaataaacagaatgtaagcattcattacagcaactaatccagctgctttagcaatcagggaccgccgaatgcgttgcatttcttccatctatgcaaataacatatataatgcatagtcaattcagaaataaaaggatggtcttgtcgctgctaagtactgcaaatcaaattcgtatgcatgtatgccacggccgccacatccaagggatgctacctccagtggcataccatcatcgaccatgaatatttacttacacaaaacacaatcggcaaaataatgtgcacagccaaaatagtaacaaaacagcacccaaactttgctctgacattgaacattcatctgtagcaaactgaaaaaatagtagatctggcaaaaaatgaacaactaaaaaggataccaacagtagatggtttcaacatttaaatctaccataatcaactaggaaaatgtataagtttttactagatctagcagatttatgaaggccccatgttctcatccactcaaatcacagcaaatcaaccaaatagaggagaaaaaactagggaaggagggacagggaagaggatgcccaaccttgcaatgggcgacgaacaaccatccatgaacttaccctggtgctcaacggagagtgacggtggaacaggggggcacgacggagagagccggcaaacgagagggaggatgaccgacgccggggaaggaactgatggagaagagccggagtcggaggagagggccgccgctcgcgaccggagtgacgacgagagcagcgccgcgccgcgcctcgcctcgccgccgccagagctagggtaaaccctagttttttcgcgagagggagaagtgaggcggggagggagcgattctgggaagcaacggtgaccccatcctccgtgagttgcacgcgcgggtgcaggcgcgggtgcagcggtgtgcatcagtcgagccaggctgagcagcgaagtgggaatcggccgtttctgtcgggcctggctgaggggctttttttgcatccgcgtggacaggctgggaggcctaagcaggcaaccaaacatcaggaatttgcatggactggtgcgggccaaccttggtgagggcaaccaaacagaccctacgtgaatggtcagcgtagcacagtgatgcatatatagcatagtacagactgcattagcagcattaggaacaagagttttatttgattccgcttgaccattccgcggaaccgcgacctagtctgacgtttccacatcatgccgccgtcactcccggctgctaccacactaccacctgtgctcgggctggtggggacggcagtggtggtgatgagccggacgctcagtttttgttgtgactagggaagtaattaagtttttaaagcaatatcatccatgtatgtaaaggggtttcaagagcatcaaagctggaggacagaacattgtgccaaatatcaggtaactttatctagagcaaatgtatcaatactgcacttccttgtcgaagtgctcaggaatcgggaccggtctcccggcagcgacgcggacctccctggtagaccttaaggtgtcttcagaaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45621 - DNA, 973 bp, Oryza sativa
ttatgccgccgttgttgggcgtatacgtcttcaccgacggctttgccttcgccgccgccgactggtgtttccgcctgcacggctggcttttatgccgccgttgttgggcgtatacatcttcactgaccggcctgccttgtccgccgccgactggtgcttccgcctgcacggctggcctttatgccgccgttgttgggcgtctacgtcttcaccgaccggccgcctcgaccgccgccgactggtgtttccgcctgcacgtctggcctattatgccgccgttgttgggcgtctacatcttcaccgaccggcttgccttcgccgccgccgactggtgtttccgcctgcacggctggcctttatgccgccgttgttgggcgtctacgtcttcaccgaccggccgcctcgaccgccgccgactggtgtttccgcctgcacggctggcctattatgtcgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcactgaccggccgccttgtccgccgccgactggtgcttccgcctgcacggctgacttattatgccgccgttgttgggcgtctacgtcttcaccgaccggccgcctcgaccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgccttctccgtcgccgactggtgtttccgcctgcacggctg

SEQ ID NO: 45622 - DNA, 4139 bp, Oryza sativa
tgttctctcctgcttgaaagttatgcggtggttctttcgtatacgatgctaaacctatcagtggttaatgagatgttaaagtgcacagatgatgtttaaatggctttaatgctttgttttaccaatgctatgccatatgcaatgctcttgttaaagaggtcatatctagtactctgacatgcattttctttgtttgagacctgtgataaatgtgggattgaacatggggtctaactccgcagcacatagtgttaaagacgtaacttgcaaaatgacattgttcattgttttccaagttaaaatttattttgtttcatccgcatggacttgactcttcgagacatgggaacatagtattgattactaggcagtgtcaaagccctgaacagtagaaaatatatatcatgacatttacttttcttacattcatgtgctgtgattgcgttgctatgctacttaattgagttattagttacatgggttgtaattgggaggaaaacaacaaagggggaaggtaaatataattgcacccatgagcagcaattcatgctattgtttttgtttaaatcgtccattttattgaacattgcataaaacaattcctgttttgttatccccattatacaaaacgttcccttaggagttatcatcttccaagtaaccctttctttacagcaatatgaagcataactaactagagtacctttttttaaagagaatttaatgaatacaggtcaagcctgagattctatctgtactgataatgatgtcatgatctattcaggtaaggaccttaaccgagaaagaaaatctagttttgtcgctggagaaacaatacccagaagatgttggtgttctatcagcatttttcttcaattatatcaagctcagtcctggtgaagcactttacattggtgccaatgaaccacatgcatatctatccggggaatgcattgaatgtatggccacttcagataatgttgttcgtgctggtttgacacccaagtacagagatgtgcaaactctttgctctatgctaacatacaaacaggtgagttacagaagtgaaaccatgacaatttctaattttgatcacatgccgagacctaggaaggatgctttcccaaggtctgcagaagttctgagaattcgtcgtcccaggacccaggctacaagccagcactgacatatgtattgtgctatgatgcctatgcatctttgatctttattaaacagtgaataccatagtgaactccacaaagttgtcgcaatgatcatcaaaaatatccttttgcaggtctttccagaaatcttgcggggggttcctgtacagccgtatgtaagaaggtacacccctccgtttgatgagttcgaagttgactgctgctcactaccaccaggcgaactggttgtgatatccccagtgtcaggtccatccgtctacctagtgatggccggggaaggcgagatccaggtagattccatgccaaatggtgaaaagtctaaacaaggtgatgttttcttcgtgccagcatacaccgaggttaagttctctgcctctggtcctgagtgcatgcagctgtacagggctggggtcaatagcagattcttcaattaatttagtgactgctgaaagagttccacacacaattgctgtaggtaaaaggtcagtgcttacaaaatacaagtgaaatgatatgactagttagcaaaagttaccatatgtactgtataggtcaacaaaagaataagtcaggttccttcatatcttgattatttgttcttccaaagaggtctataccatagcgttcctcacgcatccagatccatctgaatggagaggattacagagaataactttcagccattctattctattacattgtagttcagaactaaaatgtgaactggtctcaagctttgacaccgaatatagttggaaatacttacagacatgctccatgtcttttcattgtttgctctgccttctaggctggatgacctgagtcgttttccttttgttttgtctgtggtgatcattggcattgtcgttcacttggacatgccgttgatattggcatcgatccattgcttagtgcatgtcaatttgcactgccagtttgtttgttgtttcctactgctacttgaagtacctggtgttgctttcattcagtgaaagccggttggtccttgcgtagtgcgagaaggcccagtgggcttttggtgtttgtttccaagaagaaaagaaacaaacagcattggattggacgccggagttgcatggcatttgcagaattgcaggtcgttttcctctgcttctcgtggcccgatttggttaagccaaaacggtgtctttgatagcgtggacacgtatgtagtacgtgcagtacaggttggttgggtggatcacggcatatatatagcgtgtggctgtcatctgtgcatgcacgagcttgtagtaacctgttggctgcaggtggccatccatgcatccttccttggcttggatacatccacttcgatcagtcatcagtggcacagccaaacaaacctgcaaaataaaggtctctctccttatcacgtcaattcctagaaccagcgatcattttgtcctgcctgctttcactggcacaatttgcttcctctatcctcatatcccatcttggacatcatcttgtttccttcagaattttcagattatcgctgcattattcatctgtaatgtaatctcgtacggagtattattctcgtttgtcctttgtcgtcatcgtcttcgagagcttagacttgcaaccaaactgccctgctggttggtctctgtaccctgtatggtttagtaattacttggagagtgcagtgctgatgctacactttgaccaagtataatatctggtgctttatcgattcattttttttgtacgtgttgttaaagcaaacgtggggcaattcggccgtcaatcccgtgcggcacgtcaaaggaacacagagagagtttcgcaggcttaagcaacaccagctaagccatctacttacctgtctaatctgtgcaagtgtgcatgcttttcctccctgtcaactctacttaatagttactgacactagtagtaccattgggatcatatcaacggttggtggtgaaggccgcatcaaggaaagaaaagactccaacttttgatccaaactatccaagtatgcattgtcatttcacattggagaagtagtggacttccagtgtgtggttggtattccgtgttggttttttggttgatggctgatgtacatatatgttgtgttgatgttcacttgacaggaaagttcaggtgattcggcctgttgttttccagcatgtgtggaagacggatggatgtcttctttgatcatctctgtggactgtgtggaagatgttaattagtgggtcaccacaagttgctagctgcagaaatggactccatattctggatcatatatacagagtagttgtacatgacaaatcagcatcatatcattgctagtttgccacctgctcaaatttatatgatcagagcttgaagatggttgctaagctagagctttggtaataattaccatggcctagtggaaatcatgcttgtcatggatgtgtagcaatatagcatatgatgggctggagagcatgcacaaagccgagagcttggcatacaagcttgcatgcatcttgggtagcttaaaaaaaacaaaatcttgcatcttttaattgaaggttttgttaagcacaataagtaatccaccctagctacaaattactttaattaattaagttgtgtaaagcatgcaatctggacaacgtagtacgttgaaagttaggccagcagtcaacagccactgtaaagctaatgccggaccaaacgtgcaaaaatatcatacatatgcaagctgattaacaagttaattagtagcatgttttcgcgtaaccggtatggcagcatcatatatatactacgaagtggcatcttgccgggttaattagctcagttcatcaggttcagtgaacgatcaccaagtcgtttgatttgactaagccgcgactatctctgcacagtaggacggatgacttcctttttaactctagcattgacttgcattatccttaggacctttaa

SEQ ID NO: 45623 - DNA, 2744 bp, Oryza sativa
tacaaaaatgcacgtgtcccgattacttgaatggagttatttttacatatggtcctactatgaaaatcataaattttacaagtgcttgttaagagggcggcttgatgtcatccatggcggatttgattgtgcaagcgcttgggagtgccaaatctggtggtggtgacagctgcggagatgactacggtaggttgcggagatgactgtggtgaggaccgtgacccagcggtagtaaagatgacggcaacaacgggcgaataaaggcgaggtcccccacggcggcggcgagcagatgcatacgagttcatccatagaaccgatgggtagatccaagtgtgctcatccaccaggctagaggtagatgaaggcgaggttgtccatgacgccaattggcggatccaggggtcgaggttgtccacaacgccgacaagtagatctaggcgaggtcgtccgtgatgatgaggagctagggttcctaggtagcaacggatctggtgacgatggcgtcggctttgggagcggcgatgattgcgacgacctaattgctccctcttctatgcgtatgcgatcttgtcgccctcaccctcttctcttgcatcaatgggtgaaattgttttgatcggcacatggagcaatgatttttgaattgttggatattttttttggatgaattggataccatagacgagtgacttattagctagccacatgtgaaaagcccttcttcatagacgaataacttagctggcctcctggaaaggggcatttcacatgcggttgtctatgaaaatggacttctacaggaaaccacatcctacatgtagaaatacaatatttccacgggcgtttttgttacaagcaattgggccaaccacctctggaaatcgaatttatctgcccaaaaaaagattttcataatagtactatgaagttgggaaggtcatgtgatgaaatggcttgagctacgcattttctcatgctccatctatttccaaattaatatgtcagcgacaataattactgcttcacattaactaccaccaatactaacttcctatggttaaattataataaacaaaagttgtattgtcttgttaatcccttctttatataaagttaaggccaaaagctcaaacctcgtgcttccacgtcatcatcaaattgtgaaccgttggatgaatgcattagatcgcttctcagacgtatagagcccaacccattagtcaccgggtgagtctcttcgccctcagtgccaaatgtagctcacatgaacacattgacccatctccatacacatctacatgtatccagcccgttaatccgtataaaagagttttatggctgaacgccccttcagttgacatgcgctacctaaattatctacaatttttggatagggctgctaaaaagaatttctccaagaaagctatttgtttcttctgtttcttcttgaaattatacctcctatctaacaaattgatgttaaccaaatcctgcagcaacacgcggagcatcctctagttaacaaaggcagaagactctaaatttgaacactgaaaattctggaagcagctgcaaccgccaaaagactcctcaaacatgaccttaactagtctgctgaaaatctatgcaatgctatcatggatgctgtcacacatttcccccttacacaattcctagtagtcccaactagctaatctacgtccaatactttctccatcccaaaatgaatttatttttcacccatctcacatgccaataaaaaatttagaatacctctactttatcaaatctcaatgcaactatttctcacttcatatatttctaacacaattatttcatactgtcataaactccgatgcaatgattactttaaaattaaatttattttgagacaaatggaaatgataaaaataaacgggacggagaaaatgtatgtcttggttgtcagaacatgggatgtggcccggccatgattgttgatttttttatgcacattagttgagtcgtttcaaatcaagggtacgatcgatctcaacaacatgacaaggaatggtcgattttggatatggtcctgacttgaccagatgggatgtttcactgttgataagaagcatgcattatgttcaccgatttggcatttcaatgtaaccccgttttgtcacacagtcggtgcagggaggttctccaacacattcacaaatactacttgtctctcttcaccaaagcttcgagagttcatttttattatatgctagtatatatttctaaggcttggttcttaatagaagatgtacgaaactgagtttatgataaaatggtacaaacgagtagaaagttaaaaggttgaaatagctttcttaaagacaagctaataaacaagtttttttaataaaaaaaaagtagtgtaggaagcgtgtctatgttaatcaaatccataatataatctgttagcttaaaaaaatcatgaaccaataaaattcatgccattaagaactaattaatcaaatccaaatttgtctcgccaaatttatgacggtcagggaggagggaaatttaaagaaaccggcgaggacaaattaaaatgtgaatacatacacaacaaaatggtgaccttgatatacatgtactttttttaaaagattacatggaagacgtagacacacacagaacacgcattcacacaccatgaattaatgcaccctagaatcctaatgaaagcacaccataattgattaatcgga

SEQ ID NO: 45624 - DNA, 8119 bp, Oryza sativa
tgtaagcatgtttatcaaaattaagaagaaaatgatcttcaaagcttttgaggtactacctccgtcctctcatacatccaaaatttcttatattttaggacggagggagtatagtactatcagatagaccagatatgataatcggagcattgactactgttgtatgtgggaaaaaaatgcatctttttttttcagttcattttactagggttgaattggcttatattattgtttctaaatttagcaactccccagcaacaacatcagtgtaagtacactagcaagctacttttgcctttgcttacaggcaagtgctactaggaataagtggaaaatttgactttattgagctagaagatggatttgatatgacaaggactcagagcaagtctcatccactgcacacaaagaaacaaaagaaacctaggttgcttataattgcaaacattaatgagttaattagctgccttttctatttcgttcttgagtgtcatttttcttcagtaatgttacgttaatgctgcaaaacatgcatgctagctaggtgtactgtatatgtagactatggtacaatatatagctatagctccctattttagctttgatgaagcattgttaatcattttgcagaatgaattattcctgaaaattattgtatatgtttgatccgaatttcgttttgcattcacacatgcatgtgaatggatattaaagtttgcatgggtggcttataatatatctatgtggccttctttttaagaataaatattcaccgaattattaaaattaattaattggtttaccccttaaaaattaggggtttgaaaaaaaggcgtcctctatatttaattacttagaccactttgttttaagcttaatttttaaaatattaatttttatctttataaacaagaagattttctcaaaaaagaagtgtattaatataatcattaacgataatctactcaataatctaaatcaaacgttacataccatatactcctactaaagcaaaagcaaaacggtgtagtatgaaatactccctccgtctcaaaatataagcaattttagcatagtgacaaatcaaacatttttaactttaaccattaatagcaacaaaattaaaaaaaaatcaatcatgtaaaattaatgttactagatttatcgttaaacaaattatcataatatgcaactctttttatttaaaatatattatttttatagatattattggtcaaaataacatttcggagggagtaaatgaacaggtaggtactccaggacgcatagcggtaccctgcaaaaaaattggacatgtgtgtttgtccgtgtcggtcaacatgaacaagcaaggagacatggcctgccccttgaagaacccccctccctctagctctgtccattctgcaaacagtcgccgaacgaaagttatacgtgcatggagacttgatgcatggccggaatatttctgtgtttgtcagatcaggtctgattgatcaccagctgcttctctctctctagccttactactccctcctcccaaaaataactgcagccatggttttccgcgcccaactttgaccactcgtcttatttgaaattttttattaaaaacataagtcacgagtaaagtagtactcatgttttattatcttataacaacaaaattgctaattataaaaaaatttcaaataagatagataatcaaggttgggcgctgaaactcatgactgcacttattttgggacgaagtcagtactcgtatacttcatccgtcttataaaaagaccaacctaatatcgaatgtaataatctatctgttcagatttataatactaaaatacgttacatatctagtactagtaaattagtttttatgagaagaagaaagtatatcatagatgaaccatatatttgtgttttggatgtatgcttgcatgcacacattacatcctacggttgtagcgccatatatcagcactgtttgcagaacaaaatcctgtcagtgatcgagcgtctctagctacgtacagatatgcatgggggcctttgttggaatccgatggacaatatataacgttaaagagaagataacatgtgtcaagcaagctttaatttgacggacggggcctctctagctacatggtgagcattcactggataattactatatttcttctaaaatatatatagtagtaatctaggattaaattaacgagtactacgaattcgaatctagacaaactcttatttggtcctaaattactaaattttgagacggggagagagtatatgttagaaaagtatcattagttgtggtgaatgatgatggagttgtgagtgcaatttgtccatcaagtatcgaattctattgctcacaatatgtactctgtgtaaatttaattactacactgaaaatttatattcattacctttaattaatacactatattcttaaatcaatctgaagtgaagctcagaaaagattatacataattaattaattcgatgtatatatgattattgttgttagttttcaaggtttaaattcaacaaaaagtaatgttttcagcagcagcaattaatatataaatgtattttaatgatatgggaaatattaatgttagtcaaatatacatcaatattgtttaggactgtatcacatatatatatttgttacaaagttttaacgaaatattattaaatatttccttaaaactatctgatccccacgtaattaattagattaacttaatttctatatcacgtgttctgattcatgtagtcaagtcctggagaggaaaaaagaatctcccttaaattagtatgcacctatcaacgctcttcctttcccattctatcaaaacgcttttaatttttttttctcgccggccattctctatcaaatgccatgtcccacatcctttaagaggaagtctactagcacagtgcccttgaaagctccaggagtcttatcaaagcaaaaatttcaagttggaatcatctctagctatagcactttctttctccacctttctccatccatataaatatatacaacatatatttaggagaaatggatgagatatccatatgattgtaaaattgttccctctctggcccgttagatttgatgtgacgatatgttacatccatcgtcgttttccatctagagtacgactggcaatttttctcagaaagaagcatgattggaaaagatatatttaataactacatcctaggttatatagagcaacaaacttaaattctaagtcaaatcattaattatctaacatggtagtattatctcaataatgtacgcatcaaaagaaaacaagttttactccttccatgtcataaaaacatgtttcaagtcaaacttaatgtgaacatcaatattttaaaaatatttagttagatgtatgaaaactatatttgtagacatgtacatatatagcatgataattttatcagggtttataggtcaaatttgtacgtgggacaccatgcatgttcatgtgtaaaatgacatgttttcatgactgaagggaataactgatcgaactcatgtatattcatttgtttaaaaaacatatatggacaaaatgtacctgaaattgtatcactagcctagctatatatacttcagaatgtctatctagtgtggcaacttgtgatagcaaaccacacatatataacaataacaaccctctagctcattgttgagttcttctggaaagtagcgtggcgacgcgtttgtgtgctctacttgttaaatttcccaaatttgcacaactcaatttgagttttattggtaaccctcttctcttcttctaatatattgacgtgcaattcttttgcgcgtttgcagaaaaaagttttattggcaaccacacatatatgtagatcgagatcgagatagccatctcaaagcgacatgtcattgccgactttccctagcaagagaaagctagcaagccagagagaggcatctcactctcacacacacatctatagcttgattctgacccatattgttcccatctccagatgcaattacagcacacaaccccaccaacataaacgagatcacttggagacaacgacctctccttcgatgatcaatgcatataacaacaagatctctttcacaaacccaacaaatcaaagctaattgaatcgccttttaacaagaacaaacaaagagagaacacacatacgtacgtacacaattacattaacaaagtactactactaacaatagttacatgcaccatcgatcgatcaaccactacaagaagctagctagctctagctaatatgtttaaacacatctcaataatattctctccatcgatcggaatcatcacgctattgatcatcttctacttttgatttttgcttgatcgatcactagtacttctatcttgatcgatatgatggaacaactcatccattagctaatgtgacagcatcatcaacatcatcatcatgatcatcatctcatctcgctttaatggagagacatcacaagaagcaacttaccatctcatctatccatgatccatccatccacttagcctttagctacagctaagctcagctggatacgtagctacctagctagctagctagattcctcctccccactcgccgagctttctcgccgccgcttggcacacctcgtcggacctccacgtgtcgccgccgtccatggcgccgccgcagtagttgtagctgccggcgttgccggaggcggtcatcatcgtcatcatggcgctgccggtgcagctggagttgaggtagtcgaggagcgtcgagtcggagtagtactcggccggaccaaggtccagcccgtcgaggctgaggcttcccagcgccgacgccgagtcgacgaacacgccggcggcgccgtcgtcgagctcgccggaggactgcatctgctggtcccatctcagctcggagaagcagggcagcggctggaacgccgccgcggccgccgtcgagccggccgacgtcgacgtgctcgggctcgggtcgatgtggtggtggtacacgttgttcgggacgacgcacgccgttgctgcttctgcttgctgcaggtgggtgtcgaagtcgaacggcgaggaggaggcggtggccatggcggcgtggtggtggagtggcggtggcggcggcggagtggggtcggtggctgctccggccatcttctcgaggaggcgaggcatccaatagcagcggacggcgtcgcggaagacggtgctgttggcgtcgaccttgagctgcctggcctgcttctgcaccctcgtcctccagtagttcttgatctcgttgtccgtcctccccggcagatgctgcgctatcctcgaccacctgatcaatcaaattaaccaatcgatcttgatcagagataattgattttgattgatatatatgtgcagattgatcaaatcaatatgtatacctacctgtttccccacctggaatggagctcaagaatgagcagctgctcctccggcgtcagattcccgcgctttatgtcaggcttgaggtagttgagccatcttagcctgcagctcttgcccgtcctcttcaaccctaatcgattaattaacccaaatttgttcaagattgattgtacttgacctagatgccatggttagatcgatgatgattgcagagtgacggaggactcaccggagcagcgggcgaggagattccagcggccttcgccatggcaggcaatgtagttcatgaggaggttgtcttcctcgagggtccatggtcctcgcctcagctccatcatctcctctgccatggcctcctgctgctgcttgctcatcactcccatgggccctgcaactctcctctgcgacattgctgtctactacctttgcagcagctgggatatatagctatctagagcttcttcttctactactagtagtataaatgttgttggtcagttggtggattggatgatgaggtcgatgtatgatccccttggagggtgcaactcatacaaccatatatatagccatgtacctccactagctctcactagcttaattagcttgccccttaactactctctcaactctcaactctctaggagatcaattagggaagaaaagaatggaagagagcaagcacaagtaagtacaagagaagagggaggagagatgcatatggcctagctgcagagagagagagagagctaaattaagttattattggtggctgcttgagatcaatatatatatatatatatatatatatatatatatatatatatatatatatatatcccttttataatgacttgtggcaatcatatgaagggaatttttgagggggcatgcatgcaactgcccctaatcaagactgaaaagtactactacttgtaggaagaagaggggtacattttaatttggtgggttaattagcttcttgggggagaagagaaggaagaggagaggagaaagccaagtgcgttgttacacaccaaaaggtcagggcaatctgtcaaagcttccatctttttctatggaatgagagagagagagagagagtgagagaagaaatagtgcccagtactgatctttagattctctcctacatgaagcgtgtttgactgaacaatttgtcatccctcttgcagcactgtgttaggattagacgagagagggagagtgggatggagagatgaccaaattgttggatgcacacattggtgaaccacacacctctccacgatctccttttgcactgcaaaaaaaaaacagtaatgcaaaacgttattctttttgtttcttttggaatatatattatccttttgtgataagctcaaatcccaaatagagacatgtacatatacatatgcatgcatgggtttttatttattgatattacaccaaatcattggtatgttttcgaaagctaccacactttatggtatagtgaaatgcaaatgtgtctccacgcatgcaactacctgcctatgggcctatggcacttaaccatgcgttcaatcagaataattatctgtttcataattaattatttactaccagtttgaactagaattatttgccagatgaggtacggtctacttcaagcaaagaataagcaatcaatcagcgagacttgtgcttgcaaagcaaatagctttgtagttctttctcccgaaaagccaatgaaacactaaactttggagacagcaccctggtaagtaagcaaagattaggtaggaatgcctgtataagttcctaggataatcatataaaatattcgtaggacctaatgattcttgacctaactgtctgcatgccgaccggttaaaatgttcaattcaaatgtttagcttaaatagtttgtgcgtgatgttggcacagttgcatgcataccatggtgtgtagtcaaatacttgcaattaatcttaatatttgccgcatctaaagtgtcagttttgcggcttcccttgaccgaattttcagaagtacagtcactgttaagttggaaaagaatcaattcaaacatgcatgtccttgaaacatataatcaattgaaaggtcattgaattatactatatgaataccccgttgtgttgctgccggaaattaagttacataatatgtataaataagatgcaatataattattaaaactaaaacaaattgatacttatgaattttgagcctaaaaatgattgagattgcatggtgttatgagagaagaaagaagagataatttgaactatggatctatcagccaaaggctagaaataattagggtgatgtggcttaatgagagaagagagaaatagcattaactatacttagtggggatgaactatataagtatataggatttgagcacacatgtcaaaaagatgacaagtgaataatttacaatagacttgttgcatgatatatttaacatgtataggaaatagatgaagtgtaggcattcttgttatcttgctattaatggtgcaaacaaaaaaaatcgaataaagcctaagccatgcatatttttcatgaaaaatacaattttattggaatttgtaaatatattaagatataaataagtggtccgataatgtttgtgtgagaccaga

SEQ ID NO: 45625 - DNA, 4300 bp, Oryza sativa
tgcaacatgatcatgataaagccattagctagctagcgatcgatggaaaggaggtgagatcgagatcgaccattaattccttctcctacctacaactcgcccctgatcaatatgatcatcttcccttaattaatcaacggatcgatgatcgaaatgatgcgtgaaaacaacacgtcgtctccacttaataacttgcctggctgcttttaatctcactcactcagtcgatcagtgtgtgtgtgtggtggtttgttgatctcatcatctatcgatcgccagagtctaagcctactcgttttagggtaggttacctaggcgcctctccagcgacgacgccgccaccgacgacgacgaccgcgacgacggcgacggcgaagatgcagagatcaagctagatgcatatatcgatcatgcacacacttgccttggcatgtgattatattgtttacatcgtggcatgcaaaaaatatggatgaaatgacaactccaagaatcgcaaacctgaacacgctacttaattcgattatcgatcgttaactgctcttgcagtcagcttgaattggttgcttattctcatctagctagcaatcttgactactgttacgtacgtatatcgatcgatcgatctagttggccatcgaatatatgtcgataattatgacaatggatgtgagcttagatatatctggccttaatcatgcccatctcctttacatcgatcttgactagctatagctctttgcttcgatacccatctctctctcagagacacacacacacacatacacgttccaattctgcacgtttccacattattcccgtgagaatcgtatcagaatatattaattcacactgaacttttgattaggattaatccaagttagctagctctagaataggtgcagagagataaagagctttttcacagcacataatcttaactaggaccaaattaagagagaattagctagcttcgtactagtatgtacatatattgtgtgcatatgctggaaactaagagatgatgcatctgcctagtgctagctagccagctattataattaggagattcatattcctttcacataatataccactctagctaggtaatagctatgccttaggtcgacctttcatccgaacaatttttaatcaacgtgtttagttatatatagttattagtggtgttaatctagcaaggctagcaacttgttgcgtacgtaaatcaccaaggaaaacaactaatcttttgcattaatttaccaatcgatgcgtcgacgggttaaacatatatactaaattattgcacacttacgacaacctcccatgagagggaaaacaagtggtttcttgatggatcaatcatgatttatataaagtatagaatactaatatatcatcaatcgcatacactagcaacagaatgaattcgatcatcagttgctaattaatagctccgcctatctcgccgtgttcttgaggtattccagaatctggtagtgtgtgaaacaggaaagcaatctagcgagcacacatgatgcttagacgattctaattaattaattaatagttaattaattaaggcagacgtgttacgtctgattttaacggaatgcacgcacattaatcagttgtttaatttgacaccccacaacatacagaggcttgggcgcacctggccggttttgatgattaattctcttccaattaacctccaatccatgccagagacttgacaaattattaatctaatttgtttgtacgtgtgagctggatggtattgtgtaaataggttaattaattgctagttgggactgaaaccagccaggttcatgcatgagtacatattgttcatgcaagttacgagttttgtagggagggaggagacatcaaactgtacaattcgactacctgttgcaacgaagaaagattaactaatgctcctacggatatatagtttggtgagtagactaagccatatgttttaagtataatgccatattgccatccattccatggcattgggtcatcatgtgtgtgcacatgaagctgacggcaccaaccgtctactagttgctaagctagctactagtaggaattaataggagatagagcaacatcatgtgtctaagttgctgtaaaacaattgtaattaatattgagttcctgcggtaagctaatgcaaacttcttgtttatgttaattattaactaccagtacacctagagtttttctacgattcttcctaccataattcattgtacattccaagttattgtagtttaacagtacttctggcacaatgttgacacctcctccattttttttacctttttgactttcatgcatggtatattggtatgagagatagactttgaacattatttttatatctttaattaatatttaattaaaatattacaatattgcagaaacgtttccaatggcaaatttaatgatatatttttcgtataataaatttggacagttttaaacatataattctaaaaaaatagagttatgttagtcgtatggattttgaggtatcaaaagagaaaaaggaaaccaccacatataacgaagccaaacatgatatcacaccatatgagattaaaacttaatgataacagggagccacaatattgattgacgagagattagatctgctaaacctttacctttacgagatattttttacgtacactctcccctaaactagtataattacaatgtatcaagatattaatgtcccccggccgacctacctagagcgattattctattctacaattgtcatatactagttataagagatggtgtctctctctatttaagagagacatatagagtcctactctatttttaacaactccaaatcttattttacagctacatttgtacatatattcgtattcatcacacactttaatgtttttctacatagtcttccaaagagtgcagaaaattggccgctgctctcaacgtgccactgcacttgaagtttgtttcgccgctgtacgtacatggctacaacagagttcaatgagagagtttaatcaagcataaatatctagcgagcttaataaaaaatgattaccatattttaattcaccgtgctgcttgtcgtttaacgcagatatctacttgtgtaaacattcgagtccaaggtttcaatttttctgccaacaattattttagagcaaagtccgaagtttcggatgctttgccggcctgcacagataaccatcagggctgcaatgaaaaggccttttaaccacgtattgagatgtttgggccgtatactctacgtcgtgaatctaatgggcttagctcacatgaactttgggccgtaggcgtatgtttctgctcatcttcttttttcccgataatatagagctatggaagatgcgcatgtacactcacatattttggaataagtcccatttcacacatgctcaagaatatatttcgatttatcatgacaaggaaatagtaaaattgatctctcgagattttggcacacagcaaaacagagaaaataaaaatcttccttcgagagagaactgtctgatgtatgcagttcgtcttcctttaactgaatattctgttcagagtggcagctaatctgacgccgccttgcgctagcctgagattcacaaccggcaatctgctcccgaaatatgcatctgcaacagcagcaatcaagagcaataaacccgtggtcaggacattttctgaagtgtttaactctgcatcaaacgtaaatggcactgctaatggtagtattaccttccaggagtgaatcttctgtcacgtccttgtacgcccagtcgcatgctgcagcgatgctctcagatgcataccttgcatatatagttgtaatcagttacagccagaaatcaatcaagttaagtggaaattcagaaatgaacttttggatgtgaaagcatacgtgtctgggcatgtggtctggttcttgctgcattcttcccatcctggcactcgttgtgaccattctccctgaaacatcaagcagtaagtagatcgagctgctagttgcctcaagcacaccagaaaaccatttttcataccgttatattctgcatcagtgcatcgacaaattcagccacgccttccccatagtagtcgttttctgccgttttgatgatgttgtcatcccaaacctgaacgacaataccaaagacaaaggattcctaattgattttgtcacagtcatatccatgctttatctgatttttttttcttttgggaagtgggatgctagtctgaatgctttttg

SEQ ID NO: 45626 - DNA, 38958 bp, Oryza sativa
  unsure (1)..(38958): unsure at all n locations
agcgtactaatcacatttttttgggtgtacctggtggatgtcccccacaaagtgtgcaaggaacagaagtgcttgtgtcaggttatctgaagaactcaagatcagaaacttatcatcagcctgagactaacaaggcaaaaaaaattgcagaactgaattaaatggagcagtattacattgagtagaaggggatgttgcatcataggtgaggagctgggaggtgtagttgttgatggcgccggcgacgcacctccccctgaagctatcctcgtccttgcagtctcctgacaatgcaacacaagaaaccaacatgatgcatgctgctacaatgtgacagcatgtccatgcaaatttcagtcgaatttgaggacaaaatcaacaaactgtcgtaggtgtagctgcagaggtggtccggggtgtcgatgtagtggagcggcgccgaccaggggtacctgagcttgacgccgtcggcccaggagcagaggctgctcaggttgcccccggcgtacgacggcagcaggcccctcaccgccgcggcggccgcgtcgctcagccggccctgcacgagacgagacgatcagatgaaagaaggcgaggagcagatcgaggaagaagacggaagaatgtgcgtgcctgcgcgatctggcagacgatgagatggccatggattccccaggcgtgcgagggagcagggaagagcgaggagaagagaagcagcagcagaaggggcagcgtcgacatgatcgactgctgcatcctgaattcctgatcggatgcgaggtagaagaagctagctagacgatcgatcagtatcagtgcctcggtgatggggtttttaagcgggaatagtggggtagttcctacctacctggtagcgatcgggtcgccccccgccccccctccctccctccacctgtttccttttttggcacctcattactttcctactttagtaaatttatgcatttaaagtttatacacctaaagtttacacatctaaagtttagagaccaaaagtttataagtcaaaagtttatatatccgattcaaatttgaatttgaattcaaatattttatatatatatatagtatttctatacatctaaagtttatacacataaagtttatatacctaaagtttataagtcaaaagtttatatatccaatttaaatttgaatttgaattcaaatatccgattcaaatttgaatttaaattcaaatatttttcatatatagtatttctatacatctaaagtttatacacctaaagtttatatacccgattcaaatttgaatttgaattatattcaaattcaaatttgaatttggatttgaattcaaatattttctatatatattatttctatacatctaaagtttatacacctaaaatgtatagatccaaagtttataagtcaaaagtttacatgcccaattcaaatttgaatttgaattcaaattttttataaatagtatttctatacataaatttttctaacttttgttttttaaaaagttttgtgtggtgtactgtagtagaaagagaagaaggggaggaggaaggggggagaggagggaggagtatatagtataggagagaggcaggggagtgatcgctgggtggatggaggagcgatcacccacccaataggaattccggaatattgtatcatttcgcgccattattttaagaaagggaaagaggatgaggaatctgtcggaactacggagcatgcacggccggcaatctcgttcacacgctgctgaaaattgaggccatgttcatacccatgcacacgcctgactactgctggaccctcctggtgccatgtccgtgcattcacagcagtgtttgttattcagtgtgtgtgtttttctcctgcaggatgaatgcaacagctagctgcatagctgtattgccccttttttttctattaagatacatattttactcgtggtttccattagtatacttttcaaaatgctaaacaatacatttttttgcaaaaaaaaagaaatatatatataaattactataaaatatcagataaatccattttttaagttcaaaataatttaaacttaatcaagctaatgattttctcattttacatgttttacacttaatcttcatgtacaatgaactcaaacaaagccagtgttgtcgttgtatgaaaatcagcctcaccaattgatttcatgagaaaaaaaatggagcaacaaatttggcaggagtagcaatgtatcatgtcgtagtctggaaattttctccgataaaaacgccagagactgttgtcggcatgataaaaatctgtataaaatttatgggccgaaattgccctcagcatcacaagcatccggcccatccggataatcttggcccactagcccagcccatgccaccgctacgttaccttctcctctcgtgctctttctccgcccaataaatagcccacgacccaaccactccggcgaggctgagctgaccaccaccggagatggcactcgcagcgcctctgctccgcctccggctgctgcctctcgccgccttcgtctccgtcgtctccctcaccgcggcgcctcggcgtgcggaggcgtggggcagcagggccacatcatcgtctgcaagatcgccgaggtctccgcacaccatggctttgctaatccccttcctcctctcctcgcacagcacctgaagaggctgcagctagagagtaacacggagtgttgtacttgcagaagtacctgtcggagaaggcggcggcggcggtggaggagctgctgccggagtcggccggcggggagctgtcgacggtgtgcccgtgggccgacgaggtgcgattccactactactggtctcgtcctctccactacgccaacaccccccaagtctgcaacttcaagtactcacgtacgtcttcactcacctccacaatcttagcttcaaattttcttcttttaagataacgacttaattatagctgcaaatgaacgctgcatttacagaatacaaattgatcgttcaaagcgagcttaattgcgcgccattggttgcaaaccaggctgagcgagagaacgctttgcgttattcttttttctctgttcaaaacaattaatgagcacttcctccatttcataatgtaagactttctagcattgctcatatttatataaatgttaatgaatatatatatatatatatatatatatatatatatatatatatatatatatatatatatatatatatatgtatagatttactaatatctatataaatgttagcaatactaaaaaattttacaatatgaaacggatggagtagtagcagtaacgtttttgggtttttcttgagtgtagagtggctctgcccttctcgctctgttaggagttatgtttagccgccgtagtagtttaattagccttccttgcttcaatttttgttttgctttttctcccttcccttggcataagccggtctggtgattacgttgtgtaataaaaactttttttcttcttatatattaacgtgcaatccttttgcgctagcgaaaaaaaaatcagtaacagtatgagcagcaagtacgtcagcgtagatgccattagcccattctgaattattccctatcgaatatccaaattataccggcacgtactgttgcttgttggggaggacaaacaatcagagaaagaggttgagtaaagatacacaactcaaactctcatcacagacagattcagagtctcacggcatcaccaatgattcgatccactaatttccttgttccaaaccacaacgaattcatgttgcattcaatcagtagctttcaccataaaaaccagacatctgtcgtaattgtgcatgtaaaatgaatgtttagactccaaggaagaaaaaaaaggacatactaacaacaggaatctgacgacttgattataataattgcgtgttctctgcttcttctcgttcttaatatctcgagaaatatcttccaaactttgttagcacgttcttatgggaccaggaatgtgccgctgacagtctgacagagacagtcacacatgtgcccacacagacctgttgttaattattactagtatagttcagagataatcctaaccactggatatgttgtttgtggtcttcaatggaatgataaagtttgctaattggagcagctgaccttaactgaggtatacattaataattcagcattccatggtgaaatctgccactctgattagatgatagcagagatgagtagagctaaggcacaaacatttctctgatttctgaaacatgagctttactttcatcatggagtaatctgcttgtggctctcaattatccaggggactgccataattctcgtcaccagcaagggatgtgcgttgtcggggctatcaacaactacaccgatcagctctacagctatggcgattcaaagagttcatgtaagcttatctgcaaaacacagtgccaaatagtgctctgattcagcaggcaggacactgatccgatgatctctgaacatccatacacatgcactgattgataaaccagacaacctgacggagagcctgatgttcctggcccacttcgtcggcgacgtgcaccagccgctgcacgtcggcttcgaggaagacgaagggggcaacaccatcaaagtgcactggtaccggaggaaggaaaaccttcaccatgtctgtactgcttctctcatgtcatgtcaactgaattattcagatcagcacaaactgccatttttcactcacaagatttctgtgttcatgtgctgcttttacaggtgtgggacaacagcatcatagagacggccatgaaggacttctataacagaagcttggataccatggtggaggctctcaagatgaacctcacagtgagagcacagacatgtaaaatgatttatcagttcagaaatgcttttccagtttctgatgtttgtgtaaattgtaggatggatggtctgaagatatcagtcactgggaaaattgtggcaacaaaaaggaaacctgtgcaaatgagtaatgatatatcctgctcaaacacttccacctgtctagtacatttttaaagagaaattgacatgcattgtttaactcaatgtcatgcagctatgcaattgagagcatacatctgtcctgcaattatgcctacaaagatgttgagcaagacattactctaggaggtgagtatacttctttatatcacagtggttgtgactaaaactagtacaagaagtcattttgggcttagggcaataataattggcaaattctgcatcctggaatacagatgactatttctactctcggtacccaatcgtggagaagaggctagcacaggccggcatcagattggcgttgatactgaaccggatatttggtgaggataaaccagatggtaatgtcataccattacaagttcagtaagggttatgatcaccagaaatattcaggagaaatgttatttgttgctgccactctaattagtggttgtgcacatattttataaaaagcacacatacctatagtatagaattcaaaaatgtaattgttgtaattgcttattggaaagcacatttatttgtaagaagcacataggcctagtacagcattcaaaactgtaaatgctgtcattcatgtacaattgaaagtagtctgtgacaagaaacacataagcctagtatagcattcataaatgtaattgttgtaattcctctatgtttgaacagtgtaccacttgaataagtgtgtttcaaatcgattcatttccctctaatcatctcatttctttatttgcaaacatttaagagttgtcgcttatctctgatcatattgtcaattgcacttttcttcattagctactgagaaagtagagtacgctaaaccggtatagggatgttcagctgccaaatcgattcaatacgtggggaaaaacaagaatcacattgaactcgatgtaacacatagttaattgaataaattttattcatatatgaatcacataaaaatacaccatctaagcaatatgaacctacatacaatcgatcaatgtgagcgaccaattgaacccgccagtaccttagtcagaacgtgagtcgcgatcccaattgggcagaagagcaggcacagagaaaccgaatgcctggtctctatgttgttcttgatgccgtcatggtacacctgcctgcattgtgatcccaaaactcaagccattttaacaacctcctcacgcttgcaacacatacaaccatcatccataggtacactactacacacatgaatcaagaatttgctcaccttgcggcgaagaggtcgacggctaggaggtggatccaggcggaggcgacggtcatctcgctggcgaacatcctgacgatccccgtcaactgcgcaggagaagagaaaggttgagagaatgctagtgatcatggagtgcagagtggtgtcactgattgattgactgacctcggggagccagtacttgctggcgaacatggcgcgtagggtgtcgggagtccaggataggtagagcaggtaggcgtagaggatgccgagggcgacgtacggcgcgctgctatccacggcacgcttggtctgcgccagcacagagaaagattagaggagcaagtgagagcaattcgattgtgtgtgtgtgggttggaggattgaggaattcttacgacgtcggcgttgggggcgacgaccatgagagtgtagaaagggaggacggcgatggtgccccaggtgaaggcggagctggcaatctgagacgacgccatccctgctcctcacaaccaaatccatggcgaaattcgtcagtcagtcctacaccaatcagttgtggtagagctagaattgaatggggccgcagaggcgttacatgcgcgaggccggaacagaggcgccctgccgcgggcggggacggcggggcgggagaccgcggcgagctccggccggagagggcgcgccgcccacgccgacgctgcgccggcgccgcttcccgtgcggagctggccaccgggcagcaccaccgggcgctgctgcctcagcgccagtggcgcagccacgccaacctgcagcagcaaatcaagaactgaagctaccgcaactccgcaagtgccaagattgactgagtcatgtgttaccggctacgtacccgagcggcggaggagaggaggaggagagccgccattgcagggcaggaagcgagcaggagcagcggggaggcggaggaggggaagaggccattaccagtggctggctcaccctttgtactagtaggtcctagctgttgctgtggcgccgctccggccaccactctcactggtgtaggtgtagtagctgttgttgccttcccatggtcggcccgggtggtggacggcggccggggcccgccacggtcgaggttggccgtcgacgcgtggtcgccaccaccgaccagtgtccacgttattgatcaccaacaaagcaagaagagagatcgtgctgcttcggtcgcgcccgagtcaactggccttggtacgaaggaatgagagcgtacagagacaggctggcccgcggccatgtgccatgtgccatgtgccgccgccctcactttgccggcgatctcctcctcctgccctcgatccgtctccgtcaccggccgccgctgcgtcgacacgtcactcacacggcttcctcactttcaccacttgcaaccacagagtaaaacacttcacactcctttaggaatgattggtacacccatccaacatcataaccaacaagtataggatgattggtacaccacaacatagcaggatatgatatcatcaacaccaacaagtacagatgattcagcaataatatcacacatggcatgttggtaaaagcaaacaagattcagaagaaaaaggaaaaacaaaagaagcaaaaatgtttctcatcatctgagatgctgcagatgcagaaaaacgagatagagcaaaggtggtgttagtcctcaggccgaaccatttggcccaacctttccttcttctgaccgatcagtctaacccgattaaaactttttaactctctatctctgcaaagttgcttgcatctccccccaactacgggcttgggaaaagatgcgaaaaaggtaactgtattcttttctaggatctatcccttcttattagccttcttcattcactcctagaatcttcacttcatctcctttggattctctgtataagcttttatcaactgctggacaaatatacttctagaacgacaggtgagacgccaccatggcctggagcttgtcccagtcggatgggatctccaggttaggagatagcacaaagcctgcggcaacagcaagcgtgataaccagcaggctgcccttcaggcaggctccgccgcggctcaaccttccaaggatctccttggaatacttgtccgcggccttgatagatgcctgctttccagagtccgttgctgcttctagggccgcctcattctgcaattgcaaccaattgcacatattactacggagtacaaatacctagggggtatgtgaacagctaaaggtggtggtgtcaaacaagtttacttgcttttgcatgtccttaagagttgtggcaccttgatttccattttatcaaaaaaaaaaaggaggtaacgccatttatcccaaactaattgtgctatcaagaagctctctttttgtcatgaatcagaattcactagtcatacagaattttactactatgcaaaggatagcatcacattgcatatacataagaatgaaacaaacatcataaacagtcaaacaaaacaagtaatgcaacagggacatatcataccttagtccttaagttcttcagagtcaccttaagagattcagcactgagcttatgagacagctcgctccattttgtgactatagtgctaaggactacaacactggcttcaacattttcaggatgaagtctttcctgcaaatcagaattaagaaaacttcagttgcaacattctcacttggtgttataaaggcagacagacaaagattactcacccacagcttgtaggactctgcattttgagtcaggcaccaaatgaatacaccagcagactccccggtgaggtctgcgttatctgaacataatgtgcaataatgcaacaactcagagttgcaaaacaaaggtaacaagctctatatagaaagagaagttagggtgaaaaaggatgacagctcactttcttgcattgctttcacacacaatggcaaaagctgctgtgctgcttgtttcacggtttttgagccaggaggaccagcaagggccaactccttgattgttgggtaggctgcttcaaacctctctgtagcctaaagagttccatatgatgaccagaagtcagaacatcatcgcatatcaaaatttcagcaaacaggaaggaagaattaagaacaaacctttacacgagcgctggaaacaggaaatgcagctctcatgaacagatcaaatgtaacagggggaatcaggcgttccccctttctaacagcaccattcagtaagatgcctcgagctttgggggcagacaaaattctgcacgtgaaatatcaaaaaagattatgcatataaatacttctgatatatatcagaaaacagaaaaacggctctagattcttaatcaggtttaagttgagccatacctttcgagcaactgcagaactaaatctctcgtctggggattcccacttggcttagcacacagtgtgggaaacaggaaatgagcccaacaaaacattccagtcactaggtcaccttgagatgcctatgatacatcacgcaagagatattttttaagaaaatataaaatgatagtatggagcactgaaaataattagcaccattcagaacaagtaagagcacagcagggaaaatatacctgagcaataacccaaacaatgattggaagcttttcctgcccaagatacttattgtttcccattatttttggcaggacgtttgttagtacctctggtttccttcttacagtcaaggcaagcacaacaaatattgcaacctgaacagagcaatagtcatttaaaaactataaaccaacttgaaaacaagatagaaccatccataattacaatcacaggtccgataagcaagtgtgaattatggcagtcagattattagatcagcattttaggttttatcatatctaccaccatgcaatcttcagggccctaaaacagaaaaaaaaaagtttaatctccttcatgaacaccttacataaagtaggacttgaatattctgtcatcaaaatgcagttcttcttagaatttatataaactttttagcaatcgtggtgatccatagatcggagtaataaactaatacaaatgatcgaatcgaatcgaatctgcttattatcttacttcttgtgaggaagtgttaaaagcaatgagaaaaggctaaactaattgaattacacaatcagaaacattcacatctatctaaagtaaatggtattgacaagcacaagcttccagcaatgcaggatgtgagcaaattgttcatataatatttcaattgcaaagcctacatttttttttctcattgcaaggttgttgcttcattagatgacagcattagcgctaggctcagttgatgtgaatacaatataggacatatcgcaaatataaaacgcatgctatttccatcttgtagagcatttttatgctgctttacatcacaagtccatgataccatgcagaggcttgtatagtgagagttaagtcgtgatcgaacaaggactacctgggcccttggagtttgctgtgcggccttctttgaacccttagcgcctactgcttgacctgacagttcagacatgatgctgtctatgcaccacatgacaaagtctcccagggcatcaggagatctctgattgatccagtcactcgctgtgttgcgaactggttcaggaatatggcacaagggaatctgcacaatatattaactagttagatgcaaatctaaaaatagagagacacggaaataaagggacattttcatgcttataaaatcaaaacagaagtactagaatccattaatacactgaattattaattgcacgagtatgtgtcgtttcttttctggaatgaaacatattgcatatttatcaagcaatcgcttccgatttattagaggctaagaaattccatgctaatccaattaatgtgtaccctgatacacccatttactcctcatactacaatccgcaccaaccccccaccttccaaattaacttgcctccacgcctccccctttcagagcggaaaatggaaggaactgaacacaataccatgtcacaaatacagaaagatttttggacaatgcggatttcaggtaaaccgttaaatgtaaactcaagttgttgcagtaattgcattgaacttatccagctgtatcctgttatacatgaataatcgtgttcggaaataatttgttttaattgataatgcatccacagggtgagcagaaatagcataaccatccttaaaactagcatacttgacaagcacgtttacagcgacgtcaagtctgcaaataattcgaataatattactggcagttaccaaaagcagcattagcatttcacaactcaatgatgacgatgcatgaatcagtatcaatgttcatgcacaaccattaattttcgtaaaatttgtaagtagatacaagaaaaagatcataagaacttaacaatcagataaaccgcagtaacatttcatatgtgatgcaagtgaatcaccctataaactgcaattgcctttttatatctggtccaaatgcaatatctctatgcgtaaaagagttagggcaactctagtaactcacatcaaccatcttggacactagtgattccttgaacatcttcgcccaggggaactgggcggcgctcacgcttgcaaatgacctgccaaagtagtcggcgaaccgcatgagctgaatatcctgctggttctcgtaagattcctgcacacagaacagagggttagaatctacggaacaaaacagaaaagagctatgacacgttaaaagatctaatagttgcaccaaaacccccatgctttccaagatcccaagatcccgtgtttttacatcaaggagatcccaactttctggtacgaccagaattttcctccatcttaatcgaaaactagtagacacccaacattttgtcggaattttgaaaaaacccgaacgatccagcactaaaccctcatcagatccgatccttaacaaaaagacaaaaatatgatccagtccaaacaagtcgagatctgacgatttccgaagaggaattcagcgaaacaggacgggtattaccgagatctgcacgagatgcgccgcgaggttctcggcgtcgatcagagcggccgcctcggcgaccgtcaccttgggcttcttcggcttcttcaccttgggcttcttcacctccccctcggggcgagtcgcctgcgcctcgtcggagtcgtcgtcgtcgtcagagtacgcggaggccgtggcggcggcgatccgcgcggcgtcggggtcggccgcgtccctggcggccaggagcgcgcggtggcgcttctcggcgttcctgtcgacggcctcgaacacgttgaccttgccgccgccgttgggcaggaaccccagatcgggagcagccgcggagggcagcgccgccgccccctgcttgcggtggcgcttggggtaggtgaccttctgccacccgtgcgaggggtcggcgaccacggcgtccatcgcggaggaggaggaggatgagccggcgaggtcgtccatggccatggcgagtcgaggtgggcttcgtggaggcgagtcgaggcgagagcgatgagatgagcgagttgcgcgaggagaagaggagacgcgggggattttattcccgtcgacgcgaacgcgagggcgaggcgtgtgtaaaatctcgctggttttctgtgtgctgcctgcgccacctctgtgtctactacccactttggtgtcacgtttgtttcgggctcttctctctctcttttttttctccttttccgatgtaatgtaatcttcttccccgagttcttgttggattatttttttctcactttttttttttgctgctgctccttttttattcaggtgagatacctctggatggattctgttagaccatgatgatgtggatgtgagtatacttgtaaatggatgggataatattgttgtgtatatatggcactatgagcacatttttgtctgtcggacatattgttaggtttcaccggtttaccttctcacatgttaataaaaaagctagggttnnnnnnnnnnnnnnnnnnnnnnngtaaatataaatgtggatataagttatggtatctcagattggataatacgatgcgtggcattactagttttctcctcgttcttaccccttataaaatactaagcatttttaattatgggcgggtgaaatgtatgattctgacgtgaattacatggcatgaaaaaaaaaatatcgtacgttaatattgcgataaacggtatatggattttttttaactagtggtaaatacatgaagcgatatgtgaacatatggttgaatgtcaaattacctatcattaatatataggtggaagttgttggaagtctattagtactactagagatgagagagatgatgttgacctactgtgatgtgtcatagtagttggcatgcctcactttcctatagcaatattgatttgtccaattttacaatacgtcgtgtgtgtttgttgattatttattattaataaatggtaatgttgaaaagagttattccttcatgtatagctaacagagttctctacgcaatgttatgatataagtacaattgtacttgatatacatttttacttataaatagcacattgtgccacctttatctcataacgagggttctccactgtttttttttccttttttcaatgttgtagttgtccctgacttcttattaaattctgatattgttatgtggagtagctctatttcaatcctgttgtacttcgaagatatagatagacataatgagaatgatcatatcaacgataaaaatcataaatgacacaatagatgtatacatttttgcatattcgtctttgataagttccacgagtttacctttttaatcttggcacaaatacacaacgcaacataaaatttccatgtgatcaatagcactttgatcttatcccaccttatcatagtgtattgatttatactatatatgtagtactggtatacttatgatctacctaaattgtccacatgatattatcaagggacagatatttccatatcacacaaaattaatttattagaataaagttgatttgtcagattttcttttttagctttgcggatggatatgacgcatcatggtcagataagatcagaaagggcagctgcaaatgcaatgacatcatccacggaccgcacctactactctgcctctctctgcagagaccaccagtccacgtgtgcaaatgtgttgggccatctcagaattggatcaaggcccatcactctcgactggtcagataggcccatttcaacgtaacgactttgttgggccgaatgagagttgggccgaggaggacattgcgaatttattaggcaaccaactaaccaaccaaccagtaacagtattctgattctccatgaaccatctccatcactgacagaagaagtgtcaaggacgctatggaagtctgtccgtccatgtgctgctccagcaagcacaggacgccttttttgtttcgacgaaaaaatctgaaagaaaaggccaacgtcaacattgacatgctcgtttttcgttcttttttttttctggaagaggataacaaagtcttatcagcagttttgtttctgttccgcagcaacgaaacttcgatgctccatcagtacagagaaaggaccatttgggtacctggattggacaaaaacagatttggtttcggctttaaaaaatactcctatcatgtgggcttaaaactaacatggcacttttctgcggattacttgctaagaataccttaaaaaaagaatttacttctattttttagatgccttcttcaaagctctttgtcaagcttatttaccaatatatatattttttatatttataatcacttagataatccactataaacatacggatctgttcaaaaacttaaccaagcggatcatcctcaactcatgatgattttcagctgcttaacacaatttctgtccttaggctattttgttttttcacggcaataataggatgtgtttatgggtttttttttgtttggtggcatgcttctgcacatattttggggttgtttgaaagtgttggatatagctgttgtagcagccagccaacacggttacaggcttgcagccagcgagttgttatgaaacgtgcatcaaagctcattaaatgaatgccgtagcggttatacgatgtacattcaaatgttgcgtcgagagtccgtgctgtgtagttgtagttcaaaacgttgtagcaagcacttttaaatagccccaaggtaattaatttttatagccccaaggtaattaatttttatcactcaataataaattagtatgttaccaaattgttggcatgttgtataatttgtctcgcgtatcacttaccatatatacactttatgacacttgctgcactttaattccacccatacatcaattagactaccgctaacaaaacaccacatgcaccaaaaccttaatcgccatgagtatagcgaatactctaaatcaagaatcaagacgatgtgttgtgtctcttttggcaccgaaaactctgatggtgaaaggtagggagagggaacaactgtgatatgatgacacaagcatcaaattcaggtgcggtgaattatgataattgagaatttgctttgggtaaaaggtgattgcctgacagtaagttaggaatttgtttactttcttaaatgtaattatttcgacagtccatagctctaagtttgcaaaagagattttcctaagctaaaacttcctagtttcgacagtcaattcttttcttctaaatataacagtgaaacaaagttccaccttaggtttaaaaaaataaaaaacttcctagtttttctttgttcgaaccatgctgtacatgcttttctaccatgtgcgtctcacaatatgaattccagacggtaaacctgtttaccgtttacaccatggggaagaaaaacccagagagatggtcaaaatttcgttaaagaattatcaggaaaaagaacacaaaagtagtactctcttcataggatggaacgcttcataggattatgaatatggacaatcccaaaatataagtattttaaactaaaatgtgacacttagaacctgtttagttcgcgaaaagaaaatttttgggtgtcacgtcggacgtttgaccctcggaagaggttttcggacacgaatgaaaaaactaatttcatagtttgcctggaaaccacgagacgaatcttttgagcctaagcctaattaatccaccattagcacatgtgggttattgtagcacttatggctaattatggactaattaggctcaaaagattcgtctcgtgatttcccccctaactgtgcaattagtttttttaatttatctatatttaatactctatgcatgtgtctaaagattcgatgtgatatttttgaaactatacagggtcttagtttggttagattctacagagtgtttttttttttgaaacctaaggcggaactttgttccacttttatatttagaagaagagaattgacccagtttataaggaaaaccgggcctgaaaaccacacaattacacggttaattatagtaaaaccggctgaaacccaccgctacacaactaacaacgacggcggagcccaaaagcaggatgtcaccgccaagctaaacacaaaagcgacataacaactcccacatcgtagaagaggtgttatcattgccgagctatccgcccaagcgacccagcagcgccgacttcacaactgcagcgacactgaagacacgaaagtcgccaaagcgaaaagcagctctgacatataacaatggacatcagccaagccatcgaggagccacttccttcacgcggccagcaccagaactccttggaagagacttgtaacatcctgaaaattcaagacaataaaaatcactaaaattttgaactttttaaaacttttacatcatgctggttgttatgattgctattgcttgccaaaccgtaaatgatcacaaagaaagtaaagtaaggatctaaaatttaagtaatagataaatttacgagaatataatattgttaaccctacaaataattacgcacaagaaaacaaagccagacaaacggaaggttaattactaatttaaattatggattaaatactaaatacgtgaaccatgtgttgcgtgccatgacgtctaaatacacatgaaatgatgaccatttataatggaactctatctataacatagtttcactaggagtaattaatgggatattactaaactctaatggtctatatatataaaggtaaaccaattcacatgaaataatggtcatataattaaattaagctttataaaattttgtgaggttttaattaaacaattagattaatattgtgccgagtctcaatttactatttatagaataaatagattgaacctatccgtgtaaaatatattgctatacaactaaacttgaccaatctgctaatgtattaatcatgacaagtcgttatattaaatttaatagtaccccaaagtcttcaaaaatatataagttcaccttagggccaataactcaaattaatctaaaaagaattcatttgtgcgataaataaataaatatgggtaatattaatctagggtgaatccattggttagaataacacaaatattgagtaaacttcatttgtgtaaaaattaggatttatagaataaaatttatataggaataggctaaaatagggttaaatagccggctagcactgttcattagccccctaggtgttcgatttagttcctagccgtcctacccctcctccttctcctgcccgatgccgctcgtgtcgccatcgtcgtcgcccgcgccgctgccgcgcgccatcgccgtcgccgtcgagccgtcgccgtcgccaccgcgccgtcgccatcaccgccttgagccccgcgcgccatcgtcgtcgtcgtcacgtcgtcgcctcgtgccccgcgcccctgccccgccgcgcgcccgtcccatctcccctcccgcgcgcgcctcgcgcctcgagccgccgcgcgccgtcacttcgccgctgccgcgcgcgccactgccgcgccccctcgcgtctcgtcgtgccgcgcgccgtcgccgtctccggtcgcatcgcctcgagccccacccctccgcgcgtcacgccccgtcactatcgcgtcgcccgtcgccgtcgtgccgccatcgccgcgcgccaagccccgcgccgcgccgcgccgtcccatcgcagcgtcgccgtcccgtcgacgctccgccgtcgccgtcgcgtcgcccgtcgccgtcgcgtcgcccgtcgccatcaccgcccgccgagccccgagccgtcccgagccgcgcgcccgtcgccgtcacgcctcgcgcctcgcgccccacgcgccgcgcgccgtcgcatcgccatggagccggccgcccctcccccgcgccctataaatcccctccggtcgcccttccatcccacatcaccccccctccttcccctcctttctttccccctttctctccaccgcgccgccgccttcgtgccgccgcgccgtcgcctcgaagccgccgcgccgtgcgtcgccgccttgcgccgccgtcgccgccgccgccgtcagtaagccgccgcctcctccccttgctcggtcgccgtcgccagagagccgagggagagaggagggagaagaagccgggagggagagaaagagataaaagaagaaagagagaggaaggagaggagagattagagtgggccccacgtaattggtgaatagtaacccccttcttaatctttattagtagtgtctattacatgtaggtccgggtggttaaaaatctaattatagaagttttatggtctcgagtctatgacatgtgggccccacttgtcattagctcttcctatttccctttagaaaataattcggtaggaaaaagaaataaacccggggtcccacttgtcagttggtacaaggctgtggatatgtcttggattaaaaataaatcatttatgaacagtagcttttcgcaatttctcggattaattcaaatttgaatctttacactagcataacttattcattttaacttggatttgagtgaaacttgaacctaaattcatctaaattcataagctttccaatgatatataattcagtatttaacaaaatatatttataattataaattaattaatatcaaatgattagataatagttaacctaaatagtgtgccaatgaataaaaatggatattgtacagtagcataattatctttaacatgtcttgtcactgtagcaactaaataaattagttataatcaatccttcaaattaatgggtgtataggaaaatattagtgctatttactggtctatgtccaaatataactaaatccatgacttataaattgtttacataaagtttagcctcatattttgtaactaaaatataaacacacatagatgaatctttaacttgtttaggagagtaatcatagagctagttgtatttggaccacttaaaaatttgtcgatacaatgtcatgtgaagtagaatatatgtatatagtcggttgatatccattagttaaccaaacagagccatcttaaaatcaacatgtattgtatagcttacagtaaaaagcaactactcaaatatatgatccaataataagatattgttgcttacacatatactatacatcccattatagtggtacggtatagtattaatttgcgtgttgcatatattaaattaagagggagtgtatgacaaacatgtatattagataaatactagttataaatcttgacctcatataattataattatagttcaactgtaaattaggattattcattgtaaaattatgtgatgggataatctgtaaccataatatgattaacctaaacaactctaacatacaaagcatggataattattaaccttttataatttattgtgacaagtaaaatatgttcataattaaagtaaagcttccatcaataaaataaataatacaaatgattcactgtaattatttgattgatcctaaatccatctaacaacagaacctctagtaaataaccgtcctatgtagatagatgcatgcttagccataatccttccatagccatttgatagactaaaccaccgattagccaaatatatatgtatcctataaatgctatgttggttaactcctaaataggccacgttgacaatagaaagattaagaaaccttagcccctagcgtgattggaatccattagaagacatgaatagtatattttgttgtgcatatttggttgttatttgaatattggtttttcttgcgtgttatagaatttatgtatcggttagtcgtgaggcaacgtcagcaacttccaggaggtgaaggttgatcaagaattatatcaagaataaggactatcctgagcaaggcaagtcatcactattccttgaacatgttgatcccaattgcgaaattgttttatttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacagaggatttgggtggtatctggaaaaggctagtaccgtccccggtcaattaaggaccgtgtcggtgacatggggccgggggtatcgtgactagaggcctgggtagccgcggtcacccacgtggcctgaccccctcgggggagtcgggcccgaaggtgacgtggccacccctccctctgtctccccgaggggtcgggccgctcccgtttcggccccgagggctggggtgccccgaccccctgtggttttggcgccacgtgtgtgggttaggtgagcacacngggctcacctaccggcatttatagcaggttggacgagcgcgccacgccgcatttaatgcggcgcagcgcacgcttattcggtccgtgaccgatcgcggtgagtgaccggtcacagaccggtcagatcgcgggttaggtggcaacaggcggcctgccacacgcctcgccccgtcccgtcggaatgatgagatcttcctagctctcgtccctagccggagccggcgtgccaactccaggagtgggtatgtcagtcccggtcagattcattccaggcttcagcgcaagtatgacaaggaagtcgctggccattaaatgaaggttgaaatgggcgtccaccggaagaggggcgagcggagcaagagacgtgcgctcggcttgtcagaggtcacttccggctgtagactagccctcattgtaaaagcatgtttcctttcttaggtagctagaggcccatgtggtgacccctgaccagataaaaaggaggcccaggcctaaaaaaaagggaggacgaaaggggagttgggactctggcgaatgttggctagaacctgaactctctctctcgctctcgagtctctggattccttcacacacagatccaccagaacacaggagtagggtgttacgcttctcagcggcccgaacctgtctacgtcgcccgtgtcttgcgcatttcttctctcgctgacgttcctcagatcgagggcgaagaacctcacttagcgcccccggccgaaccggcaaaggggggcctgcgtagtctcccggtgaggagccccacgctccgtcatctggcgcgccaggtagggggcgcgcgtgtctttctaagccctcgtcctctttcgtgtgcgccaagcttctcccgctcagcccaatggccgaacgggcaggggcgcacagcctctctccgaacgctagcggtgacgacggggagcagaacccgcgccgtcgggctcgcaccccaccgtccccctctcgccgaaatcttgggcggggggaggcgctcggggaggccggaggatccgcgacttcgccgcccgcgggcgacgggggaggacggcgagacggggcgcgtcgccgcctcgtctacggcaatggcggcacgccccagggtgcgctccaggctgcgggcgcgctcctgcgtcacccgcccgtcgtccccgatccagagactccagctcggcgttggctggatgatgtggccgacttggtcatgacggcgcagcagcgcctaggcgccggcgggcggtcctccgccaccgagacctctggcgctcccgccgccggctccacgtcgtcgaggcggagggcgcggcgagcggcggccgttacccgccgttcgtccgccattccctcgtcgacgcctccgacccaaggagatatgcgtggggggccggatgcccgcctcgatatcgagcgccggcgcgacgctcgtcacgccgcccacgcaatggagggcgcttcctcgtccggagcgccacttcggtccgggcacgggggccggccccccgtgtccccggttggcggtgccggctgtcgagcctttgtggcgagccttcggaacgtccgttggcccccaaggttccggcccaccgtcaccgaaaaatacgacggaagcgtcaaccccgccgagtttctccagatctacacgaccgggatcgaggccgccgggggcgacgacagggtcatggcgaatttcttccccatggccctgaagggtcaggcgcggggttggctaatgaacttgccacccgcgtcggtccactcttgggaggatttgtgccagcagttcaccacgaacttccagggcatatatccgcgcccaggtgaagaagcggacttgcatgcggtacagcgaagggacgatgagtctcttcgctcgtacattcagcggttttgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggctctggtgtgacagctccggccgcccccgggtccgccactcggtcagagcggcggaacaggaggaggaagaaggggccggcccgttccgacgacgagggtcatgtcctcgccgtcgagggcgcttcgtgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagcttggctgagcggacgaggaagtgggaggaggagaagaggcaggagcgccgtgagggcaagaccccggcggctcccgccggcaaccggcgaggtgaggccaagcagaaggccaccgccgaggacatcaacgatggcgacgatgacctggggttccaggagcctgaggccaccgtcgccaccgtcgatgggggagcgtgcgctcacgcttctcgccggagcctcaaggccatgaagcgagagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctacaacgcggtcctggggaggcccgcgttggtgaagttcatggcggcggtccactacgcatatctccagatgaagatgccgggccccggtggccccatcaccgtccatggcgacctcaaagtcgcgcttgcttgtatggagcagcgcgcggaccacctcgccgcggcgtccaagcccgcgggtggcgacgagaggctcaccacctccgtcccggccgccccaaggcagcggatggtcacgtgcgacgaggttccggtcaaggaggttgccctgggcgacggcccgtccaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtacggccgggcgcaaggccggtccggcagaaagtgcggcggcaggccccggaacgtcaagccttcatccgtgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggcacgtcctaaggacccttaccccctgccacgcatagatcagattgtcgactccactgcggggtgcgaccttttgtgttttctagatgcatactctggttatcatcagattcgcatggctagggaggatgaggaaaaaactgcattcattacccccatagaaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcagatctagcggaaactttcgaaagtctccgctccgcccgcataaagctgaaccccaataagtgcgtgttcggcgtgcctgcgggcaagcttctcgggttcttggtctctgcccgaggcatcgaggccaaccccgagaagatacgagctatagagcggatgcgccccccccagcaagcttagggatgtgcagtgcgtcaccggctgcatggccgccctaagtcggttcatatcgaggctgggagagaaggcactgcccctatttaagctcctcaaatgctccgggccgtttacctggacggaggaggctgagcgggccctcactcagttgaaggcgtacctcagttctcccccagtcctggtcgccccggagccagatgagccgttgctactctacctggcggcaaccccgcaggtggtcagcgcggcgttggtcgtggagcgcgacgaggacaaccctcactccgcgcatccccaccctgcgtcgactcgacccgggagagagcaggcaggagaggcccccgagccgaacggcggcccgaggcccccgacggccggagctggccctccgcctgcttgtccgacggtgccaggcgcccccgacccccaggatggccccggggccactgcgggaaggccgcgcctgtcgccctctgaccccgaggtcgtcggcacagaagccgagtgcgccccgcgtggcctctcggacgaagagcgccctggagatgcggcccctggcgaagaggatcggccccgccgaaaggtgcagcggcccgtctacttcgttagtgaggccctccgggacgccaagacccgataccctcaggcctagaagatgctttacgctattctgatggcttcgaggaagttgcgccattatttccaggcgcatcgggtcacggtggtcacgtcttaccccctcggccaaatcttgcataaccgagagggtactggacgggtggtgaaatgggcaatcgaactctctgaattcgatttgcgctttgaaccacgccacgcgatcaagagccaggccctcgccgactttgtggcggagtggaccccagctcccgagcccgtctccgcccccgaggccagctcgggcccctcgcagctgcctcacaccgcctacttggtgatgcagttcgacggctccctgtctcttcagggcgccggtgcgggggtcatgttgacctcgccgagcggagacgtcctcagatacctggtccgccttgactttcgggcgaccaacaatatggctgagtacgagggactccttgcgggactcagagtggcagctggactggggatccgccgcctcctggtgttaggcgactcccagttggtcgttaaccaggtctgtaaggagtaccggtgctctgacccgcagatggacgcttacgtgcgccaggtgcggcgtatggagcgccacttcgacgggatagaacttcggcacgtgcccagacgggataacgcggtcgccgacgaactctcaaggctcgcttcctcgcgagcccagaccccaccgggcgcctttgaagaaaggctcgcccagccgtcggcgcgacccgaccccctaggggagacggacgcgcctgaacggcccccgaggcccgtcggagtccaggcctcgggatccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgtgcggctaacggagtcctcctgaagtgcattcctcgggaacaaggcgtcgagtttctcgccgatgtccatgaaggcgagtgcggagcccactccgcctcacgcacctcggatggcaaggcctttcgccagggtttctattggccgacggctctcaacgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatccccaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccgcgcgctaccagcagatcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctcgccacgggcgacggcacagagctgcctaacccgtggaacatcgagcaccttcgtcgcttctacccctagtgggggtcgggtatcatgtctcgggctcgggccaaccccgcaccccccgggcgtgcagagttggccgggggctaccacatgcatatacttaccttttttctcttccgtatttcaataaaagcattttcgatttcttgaggactgtgtctgtgccatcgttttccttttgaagaatcttggcttgaattagcacgctcgtgctcgaccttgccctcggcggcccgggccagctaaaatcgccaaacggggcccagaaccgagccgtgccccggggcgtggtgaacttcgggggggaatcggcaaaggcccacaatcgggtcatccataacccttggtcaccgcgctcccggcctggccagtctcgacacgtggatctccccaggcactagccccgacccgcgccgtttgaggctgggacctgggcacgagcccttgttcaagccaagacaaagaaggaccgcggcacagaccatcctcgtctcatacacacaacaagcagagctgacgcagaaatttcctctttatttgattacagattaaatcagtctatacaagaagggggcccgaaggcctcggaagaagaagcaaaagttattaagattggcgggggcctgggggctcactccgacgcgcccgggacgtcggcctcgtcgtcgctgtcgtccgcaccgtcgtcactgccctcctcatcgaagtcgagcgcgaacgcgagccgaggggccgtaccctcgaagctgtggacgatatggtcggtggcgtcccggaccttcgcgcgcgcgccgtcctcggtcccgggagggaactcttccagcgctgcccacggggagaagtcagggtccctggcctggtagcttgccagtacgagctccaccgccccccgggcgaggtccctcgaggatgacttgatcgtctcctcgagctcctcggggagtcgctcgagggccccggtcatctctgagaggcgctgggcgaggcccccctggtccggctcaaccatctctgttccccattccccattccccattgtctgcaaaaccctagctcgccgacggcgatctcgacggcaatcgttgcagcgccggcgacgacaacgggggctatggatacggcgccggcgacgacgacccacgatgtagaagttcccctgaagatcgcaagttcacctgcgacatcatcgtgcgcagcgaaattgccgatggaggggatggatctgggaggctcgattcctcctatttcctcgataccgtgagtaacttgaactcgaatatactccttggatagctgatgtagaagtgcattgggtatttcatcgtatttacatgtagattttcagttgatgttctctcctttcatggtaggcactggttttcagtagaggttagggttggagcttatgtcatgatagaaacagatggtaggaaatcttacacgaaaggagctactcggcattgggttgtggattcagatagcttttccatggaatttctgatgaatactttaagtgttgagttcacctggggaacaaatcaatctccttcaatctggtttttgcacaaggcgattggtgaggatgttagacttgtggacaatagtcagctacctgacctattcgaaatgtacaaaacagagagccaattcaatcttattgtttcagtgcttgacaataagatggatggtacatctgagcctttatccacccttgtcgagaatgaagtagaacccatatgtgttgtgcctcctgacaactctgctcccatcattggttctgaacagcccgctcccaatgttgaaggtgttgaaaagcctgcaatagaggaagaacctgttagagaaccagacatatttgacaatgaggaagaatatgtgggtgtcgatgatgagcatttgtatgttccctcacaacctaaaaagcctccacagtttgctgaacccgatggaaacactggcactggtcagtcttctcagcctcctgttgcaggggtgagagctcctgaggagtaggttactgatgaagatccataggtctttaatgtcatacgtgaccctgagaatccaaaaatagagaaagatgcattatttcctgatataattgctttcagaaaagcaataaggcactatgcagttaaaaaaggttttgtgtttgctggtttgaagacagatccaacacgttttctagcccattgtgctgctgaagggtgtccttggcgtgttcatgcatcaaagctacctgggaccaaagtcatacaggtgctatggtttgcttcatttatttattttgattaggcttttgattatgtttgtgtaatgcaattttgttaattatacatgtttaatgcagatcaaagttcttccctttgagcacacatgtgcatctaccaaattgcaagaaaacaagatggcaactcaaggttgggttgcagacaggattggggattgggtcaagaaaaacccaaaaaagggagctagtgatgcaaggcacaagcttgaagaagattttcagataaagttgaagtattcgaaggcatggtctgggttcaagtgtgcattgtaacatatacatggtaaatatgaagagagcttccaatttctttttaattggaaatctgagatggagaggaagtccccagggtctattgtagagattgatgtacagaagatagggaagaaaatgtgcttcaagaggatgtttgttgttctgaagccttgcatagatggcttcctcaatggctgcaggccctatgttggtgttgattcaacaagattgacaggtaaatatactggtcaactagctgctgccactagtgtagatggacataattggttgttctatgtatcctattcaatttttgactctgaaactgatgaaaattggttatggttcatgagacacctcaataaggccatagataatccagagggcctagttatatcaacagatgcttgtaagggtttggaaaaagctgttgatgctgcatttgaaaaagttgagcacagagaatgcatgaggcatctctatgctaacttcatgaagaagtttcaaggtcctgccttcactgatcacctgtatccaactgcaagaagttatactgaggatggatttaggtggtacatgcaacaaatataccaagtgaggtctgatgcaatagagtatcttgagaagcatcactcaaggatttggtacagatgtggcttttctgagtctagcaagtgtgactacctcacaaacaatgtttctgaaagtttcaataaccagatcaagaagcttaaaggtctgttgttgcatgaacttgtggatgggatcagggagatgatcatggagaagatggccctcaggagagaagttggtaaaaagcttgtggatggcatcctgccaaatgtaatgaaagaattgaatgatgcaactgtctgtctcagggtggtaaaggttgttagaagcgatgaaggtttcgcagaagtgacacttgttgagtctgacaacaacactagaaggcacacagttgatttacagaaccaaaactgctcatgtagggtatggcaagttgaaagccatgcaaacatgcattggcctggatttgcactaacagaggtcgaatccaagattttgtcagtccctactatagtgttcagacctttagagcagcttatgcagctagagtggcaacaatgactgataggtctcagtggccacatgtagatcttggcttcaaggtatacccacctaggtagaagagaggtgctggaagacctagagtgcaaagaataagagattgtttagaacaacctggcaggaagagagttacatgcaagagatgtcagggttttggtcactttgaaaagatatgcaaacttgctgagccagttcatcaagatgagcaaacaatccagccaacaaccaaaaaaaggtaatttggacttctttctatttagtccacaaattgactacctcaaaacttccctaatggtactatctgtgtgcaggaagagacaagtggctgaagctgcaggtcaggccgaagctgcaccagtcaagaagaaaaaccctcctaagaagaaaggagtgcctggagctgcagctgaagcaagttcatctgcacctgtcaagaagaaaaatactcctaagaagaagaaaactccccagaagaggaagaatcttgttgcttctactgctccacccgctagagtagttagaaaattatcagactaggttggtctgtgatgtaaaaacccaaacttgtttattttgctgcttgtagatggccatttggacttgttagatattggccatggtaatgggctccaaacctgaaatgttctgtcttttgtgtgctgcatgttggtctatgctacactcctgaacaagttatgtcagttgctacacttctgaacaagtttatgtcagttatgtgagcaagttatgtcatttatgtcagtaagtttatgtcatttatgtcagcaaatttatttcagtcaccattgcacataaacagcttctatgttaggcagcagattatttgcaccagattccaaaatatagcccttgcattgcattccccaacttgcacaaacataaatacacacaccagatttcacacacctaaggtacatcacaatatttcacacaccagacatcacacagaacatctcctaaacctgccttatcattacagcaactaacaacacatagaacaagatcatcatggacacaattgtgcgagtccaagccttctcgcactccaatttcttctttaagtctgcacaccccaacttggactgattcaaagcttcgtaattggcttgcaactgcaactcttttgcctcagcctaggctgacaactgacagatatgcatgtctttgatctgctataaactggcgcaaactgtcgcatgtctctctaagatagtcgtactcgtcagcatgacagtaagcgaccatctcctcaacgtattcgttgagatcttcccaaatccacaaggcacatctacaattctacaagaaggaaaccagattggattcagaaagaaaatcacacacaaatatgcacaagtaggactggattctcacctccccaggacactgcagccaccgccgccttggattccttggtgtgttcgatgtctgcaccgcagcggcatgcccacaagcacatttcagctctgggattgaaggagccaccgatgggactctgcaccttctcgaaattgcagagcgaccactgccactggtatagctcgcctccaaactcgttgccgcgttgatccgtctacgccgggagaagctatcggtaaagccgccgccgtatccctagcccccgtcgtcgtcgccggcgccgtatccctagcccccgtcgtcgtcgccggcgctgcaccgatcgccgtcgagatcgccgtcggcgagctagggtttgcagacaatggggaatagggaatggggaacagagatggttgagccggaccgggatggttggcttgtatcgtctcagccaggggcacaagcgtccatacggaaatacgtgcgaggacaaatggcatggatggcaattcagacgtatataatggcatggttccaatttggaagaaattgcgatggcacccagccggttttgctaattgtaatggcatatttccaaatagctgaagttgtaatggcatggttccaattaacccaaagaaacaaacaagagatcgatcaaaaaaatcagtcgcattccaaggtactacggagtaggagtacaaaccaatgagagccagcgtggcacagaagagcgctgcgccgctgacgattgacgaacacgcacgagcccgattttgacgcgttcgttccctcctgtcccagcacactgaaatccactactacttgattctgccgcccaatcgcttccagttccaacaaatcagagcccccctcaactcacaaaaaataaaatttcccccctttgtcccaccctggttcttggttcttggagtttatagaatcattccaaacttgcaaagtttgacctctgccaacttcccctcttggaggaggcggggaagaacagtcgccggcggggaaggctggtgatttcgccggatgcggttgcggcggattggatcggaaaggaggcatcttggaagcagttcgtggaattcgtagcaactctgaagggggaaagctgcagttttttcaactcctccctattgcgtgcgtggagtggagccacctcgccttctccgcctccggttagccttcgcgactctccttctctgctcctctcgatctcctgtctgcttggcctcacggtgtctctgcgcgaatcaatctccatgggtgcagggacctggccatagcgttggcgactcgacgggtgaggagttcttcttgactgggttggattggagcatgcagtttattctactcgctgggtacacgtcagtcagtgttaaattgcagattttttagcggatttttttttacagtttacaggggatctatttgggtttcatggaggttagcatttgggttgtcaagaacatggatgtgtttttttcctgttcgaatgtgacgtttcaggctttggtggctcctatgctgcttggttgttttcacaagaatttcttggccagatgtgtacgcacactgtaatggttctgcggcttggacttctctctctctctcgtttatgtggtccagaactagaacgaatcttagtggtataatccagctgttgactttgttagggccatcaattgggtcaatttcttgtttattcgtgctaatagaacacgctgcctgaaagaatgaaaaatttggaggttttctcttcattgttccattctagaagtggtgaaatatctcgcaagtctgggagcaataggtcgcaatcatacatgctttatcttaggtgtctatcttgctgtggccattaattggaaccaaaattgtaggtggacaggtatccaatacccacagtgcaaaaggggccagtgacaggaactcgggaagcagtggaaacaaaggccaaaaaaaacaacaaaaggtatctgcatcaagctctgtgtggttatcagagaagagagctttgctgaattcacagagcagcagggaggagagatggcgaagaagaagctgaagaaattgcatgccaaggatgcactagaatttttcaaccaggtcatggtggagcagcccttgctccccttcctggtccctcttgtcttgtttgcatggtttgttgaacgatgggttgtgccattctcaaactgggttcccctgttggctgctgtatgggcaacaattcaggtagtttttccttcccatggtattcatatggataaagttgttctttgatgaatttggcttggcttctttgatgtcctgctgaattgtcagacaaatagtccttttctaggtgttgagatagtactaatttactgcaagtattgcttgttgcttggtttggaagtgctgatctattcttttgagttgcagagtgttcataattctgaaaagaataacacagagaaacacctcgccccactttctagagtttattttgtcttcttactatttttattttaatgatgaatgcagtatgggaggtttaaaaggaggtcagccatagaagatttgaacaaacgatggaagcatcttatactgaatacaacagtatattccttcacttatttttttttgttttgctctttatacatgaacttttagcaataccccttttgtatctcttgtagcctacgacgccaatagagccttgcgagtggttgaacaaacttttggtagaagtttggcccaattatatggaaccaaaactgtcaaagaagtttcaatctactgttgaggtcagcttctgcacatttgctagataattttatgaatcttttgagcactaggatgctagaaaatgaaggtgctatcatttgtgaaagtttctattacgtctaatagtttttgcttggatgtaataattattggttttaaaagcttttggaaatataccttttgagtttctttggtgatgattatctcaaaataaaattcattagaaaatttctcagcttgttgtaaaacaacaaccatgtttgttgcccaattgttttaaccttctccaatcttaataaaattggctggggcacttcttcgctgccggcctggccatttttttttctcagctccattgctcctatttatttgttgtagtcaaatagtcaatatgcattgcaagatatggtgcacactggcttctattctgctttttttataaccagctgaccagtgagtgttctctgaatttgcagaaacgtttaaagcatcgaaaaccaaaactaatagtaagttctcttaaagttgtttatcctctcctgctgctattctgactgtagtactaatgatttgcttttatatctctccaggataaaatagagttacaggaattctcacttggttgttgtccacctaccttgggggagcatgggatgcgctggatgacttcaggtgaccaggtcagatattaatattctgtactgtgtatgggatactcacctgtggtaaacttagagagggaggaaatcattgcctcaggcactgatcattattgaaagaactgcttatgctgtttttagttctacagaattataacagcggtgatttagcttatttgctctgcttcataaattccgagttgtgctgttttgggtactagtttggttaacttatccttacatcattgaaaacactaacgaatgcagtgtcatcaatggtttattcaccttttctgattataactatgcatctgtataactaacccatgtgttcttccattatctgtaactaacccatgtgttcttccattatctgttaggaatatataacatgttctgcagctcttcctgatcctgcatagccttagtcattagttgttccatcttgaacaatattatgttgtaagtaggagaggcagatgaaatacttctgttggttgtacagttgcacacttcaactctcgttttttgaacatgcagaaagtcatgcgcttgggttttgattgggacagcaatgagatgagtgtaatgtttttggcaaaattagcaaaaccactgattggcgctgctcgaattgttataaacagcattcacatcaagggagatgtatgtcctttgctctttcaattgattctgttacattgttattgttattgttattgttatttctcatttatcttgatttgagagagacttcttttgaattggtaagcaagaattgtcgccagctttgctcactgagatcgcaaagctgataatgaacaatcatgatgaacaaaaatggttttggcttttcggagtcattcctgtccttaatggttgacataggatattatgatgtagttaacctgcctctcacataggataaagtggcaaccttattttgagctatttcactttagcgttttgttgaaacacaataaattttgtgtggataagaacttggatcaccacttacgttaaaatcttttatttgctttcttgtcctgagtattatatctgtatttgacgattattttcttgtctaagcgcattttctagttggctcatcagattaagctcttattttcttcgatttaaactatatctttgcagcttctactgttacccatccttgatggtgaagctattctttattcttttgaatccactccagaagtcaggataggagtggcatttggaagtggtggaagccaagcagttcctggtatggagctacccggtgtctcaacatggctggtgggtttgtgtgtgccatttagttagtccttggtatctttgcaattcttttagtgcaattacggccattgcgtattgaaatttgaatgctaaatgtgatgcttcatgagccatgcaggttaagcttttgaccgaaaccatagtgaagacaatggttgagcctcgcagattgtgtttttctttgccaccagtagatttaaggaaacgagcagttggaggtgttctttcagtcacagttgtttcagctagtaacgttgggagaaacacaactaatgaaatagggatccgccaaagctcaagtggaggttctacatctggaattgctgataacaaggtatcacagacatttattgaggtagaagttggtagtttagtgagaaaaacaagtacaagcaagggtccaaaccctgcatggaatagcacatttaacctggtattgcatggagagacaggtgttgtcaagttcaatctgtatgaattggactctggtggtgttaaggtcacctacttgacaagctgcgagataaaggtatgacagttaaacttattattttagtcagtttccattgcacatgatgcagttgtggttcttccaacacatctaaaggatgctgatgaaagtaatgtaaacaggtcaagtatgttctagatgattcaacaatattttgggctataggacataattctggtgctgttgcaaaacgtactgagctttgtggacaagaagttggaatggttgttccatttgaggacatcaggggcgaggtacatctctatagtaactactgatgtgttgtcactgtttctcttgcatccaaaacctgttttggatatgctgtaacatttagaaaaatggattcccaattgattgaagtgctaattagttttatcaagccaccg

SEQ ID NO: 45627 - DNA, 10996 bp, Oryza sativa
gtgaccagaaatgtggggttttgatgatgaattatgatgtttctgttcccaagttaacaattttagtggagaacttccttttatcatttctaccgtgacattcatgaaggttccaacaataatgtgcccatttttcacctacctattcaactgcgaactggttaactgtgccatttctccttttctagtttatttggtctggatagttgtgtaatactgttccaaactctttcccttgcagttaactgtcactcttgtgctaaaagaatggcaattctctgatggctcagttacgttgagcaattctctgagcaacggatcccactcttcatttgatgtatcgcccaagcttcagtccagaacaggacggaaactcagagttgcagtagttgagggtaaagcccttgcagttaacggtaaatctggaaagtgtgatccatatgtgaaagtgcagtatggaaaggtttgttgttaccttgcccaaagtttagcttcacttactattatacaagttggtattctaatcccatattctttttataggctctatacaaaacaaaaacactatctcatacaactcgaccggtttggaatgataaattcgagtttgatgagatcactggtggtgaatatctcaagatcaaatgctatagtgcagatacatttggagacgaaagcattggcagcgcaagagtaaatctagaaggacttttagatggtgatagccgtgaagtatgggttccacttgaaaaggtggattcaggagagatcaggcttcaaatagagccaataaagagtgatttcaacggtatcctgaaggtatttgccttccttaagcattgaattttaatattgcgaggattcttaattcagaaaaatatatacatttgcgaaatcagcgtcagaaacattttttcttaagaggatgcgcagtaaaaattttaaatttgggatgttgagtacaactatttttctacacatgaaacctccagcaacatgttctatatccttgattctgtaccaaacattagttttataccgtttgctctgttgtaccattttgtctactgatgtttctctggattctgtattgttcttcttaagcagacttcaagtggtagagttgaagctacctggattgagctagtgataattgaagctagggatcttattgctgctgatctcagaggcactagtgatccttatgtcagggtgcattatgggagcaagaagaagcgaactaaggtttggtggtgaacctttctgtatttagttatttactatgcctttattaggaaatgcagcatgcattgcttttctgacatgcgaaatgtgaatttgttggcgttttgaagtaatagaaatgaacaaatatgctgacacagtacagcacttggcatcttcagatggtgtgcatatgatcaattcagattagtccaaatctttcagcctgtagcagtccgtgcttggtttagaataacataagaacttcaataggaaaatgggcttttcaaaggtcctctacgaggtgctacgaattaactcttgaaaatgtggtacctcctcacatactagaggaaacctatagagcaatagctcgttagttttagtatgttattataaaaggaaaaaacaaaaccttttttggcgctaattggagactggagaattatatatggtcattctgttctacagatactatgaatcaccctataaaaaacaatccatttgatcagaaattctgagtaactcattccatgcaggttgtttacaaaacactctctccagattggaaccagacatttgagtttccagaaacaggagaacccctgattttacatgtcaaggaccataatgcagtccttccaactgctagtataggccaatgcactgtcgaatacagcatgcttcctccaaatcagcccgccgtaaaatggataccactccaaggagtaaaaagcggagaagtccatgtaaagatcacgcgaaaagtaccacacttggagaagaaaacaagctttcagactgatgcatcttcccttggcaaagggcacaagatatcatcgcaggtgagaggcttcgttggtttgtttgaacgatgtctctgcataacaatattgccacattcctctcagtatcctctttggtatgcatgacaattttgtgatgaacatcatgtgttttttttcaacagatgagagatagcctgaagaaattcacaggtttagttgatgagggtggcgacacagaggccatgtcactggccttgacagagattgaaagcatccaggatgagcaagacatgtacatacagcagcttgagcgggagaaagcggctttgttgcgtaaaatacaagagcttggttctgaaatcgtcagaacatcctctggtccggcaaggatgccctactagttaacaaccaatacacaggaacaaagaatagccttcacagttgtattcattggcaaagacctgaattatttacatagaactatactctagtgcagatatgtttttgaacgaaccggcacagagtgtgccaatttcattgaatatagcatagtgcagatatgttaccatgtaagtagatacacagcaagcaaaccacaaactcaagactcagtgcagtatattttgtagtgctgaaagaccaatcagtccatgtaacttactctataatctatatatatgtacacatcaatacatacagacaatttaggtgaatcctgaaatccttgtgttcttgcatccaacctgcaatgtattctgaagaactggacaggagagaagagaagagatatactccaatcacaaattcctaatcaaatgaatgtactacatgtttcttgtggttggtttatgcctgatggttaatgtcctgcaatagtatactccctccgtcccataatataagggattttgagtttttgcttgcaacgtttgaccactcgtcttattcaattttttttgaaattattatttattttatttgtgacttattttattatctacaatactttaagcacaacttttcgttttttatatttacaaaaaaaattgaataaaacaaatggtcaaacgttacaatgagggagtagtacattgccgtcctatcttttcctccattattactgcaatccacattttcaggcgttggtgtccctggacatgaaaggcacggaccatgcagagcctaggacggcgaaaggctaccagtttatgtggcgcctaaattggaaagcatttttgcagtggacatgcacaccgatcaaagcattttttgcagtgactttgctttgctgccgcctcctatcttagctactgccatggcttaccggccggctacccgttgcaaagtcaactgatggagtagcagccaggcatcagagaccttggtttgacatttggtcgatttacaaaatttttcttccaactttcaacttttctatcacatcaaaactttcctacacacataaatttctaacttttccatcacattattccaatttcaatcaaacttccaattttggtgtgaattcgatcgattccatcttcgtcttcttccttttcttcttcaggagacagaagatgagagccttttttcatggtggataactgttttttgcatttactagctatagctacgggtgtttgattagcatcatttaattgcaccatccatccactagaggtgaagtgaagttcttctcaaagaaaataaagaagacagtagtggtaggtactggggcattgatccaccgtagatgtaggaggacgacagcgcaatgctgctgctgttggtcgagatgattggtactagttcagccatatatatatggagggttatagagtttattttccttgcaagaaggaaaaaagaacatcaacctttggcaccagatcattttgtgattattctcagccggtgtgtaagtgtggtgtaactttggtgaactctagcccaaaactagcttagaataatcactaaatgacatatatgtatagggaatacttattttatttgttaaagtatatatggttataggctgatctgggattcgcttggctactttctattttatcgtgaggactttctaaattgttaaatgtttttttttaaaaaaaatcactatataaaagtttctttaaaaataaaacaaatctagattttatgtttatgataggtagtccatccgtcacaaaatataaaggatcttagatggatgggacgacacatcctaaaactacggaattcttaattaaacacgcattagtgacctatctcgatacgggtgctgctaataagctaaggcaacaactttttcttgcgagccccaaagttattatgataggataggaagattagttttcatcttatatctctaaaattgcttaagatcaatcaatccacattgcatatatatattaaccttgtaaacaaagtactcctagtaataattaaatagcaaatagtgggctgacattggactaatccctccgttccataatataaggagtagattttgaagggatgtgatgcatcctagtactaagaatctagacatgagcctgcccagattcgtagtactaggatgcactatctgtctagattcgtagtactagatgcgctacatccctcctaaatctcttatattatgggacggagggagtagtgtataggtaacgaattgtggatagcgagtgcaattacagatgctaagttataaaaaaaataaatataggttatttatcaatagtaacatcaagtttcacataaagtttagatacatttcatagcataagaattataaaataacatcaataagatataaggggtaagtcctacatgccccttcaagtgtcgcaaaagtttgatttacaccctcaacaccaataccagacattttacacccttcaacttatcaaaactggacaaagttccccttagcccaatctaaagtggttttaatcctacatatggcgatagttttgctatgcggctgtccaaccaatgaaaaggccatcgatatattttaaaaagtatataagaccccacatgtcagtcttatcactatcttcttcttcctcccccctccctctaaccaaatcttgatccaagcaagaggacacgaccactacctcaacaccaacaaggagaaccgttgttgccccagttctcttgaccgcgcatcgaggaaccatcgccaccatcgttaggaatgagggaagcagggcccagggcccacaagaccgagcaaggaggggagtgggttttggtggcaacaaggagggtgggagagcagagggagataggaggtgaggcaagacaatgttcgagctcatcattgtcctcgaggggaatgtggtgcttggctcagtgacgatggagggaggttagctgcacacccaatgaggaccgtcatcggtcagatctagaaggagaccacgtacttcaatgtcccctcttagcgtcgactatgttgccgcctgcactcctctccgttggcaccatggagaagatgtagggacctccttcgctcttcttgacagctaccatgtcatgccgttgtcacaaagtgtgctccgaggcagacaatgtatatgccacatagaactaaaaccactttggattgggttattggggtgacttgtttggtttgaaaagttgaagagtcatgaacttccggtatttaagtatctagagggaggtaaatcgagcttttgcgatagttcagactcaacacgaccttagttttgtgaaaccatgtgtggttatagttcttttgtgatgggaaattgacaagtaccggaagtgcaagaagtgtgtgcgtggactaacattggtcagattgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacataaggttgcacacggtggacgaacaccgtgtgaggaggtcttcgcaacggacttcgcaaggtcaagtgcaagtgccgggttcgcgaacagaatggagaatggaagaggagcttgtatacatgcactggcatgtgcatatgcaagcatggacagtggtgcttcggttgtgcatgcgtgcacatggccgaatgtcatgcacgggcgcaagacatgcatgtgtgcatgaggagcttgctagcccatgggtgcatgtgagctgtgattggttggcagggaggccaagccaatccagcccttcctcatggctcaagatgatggatggatcagcaggcagggaggccaggccgagcaggcccaagacaagacgacggcccacggcattggcaccatgcgcgggcaagcgcgggagatcgcgcgaggcacgcgcgcgcagtggacacgcggcggcaaggaattcggcgcgtgcgggcgtggggtccacgctgtttcaagtggctcggaggcgggagttgtactgggacccacgcgcgatttcgcgagcatgcgtgggagcagctcggcgggacacgtggaggctttggactggatgcgcgcaggtgagcgtgggatccacgcggtggagcgcgcgctctcgcgtgctgaggcgtgacgtggcggctcgtcactggtttggagagggagcacgcggatcagtgcggcgtggagagtttggatcaacgacgtggcaagcatccaggaggcttccttcggttctaaggaagaatgggtggaccagatccattctgagttagggtttcgccctaggggtatttgagacaatgtcttaggggtcttagcctataaatagagagatggatgcaagggtggatgttgctcctttggcaatccttttgagatgctcggtgagagagtttcggtgtgagtttggagtgtgtttgcccgagaggcttttgtattaggattagtttggagtgtgtttgtctgagagattttaagtttgtgttaatgttcctctgaaggtgtatgcttgctcctagttgagcggttattttgcatcacctataaatgaaatgatttgaaggatttcatttttgccttgtccatttaaattccgcttgcaatttgaactttgcgatgatgagttttgctctctcttcctcacctctcttctagtttcgggaattccttttctcttcctcctctagtttcgggaattccttctctcttcttttgctctcttcttttctagatccggcttctctaatagccgcggttctagtaaggattttgagaaatccggcttgatgagtattttcgggggcaagatttgaattgctatattcacccccccctctatagctgttctttgtctttcaattggtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatcaccttacactgtgcccgatgatgctgacatcacgcctgcaaatatggctcaggttgattttaattatcgtgcaagaaatgcaatcattggtggaatttcttctggtgaatttaatcgtgttcaacaccacaagtctgctcatgacatgtggactgctctgtgcaatttccatgagggaaacaatgatattcaattggttcgtcagaatcaatttcataaagaatatcaaagatttgagatgcacccaggagagtccattgattcttatttcaagcgttttggagaaattgtttcgaagttaagatctgttggaaaagagttttctgataatgataatgctcgtcatcttttgaattgtcttgattatggtgtttgggaaatgaaagttacttccatcacagagagtgcacctctgagtgaccttaccatggacaagctttactcaaagctaaaaacccatgagatggatgttttccatcggaaaggcctcaaacactccatggctttggtagctgatccctctggtagtacttcttctaatgactcagcttttgtgtgtggtggcttctctcttgccgctttacactcagtcactgaggagcaattagagaagatccctgaagatgatcttgctctttttgctagaaaattctcaagagcttacaaaaatgtgagaaataaaaagagaggaaaaaccaatgaaccatttgtgtgttttgagtgtggagagcctaaccacataagagtgaattgtcccaagttgaagaagaagagtgacaagacgaccaagaagcccgagggacaagggcgaaaggggaagaatgatttgatgaagaaggcgatccacaaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcacttgaggataaggatgactcatcggagcatcctgaggattttggagtggggagaagtaattcttggcttgtggactccggttgctcacgccacatgaccggtgaagccaagtggtttacttctctcactcgtgcatccggtgatgagaccatcacttttggggatgcgagcagtggacgcgtgatggctaaaggaacaatcaaggtcaatgacaaattcatgctgaaagatgtggcactagtaagtaagcttaagtacaatttgctctctgtttcacaactctgtgatgaaaatctggaagttcgtttcaaaaaggacaggtctcgagttcttgatgcttctgaatctcctgtttttgacatttctcgagttggtcgagttttctttgctaacttcgactcttctgctcccggtccttctcgttgtctcgttgcctcagagaatagggatttgtttttctggcatcgacgtcttggtcatattggctttgaccacttgtctcgcattagtggtatggatttgattcggggtttgcctaagttgaaagctccgaaagatcttgtgtgtgcaccatgtcgtcatgggaaaatgacatcttcctcccacaagcctgttacaatggttatgacagatggaccgggacaactgcttcacatgaatacggttggtcctgctcgggtccagtcagttggggggaagtggtatgtcttggttgttgtggatgatttctctcgctactcttgggtctattttcttgaatcaaaggaggaaacgtttggcttctttcagtctcttgctcgtagtttggctttggagtttcctggtgctcttcgagccattcgcagtgataatggctctgaattcaaaaattctgcatttgaatctttctgtgattcttctggagtcgaacaccagttttcttcgccatatgtcccacaacagaatggggtggttgagaggaagaaccgcacccttgtggagatggcacgaactatgcttgatgagtttacgactccaagaaagttctggactgaagctatttctgctgcttgttttatctccaatcgtgtgtttttgagaactatcttgcacaagacgccatatgagctcagatttggtcgtcgaccaaaagtttcacatctcagggtcttcggttgcaaatgctttgttcttaaatctggaaatttggacaagtttgaatctcgatcattggatggcattttccttggctatgctactcattctcgggcttatcgagtttatgttctttcaactaacaaaattgtggagacttgtgaagtcacttttgatgaggctagcccaggagctagaccagaaatttcaggtgttctagatgaaagcatctttgtggatgaggattcagatgatgatgacgatgattccattcctccacctctagacagtacaccaccagtgcaagaaaccggttctccttcgactacatcaccttcaggagatgcaccaactacatcatcttcagcagctgaggagattgatggtggcacatcaggaccgacagctccccgacacatccagaaccgacatccgcctgactcgatgatcggaggcctgggtgaaagggtaactagaaatcggtcttatgatcttgtcaattcagcgtttgttgcctcttttgagcccaaaaatgtttgtcatgctttatctgatgagaattgggttaatgccatgcatgaagagttagaaaattttgaaagaaacaaagtttggtctttggtagaaccacccttgggttttaatgtgattggaacaaaatgggttttcaaaaacaaactaggtgaagatggttcaattgttcgaaacaaagccagactggttgcacagggtttcacccaagttgagggcttggattttgaagaaacctttgcaccagttgctagattagaagctattcgaattcttttggcttttgctgcttcaaaaggtttcaagctttttcaaatggatgtgaaaagtgcttttctgaatggagttattgaggaagaggtctatgtcaaacaacctcctggttttgaaaatccaaaatttccaaatcatgtgttcaaacttgataaagctctttatggtttaaaacaagctcccagagcctggtatgaaagattgaaaacctttttgcttcaaaatggttttgaaatgggggcagttgataaaactctctttactcttcatagtggcattgattttcttcttgtccagatatatgttgatgacatcatatttggtggctcctctcatgcacttgttgcccagttttctgatgtgatgagcagggaattcgaaatgagcatgatgggagagctgactttcttccttggacttcaaattaagcaaaccaaggaaggaatctttgtacatcagaccaagtactccaaagagctcctgaagaagttcgacatggccgactgcaagccaatc

SEQ ID NO: 45628 - DNA, 2193 bp, Oryza sativa
tcagatgctgattttgctgggtgtaagattgatcgcaaaagtacttctggcacttgtcattttcttggcacgtctttggtctcttggtcctctcgtaagcagtcttctgttgctcaatcaacagctgaggctgagtacgtagctgctgctagtgcatgtagtcaagttctttggatgatttcaactctgaaagattatggtctgtctttctctggtgttcctctgctttgtgataatacaagtgcaatcaatattgcaaaaaatccagttcaacactccaggaccaagcacattgagatacggtaccactttctccgagacaatgttgagaaaggtaccattgtgctagaatttgttgaatctgaaaaacaattggcagacatttttacaaaaccacttgatcgctctcgttttgagttcttgcggagtgagttaggggtgatccacccctatggcttgatttgagggggagttgtttttcttttgcatgcatttgtaacatattgcatcatgtttactttatgcattgtattatacactcttcaattgagctttgcttgttatctcttggtcatcactatgctatgcatgtatcactcttttgctagtttgatctcttgtctagctttcatttgcttaagtagcttgtgtgatcatgttatgctgttcaagcttgttgaaacctgcttaaattgactattcatttgaacttaatcaatgtgcaatgcttgctctagaagtttgtttaaattgaagtatccctctcatactcatgccatgtttacattctttttgcaataactgtcagtacatgcttatgaatgctcatgcttatgcgtccatactttgtatcaatcatgctttacaagctttatctctgtttttgtccgggctactgagtgcgtttacgcatgagtagtgccgaagatagcactgagacagcctgtaatgggaactctagctggaacacttgattgaggtcagacggcagtgtttggcacaaccatcacttgctgactgataagatcaggtggaccgtcgtgattgtgctattgtctttaaagaaattaaaaaacaatcttaaaaataaaagtcatgagaaaagattaaaagctcatgttctatgctttgttatcatgttgatactctttatgaactgggcattagcacattagcatgggttcattgctttgattatgtaaatcttgcatgattatgagctggtttgcttccttttaagcttcttctagaaatagctttgcacactaaatcactaattcacttgaaaactttttgcttgctggcgatactaacttgatatccatgacctgtttcatacttcttatgcacatgcttagctaggcttgagcacatgcttgtatctgtgtgatccatgtctaccttttgatgcctttagataactctcaaagctctcaaaacactaaaatttgtaagtttcatctcatttttatcttgcatttttgtctcttttgatcttgatggcatcattgacaaagggggagagaaatttgcacttattgaaaattaaaaaacttgctttagatcttggtgaaagggggagtttggcacatagggggagcattcttgcatttgcattcgcatcccttttcttcttgtcacttcacttggtcttgatttttcgcgatttcaaaatgaccaaagttcgacgtttgcaaaatggtttgctttgtgaatcaaaaatcaaattttcaaaatttttgcttgggattgtcaatgttcccatcaagggggagattgtgaaaccatgtgtggttatagttcttttgtgatgggaaattgacaagtaccggaagtgcaagaagtgtgtgcgtggactaacattggtcagattgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacataaggttgcacacggtggacgaacaccgtgtgaggtcttcgcaacggacttcgcaaggtcaagtgcaagtgccgggttcgcgaacagaatggagaatggaagaggagcttgtatacatgcactggcatgtgcatatgcagcatggacagtggtgcttcggttgtgcatgcgtgc

SEQ ID NO: 45629 - DNA, 2058 bp, Oryza sativa
aagtttctcctatccatatgtgaagaacattgtttaagtgtaataatagcccaacaaagccaataatggtcgttaagagcaataacggccattaagttctaaaatgctatatttgttgtgctacttgtagtggttgcaatagaggttgctatatactccagtgtaaaaatccactatcgttataatgaccgctacaaaagctatttattacctcgtttgtaaactacacatatatatacatatacatcattttactatgatagtactatgtatgaagattgatgtcaatgaatgggagaggcctgtgggttgacattttgagaatgaacgccgtcctttttgacaagcttgagtcagtgaagccctctcatctcatccctagcttgggttgggtttgggtatagcaagaatgactttgcttgctagctagtgctgcatgaggacaagggacacctcttacaaagctagcagtgctagtactagtgtatgtgcttgacacttaagatgatcagatgtgtaagaagtaggtgttcagctagcctatgattgaggaccactgattggcaggggtacgttaatttgctttttgaggtagtgttgtttttttgcacaaagatattgcaagccccatgtatatatagtttggacagatcacagagatatacagtgtctctaagggacgccggtactccctacttacgtcctccggtaccctcgcacttaaatctaattataaatattggttgccagatcaaaaggcacaaactaatgtgaaattaattagtccaaatatgagcacctccatttctgagttgaatgtaattcttttttttaagtggaagcggcaagagtattgccgaatatattagaatgatagagttgaccctgtttataaggaacgggcccaaaaaccatacaactgcacggtttgctaaagtgaaaccggcaaaaaccttacacaaaagacacagaaagcctgaggcaaaaaagattacgaaccgcagaaggccgcgggaagagcaaaaccctaaggcgaagcctccgaggaggtgaacaacaacaatgtaattctaaaactagcttgtatgcaattatagttccaattggttaaaagttacattgaaactacataatatcagcagagctttcactaaaagagcttacacaagccacactatacatacccttaatgaattatcatgttatctcatctattcatctaaggtcagagtaccaacaaacacattatcatctcatgacaacgatgagggagaagggaacctatctttcgttttactcatgtaggtcttccatccctaagatcttttagtgtttctttttttagttctttgccgccgacgactacatttatgaggtatacttgcataataaaacttgtttattgatgtgtcgattaaccaatattgacacgatcgagttcggattttgatgatccaactatagctactttaactagttttgtttttttttcggatttaggcagctagccggataatctctactaagaaattagaagtgtttccgtcgtccgttcatgaaaaaagagcggaaaaaatcgaatccgattatatgcgacatggtaaaaaaaatgtgacacggtaaaaaaaattaaatccgattccgtcgacgcggtaaaaaaaagggcgaaaaaaacgaatcttttcgattttaaaaaaagaaacaaactcccgtctgtttccaaggaaaaaaatagaaccgctggccatatccttttgggccgaataggacttggtttgaattataccaagtcctattcggttagcatcaccaggaaaacaagtgcatatatacacacacacgtagtataaagaatcacaacacataacaaagaatcacagacaaccttatagcacttagcactgaggaatattagtttataaggttgctgatgaagattttgccctaagtgaggaaaattggtctcattgtattaacccattaaccaaggtaataaatagaaatagcaagctggtagaatcatagatagcaggtatattattatgggcacaaatttca

SEQ ID NO: 45630 - DNA, 7845 bp, Oryza sativa
atttaactactcctaattactctgaaagttctacaaattaaagatcatgtgaacttttgctaggggccttaatttagtgaggaaccatttttgttcttttacttgaaaggaagcgaatacaacatgggatcgagaaaaaatctatagttagctatagcacgagctctaacaaattttgtaagagaatgagcggaggtgggttagatattaatgatattttcccttcatcctaaaatataagcattgctggctatgtatctaaccagtgtttaaatacataggcagaaatgcttatatatattttttattttcttattgtccttactcttagggtattatatgtctcccaagcatggaaggaacgtatcgaagattggctaggagtaaatcaaccggtgtttatatgaatgttaaagcaggtttcacaaaaccgactagttctttcttattttcgtacgacatttacagaaattaagttgtcggttttcaccagttttttggtaaactagtgaggagaggtttatattttcaaaaggaaaaggtaaaccctagtcttgtctttgtccatgttttcttgtttgatcatatctcatcccctaccaatgcctacattaatttgtctgggcttacatggccaggccaagccagtgctacaaacctgcttgaatgttgcaacccattgtagtgtgtgtgactgtgtatgtgagagagaaagagtgggagagagagagagggagagggagagagatctcacatgaaaaccatgtatgtcaatgtcattagcactatccaacacaggtcctatcacttgtactggtgaaggtctcggtgtctcacattttccatacacacatccctccaaaggcactttttactgcccatgtatcctccctggcctcctctaccctaaactcccagtacttgacaacagctcttcctagcatgcatgcatcctactagacctcaaaggctaagccatatgcatgcgcctataggggcccctagcttgtgcatactctttctcaactaaattcagaaccagggctttgtaagaggtgcccttgtctttattaccttaccctctagtatctctctctctctctctctctctcttcttctcaagagctctctgcaatgcatgcatgcatatggcctacacaatgcaaccacaggttgaaggagaaagatgcaaacaaaggacacacataggcctataacctacactagatgatggatatgggtacagatgtgtgtgcgcatgcatgtgtgatgtttgtgtgtttgatccctttgcacaagatctaaagaaaaagagggcgtagcttactctatttaatgattcaatatatgcaggagagaagagaggtctcactctcagcagcatgcatatctgctgctgcattgctgcttacaaagtgatactacagtgcagtgttaagagagtagtggtgctgtggctgtggggctttctttcagctcagctcagctgccctacagctaatagtgtggacactcacctacacatattgacatacagtcatcgccataccatacgtcctcttctctgatcctcctcgatctcgatcgatcgatctctctttggatagataataataacaacgcaacaaatactgcattcctcgcacttggattacagccatcacatactccaagaatcatatatgcacaggcagcatcttactctctcactcttaatcagatggagagagagagaggggtagtagtggtagtagtgtacgtaggtgtaccagtgtatgtgaatgtgtgacaggagagagaaagggacggctgtgcagaggtgaactgatagagaactttcaggcttctctctcccccagctaccaagctctactactgcttctctcactctatctacaccccaaaccaacacttttaagacagccgttccccaatgcatttgctgttcccaaactgcagtgtctttttgcttttgtgtcatgtactaaatcaataatacttgtactcttttctctctacacagtcaggcacatcactgagctgatgagagctctactcaacgcgtctcaagtcgatctcaaaccccacacacacagcatccgatatatatctcgatcccctcttttctttttcttccggcctctccttccaaaagcctcatttgcatcatagtgttcagctgtttctctccctgctgctctctgctccaccatgtaagaaggagcctacaagcacaactacccctcatgacttttttgtgtcttcttctattgttcatctccatgttatgtacatcttccctctgaaacactgctgtctttgtgtgtcttgtttatatgtgcacatatcttgtcttgttttttcagcaatttttttttccaaacagtcactcttggatgtgtctgtttgtgtgtgtaaatccgatattacctgtaatcttttctatgcatacatcatatatacctgcatttttactactagctcctgttacttatcacaactatctagcctactatggatctccatgaacagcttgttttctactatgtcattctagtactatataaaactactatgcatagattcattcttgttgtcggcacagtgcactactacttgtgttctatcggcatcttgttgggctacctcgctcttgagttcctgtgtgctcatcattgtgcaaacaggaacttgttgatccatctgtgaatctgtatcttcaacaagttgtatatatacgtactaaatggtttcctcttcttcttcttcttcgctatgaactcatcaaggagacaagaagggagccccctggacctgaacaacctgccggatgagttcggcaagcaaacggtggagagctcaacgaccaccgccgcatccagcgccgaagcatccagtaaggatatcactgcaacattcataaccagcaaatgctagtacatatatagctttaatgtagagtaaaaaagatagatttttgttttgtgtgtgtgtctgaatgtggtcatctacttaaaattttctcctgaaccgtctcgatcattacatggaaaaaagaaaaccttaattgttgcattttagataaaggaagtacagttacatagcttcagaatgggataactgaatgattagctaattgtttacaggggttactaagaagaagagtaatggagggaaggatgaagctggcaaggtgtacgagtgtaggttctgctccctcaagttctgcaaatctcaagcgctgggtggccacatgaatcgccaccgccaaggcaatatcacacaacaacctacctagctatataatcgatattttttttatcaaagaaccaatttgatcgatcacaaatatatgaagaagttcgttttttttatcttccacgcatctaatatattctaatccaacagtaaccatttatatccttaagaaaaagattcaattttttgatcttccatgcatctaatctcgcattccctttgcctctaacttgtgggatattgggatttgatctttcagagagggagaccgaaaccctcaaccgcgccaggcagctcgtcttcggcaacgacagcctcgccgccgtcggcgcacagctcaagtatgcatatcacatcgatcgatctaagcgtgaattaaatctccattaatttgcaagttgtgtcgtctcgcccgatccttcctttctcatcatcgactagggtttcttatgaaagctttcttgctacagtttcagggatgtgaacatgggaggaggcggcgccgctgctcctccaccgacgatgcagatgggaggaggaggcttccggggaggcggtgtcggcggcgacccgtgcatcccgctccggccggtgcagccacggctgtcgccgccgcagccgccgccgtaccaccactacctctacacgacgacggcgccgccgtccgccttgcacccgatgagctacccggcgacgtacccggccccgccgcgccaccagcagccggcggcggtcggcgactacgtcatcggccacgccgtctccgccggcgacgcgctggtggccccgccgccgccgccgcaccgcgccagcttctcctgcttcggggcgccgctcgccgcgccgccggcgaacgtgcagcccgacaacggcaactgcaactgcagcttcgggtgcggccacagcaacaggaacgtgaacgccgcctcctgagctgacgcgtagtatttactgcgtttgatgtgattgcagttaagttattgttcatgtaaattactaagagccaagaaattagaagtgttcgtgatcgataggcgatgtgttaatttggggggcaagagagatcgagatcgatgggtagttgttcatgatgttcagttttacctttaaaatctactgctaagtgaggtacatgtctgcacttattggattcatgtatggtaatgttgattttttggtgtgtgagtttttgggggtgtttttagttcagatatggaattaatttaatcaactgtgtagtagtggagagatgcattgatgtttttgaacgcatatgattctttaaaatgtataaggctgatgaccaggtgtttttcttatgattttatgaacatatatattactagtagtacaaactggagtacttacaaaagttaaatgggttaaatatgtactggtagagtatattttgaaccaatgtgaaagtctcattaaaactactctacggttgtgtttagatccaaactttggatccaaagtttgcaaaattccattacatcaacctgtcatacacacacaacttttcaatcacatcatctctaatttcaactaaaatctaaactttggatggaactaaacgcagccgtttaatttgagctacatctatctacatggtactgtgggtactgaattattctgcagttttgtgctctcttcactctctggccttccctataggtgccgtactagtacaaataaaatacgagcagtcaatacacgaactcatcagaacacacatcacatcacattgaacttgatttgacataggcgccgcaagtcaacccaggctaacgatggcataattatagctcattcaagtgtttaaaaggtgatcgatatgaacaagtgcctgcaggtgagtgctgactctcggggaagctactcctagctatagatcctgatcaggattttgaatgcagtgccactagctttgaccaatgttcttgatggaacagcaaacttttttcttggttgctgctgggcttagggcctgtttaattcacgaaaaaaaacttttagggtgtcacatcagatgtttgaccggatatcggaagtgattttcggacacgaataaaaaaaactaatttcataactcgtatagaaaccgcgagacgaatcttttgagcctaattaatccgttattagtacatgtgggttactgtagcacttatggataatcatggactaattaggctcaaatgattcgtctctcgatttcctccctaactgcgcaattagttttttaatctatatttaatgctccatacatgtgtccaaagattcgatgtgatgtttttgagaaaaaaatttgggaaactaaaccaggccttatttctgatttggcccgcactatcatttctaaaatgaccagtataataaaaagcccaacagcgaaatccatcggatgtataagccccggtttgtcaatcaatttccctttactacgtatacaattttcaaaaaaaaaaacactacatatacagtttaatcgtttggcctatagctgaaaaaaaataaaccttttatctatgcattcttagtgatataaaagctaatgttgaaaataaaatacaataaaaacccatcaaaatcaactctaaaatttagtttcaaaatttaattattagttgcaggtgataattaagtcaaaaggcaaacaatgatgctgatgattatggcttctttggatggaggaaatttataggattttttcctatattatactagtaacacccttcagaacaatatgattgtagtaaaaatttgtatggattaattgcttttctatacccactattgcataggaattttaactcgagcttacaccttttttccccattgctaattaagtccaatccacaatctcttctcctctctctctctctctctctctcgtgtacgtgattttctccaaaaatgccatccaaagacgtgttcgcgaaaaaaaaaaccatccgaagacattacctttagtgtttctatgttttgaaatcttgtatacattgcttaacattgacaatctctgttcctatgtttttttttctttttccgcatattggaaatcctatgttccaaaagaaccccaaatgcatgcttaataaaaatcatatgcccattaatataagtaacaagtatacttatcgacctgatcacctgtatacatttcaatgaaaaatgctactataattaagagtttaagacgtacaatatcccccacacaccacaatacacacactactgttacaggtagtcaggaaagtcttcacatagctggcgtatgtgtaccagtgtattaattctaattgtactgtgctactcctggggggttgggtatagtaccatggttgacatctgacagcataagttgtatttaactcaaccagtgtatatagtacttctccattatcatggatttggacagtagatataatgaatttaattagtatccatctctacaaattagagttctagctggttgttgatgaggaactagctctcgtacctcaaaaaaaaaaaggaactagctctcaatcttctgataggtattaataactctcgattcgacggatactttgacacacacgatttgtgtcttccaatcaatacgatttgaacctggcaatcgcagcatcgcttctcctctggtcattaattgtgcactatccggttatcaacagattgttgtttgcctatctctttgaaatcaaatcaaattacattcggaaatttcgaatgcaacttggatttggcccctcatatttgtatgttaggccagacactgtggatagacatggcttatcatgcaagtgcgcatgccatatatgtgtcgtcactctgcaccatgacaactaggcctgcacctattttttttccctgattacatgcatggaggacaacatacacacatatcacggtacacacgtatcccacaaaatacaaaggtatggtctctacgttaattaaaggttatcatgttataatagttaagacaatacagtctctaaccattaatataccaaaatacttttttactagtcacttttcctttatcagactcaatgcaacaaaaaaatttctaataaatgctacgagtcgactctatgcagttgtcatgcgtagcaaccatctttctattttcttcttcctctctctttcacatcaccaaaaatgcttgcatgacaataaagagagaccgctaataaagaccattgtacatgccctaaatacagtccttaattaacaaatgtacaataaacggagttaggaataaatcagttaacataacgaatatcctactgaaattaaacacataaatgatatgagcaccaagatttaaacaattggggatagatttgatcagtcatgcacctactattggtatcacactgaatgtttattcatgtgcaccccacgcatgcatatactaattgaacaattaatacaaaatagaaacacatgaaaactaaagcaagaaattaataattttatgtatagaattaatctttaatgtattttagccagattaaatttggcaaaccaggaatttagttatcagataaaagttatgagatatgatcttagtactcc

SEQ ID NO: 45631 - DNA, 2811 bp, Oryza sativa
  unsure (1)..(2811): unsure at all n locations
aaaccctggttacgaaaatggaatcgaatattatcgaaaccgaaaacggagcgaaaacgaactggcgcgaatacggtaacgaaaatttatcggaataaaaaacccctcaaactgataaatccaattgaataaattatctatgtttaaaagagtaaggttgttgataaatcctaatgcaggacaaaaaaatattcttatgtaattttagatttgcataacaaatatttttttaaaaaaaataatagccaaacacaatagtattcactatttagtgcttaaaaaaagaatccagggtatttcagtcacaaaatttctggtaattctgagaaaatttttggaaattccgagaaaatttctggaaagtttctgaccgattacgagttctgacggaaactgcccttatcatttccgattccgtttccgagaaaatatttccgaattcgtttccgtttccgaaaaattccgaccgacagattccgttttcgaaaataggtccaggatccggaaagtttccgtactgttttcacccctaactctatgtgctatatatagcctgctatatattgtagttggcaattttattgaacttgctctcatttgtactaatttatataggataccacatgtacatatacatgctccctccatcccaaaatacaatacgtatactccggttttttcttttttgcacgaatctaaacatatatttatttctagattcgtgtataaaagttgatcgattctttttttgagatggagggttatagatttatacagacatatagtacatatggagtaggagtagaatccaaagttaaactaattaatctaaagggcgccggccggcaggccggtggctgtgttgcagggcagtttgcagctgcctatcgcccacaaaccagccattgcatgcatgtactcgcaggccaaccaaacgagactggccccgtgagcttctcgagatacaaacacacaaacacacgcatgtttgcatgtacaaatatcatgtcgaatcggcgaaatcgacttgtcagaaaagctacggccgcggctgctgcctcctaatataataaagctacactcttcgcttccgatctctagctagctctcagtcctactacacactcaactttaatcagcgatgtttgcatgcatgatcacaagattgatgagcacatatcgatcagtctatacatctacttgcatttcttcaggagaattattataacagagacgagaaactaggcggtttgcaatgtgtttatggcgaagcagcacagcacaggacatatgatgcatgcatgcacaaccgcagctacaatttgtactgcaacacaagagagaatcagagaagagagtggatgggtgctatagctgcagcttgaagctaataggtagccctgctgcacaagcacaaccctaagctctgctcatatgcatagcttctcctctctctgctgtcttctatacgtacacgcaccgctttcttctttatgatctttagctgctgtatgcctgtatctgcgcccccatttgcacacaaattaacaagaggaacaatccaagggcatggaaataaatcttcaggatcgcacttgcaggacatggccatatgcctggccgatcgagagaaaagggaaagagaagaaatcaaggattaagtgagaggcagcaaacaatgtacgtagatacttgaacgtaatgctaggtgctagacttatgtgctaaactctgaaataacattttgattcctcctaataatagaagttattaggaaatatgctatttcgaagaaaaaaagattcaggaaaacataaacaatatcaatgacaagttcatactctctccatttccaagtgtaagtgtttctataattcaaattttatacaaaatataagcatttctggcacatttcaaatgcacaggaaggcaagcattttcaaccaatcagttgcttaggagagaatgcaagcaatttaaagtttgaccaatgaaattacggaaaaaaaactaaccctcttgaaaagcttattttgagaataaaccctgctaaaaacttatttcaaaattgaattgtgacactaaagtccaacatctcagcaacctaattgtctctatgacactgggtccgagatggcagaccgagttccaagtgctatggtgctaaccatggaacctcagtgccaatggacatagcaccgtggtaggggaatgtggccaggagctcaatggcggtggtgacctctagatcgatcatgcagtggtgtcattgcttcgattgatgttccaacaccaattgactccggtgctgctaccgatttcttgctcttccacatcgccattgtccttgtcgagtctcgtcgactctagcaccactacgagctcgttgagatccagagcacaagcttagcctcctacctcagcgtcatgcttattggcgttgaggttggaagttcaatgccagagcacttagagttgaccacttgccacgttgatcatccagcttgaactcggtgccatgatagcagggggttaacactagcgtgactggtgctgagacgttggatcatagtgtcatcgggcttgacgttgagttcgtggttcattttaaaataagtactggcacagttcatgtttgaaatatttcttttataaggatcatattgtcaaaaacatctgcaaacttccaacttttccatcacatcaaaactttcctacacacacaaactttcaacttttccatcatatcgttctaatttcaaccaaacttccaattttggcataaactaagtgtgtgtnnggggagagggg

SEQ ID NO: 45632 - DNA, 4798 bp, Oryza sativa
ctgcacccctccgaagctgcgctagtggccttgtcgcgcaattgataaacaacaaaactagctgagatttatttactttggtaagccagtgggaccctttggcatggcttctcttgagagagagacatgcagctagctgagagtatgtactgggtcccatcgatccccatttgattctgatgagcttctgatagatacctctgggcacatctcatgtaggatcggagtagatgaatggtccagcttgagctcggtcttgaaagaaaaatactataccatgctgcagttgctgtccatctccatgcaatgcaatgcagtacagcagcagaaaacgatcagaccgtagcacttgtggagtgctgtactgagtcaggtatagtagccgactatgcacggtgaaaacctacaactatacacacgtacgtagtatgcgtatgagtagtgtagactagtacgatcgactagtagtatacaaccaagagctagctagcgctttagccagcacagctagccagtgtcgttgttcattagtaccagtacactatcctccataatttactcgactatagcatagctagtactcctatgctacagttctcaaatatggacacttgatcgaccacggactcacggagagaatggtcatgctatggatggttggaacctaggaatttctcaggataatttcctattaggcaacgtccgttcgtttgttttcttgctggtcgatcgacttcggttttcaagtactctctccttttcctgaatacttgtcgattttaactatgcgtataggttaacttggaccattgttggagaaggttatatttttgggatcctccctccctgttagatccataaggcacaattactgatcaggacatgagttctaaactacggtagcttgccgctatgagagcctcaattattgggccaagcttcatgtcccatctatagatggccatctgggccacccggcacggcacggcccaagcccggccggccgtgcctgggccgaggcttgtcgggccggtatggcccgaccgacgcaccgagccatgccgtgccagcccacgggcggcatacacggcccaatactactcggaccgtgccgggccggcccaccgtgacaagggtgcaacccaggcacggcccggttgtcgggccagcacgggcacgaccccagtcgggccgtgccatgcttgggccgggccaaaattgcgggctttgggccgggccatgggcctcgggccatatggccatctatagtctcatctacatgttaattgatgtcagtccaaagcccaaataaccgccccgctcaaggcatgcataagagtacaagagcaccccaatgcgagcccacttagtatgtgtgtagatacatggtaaatctccttatccccatatagtagtactgtaatttctagctatgaatctaaacatatatactagatctagtttcatatatagccagaattagtttagagtgagttgcactttgggccatgttttattgccaaagcttcactttggacagccctattgctccaccgccacctaaatctccactgatgtcattgtttgcccttgccgccgcctccggctcctctcccatcgatcgaagtggggcggagtggtaggcaaggaggatgccgcccctactccccactctcctttcctgcggcctcttttcctgtcacaccccaatctggcaccgccgtacaacggcacctgacaggagcgtgtcgtaggaaaacggcatgaactgcgtcctacgaaaccgcgatctcagtaccagtcccaggacatagcgctggtacccacggtgacaaacatgaatcattgcaaatccttataattaatagaggacttatttaccttaacttaggttgcagctcagacagcccgagaatgcaactggcgacacggacgaggcaaacaccaacaacagcagcagcagaggaaccaaccaacggactaacacccaacgccacaagcaacggcaaggaactaggacgaaaccctaatcttcacttcacttcaacttcatcttcggagctggcagaactatatttatatagagagcaagggtgagtacttacgtactcagcaagccaggggaacttaggtggttaatgcaagcttcaagggaaggctgtttatttagcaatcagttttgttttcaaggttttcaacaatctaagtgtgtgctttccacaaccagagcgagacaaagtctcagctcggtcggggtgagaagtaacaaatttatttatcaagatttgcacaactccaagagttggcttcaaatctagttttcccaaaccaaaccaattttccaaacttcccgataatagtggtccccaaacgaccaatcacttccagggactcccggtcccactgtcccccggacagctaaatgcttcccaagcattaggtttcccaaaccttaacaccttttcataaaacagggtaaaacaaaaactacgctaaggaatcacctcacatccgcccatgaccgtgggcacggctgttcgaatagtttaataacctctgcagagggggtacactttacccacacgacattactaacctgggtcacctagcccgtgcagaacagccacgtctggcgactttgaggctttcacgataaggtgtttccaaagccgacacagggttgccatatgccaatgagaggggtcccagaccaacaacaggttaggtcccagaccatactgtgccaggaagcccgagggttctccccgacaccaccccgttgaatccacatgtctcttggcatcatggttcccctaattagctaattactcagccaggggcgtcccattacacccatgtggtcgcactgttgtattctcggatgtaattccgaaggaatcggtccttaaatgcgaccgcacaagtattccacccaggaatggccttgtgtcgcgagtttcatttttaaaactcattttctttcacaaggcaccgacccaggcgtcgggttttccaaagattttgtaaaccaagtgttacccaagaagttactcaaattttaagtttgaaggcgaccgtcgatactcgcatagagtgcacgaattatcgaggcgcaactagatggttacaagggaacatgatataacaattaacaatagaaggatcagatgcaacaagttaggtaggcccaccggtctgccttgcagacggggcaaacagattaagtgcaatcctatcaatgcataatattttgcaagcaatataattaagttcaaatataggctcaatatgttcaaaggtggcttgccttgctcagggtcttcacgaagcttcacaaatcttcgagaaatccgcttgaagaaaaatatccgataaccgcaactaggcgcaaacaatcaaaaacctaagcaaagaccaaataaaatgtcctatttaggctaattaatagtgccattagatagatcacaattcaatggaattactggaagtggaacggaggcaatcggacgaacggatcgagggatatgaattttggaagtttaaatgaatttttctggacaaggagacgatttgtcggaattttctggaatacgagaaatggtttatggaatttatagaaataatattctcaagaatattattgacatccactgacatacaggctcgaggggacgaattattggaatctccggattaagaggatgggtttatggaatttggaatataggaaatgatttattgaatttctagaaaagagaaatatgtgtggagtattgaaaaagatattcccaagaatatctttgactcattgacacgtggggccaacaagaaggtgagagagagagaggagcaattggagggagtaattgtggacttttagctcttgggtgatggacactgggcttggacgaagggagtgtatatggactttgtttgtcttacttatcaggccgaggaggagggtggctactgggccaagcccaagagcaagagagagggggcggctgctgactgggcgtcggctgacttggtcaagcggggccgacggctgaggtggcgccaacgtggacgtcacgtcggatggggaagggagaggaggccgggcggctcatcggacggctcacggcgggatccggcgaacggcggcaagccagaggggcggctagcactggcggcaggaggaggagaaggggaactcattccacggctcagatcgggaagacgacgcgcgacgacggccggcggcggcggccaatctcgccggcacgccgacgtggccgcacgcgagaagagcgaagggcacgcgggctcgggcttagccgaaccggtatggggttgcgacgcgcacgcggtgacgcgggacctgatggtcaccggcgacgcacgcgcggtggcgttatgcggcggcggaaggggcgacacggcgcggaggcaaaggagaaggccggcggcctagggacagtcagggggagctcaaggggatctccgggagcgtggcggcgagaggaatcggcgcgagaggtgccgacggcggtcgattgcggcggcggcaatcaccggcgagcaaaaaggggaaaacacaacgagacgacgaggattcgattcaaaggggtgggagcatctccggggttcaaggaatctgtttccggtgtcggatggggcggagaagcactgaggagggccggcgacgagcagcggcctccgggagcggacggtaatggcggtgaggccatgccgggcgacggcggtgctagggaatggtttggggaggtcctagggagctcaaggacggtgttgg

SEQ ID NO: 45633 - DNA, 4926 bp, Oryza sativa
gcaacagggcggcgacggttgttcggctgcaatggcgcggtggggggcgaaaacgagagagatggaggggaggggctcggctgtggttttataggcgcgggatgtggagcttcgaggggaaggaaccgagcacgggcgatcaaggagaggcggtggcggattcgcggtcaagctgtgacagaggcggtcacgggtggcaaaggaggtgacggtggcgccggtcggggaaaaagcaaaaagggggagggagaaaggagctcggctccttgccgattttgggcgagctgagggaggagagagcgcgtgggagagagaggcgctgcctccgcgtcttggacacacgcgcgctgcggcgcagaggtgggggcagcggcagagtgggcacgggcggctgcgcggcgcaggcgggccagggcggacggtgaccgagggcggtcggccaccacggcgggagcgcgcgcgggaacgagcgaaggcggtggaggtttgagcgatgccggcgggaaatcgacgtcggcgcgtgagagagagaaagcatcgagagagagagagaacgagagagcgagagagctctctctcggctcggctcggcgcgtgcaacgcacgtgcgaggctgagggaggagatcggccaaggaaggaagaatcggcccaacgaccaagggggaggcaaaatagacttttgcagagagatgatttggaagggatttggatttggaattgaatttcgaatttgattacttggactcagggaaacagggaggagtcaaggaatggattcaaggtggactcggatatttgtggaatcgggacaagtatttggcgaggattcaaaggaggcgattgaatttcaggatttgatttcggaaacttgaatcgggattggaaacttgaggtggaggattttgatggtgatgagagggaacaacgatggagattgaattgagatccatggcacgacttagactctcactcaaagaacgaaatttttgcatataggattttgccgaattagtttttaacgtcacgcaaaaagcggagcgttacatttccctaccgctcgccgctgcgagggatggggagaagtcgcgccaacgccgcagcacatcgccgagcgtggagtgttcggagaaatagaggggagaaaggggttgacaagtggtccccatgtttttaatttttttcctagtcacttacaagtgggcctcacttgtattgtgtgactaggttgccacatcagcacaaagttgaccaagtcaaagggttacactagcaaaaccgctctccaaaattgttgagggagtcaaattgaattttttttaattgttggggatcgagatatctggtattgtggttcagaggtacgaattagatttggcccccagttaagggagttgaagtgaacttatttcggcctgcggtactggcttgtgaaatttgtgggctttgattgccaaaggccaacaacttctatatatattatcttacattagccaagaggccccgcctattttgaaacaactcagcccaaaccaaaataaaactgcatcatcaacgtgttcgttttgattttgttgaggttgttcactttgttcttggtaaccaaattttgtcagtgggaaatcttttcccccactctttttgacctgtttacagtggccagccactttctgactctgctaatcttttctttgccaaaagcaagagcaccatggaccatctctgtactcgactctgcacgtagcaatcgacgtcaagagcttatccaatgtaaaaaagggatataaatgatcacttcggcgtaatctttggtttgtttatgcagcaccaaacatatctaaatgcaggtcagcacaacacaaagctcatggatgattttatttagttggatacagagaagtcaggaacttgtagaacacctctttaatcttctgtttccttttgttatgcagaggagaggctgctttccctgatgacataacataagagtgccaacatccacaaaggaaaaaaaacaaaagataaaataaaaaggaaaaggaggatgatgtggttatcctaaaatgttgaggcaaatctagtgtgacatttgttgctatcatcatcttgtgatccaaggaggagagcctataaagcagagagagaagaacacatgaaaaagataaagcattgtcaaagctgtgcttgtctccatcctcaccacctcacctcttttgctttccattccatgcacacacagattgtgtcacatacactcacacggatttatatacataatgacatgaagcgtctagattccaaaatccatcatgcatgcaacgatcaaatttatagtatctcacccccaccacatcacatgcacccaactacaagattgatgtgggtctcttatttatctactatgtataaatacataagtacacatatattgcctttacacgatctcttcatcgatctctgactctctttttacagaactagatcaggctagctgcgtgccatgcatattctcatgtcgtctatgcaactttatctttttctcactatatcaacaaaggaagatttgaagaggagatgggcaagaaaaaagtagtagattacaagcagggactagctagttacagctgctgatgctgctgtcaatgtgcagggaagaaaagaggagacgggtccctctgcatcttgccctgagccgggtcgactttgaccctgttcatcttctcctcgcaccagtgcagctgctgatcggtgatctccggcattcgcagcactctggccacgatcttgaggtcgattaagcccagcagtattgacatctcctcttcttccctcagcttcgtcctcctcagacaccgtcttggcctcgtcaggtccttgagccggctcttcttctgaagatttcattttcaggcaatgagaagaaagtggaattaatgatgatgatgaaagaaaatctgatcagcattgtgtgtgatgtttatttatgtggctcactttcttgttggccttcttgagggtgatgaccagagtctgatccatggagctggtcctcctcttcaccatttctctgaacatttggtagtggctcctcttgtctgcacgcaggaacgccatgaacgttctgatcgactcctccagtatgtacaagaactgcaccgccgatatcagatcgtccttctcgtcctcctcatctgcaatattttcaaaaattaacaacgcactactcaattctcagctactctaaatcagctaacaaaacaataaagtttggtcaattccatcagagaaattagttagttacctctgaactctgggacgaggagaagcttgggggatgagttcttcatccgggcgtacacctccgggcggagtccgtactcgtagggctcgttctcgatgaaccggtgaagaagaacttggaattgctggaactcctgcgcgacgcgcgccgggcagcacctcgccgcgatgtcgccggcgtggcggcggaagctggcgtagttccagttgagcgcctcccaggtgaggcagatctgcgccacgtacacccgctccagctccgggtacgggtccctcagcccgatcgccggccgcggcttcggcgtcagcttctgcacgatccgctccgacaccgatcgcggctgatactttatcgacctgtacgactctgcaaattaaccgttccagcaaacgcaactgatcagtaaactttctgtaaatattttttgttgtgtgagccccattgtgtgtagagaaagagttgcagggagctggaattgcgtcgtttgattgaggtttatgtttctcgagaaaggtttaattaatctagcttgggtaatgagtggtaatgatgacttgattttggaagaataattagtatgtacctgtctcggtgagcttctgggcgccgacgcgatggaagtagaccatgtcctcgtcgtacttgcggaagagagcgtacgactcccaccgcgacgagctccggcgagacgacgacgagaaggggtactccgtctccgagtccttggtcaccgtcgagctccgccactccaccgagctcttcgacgtcgactcgctcgtcagcgtcgacgcgcccaacctgctctcctcctcgcgctcgcgctgcactcctcctttcccggccatggcgccctccagaagcagcttcttcgtgtcggcgagcgcccggctgttcacgaacagcttcacgtcatctcccctaaacctcttctcctcctcatcgtcttcttctccgtgttcgccatggccgtcctcttccccggctgcaaccacgtacgacgagtgtcagaaccaggatgaaatgcatggttaacaagaagtaatagaggttagtggaattaatggttataccttcgacgggaacgttctccggtgatggcacggcggccggaatgatatccttctggctcgacgcagtggcggcggcggcggcggcggcggccttgggctcctcatggctgaagctgcactggcgatggtgcggcgagattcgtcgggtggattccaccatgggaaaggtgctctccacctgcaagcaacgtgcaggtgtaggtgtaggtggtgtggtggcagcgtcgtacatgagctgatcctttccttcgccaccaagcagagcagtgtcctcgaacacggcctcgtcgaaccagaacagcatctccgcttgctgctgctgcactccggcgatgtcgtcggcgccggcgaactcctccctcccggaggtctccgtgacctggtgctcgtcacagctaccatggcctctacatacatacgcacagtaaaaatgtgacacgtccatgcaattaatggcacaaagatctctctgaactgaagctagctctgtcactcactcaccggcgtgaaggccggcggcgagcttggcgaggaggaagaggaggaggtaggcgac

SEQ ID NO: 45634 - DNA, 7288 bp, Oryza sativa
  unsure (1)..(7288): unsure at all n locations
tcagtgccagcatctccccgcagacgactgccgggggaggtgcctgcagaagacagccgtcgccggcgcccccgtagccatgagaaggagacggcgagccaagcacttgcgcatgcaacggcgccgccacccgagagcagcagctgctgccgctcgcattacgcatctaccacctgcagcttccccttaatttgcctcttgctcctactactacttccacactgtcaagctagctatccttgcacttgcttattagtatcactttgaaatgaaaaatgggaggaaccaaagtggtgatgtggatcaaatcgggcgaatggtttgggacaacacaaagtttatataggctttgcataaagcatctgggagagatcgagtgattagagaagcatggggcccaacgtgatataaagatggtcagatgattctgttgatgagaggagagttagcagaagaagcattaaacagtggttaaattagttgtttgattgtgaggcaaaggaggcatgccctgtctcaagttacttgcattacgaggtaagcctatatgcgtttcatcacctggggttttggtataattctcttacttcgattttctcatcatctcatcaccgccgatagctagctttaatttgacagtatatatgatcatccagctagtggtagtacgtaacatatctagcagatcgagagcatcttctgaccattatgattttggttacttgcataagtaggtcaaagaacacgctatcatgcagcaacaatgtcggaatagaatcagaacatagaatcagaacatgaatcagaaaatgggcttgcgaaatgggcccccggttagagaaatagtcaaataggccgaatatggagttattaggcccggttacagaataagcccaacatagagtaataaacttctgggccatcaacattttgtgctatatatctgggctaattttcaagtgggctatattgttgcgcaattagtctatttgggcctcactgggccctacattctcagcccacttgcgaaaagctttattgagcctcaagtcctcttttgtccttctgaattcccctctgttttcctcctagttcacatctaaacatgtctttcttctccttttagtgcttcattttacctcgttcaattaacatatcgattaaccaatcattaaccaataagcaggttgggctttcatcagtataaaattaacagagttagacgtgctctaaaaccagcagtaactggcctgttactgtcgaagaatgggagcaaaagccctgcataattaagcacttgatctacataatttaatgcacattatcaaattaactcaagtcgtcaacaattgtggccacttgacttggaacagggcaggaacgagcgatcgacggccggttgaaaacagggaccgtaccggtacgtaattaattaactgggctgtcagtggactgatgatccgtgtgacaacgtaattcacgctctctatcatgcgtcgtcaaattataatttctcaatcaagcaacgagaaacaaaaagttacacgctatcttggttcaaaagaaggtcgaaaccatgggaacaactttaattttcccacatatagtatatactactgctttgcaagatcaactaggaaagcctgaagtgtaattaggcactagatataattaatcaccaccacgagctaagcttgatgagatcatgccaactaggatgaacacttgcatatgcactcagccccagcagcacacaagtttgccacaagttgagcaataaaactagtgttttatggcaagtgtcctagaatcatttgcagctaaaccatatataaataaattggtatccagttgctgatggccctgtacactcggaatccaagtgcttattaggtgcattgcatctctaccaatcgatcgggccatctgattggggaatgcgccatgaacaccaggagattctgtctcgagcgagggggccccaaattttgttggacagcttgatttgttctatgtatttttagttcgattttgtcctcaacaagatgggtttactgtttcagagcatatatacttttactttccccgaaataattgtgtgtctgtttctgaatttttggatgtttgcgtcctagctgatgagacatcgtacgttcatagcatatataattaagtacatatatagttaagtccgaacttaaaattgaattaaacctgaccaaatatgctctatgttcttgacgaaaaaggctatacatactaaaactttcttactgaacttttaataacactgatgtgttatatatgctgtgggtacatcactagatatccactcatctatgttaatcaaattgttgaaattattatttgtaagagtttttgttttttaaaaaaaatatgtgtagtagtgctccacgttcttattccaatcggctattgttgggagttggttgacacgtgggtcctctaaccgacatgccattttcgctctaaaagaaagttgggaattgatggtcgggtggtgacagaacaatcatcaccgctagctactcccttttataaggagtatagatagactagcaaacatacaacaagggaaaaaaatcataaggttaaaagagtaaagataaagtcacacaatttgctattgaaaacagggatagaaatgcaaatgccatgtttcttgggtcggtttagtcctaaaatttcatttgtgcaaactcgtccctctcaatgttgatttgcaccaagccaactcaatgtgaatctagcgtaaatagtaaaatccccgattaaagttcaaattgatatctcacatgggtaaatgtataatttgtacttcctctgtcggtgacatggggccgggggtatcgtgactagagacttgggtagccgcggtcacccacgtggcctgaccccctcgggggggtcgggcccgagggtgacgtggccacccctccctctgtctccccgaggggtcgggccgctcccgtttcggccccgagggctggggcgcccccgtttcggccccgagggctggggcgccccgaccccctgtggttttggcgccacgtgtgtgggttaggtgagcacaacggggctcacctaaccgcatttatagcaggttggacgagcgcgccacgtcgcatttaatgcggcgcagcgcacgcttatccgatccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaaatatggcaaggaagtcgctggccattaaatgaaggttgaaatgggcgtccaccgggaaagcgggcgagcggggcaggaggcgtgtgctctgcttgtcagaggtcatttccggctgtagactagccctcattgtaaaaagcatgtttcccttcttaggcaactagaggcccatgtggtgacccctgaccagataaaaaggaggcccaagcctaggagaaagggggttgggactctggggaagaggggcgagagcctgaactcactctcgctctccggttctctgtattccttcaagcacagatccaccagaacacaggagtagggtgttacgcttctcagcggcccgaacctgtctacgtcgcccgtgtcttgtgcacttcctctcccgctgactttcctcagatcgagggcgaagaacctcactcagcgcccccggccgaaccggcaaaggggggcctgcgcggtctcccggtgaggagccccacgctccgtcatcctctatcccaaaatataagtagttttaattagatgagacaaatcctagtactatgaatctggatagatagtttgtctagattcgtagtactaggatataccccatccaaccaaaactcattatattttgggacggagggagtatatgaaaaggatgagtatatacacctagctaggtgtaccgtgtataatattttcttttatgagtatacatatatgtgtgtgtcggatacctactctatatatagtgcttgcgggtttaaaaactccctctgccaaagctttcaatcactataggggaaacgatttttagtcccggtttacaactcctttactaccaattgtagcaaccgagacgagcaaatcgggactcaagttcaaaatctttagtaccgatacatagcaagtgaaaataaatatgtgggatatgggattcgaactcaagatctctcacctcagccctcacacgcgtaaccaactcacctactacacacatctagcttgaagagatgttttacttttgaactaaccctggaggctttactactggtctttagtccatgttggtgttaccaaccgatagtaaagataccagttggtaatatcaactaggactaaagatgtttctagggatttggacttttataaccggtactaaagcatttttagtactggtttttaatctaaccgaggtatttgtgattttgggtactacgtcaaaaggtttgttctctagtagtgaatactccctaatccaagattaattaagatacatgtaaaaaaatataattaagataaaccagcaaagcatgattactagtaataaagctgtaagtcccaccaattcaaccctcctatattcttcttttctattaatagtaactccaagtcctcaatctagccaaaaaatattttggcaacttagttccttgtcaaattttagaaaaaaacaatgaaataactatggctcaaaattgctaaatattaacctggttgtcaaaagctgatctcgatcgatcggtcgatcagattgatcatgtaagctacctaccatttacccaaattaaactgtagtgctgaccaatttagtagtcctggcacacgacgcgcgtggaacaattttgcgtggagaccacacgccttctcgttaatctaatccaacaattctaaattgagaaaaatatcattgatcacattgactagtagcagtaaataaaacgtaattagagtggagtagccatcaagtgggcggttgataaaggttagcatatataccaccattaggccggaggagggtccagatgcattgcaactttgcacacagcttcgtcgggagagcctcaaatcaaatgacacattggtcgaggattatgtcattgatgagctgtgcgattacacgtaagtacaaaaactatatacctacaaagtttatgagggtacgacgtagtcatacgaattatttttttcttagattcttgagcggttgcaagtttgcactgtgcgtgcctggctagatttaaattaacctaggtctagaagtctttgatttatctaatggctcctctctttgtgcacctttcttctttattccatgttgcaaggaatgcagagatcgaaattttgtttaatccttattttaaatgcggctactaacagcatactattcaaatagttttagttagtggtacggatctaaatgaggttctggatggataattaattcgtttctcatgaattttatgatattattctcattcaacacgaaatcttagtgggaactcgtcatggaaatatgtttgcaaaacagtaggcaatactcgtggaataatgcaaggaagagggtattaggcttatcctgaattatattgattgatgcctcgtacgtttagttgaccttgatgctacgaacaggattacccaaaaccatgggcgctttctttttttaatttttttcgatatgatggattcatgcatgtaccatgcgattcacattatattacacagctcatgcatattggacaagtggaggcacaaatattagggagaaaccaagctagattattttgtttattgtccctatgcctttttaccgtactactccctccgtcccaaaataagtgtaattttacactattcatctccaacgtttgaccattcgttttatttgaaattttttatgattactatttttattgttattagatgataaaacatgaatagtactttatgtgtgactaaatttttttaaatttttcataaatttttcaaataagacggacggtcaaacgttggacacggatttctatggctgcacttattttggaacggaggtagtagtagctaggtttttctcctaataaatgtaagccattcagtaccattagcccaaatgcaaggcctcacgcttcagaaacttaaactactcacatcaaatcaagaaagaggctttgaagaaattttccttttaatttatttaatggagaaaattgcaacatgcatggtagtgatgttctaacgtacatatatatgtactccatgtacgtataatgtgcgggcgtcactgtacgtaccggtggtcgaactatatattttgtttagataatgaaatggtttacaaaggtcaacctaattaagggcctgttaattaatttgcaacattaaaagttcacagcatttatctaagtttgcatataagttttctacaggatataaatgtgttttttttacataataaacagtggttacaagaacttaatttgagaagtacggggtattatgaaagttgaacttggaatttgacttgtcaaaaaaaaaacaatgtgcaccgagtttccaacaaaagaaaatccattatattttttttgtaagataataaggcaaatataagtaatatgaaccctcaaaatatctgaaatttaattacatatataagcaatataaggtaagctcttgaaatctattttctcatttaaatagccctcaaatattcagagtatttatgcatatgtttttttcattttcatttccattttattttagctctttactctggttgagtttccgatcaaatgtctcttaatttgcttatatgtagttaacaattgtgtgtttgtaagttgataattttgagctatatatatatatatattgattgattgacaagttacttcagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45635 - DNA, 24702 bp, Oryza sativa
  unsure (1)..(24702): unsure at all n locations
ctgcgctgtgtctgatgttggctggcagcagcagtagcaaacacatcacatgatgagatagttgctgattagccagagagtacaccacgcatggtacttgttctcctccctcgattagcaagggtcccttaattagctagtgtcggtgataaactgcttgtcaccttagagtagccagctatcactgcatgctgcacttaaaaaaaaaaaagaaaactgcattctgatcgatctcatgcatgcttaacttgtcggtgaaaatgacagtcaagcaaatgaattgaaagtcgtactctccagctcgtgacgtcttgatttgcacatcacattatatattctcatgctttcgatcaggaaggagtccagcacgcataacgggtgcacaaccgccgcgcattcatgcagcctgcatgcacacaacaatccaatatataccaacagatcgattgtctgacaatccaaactactgctgtcaaaaatgttttatggttaatttgcaattgagctcgatgaacaattcaatccagctttcgaaataatggatttggtcgcgtgagaatgggcaattcaattttggagatctagaactgaataaagccgcatctgtaatccgtccttctcaattcttgatcaggtcttgcgtgcgtgcgtgtgaaagccgttgacatcctactgtatatactagtattcagtaatccaataacttctgtacagcacacgagaatctcttcagggttagttaaagggatattgaaaaagcgctttttcagtcgtactcaactctgtcgtctctgcttgttttggactttgcttctggatccaaattcacttattgctttacgtagtaatgcatcgcgattatttaatccaagaataatttatgggtttctggtatgtaaaagaaaatagattaagactcggtcagattaatccagctcaaggacgaggttccagaagaacatacagcctatgcaactttccaggtaaaactaagatatattcagacttcaagtggcacatttgtgcatggcatatcttggagtttatacttgttgtctgatcgtacaagtagatgacgcattgacctatgaggctgttatcaattagtctgtacaattaactctggctaacaacctgacgacggggctaagtgtcgttatctttgaagctatacagtggcttctgaccgatggaacctcacgggacacacttgaaacttgatcagcagctagctactccctccatcgtatcctcgtaatataagagattttgaatgattttgaagggatctagattatttatagttgtggatattatgggtaccccatatccatacggcatggttatccgactagtcataggggataacttatatttatgtaatgtgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcagatgagacaactagatcgtcagatctataatacacccggcggattcaaatccccaaacaggagtagggtattacctctcattgagagggcctgaacctgtctaaatcctttgtctccgcctccatccacttttaggtctcgtgcgctacccccttttattattgccgaaatcatgtttcgacagttggcgcgccaggtaggggtgcgtcgagtttcttattgacgagtgcgatggaatcaattcaagcgttgagattaatctcaacaagttcgacgacttcaaacgataatcggtttgtcgtttcaatatattattatcagattgatctataatcacatttgatgctctggtattttttttcctcggttacatgtactgccggttggggtgttcgctggttctctgcgggaccaccggtcgagccatcgtcgtcctcacgttgttcgtcgcccattggcagcacgacaccgacaccaggcgtacacgacgacggtgcatgctatgaccatacactggctagagcaagcgtatagattggttctgatcaatctagtgcatgcactgccaagtgccaacgatcattgcatgactggattataggagcaagcaaacaaacctcgcatcactaatatatgcatgcctatagcaagtatatatgtatataggcatctgttttctatggtgctaataaatttttgttgtttgtttcgcatgtaccgccgggagcaacgtgctcaccggccgcctccacgcatgccgccaggcggcaacctcatccccgcgtcggccgcgtttgttgctatcgtcaaccgcgtttcggtcgtcgtgcacatggtcgccgagttttgcggagtttctggttgcttgcaggcctggcctattatgccgccgctgttgggcgtctacgacttcaccgccggcctgcctccgtcgccgccgattggtgcctccgcctacacggctggcctattatgccgccgctgttgggcatctacgacttcaccgccggcctgccttcgccgccgccgactggtgtttccgtctgcacggctggcctattatgccgccgctgttgggcgtctacgacttcaccgccggcctgccttcgccgccgccgactggtgtttccgtctgcacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggatgtctacgtcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggtttcctttgggccgattcctagcacccgggggctcgttggatggaccgagtaacgcaaggtgctaagtattattcggaataaatcaaaagcatagagatgagataaatttattttctgctcttaataattgcaaaagtacctaagtagtaaattctgatccgtgaaactttgttccattaatgacgaactcatgtcactcatatgcatgtttgggaaatgcctaggccgactcccgatgcttggtggttatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacatcttcaccgaccggcttgccttcgccgccgccgactggtgtttccgcctgcacggctggcctttatgccgccgttgttgggcgtctacgtcttcaccgaccggccgcttcgtccgccgccgactggtgtctccgcctgcacgtctggcctgttatgacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatttggtttatacagctaccactactgatggacatcatcgtcttccgccgccgactagtgcttttatcttcacaactgcgcgtcttcactaccggtttgcttctgttgccgccgactcgtgttcacttcatcacggcaacacaactttgtcatcatggtggagcgacttcatctttattatcttcggtaccagcaaactctattgctgctacttcacaagttttgctacatcaccaaccatgacgttgttgtgaatctcgacatctcggcatgcgatgccgtgttattttactacaacaagtggctctccaacattcatgatttctacttggacatcttcaacacatatcttcaatcaagcaatgactattcgacgacaagaggctacagttctcgactctatgttcagttgtttcccaactaatcaaagagtcgggggctacacaaatacaaggctcaaaattttgacaaattttatgtcaagctgaagaaatcaattcatcaacccacgagtcaactccaggagtcattatcttcatctttgcttcggagcagacattctacttcaacaacttcaaatatttcggtttagacgagttgggcaacaacatcaactcttcacggttgacctactatgcaaatgctgatgagcgtctttgtcattatcattggttgctacactgctattggctggatcaccgacatcgtcatcttcatcatgtcggttgcgtttgtcgtcgtcaactacacaactttatcgctgagcgccttcatattcattgctggctgacctgactgccgccaactggtttcttcgcctccatggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcggatcagaagctattcatatgagctacgcttggtctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaattcttttataccgcagttacttaactttttaggagttggtacaatgcatcttaaaaggtgtcaaacagtaaagctttatatagctgtcccgctgacttttttatatataagtcaaggtgttgtttgggtttttaagcaattgattggatacaatatcattgcttttcgccacgtaagtgtgcatttttattgaccaatattatggcttaggctgattatatattgtggtcattttctaggcggttggtaaatcctttataagtttatttacttggattttataccacatatgccatatatttccaggtgtggtggaaccatgtgtcttctagggacttaagcacatctgttaaagcagtgtgcgcatggcgtatgcccaatactttggaaatttctttattcacaacatacaagcttttttatagctgttttgctatgtgaattttcaataatgtagccaactttaggttacactcatcatattttgcaaagcagtcggtatatcactcggatcatgttattcagggatttacaccgcatatgctacatattaatatcaagttgcttggttaattacgattatcaaaaccacttggttggttggattatttattccttgactatatgcttggtttgttcaattaaccacattgtcaggggctacacctattaggtgcatctagtcgatgcacctgactatatttttcagccctccacagtcttcagatttggtaaaagtactcgggagaccatggcgaagatgattgaagcactcggctttggagtaatctagttcgagagaaggttatcttttcgactgcgaaggtctcaggagctactgtggatattatgggtaccccatacccatacggcatggttatccgactagtcataggggataacttatatttatgtaatatgtaacagatcatgacttgggtgttacgtttccttgtatattacggaacggcctaaactcctggtttgataatattgtaaagtagatttaggaaaccgataccgtattggttaaggtttctatcttgtaatcctgcccctcatcctatataaggtgggcaggaggccctctagggggcagatgagacaactagatcgtcagatctataatacacccggcggattcaaatccccaaacaggagtagggtattacctctcattgagagggcctgaacctgtctaaatcctttgtctccgcatccatccacttttaggtctcgtgcgctacccccttttattattgccgaaatcatgtttcgacaatagtactattacatccctccaaaatctcttatattttaaaacggagggagtactacaatagtagctgaattttgtacttgcaagattatccggcacaagatagaatatattcttgcgagctgaatggatatatatatacgtgatcgactatggagtacacagcataaatacttatattcacttattccgaaaaaaatacttatattcacaattatattcgcgaaagtggtatggtatggtagtatattatgacatggatgcatgatcgatccagccttatagcatatgctacatatgtacgcgcattactacgtggtgggctagatgacctgggtttaaagcctcattctttctaattatttgatattatgtcattccctaatattcgcgttactacgttgcaaatgggtgggcggcatctatattatgaaaattatgctagcttatagataacttcataacacataaaactggttagaagtgaagtgagcgtaactcaacagggttcaagttccagacttgacacggccgttcgtatttatgtctaattattttttcagtggtatgcgacgtacctgttgacataaaggtaaggtgtacgtgtgttttttataaggatcagtgtacgcatgttgtgaacgcttatatttgtgctgtgtttctcgaagaaaaaaatatatcacctgataaaaaataacgcatcatggccattgctacagatattgtaaattgtcgtcattggcactgtaatatagccaactagcatacttatcaaaccagtttggatttaataacctattcttgctcttcagacatcaaatcagagatattacaatattagtacttagtaccagtatttagacttggaggaccagtgaagtacagagtgccaactaaaaatttgaatataaggtaaagagtaaattgcattgccggtacatgaacttgtcagatgggtgtaatttagtgcacgaatttgtaaaatgtttgttttggtgcatgaacttgtctagtacatacggaggaaggcgaaaaagacactacatagctaatcttattgatttagaagtttattaggacactatgtaaacatagttctaagaaggttgttattggacatacacattttcaataaaaaatagaatatgatacagtaatagtagaaaaagattaaaaatccgagcaatgatacaagggttagaaatatatgaaattcatcatttccacgatgaagggtaaagtagagaccaaatttataaataatgcatttcttatgcatactcactacacgtatgtacgtcacattctaatcaacatctcaacttcgtaaaattaacattgacaagttattttggtcctcattcacacgaactagacaagttcgtgtactgaaacaagaattttacaaatttatgtattaaattgcatccacctaataacaagtttgtgtactgccaatgcaatttactctaaagtaaaatttgattgggaaccaaggccccgcttgtcatacattgaatccacccacgtgttttctcccaattgaattgcatagactcgagtatatgtagacattgcaaaagtttctttagacatgctctgataaactggtcaatgtatgcagctagctgcatggaggaatcggaccaacccatgagctaatctgatctgagcgacccttcagaattcagtacagcatcaacctctcgttgtcacttcggactaccggagacaaattccctatagagattacttcggacattctttgaacaatggcatataaaatcgtttttgcaaattgcatggtacactgggatggatgaatcatgaatggatatatgctttggcaaacggcctaaaaattctcttatataaatgtgggatcactctctttctacaagcaattctacctgctacaatggcttagatctacatgcaaaggtccaaagtatcattattaatactcttcatttttaacagaaaggcccagcaacataaaaaaagagtagattttacatacacgttttgtgacacttaacgcttaagtattaaagtttcaaaaaatcgcaatatcaacaaatgggttcacccgcgagatgacatagttctttccttgcatatatttaggatgtaggcatggcgaacttaaattttcgcaaaacatagttctatctaggatgaagctcccaaatctatattctaggtggaacaaccacgtcattttgtaggtggatctgtccgttgataatatagttttgcgaaaatttaatccaaaataaatatagttaagtgccaagtgtaaaaacatgtgtagttttttacaacttggaccataaaatatgtaattctattaaatttactcaaaaagagaaggactagcactcgagtgggcttaatttttttatctgtgagatttatgggctgacacaagtaagcctgtgcagcccaggtagagttcgttttgtgcccagcccaagaaattaacacgaagaattcggactatccaaataagtccgaataagacacggcccgcagattatttacggctcaaatgagtcagaatggattgccccaaatgcaaaattctgtgcatatgcactgccaattaattcacagcaactgtactcctgttcatatcaatcaaaacacaattatttggataaaaaattccgacactatctatctaacctactacttgcactgtccatggttgaattcctgtcttgttttaccggccttcagtggtgaaggagatcgagatggagttcctggagtcgtcctcggcaatgccgcccagcgccgccgccgacgccgacgccctcgtcgtcatcgtgtcggtgccgagcgtggtggccgtgttggcggtggaggcggcggaggacgccgtggtggtggtgctcatccaccggccgacccggccgtggatcgccggcttgccgggcttgggcagcgtgaaggagtcgctggacagcatgaggtggacggtgtacatgtccggccggtccgacaccacggcctggcagcacagcagcccgagctgcacgcacagccgcgcctcgtcggcgtcccactccgccatcgccgggtccacgatctccatctgcctcccttcctctgacagcttccatgtctgaataatttccagaaaaaaaaaagattcagtcacaactcacaatgctgctcctggaagataaattttcagaatccagtgttgttatttcagagtacttacgtaattcaggaggtcggttttttcggcgtcgagatgtttatcgatgtttttcctcccgctgacgatctccagcaccagcatcccgaagctgaaaacgtcggttttcgtagacaggtagccgttcatcgcgtactctggagccatgtaaccactgcgacgtatcacttactgtactcacacgcaaccacagagattttgtggacggatcaagtgaataacaacgatgggttctggtgtaattactcactatgtgccggaaatccggaaggtgttgacgtgcgtggcgtcctcgaggaagagccttgccatgccgaaatctgaaatctttgggttcagctgttcgtcgaggagcacgttgcttgccttgatgtctcggtggatgatcttgacgggggattcctcgtggaggtagaggaggcctctcgctaggccgacgattatttggtagcgtttgggccaatccagctgcacgctcttctttctgtctagaggtacataaacaggtatcatacatacagcaggttgcagagcattttctgttttttttttttatgttgtactacctctgtcctaaaatatagtaacttttagtcatatatctggactagtgctaaaagtcattatattaattttggaatggatgtagtactgaatactgatctggttttgtatggattatatatgcagatggaattaagtataggtacatgcgtatctttatgtttaaactggaaattgtaaagaacataattagttatgctttatgtttttttttaacaaaatcatggagcatttcaaactatggtacggagtagctaattgaactttctgtcttttgtttgtccacacagaagtttgtgtgtgtgtgtgtgtggggggggggggggcggtgttcagattactccaaatgacaagaaatcctattcgagaaatggtcaatccaaagacattgggcggcataatggcatacagccatacccgatttgatgtgatatgttgagcctttgagattaagcaaatcgaagtattgcttttgacacagtaaaggtcaatgagaacgtcaaggcagatttttccttacattgactgacaaaaagacttcttgcagattctgtgttctgcttaattgactgaacaactctgtgtgactgtgtctgtgcgaatatatgctttgccacggctaactcatcgttttggtctccttgaaagttgaaaccactaggccacaaacaatggaactccagtagggacttgtttttctaccagaaatgactgtttctacaagcactttccctgaattttgttcagaactaccatagagttttggctattatgatttgtgcaccacaaactctccaacagagtgcctagcttccgaggttagaacctttgtgttttgattaatgataaacagataacagtgattcgttatactactaaaaaaaatgaccaaactgtcagatttagctcacaaattctacccgtaattcagaagcaatctgatggcaattaataattaggacattttgcaacataatacagtagtatgcagatgagagagaggtgtcaccgaagaggaagtggtcgaggctgccatttgggaagtaagggtagacaagcatcttgtgaccggaggaagcgcagcatccgagcagggagaccaggttcctgtgctgcaccttgagcagcagcctcacctcgttcaagaactctctcacaccttgccgtgactccagcgacagcttcttgacggcgatctcctgcccattctcgagcaccccctgaagagagatggtaacaagatcaaccgattttttgtcagttagtagttcattcttcccaagatgtaaaattcctgacaagtaatggtacgtttattatttactactactgctttgctttgcaggagtaaaaatgatgctttggttcgtgcaatgttgagattagaatctcaaaagagaggaaaaaaactaatatcgcatattaatttgacgaaatgatgtctgaaagtagcagagcaggtataatcagttattagtggtgaaaaaaaaaagagagagagccagcaaacagtagaaaagatatttgtccatggaaaagatagtacacccattacccatacatagacagggttagatcaatcatttgtgtcgttttggtaggtgaaaaggacaaaatcagaatggaaagcaaggaatggctttgttgaccaaccaataaaaaaccagtctttgttaatgttaggtgaattccacaagcaaaacagggcaacagcctagcagcaaagcaaagccatggcgaaaggggacgatgagatggcagtaagaaacaagccttgtagacggggccgaatccgccgcggccgaggaggttgtcgtcggagaagccacgggtggcggcctccagcacgggcagctcgatgaagaggctccactgctcctcctccctccccgacgccgccccgccgccgccgccgccgccaccgccgttggcctcacgatcagcgcctcctcctcttccgccgctgctcctcctccacctcccgcaccagccgcacgaccacggcatggcagcagcagagcaaaatagagagaaattaaaacaccaaagcacacgagtacacgacgcagacacgcagaagtgcagtgcagttagctaggtgtgacgtttcaacgacgcgcgcgacccggtggcggggtgcagagctagtttagtgcaggtagtctggtgatttatggaggagacacgtacgtacgtcgtccatgaccgtggggtgtgtttgtatcgcagtgttgcaggcggcaaagccggcaaccgcgtttgcttgcttggtcagtgtccaaatgggacgagagacgactcgtgccttgactttctagtagtactagctagctcccatcgtatcatacgtggccggcggcttttcattccagccagccattaatagaagacgcgcaattgattgacctatcatcgatcagtcgtgctcctcactttactccctccgaaaaaaatactacatctccgtcccatgttacctgtaattttgactttttatatgtaacatttaatcattcgttttatttaaaaaaattggtccaaatataaaaaatgatagtcatacttaaagtacttttatgataaaacaagtaacaaacaaaataaataataattctaaatttttttttgaataggacaaatgattaaatattaaaataaaactcaaagcgacaagtaatatgggatggagatagtactacaaactatactactagtatttcgacagaaagttatctagatttgtcaaccttttatcaatgctctgaacctatgggatataccgcagttgaacatatgcatgaagtattaaatataggctaaaaaaattaattgcatagattgcgacaaatttgcgagaggaatcttttgctaattgctacacgatttgataatgtggtgctacagtaaatatttgttaatgacatattaattaggcttaataaattcgtctcgcagtttatagacgaatcttgtaatttattttattattaaactacgtttaataatttaaatatgtgtccgtataaccacgtgacatggcaacatgatctaaggtcagcggtaattacctaccgccggccgtcgtgatgcctgtgggccctacagcccgtcagcacggcctgtctcggacgatttgcattctatccagcccaacactatttgggccaccgagaattgggcctattttatgggccgtgatgggcgaataggcgggaaggagcccaactctatgggcttcttcgggctccttctacccgagctaatgttattaggccgaaacggcggctctggcttacgttgttgggccgaaactagcgatgaacggaccaagcttgcttagttgttgccggtaacatgttactgctacaagcgatcaatgggacaattatcgcccgtgaattctacctgatgatttatccacgtgctcatcacagccagcagggaaggccagaggcgggatgattaatttgcatggccgacacgtgattgccatataggattaacggggtgaaattaaacgacaaaaatcatccctgatctgttcttccctgttgacaccaaattaatcgatcctttttattacggttaaacaaccaattctgggaggtgatgcgatgatgttctagctagtaagaagagaccaaacaaacagactattgagagttgagactgctaccaaattcatcttatttattggacagcaaccacaacatactagtactacgtactctggtcaccgaaacattccctcacgatccagataaaacaaacacaataaagaaaaaaaacacaataaaggaaaaaaaacatacgtgaccacacgaatgttacacatatgtcactgctactcggcagcaagcaaggcgttaacgctgatcgagcggtcagcgcgtgcgcccctgctcgacgcgtcgctcttattcaccgttggatcgtatgatctgaggctaattaacatgagtagctaattaagctggctggttgtgacacttgggccccgggaagccgtggtagcgatcgaggcagcggaagcgcggcggctgcgactccacctgcacgcacttgccgcagccgccggagcacgacttcaccttgtcctggcagctgcacgtcggcggcatcgaccttgtgcacacggcgtcgtcgcagcatttccacggcctcgacctcaccgcctcctcgccgccgccgccggtgcacttgggcccggggttgacgccccagtaccagtcccggcagacgtagccgccgccgtcggcacgcttgcagtcctcgcaggcggcggcgcagtggtcgacctcgtccaggcacttgtacttgggcggccagatcctgagcggcgactgcttcagcttgtcgcagcagtcccacggcggtgacggccattcgtcgccgccgtcggtggggaggcggatgttgctgttgggggtgacagcggcggaggagatggggatgccggcgaggaggagggctcccagggtgagcgtcagcaggctgccgctcttcatggctgatcgttttttgttctttaagaagttgggtttgagatgcagagtgtgatagtagtgtgtgtatttatagaccaggaaggcagcaacggggcccacgaacgagtccacgagatgtggagaagagcgagcgcgcacgtggcgctgtccccacttgtcagaacacgggaaacacgactgaactagggaaactattctaatcccttaataatgttcccttaaggatgttccctcgtttgctcaaaaaccatataaacggttatgaaaaattctggaaaaaattgacaatattcagacaacacatatatacaactccataaaatcttaagtccaaactcaactcacacatcgagatataaaaaagacaaattcagcgtataaatagtagcgtactgtttatatgtaaatttatctttttttttctcgatgtgtagatcgaatttgatcatgaattttggtgaactagtaggtattattatactctacactgtcaatttttttcagaatttttcataattatttgtatcaaatttaaaagaaaaaggtatacaaggaatatcttctcgagggattagaatccactcccactaaaatatggaattgtggtcgggtctggacttctcggtggatggaaagggcggatggtaacagtaactgcacatgagcttcacgaggatcttggcatcgtgcaacgcatgtgacggtacacgcatgcagttgcctccacgtgcgaaaaagggcactagcctgacgcatctcgctaatcgatgcctagtttattgatgccctctgcagccctggtccctggacggagtaattggtcatgtcatgtcaatgatgtcaagtctgctggctgctgcaccctgcacgctgcggaactcctcagcctcaagccctcaacacgttgctcatctcgatctttcgtccgtcggcctcccgtgtcgtctacgtgggctggacgggcctgagcgctttgggattttgggcttttaagaaaaacaacgagcttgggctcctaatctgattcttggggccttgccgtcagtgggctgcaaagaccggcatttactccatcagttttaaaatataaggatttttgaataatactaactcaaacatttttaattttaactatttatagaaaaaaaaattaaaacatcaatcatataacattgatgttagtataattatcattaaacttttttttatttaaaacatcttacttttataaatattattagttaaaatagtatatcgaagactatgctgaagtttaaaagtgtttatattttgaaacggaggaaatagatcgtacgtaattggtggcatcagctgaactggtgcgtgccagcatcgcacccactgtcgtagtgtagatcatggatatatatacgagatcatagaagtagataattaataactcaccaggcgactgatcagtatatattagcactgtattagtgtattctcgatctcacacttgcagttaatttcgagatgaacatatatatgatcggtactacgtgattccgatccttaataatattagattaattagttaattaatcaagcagcttaattgtgtggatcatatgaatcaagcgtgaggaggaaggaggcccttgtcctggaagctcttgatgcagtcgtcgaacatctgctgcacggagaggaatggcgggaagccgagagccctgatcttggcggtgtccatcttgtgggccctgtcgtctcccttgtggctgccgcactccgcggggatcgggtaccccgggtacctctccctcagcgaccccacgatctccgaccagtgcgccacgtggcacgagcagatgagccgccccgacgccctggcgtcctccatggccaccacgtgggccagcaccgcgtcgtccacgtggacgaaccccaccgtcgtgttcgggtacctggggagctcgccgcggaggagggcgagcacgatcagcgccgtgctcgtcggcgcttgcgacaggatggggcccacgacgaaggacgggttcacggcgaccatgtcgaggccgcgctccttggccagccgccacgcctccctctccgccagcgtcttggcgtaggcgtaccagaggccgtgcgccgcgcagtaggcggcgtcgctccagtgcgactcgttcagcgccgccgccgcgccggcgccgtagcggacgcaggagcaggaggaggtgaacaccacgcggcgcgggcgcggcgacgccctggcgcaggagcggagcacgttcgacgcgccgcgcacgatcggctccactagccgctgctggacctcctcctcgtcgtcgtcgtcgttcggcttgccgttgttgctgctgctgttgccgaccaccacgacgggggacgccgcgtggaacacgccgtcgacgccgcggacggcgtcgtcgaagctaccctccaccatcaggtcggccttcaccagctgcagccgctcgctcgcgccatcaagctcccataggaaccccaccttggcttcatcctctgcatgcacacatgctcagatctcagacgtgcatacgtcgtgttcgatcatttgcctcaacggcgcaagtgtgcgtgcgtgttacctgggtctctgacggtggcgcggacggtgtggctggcggcgagcagcgcgcggatgaggtgcgacgcgatgaaccccgtcccgccggtgacgcagtactccggcatctctctctctctctctctctatctctagcttactaccgagagcgatctctttatgtcgaaatgacgttaatttattctgaacttggggagctcagcaatcgaaatgttaattatttcttcctttgattatcattttagaagaaagaaactccgttggccggtttgaattaggttggtcatgggaagatcgaggtatagtattactcttttctagagaaggttagtgtgcatgatgagcttgaatttgtaactgcaacttactaaattccaaccttctcttgtagctattccacctgtttcaaaatatatcaaccttataccagaatgtgatacaatgtgcagatttttattgtagtacaatgtactcaagattggtttattatgggacagtgggattagtaacttccaacttgctcatcgtcagtcgatctcgctggattcattaattagcaaatgacacattggctccatcgtttcatttatgcttatgcaagatgtactaattaatgtgttgttagtatactttaggatcgatcaaattaaaccctggttgctcttcgatccatcctcacgatcctgtccaagtaacaagtagatgcaaggcgtagagagggtaagctctaggttcaattctgcaacagcccggttatcatcttggtggttacagctacttgcgtcgtcggcgactgtacattcatcgccattgacgtccttggaggaagaagatgaattgtggcccggatgctttgcaccacgttcgtcgtgagcttcgcttcgcagacggcgacgccgtcgacggtgttcatcatcatgtagcgagggtggatgctctatagtactatccatcagcttggagttccagtggttcatgacctctttgtctgtcctccccggtagcctcccagcgatgagggaccaacttgatatatatgcatcaatattaatttgatcattgcttaattataacaaacggtgaattaatagcggaatattgttgatattgggggaattaattaattacgtacgtaccggttgccgagcaaagcgtgcagcttgaggaggagctcgtcctcttcctcggagaagctcctcctctttctgctccggctaagcggcgacggcggatcaccggccggcaagtgctcggagatgagccgtggtggaggctgcgatgacacctgcagacttgcagagctgcgccgtcgtggacacctcattacacatgtgttagcacaaattacagctagagatcgtcttagctagatcgatcgatcagtagcagtagaagagacaatataattctgcatgcatatgatcagatgtatatatagaaacggggctagttgctgggagatagagaggctttgacttgactggaatggaagtcgatcaggttggtcgagctgaggcgaccggcagctggttggttcagccgggtacgtgttggaacgaacgataatgcggcttgctgcaaggggctcgtgcgcgggcagcagcgagcaagaattcataaaccggccatgaacgcttgctggtagctacaaaccatccattcccggccctgttgctactcccctgcttcgtattgtaaggtgttttagtatttttctaaattaaggtgactttgactaacttttttagttttttgaaaaacacaccaacatttataacgtcaaattattcgttaaaatctaccataaaatatgttgtatttatttgttattgttgtagatattagttatttttcctacgaatgtagttaaagttaaaaaatttcgacttacaaaaccaaaatacgaatactgcatagagcgatacggtgaggattccatatgccagcttcaaatttctgaaatttcaggtacccaaaaactattttgcccgaatttttcacccaaaccagctggtaagtaagcatgcgagaaatgctaatctcaagaggcgcacccgacaggaaactacagtaaattaacagcaagtcaggtgctaactgaactagctacacacgtaaaataaaagggtagttccactttgatcggtagctgtaatagggaagcagtatacctaccaaatcactccacaactgaatgagacttatgctaccaagcggtgcatgtccgcaggtcacacgtggccggccggccattctaatcgaccaaacgtaccacagtagatgcatatgcccgagcatttgctaaaattcagcataaacttctacattcattgctgtaaactgaaatgaaattgtacttccaatggaagggcaaaaagccaggacactgtgcttctgtcttagcaaactcaaactactgatgtgggttacatgttacctctaaatcgtgatgccataagaaatttggcttgtatatgtacatcagctataactaggattccactgcagtgttgttcttgtggaatatgtacaaatgacttcaaaatttggggctcccatcttgccagaactgaattctataaacttttagttgcacaactaaatttgttaaactagttcatgtgtatatagtttctcctgcggtggtgaacaggccgatttcttagaaccacgattttgtgcagggtatagtctaagagagcttttaagatgatcaattccttgtcttctaagagcatttgggttgatacctgccttgtgagctgcgattactccaatggcttcccaatagttctggacatttagctggggagcaaaagggtcaacactgtaagattgctatggatttcttgcataagtatcagaatgagagctttgtaaaattgtcaagacatgtggtacataccgcctctatattgaacttgtcaggggtatcatcaagaactgtttcattttcttgaaccgtaatgattaagggctgcaaaaaaacaattattcatgaggataataaaatccaaatggaaagataaaacatcacttatcactgatatctaccttgttctttgtagcagttctagcaaaggcaatagtaccatctcctccgcaagcatcttttggaagaatcacactatcaacatcactagccactatgcaaccattatccatgtttccattcctcctcatcacatattgaggggcattgcttaacccggcaagcacacaaggtagaaaggtatgtccaatctgttacaaaaaaagatcaatgagaactggtacaaaaagatgatataaaattaacgagcactgcttaatttgacataggacagcactgatctatatgctaggaatggatgtgaacaagtggactaactttaagaaaacatgtaactaccagatagtgaacatttgaaattagcctgatatacaacatttcattgtagggtcattactaagcatatccctgatatttagttaacttagttatgcaccagcatagttcagcagaaagagtagaaacctcttcagcagcagatcttggggacactgacagactgagaactgggggtaaaactgcaggagcatgggcagctgggattttgaatttcttcacaattagatgactgataatcgcttcaactcctgccaacagatcaactccctgcattgatatggcattgaagaaaatacaagattagaaatgatagatgcttggaaatgctgaacaccacccacaaatgataacctcagcatgtctaccgtgatcagtatcaaccattgaattgcatcaatataaaaattcagcgagcaaaatgacaccataaggccaacagctttcaaactacttgaaaagagagtgttgttgcaacttgcaagggacatttcagatggtccaaacagtaaatttgaaaaatcgaagagcatcccataacaaactaaatcaagacaacatggtgtttcaagaattctaagtggcacaactatcagtaacctgttaggaaaaataataaaccagctacttgagcaggcaagtattacctttccttcccgataacaatctgaatcttctggatcatcatctggaaagcgcgcaacaaccgccacagcattcacatcagagcggttcaccagggcctcaactgccctcaggagagaatcagagttcccaacactccctgtagacttcccacattttggatcaaaccatgtcttgatctagaccacaaatgagcaggtcataagtaagcatgaatattacatcaggcactaaattatctttctaactagaggtatcactagatcttaaacgtattctcactcacaggacaaaaaaagaagggatcagaacagaatgagcacctccaaaggagtatcagtcacaatgtactcgactacagggagcccaagagaagccctcgcggcatccgcaacctgcaagtgacggagtcgaagctcctcctcgattccagaatccaacaccaaacctacctaggttgaagcagccacaatgtgtcaatgtatcaacaaaaccgtagctaactagctacctacagttacattatccatggttgtgtctgagcaatctctagaaccactaaattggtagtagtaccttgttctggtgaactggttggagagcccaggatccttcagcgaacctgtcaagggcgtatccctcaacgtagagcgtgttgggcatcggccagtagagcatcgcagcgttcagcacctgtgattatgtgaagacgaaatcttcaaccatggagaagccaaaactaaccctaacagctactggaagttaatacttacattggggtgggagatgacgcagtcggcgacggcaccgagcgcgcgcgccacgggaagcgcatcgccggcgaaacccccgacggcggcgccgactccggtggggaccaccaggacggacgtgtagggcctcctgaagctcgggccccgcgcgctggcagaaggggcgaggcaatgagcccgggagctccgacgagtcggccgcggcggcggcggcgacggccggaggaagggacgggtgaggtggagcgccattgccgcggcgaagcgagggcggggacgcgaacggataaggctgtgactcactgggccgccaaattgggcccaccactcggcccaattatgcactgaatcaagggggcccacctgtcattctcacgtagaaaccaccaaacccttcttcttcccccatctctccgcagccaccggtggagaagattcgcgcggccgctcgccatgtcgtcgccgtcgccggcgttgtgcgccgccgcctcctgctccaccccgcttcgcgttgcgtcgcctgtcgttcggttccgccgccccggcgcgcccgcgcccgtcgtatccgcggcgcgcgcgtcgtcggcggcggtcccggccgtctccgacgacctcgtcctccgcatcgcggagcagctggaggactcggtcgcggcctcctcgccgctcctcgacccgctccgctccgcctccgcgctctccctcctctccacgcgctggccaacccgccgctccaacgaggcctaccgcttcaccgacatctcctacctccgctccctccccatctccctcccctcccgggacgcccccgccgtcgcgccgcccgcctccccctacgcctcccacgtccacttctccgatggcgtcctcacctcctcctcgggcgcccacgtctccgccctcgcggacctcccgcctggccacgtccgggaccgtgcggccgccgctctcgccgcctccgcgggattcgccgacaaggacctcttcttcgacttcaacgccgttggcgcgaaggatgtcgtggtcgtgcacgtgccggagggggtaagtatggccgacgacccggtgcacatcatgttcagttacagtggctgcggcgatggtagtatgatgatgtcgaacccgagggttctcgttgtggcggagaagggggcggaggtggccatcattgaggagcactttggtcaggaggacggtgggtgttattgggctaatccggtgatggagatcatcgtggaggaggatgcgaaggtggtgcattcctatgtgcagcagcagtcgtttgcggctgcgcataccaagtggaccgtcgtccagcaggtagacctttcttgtgcattttgaattgctttgcatatagttatgatttgtggatcgatgtcttaaccatagttgttgttcaccttcaatgtgcttgcttgttctgtgagttgagctaggataggataggataaagacaattttggttcaattaggactgcacatggttagaaacatagaattactaagttgataagagtagcagtggcatatgttacaatttatatgtttcaacaatcttatctaaaaacaatattgcaattagaggtagcttccttcttgtttgtgatatttagttttatttatggggtgtcatgagattgtgttattccttctttagtaggatgcagtataacagatcaatgaggaatgcactacacttattttgtagctagaagcttcacatgcagaaatgagatttcttattccttctttagtagggtgacaatataacagatcaatgaggaatgcactatactttctttgtagttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45636 - DNA, 858 bp, Oryza sativa
ttccgcctgcacggctgacttattatgccgccgttgttgggcgtatacgtcttcaccgaccggcggcctcgaccgccgccgactggtgtttccgcctgcacggctggcctttatgccgccgttgttgggcgtctacgtcttcaccgaccggctgcctcgtccgccgccgactggtgcttccgcctgcacggctgacttattatgccgccgttgttgggcgtctacgtcttcaccgaccggccgcctcgaccgccgccgactggtgtttccgcctgcacggctggcctattatgccgctgttgttgggcgtctacgtcttcaccgaccggctgcctcgaccgccgccgactggtgtttccgcctgcacggctggcctattatgctgccgttgttgggcgtctacgtcttcaccgaccggccgcctcgtccgccgccgactggtgtcaccgcctgcacggctggcctgttatgacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatttggtttatacagctaccactactgatggacatcatcgtcttccgccgccgactagtgcttttatcttcacaactgcgcgtcttcactaccggtttgcttctgttgccgccgactcgtgttcacttcatcacggcaacacaactttgtcatcatggtggagcgacttcatcttt

SEQ ID NO: 45637 - DNA, 931 bp, Oryza sativa
  unsure (1)..(931): unsure at all n locations
tttaggtgacactatagaatactcaagcttnnnncacatggagatgggccattcagggttttggagaaaatcactgacaatgcttacaagatagatcttcccggtgattacacagttagtaacacattcaatgtggttgatttgtcaccattctttggcacggaagaaacagattcaggacgatttaaatatgaattttagaagttttgagctatttaaatgaatttctagaattattaccgatttattacgcaataattatttattttcttaaaggaaaaataaggttattgcgtcaacagtgggacggttgtggatcgagtccaccaaatgcgggccccacgcatcagccaaaggggaggggcggtccaccgtggactaagtccatggcggcgatcggccacgcgggcacgcacccgatggcccagatcggccgagggcggctgggcggcgcggccgggcaggcgcacacggaaagcggccagcctgccgccggctagcggcgacctggcccaatagcgccggcggcgagcagcggcggcatgagcggggccgagagaaggcggttgaggcggggagggaggaaggggacgcatcgagcggaggtggcggctgtgtggcaaaggagagcgtcggcgttgaggggttggaggcggcacccgtgggtcgacggcactggcggagttccagcagtgatttccaagggcggaggggtggacggggcgcggcacaacgttgctacgccaacggagcaagcggcgcggtccggggtggtcgcggtcaatggcaatcgtcgatcggaggcgacgaatgcggcggcagcctctggttggcggcggaatcggcactacagcggtgtttcgcggcgagcgagggacggccgaggtagccctcggtgcggcgaggccggaggttgtggcggcacagcacg

SEQ ID NO: 45638 - DNA, 16801 bp, Oryza sativa
cggattggaaaaccgaatccgggccgattcacgggtgcggcgcggcgcgtgcggagtggaagagtggggcggggatagcggtggcacgcgcgaagtaggcagcgaggcgcgcgggcggagtggcgatgtgggaggaggcagcgactggcggttgctggcgaggtggctggaggaaggggaaagggatgacaggtggggccgtgggtcccacctatcggcgagggagggtgagaggagtccggaagagggatgcaaagtagactttgcaagggggcgaaagggctgggccgagggagagggataggccggccggggagagggggggcatgggctgcgagagggaagggggatttgggccgaaaatggcccaaggagagtagaaggagttttaatttgttttctatttaatataattgattaaatgaactttgtgtctttaaaattacttcttgagctccgaaaattcgcaggaaattcgagagaatatattaggacgcagagaatattacaaaatattcccggccatgatttttaaaggaaattttaattccctctataatttcacttgattgaattgctttaacttttaatataatttctagaaatgatttttaatcccgaacgaaaatcagagcagtactgatccgatggttaaagcatacatcagctaaaaatccgatgtcataaaatccaatcgatttagataaacagtgaaacctttgttgcaatcagctaaatacaatttgtatgtaatctttgtaagaagatgtaacatccagataacttatcggctagcaccctgataaaacattagcatgaacctatcggcttaacaagaattatattaacaataacaatctagtaggttggatctaaccgatgcagcacgagattatatatgataatctaatactcgatgagccgatagatctgtctaatgtgatggatataataaatatatctataacaacattgtgattgtagagatatatcggctaagacagaagatcagacctaatctagacagtcccaactaaaccgatgcatctctaaacacaatgcaattagagatagaattgagatatcaggtaggcaaatatatcaagcaaaccagagcgatccaagagatcgaagcgatgcagccttgaacaacaccaatgtagccgatagattcaggaccaatggaacgtaggacttaccccttcgccggagatcaaactgaaccgatgcagccccgcgtcaggtgccaaattccaccagttgttaagtaaaacctcaaaaaagagggtggcgatgcgccgagagtagtattgatcgagagataaattacaatgaccccgggtgtacatatttataccctcgtcacctccgctgcggcatcgcctctcgctagccgccaaaccttttcatctccctcctcgccccgccgacatcctaccgacctgccggcctcctgccttctcaagcgtcgccacagtcaccgccgttgcgttgcccgtcaccggccgccgacgccctcctctcccgcctcgccccgccggccagcctgcgcaaagaagtgagagagagatagaggaggaagggagagaagaggggaaagagaggtgccgacgtggacaccctgacgtcggacaaaactggggccaaaccacctatggacctaaagcgtgagtgggcaaactaacttgggactataggtgatgactggtctaaaagctttatctacctattattttagaaacttaaacgtttgaaacctagtatttaaactaccatgtttgtataaatggctaattctttcaaacaaaacagataaaatagggcaagcattgtaggcttagcatttaagattatgcaatataaatataatcactaaatgcccaatgcatgttagctaaaataaaatgacaaagagtgatcgtttggatcatacaaattcctaatgtttaacaaaaaaaattagagtaaaaatatttaaatcatgaaaacaatcataccacactacataataatcacgcatgcagagttatttttagctatgaaattatgttcttgttaagctatatggagtctcacacactctgcacgacaatgagctctctcatactgcgaaatcaattaagactcgagaaggctttttagaaggctttttatttgaaatatatatagtgtcacatgcacccaaggcatccattaataaacaatgagacaatctagcatatagaaaaataatagtaggtgtatcccaacaaaggacagtaagttataaaatatgtagccaatttactacatacctaaaggaacacaaaaataactgtcaagttctattgattgctgaaaaacaatgatatgggtacaaatatcattattttcataatcaatcaatgtaaaatgacaattttaagtcacttatcccacgttttaattgaatgaacaattatgctcatcacactcctacacaaataattttcgcaagcattctttccacatgttcctcaaatgtgcagcctcatagttagtaagtcttttgcctaagacacatgcgccacctttagaaataacttttgtaatgtttttagacataggagtacttaacccttaacccacaaggtagcgttgaaggttttacatatagaagtattttatcggagtacttaacccgtaaaggtagtattgaatcgatctactctcttggctatagaaaaaaaaagggctcattttacatcctaacaacattttattcttttaaatttatgcttctctacaagtcatatttcactttgacacatcaagagacgaaggtaaatgataattaaacgaattcacttagttccacgctttgcacgtagaagcctataaggtgtcaatacaaaatcaatagcatatcttataacaatatgattagaagtttcctactaaattacgttgtaagactaatattgactaggtagttttcttaaaaatattgtagggtcctacgtataagaagcgctatctaatatatgtatatttagggaaaaaaatacatttatgagcaatacgagtttctcaagattttttttttaaaaaaacaatgaacaatcaattaaaaagggaaatacctaacattaatttaaacttattttggtagacctgtttttaaacaaaataacaagcatgcccgcgcattcacgcgggctacctttccagtttgctttctagtttgtagtaagtacttcttcccttgatgaaatttggtctgctttcttaaccggctggcgaaaaaaataatctatcaccataggccaagcaagtattgccatccagcctgccaaccgtattgagcaccctgtccacacatcatccgctgtcaccaaaacgcccctgctgaattgaattgctgatgatatcatcgggtgtgtccaacggctccagcacatgaactgcaccatcgctcatgccgactgcaaactggttaggcttccagggatgcgcagcgacaaccatgggatacacaatttcaccaccgctggagttgataagatgaaacaagagggcagcattaacaggtcaccagcattaaaattaccagactcgaaacaaaaacagaattaaactgttggagttggacactgcatatacctagaaactgaagatggtatataggcagaaggtgcaatcctgcactgtaacatgagagattccacttgaaatattccaattgcaccatcacagaatccagcgtagatcaataagccatccgatgagtatactgcactcgaaactggagcagagagtggatcacttgggaaccactgcacattgtcaatcaatgaaaggttaaatatcagtgatgattacaatatattgtgaaggttaggagcatcataaatatttatctcactgctagcatgatgtaacatgtttactcaagaccgaatcaagactgcatatagcaagtgatagatgcaaatacattgatatataaattttgtgaacaacttactgagcacaagcattctagctcctcatcgtagatcgccaattggctctcatgaactactaaaaggcgcttttggtcatagtgaaactgcaccattatatcaccaactaaagctccagaatgattagatggaggttggatatatctggatttcttcttcgcccaatcttccatactccaaacacatagctgcaaattccatttcattgcacacacaaaaaaaaatgattcagaaaaaaacaagtataatatacgtagttttccatgcaatcaagcatgtaattttttttaatttcttatcttttggaaaatggactaaagaatggcctgaaatgggactcatataaatatggattttgaagctatgcttatatgcaccgagcttacatttaactcagcatccattcaataaacaacaaaattgccagtccaaaaatctttgatatatattagaatttacacctgagaatcagcacctgaagatacaagcacattcattgatagcgagaataccagtccagttatctttttctgatggcccttgagcacccatttaacctgtgcaattcgattaagataagtcaatattttgtcatgttgctgccaaatataaacaaacggtaattagtatattaagtataggactccacataggaagaaccgaacaatcaattaccattgttgggaaaattgactctcggcatgaaaactttgaggcaattgcgcactgccgttttccacccattgccgcgtgattaacatgttttaactcatgattattaccataattatgcaatcacgtgcattgattggtagcgcccaaaaccttatgtttttggaaagcccccgattcccctcagtgcaaaataaaatgggaggccgaccctagaggaaggtgacaactttttctctcggtctcaaatctcaccaacacaaaaataacgtaatcccgatcaagctaaaccgctggaggggaaacatggtacagtccaggccgatgcaggtggaggccggaggacgctgccagcctgccacatcatctctgcttaaactactacgccgccaacgaacaccagagcagttcaagagactccatcctcttctttcactccggttccaagagaggaaatcgcaacaagtgcaatggcttcaaacaatggttagcgcccctaatattccgcattaggtgatcttttaggcttagcatattatgaatcttaagtagattatgaaatctacaatcattatgacttcccatatcttcaaatgtcgagctgacaatatatgaggtttttgggtcatactgggtaccactttcttcatactgttgccaagagataccacaaaatagctatagaatgcgtgtaccttgtggtatctcctcaaagaccataaaaggctcacaatttattatgtaaaaaagaacatatgtaaaacaacatttagaatctcaccagatcctgatacataagtaaaagatgaggagatatatagtctgaaacgagaacatattatttcacaatgggtactgcacttccagtgggaatcatagatagtgagttttgccaatacttttgagatttatgcaaacaggggacaagagatgcacggctaacactcacctcgtcaacacggatattgtagagtagaatcgaagagtcatccgttccaatagctatgatgttattgtcatgcgggtggaatgcgaggaaagttgcagagggtggaggtgctatgaaagtagtcatggtctgtgagtgattccacaaaatcagttaagtaaaagaaaggccatgatcgatgcaactatgaaataaaaaatattttccggaagtagtcatgacctgtgagagatcaatcatgaaattaccagattattgtgttacatgactgaagaagacataccttgaaatttaacatgttgaacaacgaaactttgccaccagatgcagaaattagatagcagtcatttttggatagtagactgcaggcagctgcttcttcagggttgccattagcagtgtcattcattagaatgtcactttccggttgccacacttgaggtgggacagatgtggtggactaacaaaaagtagtgatggttttaagaaaacaaccaaacagaactgcgctgttgaaatcaaaataatttagttctcctgtctaaccatgccagcaggattcttgtcattgctctcccatttccacagcttatgaacagcatttgagctgagagctaaaagtcccttcccactttttctataaagcagacagataacctataaagaaaagaaataaaacacaatgcttatcagaattgtataccgatctgaatattctagtgaactgccagaattgtataccgctctgaatacagcttataagttataccactatcgctttgaattctagtgtgctacatcacaaaaatgagaaatcacatccaatgtcaatatcaacaaatatagacgcttgtgaaatatttacatgcaaatatcaacagatactgtgatcttccttgcattaaatagaatgtaaggtcctatgtttcaggttgataacttgatatttcatggtcaacgtactaatacgaaaagatgcacgtgcaaacatcgctgaacatactttgcttgaagatgcttctgtaactggcatacgcagtgctcgaatacggccagagctaacaatgttcgccttccaggcctcatttaccaactccggggttctgctcacatgcatatatgcctgcattttcaatacaattagcaaataatattgaacagcaaacgaacaagaaagtgcagcaaactcagctggccactcatgagttcctggctataactacagtacacacattccaaatggaaccaagggcattcacaatcaggggctgcatggtaaaaaaaacagtggttatttttcctctttctcccagtttcttcatccaacggccaaccaagctcaacagcagcaacggtcttcctgtggcaggacacggcagtagatgggtgtcgaagcatctccacgtcatgaagaaatctgcagtgaaatgaattggcacagaggacagtgatggtggggagacgtcaaccagtactagagaacacagtcaagccagagatactcagagttttcaatttcggaaattgttattctgtgggagagaacaataactgaggcatcagccaagttagaaacatttgcatggtggtgtatctctgaggaatcggcccggcacccactgacagtttaaaccgatggagtcactaccaggtcaccagtgcacacttgctactgcaggctaaagtagcatacctccggtttgctcgctcatgtgtatattgattcacgagaacgtgaactcaaatcaagaaggaataagtttaaggaccattggtaacttaactcgaatataaacatggtgcaactagtagcataggccctcaagaggcctgtacctcataaagatattgtaatcaaattgaaggccaaacatgcatctaggtacgttttttgcaatatcaaatgatagacaggacatgaatttttctactcgtataaaagaagggaaaggaatggatataggactaattaaaagaagagaaactagaagtggctagattcgactcctagtttgtgaggcataatataggggaagtaattacctttactacaaaaagcaacatgggaatgaattaataagatgaaccaacgttggtctatcaatgtgcatgcatgatcagttcctacctcttggtagggtgagagcacagcttgttcgtcttgccatttggtttgaacagttgggtgtttgggatggaccgcagctgagttcatcaatgcagcagccacttcctccacctctgacagacgggcatctccacatttcagtactatggtgactttctggagcgaacttcttccaagcttctcgaagctaagcagcttgtcaaaaccaagctgggttgcatctttcaggaaccgcatatggacagcaaactcgaggaattcaagacttggcatgataatagatgctaagcttctattgtctgtgatgttgcacttgctgccgtgcagatcaaaccagatagatgtaccaagtatccttaagattctcaacttccgaaagtagccaacatcttcagtatgaatctttatgctaaccaattcggtctcatgcaaacgcagcacaaggcagcggagctctggcaacctcgcaagggtttccatgtcctgctctttcacaattagcacaaccacatccagacaggagaggttcggagcaagcgatgatttaatccatgctggcagtccagagaacacaaagcaattcagacacaggtatcggagatgcaggcaggagacagatcttgcactgcttgtcactctccttgtcactaggggtgggccctcaatgtgcaggtcccggatattgtgcagcttgcttagggattccaacaaagctctctccatgctctcattcaaatcctcaaaataagtccggagcacccttagttccctcagtaggcccagctcattcacaaacttcatcgtagacttcgtagtatcatcaacagcagcagcatcatcatcatcatcaacagaagcagcatcgtcatcataaacagcagcagcaggctctatccaaagctcttgcaatgaggtcaacttaccgatcaaaccaatcttcaccattatttcccaatcagctcgtaggcaaacaagttgtgtcagcagtcccacctcctctggcagctcctttatgcgacttccccttaaatccagtgtctgcagaaacttgagataccttacttccctgggcagcttagtgatatatgtatctactaacccgaggtacctcaggtgaagtaaactcccaagatggcttggcatagttttgtccctatcttccaaaacattaggcgtctcactttctgcacagtttatcacatctaatacacgtaaaaccggagtgtgtaggcataatgaaccgaagcactgactggcaataagggatctcacattcttcagagtgatattagctagctgaccatccttgtgcactagaacacgctgcagggctaacctgcgagcaatgctccccggaagtttctgtcgctcatcaccattcaatacagtgacaaaattttcttcactcgataatgagtggatcatatcaagaaccatatcatgaacgcagcaaccatctacatacccttcatgttttgtctccactggctggatcatgcttctatttatcaactcattgaagcacctctccccgagctcaaataatcctaaccctgctgctagttcctcatggatgaaaccttcagctatccacttccatatcaaactatttttctctatcacatgatcttcgggaaatacacatagatacaataagcaatcttttaaatgtgaagacagatcatagtagctaaaagacaatatccttctagtattacctacatcatcattgtcttcatgcccaaaaccgacagagttgtagacctcagaccagtcctcccctggtttactggccaacaaactagctattgtaatgatagctaatggtacaccaccacatttcttcaaaattttttcacatgccttagctgatggattatcgaaatacttccattcaccatcaactattcttgcatacaataatttttcagagttatcacgagaaagtggctgaattttgtaagcttcaccagcatgtgtggcaacttcagaaatacgagtagttatgacaagtctacttccacaatcactttcttgcagagcacatctgattaatttccatgactccttgtcccatatatcatcaataacaatgaaacacctatgtcatgattggatagaagtatcagagcaggaggaaaaccagtgcagttcaaagttaatcttggttcagtcagagttaggggtcagaatcaaattcagttaaaattgagtttagagtttgaatctgatttggctaagttctttgaagtttgttcagactacaattcagttagtattggagtcggtttgaattgggcttggctatattagctggttgtacatcatgaattgaatcatgcacttatatttttgcaggataactgacatgtacttacatctccaatgtttgtatgtgatgtatgtcttgtgcttagtgctaaaatacaactgcatgttgttatataaatataatttgcagtagctctaacaaataaccagttaacctacatcattaatttattatatagcttgggcctaccaaaatcgacatgatgaatgtctctcttttctcattaatgtggttgttttttgcaactcttgggagcaaatgagcttgatatgtttaaatttgtttgaataatatgactagcatgattttcttgcgattgcgtggctagataataaattaataatactcatttgtatgagaaaatatatctgaatattatacaactgtttttgcttgctgaaaacacatttacatttttatgcatgactgtattaaatcaatctgcatcgattagcgttgtactattttctagacttgagatgtaaaatgtgctcctttcatcctttatttaataaagtaaatagatataaggaaggaattgtacagatactggaattcaaagtcacaacgtaagcagtgagtcattggattggtgattacactcatacctcttctccttgacgaattccttgagttcgtccatgagctgcttttcatccaacaccatcatattcggattcgtgtacttttccttgtcaagatcaatgagaatgtctctaaagactttcttcatgtcaggattccgacccactggaacaaaagctccgcattcgaaatgcggttcaacctggtcatcgaatgctttattcatgtcaggattctggtcgactggaacagaagccctgcacttgaaatgcggtttgaagtggtcatagacagctttggcaagagtggtcttgccgagtcctccaaatccaacgacagagatgactttcatcttcttgtcggacacatcaacatcaccccccagggatagcttgtttatgagatcgtcccttggcccgtcaatgccaacaagctctgttgcccttttgtacagattctggagacgaggatcgatggtcgttgccgctagagacttgaggacaacgctgtcgactgtgtacttgacatgccttgctttcacctgctcgaacttcttgttaatgtcttggatcaggttagagatcttacggcgagccttgctcttcttgaacagcttgcctaacttcttccggaggcgcaggagcatgtgtggatcggtggggtcagggccatcgtcgtgcaccaagaatgtgtcgacgatgtcctccatttcgtaggatgcctccctgacatcgcgcgcccaaagcttgaccagctcatcgacctgctccgatggcacatcgccgatcttgcggaggacggcgtgcacgacatcgagctcccgtgagagacttgatcttctccctcacgcccgtttgcaggccgtactctttctcgagcagctgaagcagcttgggcagcaggctcctcatcgcccccgtcgccagctccatgcttgcaaactgggggtcgggaacaagcctgtcgtagacagcaaggaaggcccgcccgccccagatccgccgcctcctcttggcctgaagcaggagggacgcgcagctctgctgtccctgccgctcgccggccagatccagcccctggaaggggttggttgacttctgtgagaccggaatggaagtcactccggatggctaacgcaaagcagcaggggagtgagtgagtagtgactagtgactactgactactgagtactagtctgtcccaaaaaaagccaaactctggctatgaacctggacacatgtgtgtccaggttcgtagctaggattggactttttttgggacggagggggtactgactagtgaggacgacagcatctgcaagggtggaccacctcacttgactggctgactctgtgatgtttgtgactggagtctacttccttcgtcctagattataaatatttttaattctaacatgatttttgagatactattttaagtaacaatatatataaaagtaagattttttaaataaaaagtatagcatattttaataatttatttaatgataaatctattaacatcaattttatatgattatcttttttatttttttagtaatggtcaaagctaaaaatatttgacttattactgtattgaaaatgcttatattttaggacgaagggagtacttttgtttaaacaatccgcacatgacaatgcgatgtttcgtattgatagagcaggaaaataaattacaagtctgcaaccctagaaggcgatatagtaggaaaaagaaaaaataacaaccacaccgtgtgtctataaccagatcccgctacatccctaaggaaaaaagaagcaggaacacaacatccctaaggaaatgaatattctaaacgacacctttaggaaggatacgacactaaaagtgtcatcgtcgccgaccttgaaccctcaacgtggttttcacttgaagaaatccatcagggtgagcagagaagatcactcaacaatgccccaagggaaaacggcgctctcaagcatcaccattgctgccctggaggggctgggcttcgcctgtaatctctttgttcgcccgtgttgttgcctgctggaaacataaccactatcaactgtgcaccttcaacacgtagccaccgcgctagcgccttgccgctggctagccatcaagtaggacctcaacctttggcgcactccaaacccatccacgcggatgggttagaaagggagagggtgagagagaataatggaccaaatgtggccaccttgtggcggcaaggtgccaccacaggaggactagcgtctggatagaagcccatcgcaggcctactcacccacctcacggcacgaccgtcatcgctgcctcagtcaaactactcgcatgccttaggccgcttgcccgcatcaccgtcgcctcgtcctaatgcccatgcctccaccgagactccaaccggagcgccgaccgcagcagaccccgcttgtgccacaccagccagccacggctcctcttactcgcaccacgccgctcccaccgccatcatcatgcctacttcctaccgctcctaccatgccaacccgcgctaggtcagcctcccgccaacctccttccgtgcgcgacctaccaccgatgccgaccgcgccacattggccactatgcccttgccccaccatgttagatgctcggtgccagccagagccaaccacggagttgccaggcgccaaatctaaccatcgtctcggccctcgctccacaccgttgtctccttgcgcccgacgccgctgtctccctgcacccggcgctgcctttcccgcacttcgccgcctctcacaggaccaccccgccaccatgcccgatctggctgctcagctgctagatctgcttggtcgacgtctcagctcagccgcgctggccggatccgcgctaccgcggcctcccatgatgcgcaaccgtcattgccactcctccatggccagctcgtcgcgtcggcattgtccgctgccctggcaactcgccgctatatgcccgcaccgtcgagagcgctgccggagtgttcttcccgccgcctgagtcgggggtgagcggcggctaggtttttcgccacctggttgcccatgcggggagcgacacttgagtccaaagtggtctcgttaaaccagccatgatattactttggaaactcaacacagaataacatcgcgaaaagatctaaactggtgacgatatcggggctcgatattttttaaagagacatgattacatccacttctctttaatctagcatattacagtgtatctaggcattcataaccctcgatcgactaggccactaactagtcaaacccacacctatattactatcgtcttgtagttatataactagtatgtctctctatgtacatagagagaacttaggctgcgttcggcagctgtggttgggaacaaatcccctcctgcatgcaaaacggggcggttcaccattaacacatgattaattaagtattagctaatttttttttaaaaaaaatggatcaatatgatttttaaagtaactttcgtatagaaaaattttaaaatacggaccgtttagtaatttgaaaagcgtgcgcgtgaaaaagaaagagagtgagttgggaaactaaagtgccaaactcagccttaggatagtttgactctaactttatactacactgttacaatttcaaaccgtcaaactaactttatacccatattcgacgatagtttttctcttatgttacagtactctgttgtacaatttcggttttgcgcgttaacggtggagtgagatttgtacatggccgttaggcagctaatatgtagtggctgccatgtaggcagctaatatgtagtggcaaccagacaaccagtcgatggactactaatctattttgcactgaagttaattacaaggccactagcctgaattttaaacgagctatgtaccgggtacaatcacatattgttacccacacgatcgctttatccgactggtgggccaggttcacatattatgtaatagattaggacttagaaattatattgtcttgttacctaaggcatagctaatagtcctaattggatacgattatgtaaatagaaaaggaaactcgtgccgtgtccagcagggtttttctccttttaaccttgtctttgaacctgtataagaatggtaggaagccccaagaacataaccacaactcgatcatcagatcaataaacacttgacggatccaatcctgaaaacaggaatataatatttcttctcacctttgctcatccactttatctcgtgtgctacgccttttctcattgctaatttctagaatcggcacatatgcacgtaaacacaagtttgaagctataatattcggtctggacacatacttggttatcttaatttcactagacttgaacaaacgaactacagtcttttctcttagggcaaattttatagtaggggtaattgtcacgtctaattttattcatataagataagaggtgatatatacaatacaccacatctacaccacctctatcattgtaacctaaataattttattttatttgtttgtccaatcccctatttctttcatctcattttccttggggtttgtgtggaggttgctccttgcatgaggggtggctcaccttctctttcctcaattattactcccacctcatcatctaatcgtatatggtatttttagagagaacacatcaagcatcatagtacttgcccttaggctgtgttcgggagccccacttccttgcacggaaaacgaaccagtccactagcatgtgattaataaagtattagtttttttttaaaatgaatcaatattattttttaaagcaactttcatataaaagttttgtttgaaaaaaaacacgcaccgtttagtcgttttaaaaacgtgcgggcggaaaatgagatgagtgagttgggaacttaaagaaacgaaatcagccttaggtagtcttcttttaggcggtgattttcccccacgtttccaacttcaactatcttgtttttcacgcacatgcttcctaaactgctaaacgtgtattttttgaaaaaaatagtttttcacataaaagttgcttaaaaatcatattaatccatttttcaagcttttttttttgctaatacttaattcatcacacgctaataggtaacatcgatttccatgcccagccttaagccattgcaaatttgtcatattagaaaaatgccactactgtttacaatatcggctagatgccattagaattttgtcaaattggatctataccatagccatcacgtttttagttcgggatgaaaacggagtggacacggatagataacgctcgtaccatattcgtttttttttttttgccgaatatggattatctcgaatatgatcggacacgatcacacgaatacggaaacattttttcctcagaacacaaaaaccaattcaacttctaatataaacaaatatcaacatatataattagctcattttatataaaatataggataatttataaatagttttaaataattaaataatattaatagtgtggactagtgtcaagacataactactattaaaatctaaaaaggtatattgaaggtcatcggacatccgaattattatctgtatccgacggaaaccccgataccatattcgtattcatatctgggagaaaatatccatagctgtatctatattcgaaaggtatccatattcgtttttatctggagcggacggaaacaactatccgcttcattttcatccctattttcattcttcatatggaccaaatacccttgaacttgggacccatctgtcagtttcatctccttcctccatccctcctccagcctcccagcgcctctcttatgttcgtctgcaacctccgcgcccgtgacaaccgcttcaggacagcttcaagtggtccaccatgtcggcgaggtgggccaggtacaccaggagcactgccgcagcgtaccataaaattcgattcgaagttctcatattttaaaattaatttttaatgactattttcgcatgcggtcctattaatgaggcgcatgcaaaaatctattttcgcatgcaaactcttaagtggttgcagcgacggcgacggcatcggtgggcggcagcggcaggcggcgagggcgg

SEQ ID NO: 45639 - DNA, 18341 bp, Oryza sativa
ccgccatagggatgggctcggcgctctgcgatgggcggtgggcacggcgccgcagaggcgtgtatctggcaccggccccacgacggccggcggcatcgggcggcgagcatgggcctgtcgggcaccagccacgcgacggccagcggtgggcggcgtgaagctagaactgcaggcggcgggcgggaggctagcgtttcgggattatttttatttttatttttttcactgaaaaatatcttcgcatgtggttggctatataaaccgtatggaaaaattccttttttgcatacggttgcgttgcccgcatggagaaatagcgatttttgcagacctttccgtgcatgtgggccggctaaccgcatgcaaagatcgattttgcctgcacgcaaagatttctttagtagtagtgtgcttgggtagccgcagcgagaacgacctccgctcctcgagcgagtcctggagcgtgtcggcgtggtgcgcggcgcggtgaccgttgaaggggtcggccaccgagtggtttggggagagcgacacggacggcgtcgccgcgggcgctcctgcgtcatgcccgccaccgccggagtcagcaatggagcgcggtggcgacagtgtgaggcagagaggcaacggcgaggagaggaggaggatcgaagcggtggagagagagagagagcagctgcgtcgggagcatgttctgcaggatggtgaggaaggcccagcagcgaccatatctacgatccattgccgtgaattggagctctaagctctgagctgtgaactcagctagcttcttgctgatctactgcctgagctgctaagctggacagcagcgggactgatgccatcgccatcgccccgatgccgagctgcttgctgctgctttggctggccatcgggagaggaagggagggagaggagaagaagaagaaaatatatacgggagtggaaagggatagaaaacgtgatggcgatggtattgtttaaatttgataaaatactaatggtatcaaactaatatcatgaatagtacctagtaaaaaacggatcggaccggcgattcaaccgaatagtcaatagtagtggtattatttcaatgttttttttatattttagacatttttaataaataattttaataaaaaaagcttgcagtaacttattaacttatttccaaaaatgaaccagccacaccattgtaatcggtgtggccaatctgaacagccatgccattggtcacgcgtggcatgtcaaagggtgcctcatggcagacgttgtcgttgacaagatcaatctggcgctgacgtggcacttctgccacgcctagctccttggcgtggcaggtgtagtctgccacgcccgacttgttggcgttgcagtgcatctagcccaattattttatatttttgaagaaaataattatgataagaaatttcatgtgttaggaatatttttattaatttcatgaccattgtggtttatgatgaacatgctaggtttgtatttagaaaattgatactaaacgggtaaagatcggataaagtttttccggtatttgtgaggtattactagaaaacttcttggggttttgattaagcaagagatttgatctacctagcattcgccaaattaacttcaagacgataatcatcatggcaacaagtttagaactaggcaacacttcaatatattttgtgaacaaaatattcatgaaatattggttgccacacttgatgaagatattctccccaaattcaaaggtatttatattagcaagcatacgacaactgcatacgtcgaaggacgtggttactcaacagttgttgggaacaataaagtgtattaattcaaggatttttcttaggatcctccctttacatggccctaggggtctagttatagtcctattacagatccccctattagggtttagattttacaggggaatttacatggttgcccttatgaaagggacacttgtatgggtatacagtgtaattgagatacatgggcctctaacgggccaattagcgaacgctggcccactggccaatgggctagagcggctgggatggccccttgggcctccttggagctggggttgaaacggcgaagtcatcctccttcggcatgcacccttcgccatttagtcttcgcccaggacgcatttggacttgcggggtcccaacgcgactcttcacccttcgccgcctttgccccatagtcttcgccacgaggcttcgccccgatgaatcttgacgtctcgagtctgaatcctcgctggttgcatggtttcggcaagtctggtcgaagggtctcatgacataccgccaacaatagttatatctattaagctaaaaccgcgagtgaacggaatgaagacctacaaaaggagtctaaatggatgaacctgagttataagacggcattgtatagagagaataaaatgaaggtttacacaagaaggtagaatgatgacttatgtgccatattaactacaacacataggcacaactattcataatttgaaggctacaaactcaggttgagacaaagaagaccaaggatgaccaactacaaatgtctgaataatagagatattttattcaagaccttgatctggagaaatggatgtgaaccaacaattattcaagatagtagtactaaagaaacatattgtactcatttatcctaaaaatataaatgggtatatcagactaggagaaaatatatgaagaaattaaatgatacaaaaatatatgttagaaatatacaagatcccttcaaggcatgacaaaccatgctactactcgaagacgtatgactgaaggaagaagtttacaattttggcaagtgccaagagtttgatcggatattgacaatgtatttggataaaaagggtgcgagccatctacgacaaattttctttaaagattgaattcccaattttctctacactaggagaatcagcatcgaagtttatgaatcaacaaggagaaaataattagaggacacaaaattattggttgaaaatataccttgaacaagatctatccagggtattcattgtcagatccagcgtattcagacctgaaatggactcccactctctcacgatgtggccgccgcaagacaagaacaggagaaaaactagggttctaagttactctaggacaaattaatttgctttttcatgccttcttctccttacggcgctgggttatatactcccagtcgcattttcacccacatgttcaaaattacagcgctgctgacataatcagagtaaaaatcgtgctcgcaggcaacgacaaatactaaatagtgaatagtacaagataactccttctacacctttggatcctgcggtaaagtttaatttccttcatccggccgtccatcttcacttacgttctcagcgaaacgatatgtcctgaactctgcttcttctctgcttatctgaacttctctgcatgtctgaatatttgatctccatttcctactctgaaactccccatcctgacattcatgaccataaaaatttggagattcatgactagagctagagatttgtacttccgacaagtgcaaggagtttgaatttataccagtggtatatctggataaaaagagcataaagcgtatatggcaaattttcttacccacaatagaggaatcaagctaccaattttctggacacactcgataaacactttcaactccaagagctatattacaggccaatcatttggaaagcaagactattgacgtacaacaagaataaaacgacgaataaaagtgcgactgaatggaaataggtcaatataagtaatacttgtacgcaacaatggaaaaaattcaagaataaattcactaccatctaaattccatggattttgaaatatctcacaatatttcttaagcgaatgtagtgaatcatacaccctgattgctaagaaaaactttcttactccctccatcccaatatattacaacctaggatgggattagacccatcctaggactacgaagtcctaggttgtaatatattgggatggaggtatgtgactcgcaaataagcaaccaagacttggatttctaatgaaggaaatgggtagatatagttaaagaatatgacttcaatgttcgatcctattcaagaagggataatgtaataatcgccataagaatacaacatctggttatggtatgaaaagtaacgaagaaatatataaggagatgatcagttactatgaacaaagtattattcatggacatgtgagacagtacaaaattagaagtcaaaaatttaagttaaggcgttacaaaaggttggaagaaaataatgttcaaaagaagatcctgcagccgacaaaaacagatgagaatcatgcaccagttttatctcgaggatactagaaaaaagtctgacctcctcaataagtgtatatatatatatatgctcgaaagatcgaatcctatgcagaaataccctatgacatgtctctatttggaaaggctgtcaagtgtcggattttcaaactttgaaccacatgaagttaaatcaagtaatctacagctttttattacccaatgcatacatccaagaatattccaagaatacaagttatctaccagcagattaatcagtcggatatccggaattttgggaaggaccaaagaaagaataaaattcccacactactacctggactcttcagaaatctcgaggatgagattatttaatggggtaggtttgtaacatcctaaaaattaactattttctagtcatgtgtcatgccgattcttatatttctaataaccttctaaacctagaaaaaaataattagagagacctcctaaaactaacttgcataaaacctctccttggtattcaatctcttttgtggtttttatttaaaaatatattttgttaaattgaggaatttcttgattgaaatctaattttgaatattaaactttttttattaaaaatcctttattcaaattatttgaaacccttttatgaattatggtccaagaaaatcctccaaaccaaatccttgcaattccaattttattggaattaattgttgacccgtctcttgatattaaagctatccttagttctccttccaaatattccaaattcctccttttgatttagctactaatttaattcatatggcttgattcctcttgggcataagaatagtactagaaaggtctcgcgcgctgcgccgcacgggtgtaatagacgtgtctaagagccgcacgggtgtaatagatgtgtctaagagcctaagacacatgttattggagcttacctgtcacatcctgatttttgtttcaggatttataaataatttaataaattaataatagaatttatgttaaatgttctttaatttacaagtgaagtaaaatgtgggaaataaaatttcctaaatctaaagcatggatggatttaatttttattaaattctccatgattaagtcaactctctgaaattttctcggatttttcagagctcaattcctaaatgatacaaagaacagttcagtaattatttgatcattaatgatctaattataattgttaagagcttttcttgtttaaaaatccttaaattataaattgttgtttaaaaggaattattagaaatgattttaaaagcctagaagagaagatctaattttaatttgctaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtcttcttttggctttgggccgaaagccggcccaaaaccctctctctctctctttccctcggcccagtccggcccaatccgccgagccgccgctctcctctctctctcagccgctgacaggtggggcccgtctgtcaggcctgtcttcctcctcgcgccgccgccgccgcccgaaaccctagcgcaagccgccgccgtctccttccaaatccggccgctcctttccttctccggccgaatcgatagaggggaaacaatctcctcgatctcctcttccttttcccctttggaaacatcggctaaatcggcttggaaagtgttggattcgagatcgaatcggattcctctctctctcccgaacccgatctttccttctcgtcaccggtcgccgtgggccttcgccgccgccttcttgcacctataaaaggacccccgagctctcctctatccgccgccacctttgctttagcctgccgtcgcgtctagcgccgcctccgcgtagccctagtcgccgccgtcgttgccgttggttcagccgcgtcgcgccgccgttgcagccgccgtcgtcgatcgccgtcgccaccatcgggttcgcaaggtcgtcgccgtccccgtctgccgcttcaccgccgccgaagaccgccggagcgccgttgccgccgtcgacccgaaggttgccgccgcttcttcctcgtcgccggcgccgtccgttgctcttccgccgtggttttggtcaccggtgagttcgccgcgttgtcctctatccgttggtgccttccgttcgtgtcgaagcgccgccgttcgccggcgagcgtgcgccgtccgagccgccgagccgccgccgccggaggtgacgtcgtcgctgacgtcatcgttgccgttccccgtgagccggtcgtggaccgatcgatctcggccgtccgttttggatggattgatctcggccgtccgttcgcgtgaaccgtcgcccgtgcgcccggtccaccgaaaccctagccgctgacgcaataattctcttttccttttcaaaaataattcattattgcgtcataatttaattaaaatccatataaatgcgtcataatttaattaaaatccatataaaggttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcataattcatctaaaattatgatctacatgtttgtttactttttatgtactgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacaatcctttgagcatgttgatcctatatttaaattctctatttatttcaactgtgcatttattttcgaatgtcattgggtggaattaacctattctttgttatggcccttttgttcttgattactttattccttgttaccttgggttattataattggactagttgagctttatatatatattggttcaactagatattagatataattgcttagccatgcttagaaacattagcacactattgggataatttatgactcattattatttaatgatggcttaatgatagttcacgatggtcaatcgtgattggttaattaattatttgccaactaaaacttgatgatggtgggttgtgagcacatggttttgagagtcgtgctcatgacaattaaggaccggttcgcgagctactgttgtgaaatattaaccgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcaccataactatggatgttatacctggtaataatttgcttagctcctggtttggagttagatctgttcagccgggtatggttgttcagaatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgttatatgctcaccttgcaataatcaatcaacctcagttgaagaaaaaggatccagaaggagaagacgtttggcttataccccagttgagctgcctgtgggagtggagccggagcttcgctagattttattttttccgctgtagttttcttcatggtgaggactaagtgcctcataagtaagtatttatcgttttagttaatttgatgaatctgtatattaaattgtcagtttgtgtacctcggctgattcctggacgaggatttaatgcacaaataagttcggaaattactatagaatttccgggcgtgacattaccgaaagtgttatatttagctggctatttagcctgtgtgggaacaacagaacaagtaacgcatttcaagctgtaatgagcttgattggttttttagatcgtaaagagtctttcccacccaaaaagctagccaatgagatgaggggctcccccacttatatcttagatccttttttcttccacaaccaatgtgcgactattcaacaatctccccattcacacattggtgtcctttagcccttcaccgccccttcaccgtttctccacagtcccttaggtatacgggtcccgcaggcacccacgatccatcaagccagagatgttgaactagccaggctttgataccagttataggatcgtaagggcctttcccaccccaaaagctagccaataaagtgaggagctcccccacttatatcttaggtcatttgcccttccacaaccaatgtgggactattcaacagttttttgtttaaatttgggctcttacatactgctatgatttaaggatgtacacctcctgttagattcaggcactcagtaagttagcatgttctcaagcttggattacatacggtatgttcatctgttagagccgttgtttgcacccaaatttagcacctatggatgaaataggggaaaattgtcaaagtttggaaagcgtcgggtttccttcacagggccggtcagaccacaggtatgtgggtggtttgaccggttagtagggccggtctgaccgcagtcagggtccgagcccgaatttgttttcatcgggtctcggtttccttgctcgggaaggctatgtttcgtgtttcctttggtttctatcccgagttggatgtggacaagggtctgtagagggcaagaccaacccctatttaagggacaatgccggttcattgtaaatcccccgaatacaatttacttgaattgttcttttatcatgttttctattttaccctagttttagtccatctttgtcgatttgcgttgtaaattgtccgccgccgctgcgagagtgctgcacctctttgtaggtttgtcctgaaaaccttctgttttgcccacgagacgggtagttatcctcatatcgatctaaatcagcttagaggctgattttaatatctaaatcggcttttctagccggtttagctgtttttctacaaaaccatcttcatttggccctttggctagatcgaggtggttggcgactccatatcaccgcaaggcgtttaggtgttgtgatcgtgcttgttgacttgtcacaaaaaattaccaacacacaatttttgacgactccgttagggaacaatctaatcggccatatcacggcctaatttcgtttaatctagtagttttcgtcaaaccgatagtttcggccaaacggccgaaatcaatctatgcatatactgccgtcgttgcattgttttgtcatctaatcgagtgtttcggccgtacagctgaaaccgatctatactcgcgtgcgtcaaggcagcagtagcagggccggcagcatcttgctgtacacggcctgaaagttttgagtctcaatcctattcggtttgctgtgtacaaattcctaaaaatagaagatcaggcttacagtcaaagccgatctattactgttaaaaaaaaatcaaagccatcgcattgcatcggctattaccttgaagattctgttttcggaattggttaggtacagtgacatatatacacaagaaaaatcaagaccgtatattaatttattcagtcaaatatttcggctataagctatatggctggatttaatcaaggaatttcttcatcaactataacgagcggaaacaggttcaacaatattactacacaatacattaggaccgatcaaggcgtcatggaaggaaacgtcccgcttcctcaagttgtaatttcaccaaaagtaacctccgattcacccaacccatcttttgctaataatcgttatgtagatgcatatactacttcttttttgcttctatacaatatgctcgtaatgttatgggggaatcaatgggtgtttatacagccgattacacaggaatcagctatatgcagaacttagctaacggtatgactggtcgtgacaccggtttaaccgcaccctatgccggtcagaccgtgcctaccatagccagttagaccgtgccctatcctggccagatcgcgcctcctgtggccggtctgaccgcaccactgaccaccggtcagactgggccatgggccagtcagaacgggtgcttggctggtcagaccgggctatctatagccggtcagaccggtttcctgggaatttctccaggttttcataccacgactagcagtactaattttaattattattcatcacctgttaatactattagtcatgctactccacatatccctaatgcttacaatgatcctaatagaggatattctcatgacaccgggtatggccaatatattatattgcgccgcaacaaccacctcttaggccaccaaatacaccaccaaatctatataggcctaaaaatatggaggagttaattagtatcattattaggaacatatttgggattgaaacgaaggatcgtgctagggagtaccaaaagtcgtatcctgatttttatgacatgatcccacatcctcgtggttatagaattcctgaatttaccaagtttagtggtgaggatagtaggaccacataggagcatgtagatcaattcttagcgcaatgtggtgagactagtaatatggatacatgtaaattgtgcttgtttcctttatctttgtctggtactgcttttacatggtttacttctttaccagcaaattctatttttacctaggctcaattagaataaaaatttcatgattatttttgcactagtaaaacttgagtttaggttatctgatttaacatcgattaggcacaaatacaatgaatatgttgctgattatattgagaggtttagagatattaaaagccgatgttttagtttgaaaataactgacaaagatttggccgacattgcatatgatggattgcttgattctattaaagagagattgaatggccaaatatttcttgatgttgatcatgtgttgcataaagctctggatcaggaaagccgagtggatgataatagcttaaatgctagtttagatgatagtgcaatatcatgtatagccaaaccaagcgatggttcgaattgtgttaatagtttggacgatgatgctataacgagtatagtcgaatcaagtgttggttcagattgttttattaacttcgatgataacgcaataaccaatatagccgaaccaagtgatggttcggattgtgttactagtttagacgatgatggaatagccgtaccaagtgatggttcggattgtgctgttagtttagagaatgacaccattgaaaatatagccgaactaagtgacggttcggattatatcacaagcgaaagtgaaatagcgttgtcacctaagaccgagtcaaaaattgatcatgtggatgttggaaaatatgataataatgtcttgcgggatagtagtgaaatagaatccaaagaagctatgcatacatatcaaaggccgtatcttgaacacgtagattcggtcccatacctgcaaggatttgaggtgcccaacttcacaaaattcacaggtgaggatgctagaacaacaatggagcatatcggccaatttattgatcaatgtggtaaggccggtagtaatgatttgcttaagttaaagttgtttcctctttctttgtcaagttttgcatctatatggtttagtttacttgctcctagctcaatttctacatggtcacaaatggagcatgagtttcctgattatttcaaagatgcaagcttgatggagcaaagaccgattgatacttcatcggtcacttgtgagactatttcggttacgcttatgcctaagaccggaattgttagtaatcctctccctattagtactattgatgatgataaaatgaaagggaaaaatgttattattggggatcctcggcccgagacaattcggatcaataatgcaaaggccgaagatcgtaaggttacaaaggatgagtcatctagttccatagagactaaaaagctgaagctcacttttgagatgcttatggctaagtataagaaaggattagccagtcaacgatttgataatcaaactagtgattcaaaaagaccaagatcatctcgtaggaagagatttggtcaaacatcaaagcaatcagagccatcaactataccaactccatacaaacctccagttgtgatgccatggtatccatatccaatgtcaccatttggttatccttttatgtattacatgccatggatgcatcaaccacctataccgtattatcaagagtggaaggaatcacctaggtcaataccaaatcattcatctaattcaagacaaaaccgtttctcacaaaagaatcggtccggtggatcaaagatgaaaaaagtaaagaaggtgtgggtgcgaaaagaagccaaagctccggaggtcgttactattaaggaggagtctcaagatgttcgagtacctactggagatgcggcgaaaactatacaagcggagaagactgaagccgacgccgttactgtcaacatcggcggcctgaccaaaatagctggccggtctaaccgctagacaacggccagtctgaccgatggtttgcagccggtctgaccgggcccagaggtcggtctgaccggggggcattggagaagagtgggaaaattgagagcaacacaggagcatcaacttcgaccaaaaatatcaagaatcattgcttagctcctggaaaataaccatagccgaagttgataccttctggcttatttcgctctcaaaagaggaggctacagcatcttcgagccataggtcaaaaagaaaaagaggtcgaagttgtagagaataaaacatgagccttaaacaacatctaaacgagtgtggagacctaaagagataaaagttgagggaccggtgatttcccatagaagcaatagatccaatttgatgagagaagaatcatcggtcatttcagataagtctccttcacatgacgctatgggtattagtgcggtattgatcctgccttcgaaatcgtgcaatcaagaaagccgattttgcttggggagcaaggctttagtatgctcatcaagacataaagagagacgaacggcgatggatacaacatcacatctttgagccgccgtttgttggatgctaatgcaaggtatgagtttattgtgttcatcatcatattatatgcatatgccatgttggaacattgcttgatatttagcacatgtgtgttttgcttatcaaatccatattatacatacatgttgcaaatgccagttctaagtagtggaattggtaaattggcatataatttgtttaaagtatgatttggctcatgaatctttgatatttatttaaagccaaatcatatgtgtttttatggatcaccatataatatatagatttcatatttattgcactatgaaagttttgcttattagtaattcggctaatatcaacggtcaatgtgatgatttgttctagagttgctttctttaggaacattggcattgttaatattttgcatacatgctcaagccgattacttacatttatagtttattggaatctatgcatgtgacacatgactttggtgattcattgttgatcatacttcaattggctaagtgttctgatgctatgatgattattatttcaaaagccacttgaattagtattcatctagacatattagttggatattataatttttcatatgtctagagggaaggaattttggttcaataatttgatacaccaagcatctggctattatgtgaagaaaaatttatatgctaaaagccgatgcttgatttcaaaaggttggacgaaattggcaaaatcacatactaggggcggtttgaccggtattgcacggccgatctgatcggtggtaccgacggtctgaccggctctgcatggccggtctgaccgagcagacagggtggtctgaccggcattgcgtggccggtctaaccgatcccagataggaagctgggaggcacgttacaattgattcaaaggccgaattaatcgtgaattcggacatttgtgcccatgagtcagaagaaaattggagaatccctttgaatagaatatttgaaagatcctagtcttagggttgatcggaaaattcggcggcaagcattcaaatgtattttgcttgatgggagttgaatagccgaaatatggatgaggtacaattaaagtgattagataatgattactctagagctgctatgggagatgttcatgaagggatttgtggaattcatcaatcggcccataaggtaaattgtttgcttagaagaacggggtttcatggccgaaagtgattgatgattgtttcaaatattatagaggatgtgaagtttgtcaatggatcggcaatgttcaattagcgcctaccgctgtatagaatcttatcatcaaaccatggccgttccgagattgagctttagattttattgatcaaatttatccttcgtcatcaaatgggcatcggttcgtgctaattgctaagaattacttcaccaagtgggccgaagccatgccgttcatgaatattacttacagagaggtaattgactttgttttgaagcatattgttcatagattcggtattccttaaactttgaccaaggagcttcttttgtgtccaaagaggtgagaagttttgtcgaatcatatgatattaagttgtttagttattctccttactacgctcaggataatagataagccgagtcgagtaacaaaatattattgaaattagtcaaaaggaagattgaagaacactcaaaaaagtgacatgaggtgctttccgaagcattatgggctcatagaatatctaaacatggtgccgctaaagtcactccttttgagttggtttatggtcaaacaagccgttttgccgattgaggtaaatcttggctctcttcagtatatcaagcaagacgacttgttgattgaagattacaagatcttgatgggaggcaatttttaagacgtcatcgacaagcgtttgaagactttggaagagatggagacacttcaagacagtgttttcagagagtgatcaatgggaaatacttgaagaaatacttccctagcgtttggcaagatgcttaggaagtcccgtggccggtaattggattatcaccctaagacaacatgttctatgcttttagattcacgatgttcatcaaaaaggcaggggggcatgtgtttacacccaaatttggcacctatggatgaaataggggaaaattgctaaagtttggaaagcgtcgggtttccttcacagggtcggtcagaccacaggtttgtgggccgtctgaccggttagtagggccggtatgaccgcaggcatgtgggcggttagatcatcagggtccgagtccgagtctgttttcgtcaggtctcgggtttccatgctcaggaaggctaaggctatgtttcgtgtttcctttggtttcaatcccgagttggatgtggagaagggcctgtagagggcaagaccaacccctatttaagggacaaggccggttcattgtaaatcccccgaatacaatctacttgaatcgttcttttatcatgttttctattttaccctagttttagtccatctttgtcgatttgcgttgtaaatcgtccgccgccgctgcgagagtgctgcacctctttgtaggtttgtcctgaaaaccttccgttttgcccacgagacgggtagttatcctcatatcgatctaaatcggcctagaggctaattttaatctctaaatcggctcctctagccggtttagctgtttttctacaaaacccatcttgatttggccctttggctagatcgaggtggttggcgactccatatcaccgcaaggcgtttaggtgttgcaatcatgcttgtcgacttgtcatgaaaagttacagcatccaatctacaagacgaagcactctgtagtatgatgaatagcggctcaaccggtgaggatgccagcaatccaatctacaagactacaacatggcaagccaacattgtctcccgtgctcttcctaattcgtgccgctcacctcctaacccatttttcttaagttgtgcatggctcgtttcgtgctagggatgttgacgaagccacatccatagcaactaaaggtgaggaaaaaaggcaaatctagataagtaggactaggttctttttttttacccctagcatatatactaataagaacttcttagactgatattacacttctataagactaaaataaatccctttcatatgacctttcatatgactaccggagaacatcctcttactataaagttacaacccactaaatattaaagcttaacaagaaaagatgccacatcatcttctactaacaagatgacatatcattatccactaacaattattacatttaaacatcacgaaaacatactatattatctatgtttaaacattatgcaaacatgctatataatctataattttataattattaaattttaaagattttaaaatgcaagcatgttaaatcatcggagaagactaggcgtcgagagcccgatggggagtggtaaatcgggcgcccacgtcatgctgacgtcaacaagatgcatgcatgtttttttctcttaaattatctatccattcatgatccgattgcaccattaaatttgttgcaattaaatatttaaaacaagaacgcacatggatattttccaatgaaaaaaatatttagcttattattgaattatttttaaatgttgcacgttgttacaccaagtatatcggaattgttttactaagtagatcaaaaatgtttcaatcgtttaaatcgggcattgtttcaccttatataaaaacaatgtttcagcaaatagcgaaagaatgtttcaagtcactgcaacatttgattcatatatagtgaaacattacaagtacattaggtgaaacattttttgtggaacaaaaaaacaaacgaattcccttaacagagagtttctataagatgtgggtaatttgttacaacagaatgtttgaattcactacaacattagatctatttatagtgaagcattatgagtacactaggtgaaatatttttgtggaataaaaattgaaacgaattcccttaatatacgatttccaaaatatgtaggtaatttgttgcaacgaagtatgtggtggggacatgtggcgagtgtttacaggggcacacgtggtgcgtggtgggctagcgcggcatgcgcgcgtcgtgcggcggggggagcgcccgatttttgctccccctgcaggtcgaccgatccctggtgtttccgcaaaccatcatgtcacataattaacataatatttcaatgagtaaatttcagaaaactacaacttaagtaacaaaactatcagtttgctgcaacattagcgacatgttt

SEQ ID NO: 45640 - DNA, 25935 bp, Oryza sativa
taatgttgcagcaaaccaatagttttgtcactgaagttgcagtttttatgaaatttactctatttcagtatgttgcttcattattttttataatatcctatgtacctatttagttcatcttcacttagttgttatttctcccttctctaattaagccatataacatcaattgcttttagcgcttaaatgattaatctatggtccaattatctccctccttttcttctctcgttaagttatatcacctcaattgttttaagcccttagataattaaaatatggtccaaactatctccctacttttattctctcgtaaaaccatatcatattacttttatatttgaattatcattttatataatatttaaatttaaattatcacaaaccacatcaacttacataatcttatatagtgtaactatcttacacattatttttacttattgatatcctactgaacttccacagcaacacacaaagtttcacctagtttaactaaagctaggtgacagtggtgacatgtggtcacattgttatggacccacatattagtgggtcaagggcacctaccgttacgatagaggagctgcttccggaaaattgaacacactcaaatagtgtcaggttaatttctttgtactagctatcatcgttaacactgaaacatatcaagacaaaattataaaaattaaagatgtttttgccggtattttgctacgtcatccgtgtatgagtcggtttttaagttcgtttgcttttgaaaatacatatccgtatttgagttggattttaaaattgttcacttttgttaatacagaaagaattatataagaaatttatttaaaaaaactcgcatgctaacttgagacgatcggagtcctaactgcagctcatgattttctaaaaaatatatatccaagcgaactcccacagtgaatttcatcttaactaaaccatataataacaagattaaaataaattttacccgttgcaacgcacatttttttctagtcatcaagacaaaagtaaaacaactactatagttattaatttagatccagacaaaaatgaaacaacgcccatagctattaattttattaacttgtactccttcagtactaaaatataaaaatctaaaatcggattggatattttttaatttcttatattttgtgagggaatataaatttatagagttacatatagaatactgaagtatatactagttgcgtaattgtgacgccccgattttcgttcgggattaaaaatcatttaataaggcattttctagaaattaaataaaagttaaagctagttaatcaagtgaaattattgagggaattaaaatttcctttaaaattcatggccgggaatattttgtaatattctttgtgccctaatgtactctccggaattttccgtgaattttcggagctcaagaagtaattttaatagcacaaagttcatttaaccaattagaataaaaagaaaagaaaaataattttccccttccttgctttcgggctcggcccaaattcctcccctccccatctcgggctctctctctccctcggcccagctcgccgctcggccctctcctccccgaagtctactttgcctccccagccggcctccctctcctctttggccgacaggtgggacccatgggcccacctgtcatccccaacctcaggccggcaactgccgttgccgccatggccgccgaaaaccgcccacgtcgccaccattcccggcctcctcgagccctctctcgcgtgggaccgggagccacccctctcctccacctcctcccccgcttttccccaaattttggcgccgaatcgagccccacttcgcccacgatgtcgcccacgtcgccggccgttgccgcttcaaatccgccacatccggccacgatttctcctccccgagcctataaaaatgatccccgtgccatcctcccccttttccccaattttcccgaacccgctgcactccctaccgctctcccctcgttgctcccgcgctctgctgctttccggcgagctccggctgtacgccgccgtcgctgtagccgccgccgcgccgcgccgctgcaccgtcggctccgccgctctttgccgcacaccggccaccgccccgtttccacaaaactccgccgaaacaccacatccaccgtgcacccgagccacagccgcctctcgtcacctccagtcgcgcgccaccaccgctcccgtcgctgccgcgctgcgctaccaccgccatcggcatcgccgttcctcgccgcaccccggcccctactccgtttcccctccctgcccctggaacgccgccgccgcgttcaccatctctctccgccgccaccgccgactccagccgcgtcgcgccgccgcttcggtcgacgtcgactcgcgccgttgcctccctcagctccgcaaggacgaggaggacctcggccgccgcccctcttcgccggaaatccgccggagctcctccttcctcggtcgccggtgagctctacctcttgtcatcgccatcggccttcgtttccagtcaccccgcatcggtcctcccctccctaactccctcttctccttctgaaggtcaagggcgaccccgtccgccctccgtcctcgcaagccgccattgggcaatcgtcgtcgccgtcctcttcctccgcgtcggccgccgcttccggtaaggatctctcctcccttccttttttttcccgtccccctttcttgccgaccgccgcctcttggggtgcgtcgccgtccccgtgcgcgccgctgtcctccggccgcccgccgccgttccacgtcgccggctgctgcagccggttgccgcctcccccttgccgcctcccccttgccgccgcctcccccttgccgcctcccccttgccgccgcctcccccttgccgcctcccccttgccgccgccgcgccatgtctcggccgagccggcttcatgccgtgcccgtgccccagccgcgccgcctcgtggccgtccgatcggctttgggccgatccgggccgtcggttcctgtggaccgcctcggtggtcccagtccacggtggaccggcgcccttgtgccgctgaccggtggggcccgcttgccggcgccgcccctcccccttgatgacgtcagcgagttccatttcctttgtaaaaataaataataattgcgcaataaatcgagtttaattctagaaattcatttaaatggctcaaaacttctaaaattcatatctaattcattcgaactccgaattgagccattcaacttgcaaaattcatctaaaattgagctctacatgtttgtttactttttatgtactgttttcttggtttttattagagtttttcctcgttttgcgtgccagcgtgtagaatccgttgtttcggaagtccgcggtcgcgaggaaaagagttcggaagattgttttgaagaagcaaggcaagtcacacattccccttgagcatgtttatcctaatttataaatgttttaccgtttacaaataaatatgcatgttttgctaattacatgggatctgggtattacctatctgctcgcttgtgccatgtttacttgatatctgttctttgtcaaccttgggtaataaatcgactagctcatgttacttatgtgacctagctagaactatatgcttagccatgcttaattactactagctcagttgatgggataattacagtattagacctttttagtatcagaatgagctatgtgctcaagacatctggccatgcttcatggttataattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgttttgttcaataaaatgttttacaaccgcctttatgcaaatagccacaaaccgtccttgtgttccccttgcacgcctgcatcgttggtgtggcttgctgagtacggtggttgtactcagccttgctattattccctcttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttgggactgtgtattacttgtcgttttgtgtaccctggctggtcctggacagggatttaatacacaaaatagtctggaaatttgggctaaatttctgggcgtgacagtaatcatgtacgactttgcattctagaacccctttatcccagtagcaccatcccatttgctgcccatgctaacctctcctcagacctagcttccatctctacctccgctggcgcaccgccctgaacatcagcctcctcttgctcgtcgacggcatccccattcttctcctccggcaaagcctccacaaccgctaatgctcctcccgatgacagcgacgatgatcaatttgttagtgtgaacgcaaatatgatcttgcggctaaaccaagtcggcagagagatttttttggacgatcgctacagtgatcgacctctcaagaacatccctgatcgggggatttaccgcctcttctagtgccggttccccctgtgtatagtggctataaatagagataaatacctaagtattaaaccctaagttttcctttgctacccgatcaagcaaaacccactgaaaacacagggaagaaccgagacacgattatctctgtgcttccaaacgaaaagagaagaaagaagaacaaaagacagagacatgggaactcctggagatcaaggtatgacccaatcccattccaatttgtagttccattttgtgccaaaccgatccaaatcatgcaatccaacaatggtatcagagcaaggttggcctcaaattggaactcagtaagtgttctgtgcaatccaattaaatttgttttagtgtttatgttcaagttgttcttcgtgttcatgcccaaatccctctgttaaagttgaattgagcccaaatcatgcaatcctgaggtataagaaacgaaattaggcctactagggtttcggcttgaagaaaatagaagaaggggaaggcaaatttcatgcaaatctcagaaattccccaagaaccaaaaccctagcaacagtaaaccccccccccccaaaaaaaaattccccaaatcatggtaccctaaccctaaaatcatggggaaaaggagcgcggcgggcttacctaagggccatggtggccggtggcaaccaccgtgtcgccaccgacgctgtaagaggcgagcgtgcgctcgaggacttggtccccgagcggcctcgtgacccgccgtgctggcccggctcctccttgcatgcttgctgtcgctgaggtagccgttgccggccccgtctcgccgtcgctgccgcagatctcccttgcgcgagcgaccggcgggtacattagggcaccgtcgagcaacgctcaacggggatgcgcgccagctatggcggcacgcagccccggcgagcaaggctcggtggcaccatcaccgaccccgtcgtgcgccgtttcgccgccgtcgtcgtcgtctcgctcacgtcgccgcgggtgtgagagaaagagaagaggagagaatgggggctagggtttctcggggggcggccgccgcgccggttttgtcccgcgcgggagcgatcccggccgtccgatgagatggacggctcggatcggctcgctcccgacgcaggctgacgaggccgtgcgtaaggggtcgaacgccggcccaggcccaggttgttgggcctggagcccaggcgggaggcggcgcggctgtgatgggccaggccaaatgcggcctagctcggggaagaggcccagctaaagtttcaataaaaaaattaaattatatttggtttaattcttaaattggctgcatagtaacgggctgcatagtaacgtgtctaagaaaaggattgggctaaaatgatattacaattaaatttttctttttaaagaattatgattatgattattgtgtttaaactttaaatatattttataatgctttagttaataataataaaaataataagtgactttattatatggtaaaattctcttttatttatctgtttattttatgatcattacattatgtttattacttaaagttattattattttatgcattgtgagtttatttgcgctgcaaataaatattgtaattaagtgtgacaaacaattgtcattctggccaaagctgattgaattttatttgatcacaaaattttattaattcaattcaaatctggccaaagttgttctgattgaattaataaaaggagttttttttaaacaaattaataaagtgtggtttgtatttattattctggccaaagctgttatggatttgaccagcatcttatgcctcacaaattgctggaataatgggcaatattgaacaacttaatggaagtaattatgcttcatggaaggagaagctggaaattactctagctctgttggatattgattacgccctccataataatcctttgattgagcctagaccggaaaatgagaattatgagacccttaaaaaggaatatgatgaagtaaaggcaaaatgggatatttcaaaccgtaaattccttatgattatcaagagctccattattgacgcaataagaggagcagtcccagagactcagacagccagagaatatcttgctaaagttgaggaacagtttaaaggctcttctaaagtttatgccaccactcttattaaaagattggtcaatgaaaaatatgattttactggaaatctgagggaacatgttatgaagaaatgtcacgtggcctttaagcttaaatcaatggaaatgaaaatctccgaaggtttacttgtccatttcattatgtcatctctgccccaggaattttctccgtttacgatcgattataatgcaatgaagatcaagtggggcattgatgaattaatagccatgtgtgtgcaagaagaggaaaggcttaaggcagaaagagttgatcatgcgaatctatttaaacactccgagaagaaaaggtataaaaaatttaagaaagagtttttgaagcctaagcctagtcaatttaaagaaaaggggaaatgttcaaatcaatcccagtagaataaatctggaggaaatccctatacagaagaaaagggaaaagaaaaggatgggtgctacttttgtggaaagagtggacaccgccaaaaggactgtattgggtttatgagatggctcagtaagaaaggtactgatgttatttcttttgttgatgaatccctgaatattgattatgccatcaattcttggtggattgactcaggagcaacaattcatgttgcaaattccttgcagggattcactatgaggaggaccctaagaagaggggaaagaagaattaaagttgctaatggagttgaaactgaagttaaggccattggagacttcattctcacacttcatactggcttcaaatttcagctgcatgacgtcctttatgtaccctctatgaaaaggaacttaatttccgtttcacgtttagataacggtggttactattgtacttttggaaacaatagatgtataattatgcatgataataaagaggttggtctcgccgatgggcaggaacaactttatcaaatctccgtgtgcgatgccacctataatgttgactcctccttaaatgcaaatgtcagtaccaaacgaaaacataacgataatgagacttcttcgaaattatggcactatcgtttgggccatatttcgagggggagaattgagcgtctcattaaagaaaacatcctctatcctttggacttctcggatgcagacattgatcactgcattgattgcatcaaaggaaaatattcaaagcaaatcaagaaaggtgcaaatcgaagtatgggagttttggaaatcatccacacagacatatgtggtccatttaatgtaaagtcagtggatggatttgatttattcataacattcaccgatgactactctcgttatggatatatctatccaatcaaagaaagatctgaggcattagacaaatttaaaattttcaaagcagaagttgagaatcaacatgattgaaagatcaaaattgtaaggtctgaccgtggtggtgaatactatggtagacatactacttatggtcaaattcctagaccttttgcgaggttcttacaggaaaatggcattaaggcccagtactcagcaccgagcgaaccccagcaaaatggagtagctgaaaggcgtaatcgcactcttatggatatggtacgaagtatgttaagtcactccattctgccggtaaagttatggatggaagctcttcagacagctgcacacattcttaacagggttcccagtaaattagttcctaagacacctaagacagctgcacacattcttaacagggttcccagtaaattagttcctaagacaccttttgaattatggactgggaagaaaccaaccctaaattattttcatgtgtggggttgtcctgctggagcatgagtttttaatccaaacatgagaaaagttagacctcaaaacaatcagttgtcattttatcggttatcctgataagtcaaaaggcatatagattctactgcccaaatcagtttacaaagtttattgagacaagacacgatgtgttcttggaaaatgacataatcaaggggagtatgacacccagagaagttgttctggaagagaaactgaattacgttccaatgcctctaattgaagaacccgttttctcaacacatactcgtgttacaccttcaatagaaagaaataatgatgcaacatctgctgaagctcctgcaactacttctagtagtatatcaaatgatgagaataatgaggatactcagcagccccaagttgtgatagatgagcaaaataacgaacccgtcagaagatcacaacgagttagaaagtcagcaattccaagtgactatgttacttacatgaataaagaggtgaatgaacctatgagtgaagaggtgaatgagcctatattagacattgatcccatctcatttaaagaagcaatgaagagtgaacattcgtctgaatggttaaatgctatgaaagacgaaatgaagtccatgagtactaataaagtctgggacttaatagaaattcccgaaggagccaaaacagttggctgcaaatgggtctataagactaaacgtgaccctaagggaaatatcgaaaggttcaaagcaaggcttgtagcaaaatgatttacgcaaagagaagggattgattataatgaaacattttctctagtctctactaaggactcattcagaattattatggcactagttgcccattatgatttggaattataccaaatggatgttaagacggcattcctgaacggtgatttatatgaagatgtatacatggcacaaccagaaggttttgttactaaaggaaaagaacatatgggatgtcatctaaacaaatcaatttatggactaaagcaagcatcaaggcagtggtatctaaagtttgaccaaatcataagacaatttggttttaaagagaataaaaaggataattgtatatacgctaactttaaggagagtaagttcatcttcctaatattatatgtcgatgatatactcttggccagtaatgacaaaaatatgctactggaaacaaagaaatttatggcctctaagtttgaaatgaaagatctcggtgaagccacctatgtgttgggtatagaaatttaccgagacagatcgaatggtgttttggggctatcctagaaagcatatatagaaaaagtactgaagaagtataatatgcataattgttcagcctcgcctgctcctataatgaagggtgataagtatgaaaaattccaatgtcctaagaatgagtatgaagctgcacagatgaagtcaataccatatgcttcagctgttggaagcataatgtatgcacaagtgtgcactcgccctgacttagcatttgttaccgggatgcttggcagatatcaatctaatccaggtctagagcactggaaattagctaagaagaccttacgttatctacaaggcactaaagacctcatgctcacatatagaaagtctaaaaaccttgaagttgttggttgttcggactctgatcttgcagggtgtgttgatgataagaaatccacgtcaggttacattttcacccttgcaaggggagctatatcatggaaaagctccgaacaaagagttactgcatcgtcgacaatgcaggctgagtatgtggcatgttatgaagctactggacaggcaatatggctgaagaattttatcctgggattgagagtggtcgacagtatatcaaaaccactcaaattatactgtgataacaaaccagcagtatactatgcgagtagcaacaaatcaagtgcttctgccaagtacattgatatcaagtaccatgttgtgaaagaaatgattcaggatcagacaataagcgttgaatatataaacactaagttgatgttagcggatccactcacaaaaggcctaacacccgttgtatttaaagagcatgttgccggcatgggtttggtagaaaagcctttgatcctggaataagaaggaacctatatggcactgactccccataaaactaaggcggactcattttgaaattaaataggaaccatagtcacttggttcagtggtgcttaattgattactgtaatctaatgtcttgatgtactgttttaatgaaaagtgagtccataagtttgtatatgcctaatgtaataagttcaaagagctcgtaagattaaagaagtttattttaaaatataatggtgtgctatagtcactggattctgttatgctttatattggtcactgtaatcttttatcttggtatgctattatgttgagagatggacttataaatttagcctcacgattaagggggagaatgttagtgtgaaagcaaatatgatcttgcggctaaaccaagtcggcagagatattttttttgggcgatcgctatagtgaacgacctctcaagagcatcctttattgggggatttaccgcctcttctagtgccggttccccctgtgtgcagtggctataaatagagataaatacctaagtgttaaaccctaagttttcctttgctacccgattaagcaaaacccactaaaacatagggaagaaccgagaaatgattctctctgtgcttccaaatgaaaagagaagaaagaagaacaaagacagagagatgggaactcctagagatcaaggtatgacccaatcccatttcaatttgtagttccattttgtgccaaaccgatccaaatcatgcaatccaacaccattctcctccttattcttcttcttcttcaccttcgatgatgacgatgacgatgatccagtctcctccttattcttcttcaacttcgccttccgcacctgcattagggcgtcgtggacgttcatggcagcgtcggcgtgcggggcgtcgcctctgaatgcattagggcgtcgtggacgttcatggcggcgtcggcgtgcggggcgtcgcctctgaagtagtgcaccatgaccagcccgagccggccgtcctcatggccatccacgccatggctcagccaccgggaacggaacgcccacagatcgatcatggcttcgttggccatggcggcgttcttgtccttgacgtcaaggtggttttctttaaggaattcggaccattccaggatgagccggtaggcgtcgttgcagttgaggaacttgcacttgaggtcgtagtcccggccggtgcggtcgtaggcctgcactcgcaggccctcgtcgccgtcggcggcggccttctccgccggcgtcaggagctcctcgaacgggaacggctcgtcgccgccgcggtgcgtgttgtgccagcccttgcacgacatgagcagccggtgctgggcgacgctccggtccgtgaacgtcatcttcttgccgtagacgcgcgccggcggccgccacggcgaggcgacgaggtaccaaaggttcgcgcggaggttgtcgtcgacgacggcgatgttgtcgagcgtcgcgcccgtgtcggaccccgccgaggtcgtcgacgccatgtcgtgccctagtgcggtccagaagaacgcgcggtggtcaggcttgggcttcttggctcccggcggcggcgtcgcctcatccgcggcgacgtgcggtggtcggccggctcccaggatggcggcgccgccgatgagcttcttctcgacgggacggggacgccggcgcgcggccggagcggcggccctcaggccggccagcttgcacttccggacattctctttcatgctcggcgtcatcattgcaatggcgtcttcttgccgtcgaacacccaggaggagggtgtcagtgtcaccgccgggaggcaggtcagccggtgcgccgccgctgacgctcggcgggctctggtcctcggcgaccatcttccccttccgcagccggccctcgcccaccaacgtctcgccgccggtggcgcacggcgcgctctggtccgcggccgccgccggagctccaccatctggattgccgaccatggacggcgtcgacggcggcggcgcctgagtcacagtcgccatctcctcctccaacgccgccgccggcgatgtctcccgccgggagaccgcgtcgaacgacatcggaaagacgaaaacctgaaagaaatcgacgaacgatctgggagtccggaagaatgacggtcggtgcaatttatttataaactgttatgcgtatagataccatttgtactggtaactgtagcagatgcgaactctatctcgttattttgtattttaaattttatagatagaaaggtttagagattcaccgggttatcttttgtcgttttatattccaaaaatattaaaacataaaagtaaattaaagtcacaggtggttccatggtctagcggttaggacattggactctgaatccagtaacccgagttcaaatctcggtggaacctgtttttgcaacttttttttaacttttttttccagtggtgtaacgagcatatgatgtttaaatttcattgtcaagataaatctcctatgaaatcgcaattctcaagctgattatttcattgttaagataaatttcctatgaaatcgcaccgaattttctcaagctgattaggacccctttgaatcgcaggattgagaaaacgtaggattttataggaatataagtgtaaaacataggattgcaaaagcacatgaataactattcgattgaaccgcaggaaaaacacatgaattggatgagaaagataaactcaaaggaaagttaccaagagattgaagctcttactaaattttctccaaaatctctatagaattatccattccaaaggaatttcaaaggattggatagaatacaatcatttgtttcaaaggtcttcataggaaattttcctataggattgaaatcctccaaaattcctgtcacagcctgaatttcgtttcaggatttataaattatttaataaattattaatagaatttatattaaatgttcattaatttacaagtgaagttaaatgtgggaaataaaatttcctaaatataaagcatggttggatttaatttttattaaattctccatgattaattatactctctggaattttcttggattcttcagagctcaattattaattttaataatacaaagaacagtttagcaattatttaaataataaattaattattaaatgatctggatattattatattaaatactttgagtgtccaagtatgttcaagatttttcttggaattatttgagcattggaagtatttttaacaattgaaagatcatctcattagttaatttatttggaaaagtaaataaaaatcctcctcctcagcctgggccgaatccagcccattccctcctttcccctctcccttcctctcagcccagataaagtctgtttaacctccctggcgctacagtactccatcttcctcctccagccgactgtctcccgtgccgtgcacagtgccgccgcctcctcccaccaatccgacctccccgttgctcctctttccaaattagttgcgggaatggaatcccctcaatctcctcttccttttccccaagaaatccccaaaattttctatggaaattctttccaatttcgcggatcaaatccttcctttttccggcgagaaccctagactttcccgagtttttcccgtcgttgtgggcttgatcccgagctcccgtgcctatataaaggaccccctagtcgtcctctacccatcccctcaagtcccgtccgccgtcgtcgccggaatcgctctccccgcgctctccctctctctccacctctggcagccgctccagccgccgtgcgccgtcgacccggccgtcgccggtcagtgccgccacttccctcggtttcgcagtgaagagctctaccccggccacccgttcttttgcgccgaaccccgccagaagtcgccgtccccgtgaaggccgaaccgttgccatgttttgatctccggcgaggccctgctgctcatcccgtcgtcgccttcggtcgccgtcgcctcctttgggttggcagctgcgaggtgatggccgtccacccctccgttatcgctgctcgtcgccggaaagtcgtcgccgccatggacagtacctcgccgcccttcgaagctcgttgtcggccatcttccgtcgctgtccgtcgttgcgtaagtgttggtaagaatcgccgtcgccttctctacctcccggtgccctccgtttgcatttttttgtgccgttgttcgccggcaaccgccgctcccatgccgttcgccggtgtaggtttttccctagggtcttaatccaatataatctaatccgcggtttgtctagcgttgtcgtctccatgtgttgctatcggaacgttgtcatcatctctccctctccgatcattttggttcggtgagacttctatccgttttccctcggtttagtttttaatctcccgtttttgttgtcgagtagtcgtcgctctgccgtagccgtgtgccgttgtcgctgtgccgtcgccctaaccccagccgcgtgtctccgccgagtcgccgccgcctagccgagccaagtcgccctagtgccgccgtgtcgcagctgtgtgcctcttaaacctagccaccggtttagccgcggtcgttgttgagtcgttcgctcgttcgttcgaacgaggtgttccccgtgcttcgtccgttcgtctgtgttgagtcgtcctttagtttagagcctttcagagccgccggttccgttcgccggtttcggttgatcatttgggtgatcccgtgtcacgtagaattgactcgttgagtcggtatctcgtgaggttcgcttgcaagattaatcttagccgtccaaaattgatataaatccgttctttcttttcaatgacatattattcctttttaatatatgtcatctaccaaatatgatctaatctttttccggaggatgttttaatcttctgtctcagctataaatcatttgtaaattgtttaattaatttggaatagtcttttctttaataggtttaattggaatttaatcttgtaaaatttgtaactaattcatatgaaatcggaatgaggccgttcaagtctctaaattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaaaaccgattattgcaaggcaagtcacacagatcctaaacacaatcctttgagcatgttgatcctatatttaaattctttatttatttcaactgtgcatttattttcgaatgtcactgggtggtgtgaatctattcctttgttatggcatgtttgcattgattactttattccttgataccttgggttattataacatgactagttgggctatatatattggttcagctagatattagatatgattacttagccatgcttagaaacattagcacactattgggataacttatgactcattattatttaatgatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacggaggtcgctggggagtccatgccttgtttataagagggtgattatgatccaggaaaggtgcgctgtggtggattgtgttgtgcaaggggtattgtcacagctcctttccgagataccgtggtggtattgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaatagttatggatgttatacctagtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaaagctgcttttgcaaatgagccaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgtctcttaaggaagtatttatcgttttagttaatttgatgaatctgtatattaaattgtcagtttgtgtacctcggctgattcctggacgaggattttatgcacaaataagttcggaaattactagtgaatttccggacgtgacaattcctatgtttttcctccaattcaaatgggcccttagtggatttgctcctcgtcaatttgctgacactgatagagagaagagggaggagtgaggataacatgtggggcctaccatttttaattattttgtgtgtcgctgacacgtgggcccacggttttattatttttccgggatcaaattgccacataagcgccacatcaatgccacgtgagacgaatacctagtcaaaagagccacataggtgcaacgtcagccaaaatcaccttgggacttatgttgcaccggttttgaccattgagggacccgttgtatctggttttctggttgaaggatgaaataagtttagggaccttagatgaacttattcctttaaactatggcagaatatatttagggaaggcaacgggacgggtcgggggtgggtggaggtagaatgcccccggccctggcccagcattcttcgccccgcccccgacccagaccaagagttcggggcgaaatctacccccacccccgccccaggcgggtccccggaacccgaccgggcccccgcattggatgcacaacagcaaaggagaacgatgggggcagcacaacgaagcttgtgggcggaagacgttgatggtagtggggaagcagcgaagagggttggagctgtgcttgacctgcacgttgggggacgatctcaaccatcatgcatctgagggctaggaatcaacaaaagacgtcggtcttcaattcacgcgagcattctcttgtttgaggctaccctttcaggcttcaactcgggaggaataggagaggagaacgtgcgccgagggcacaacgacgtggtgcggcgccgggcgcaaggaaatgcgcggtgcggtgccggacgcgattgcgcgaggagcagtgttgggcggttgcgcaacaggtatgcggcggcaggagatggatggggattagggttgaggtggattgcattgcatctatacctgctcgtgtgggcttctttgggctgattttttaatgggctatcggattgctgctggacagattatacaagtttgtcttaggctggattttcctatggtctactggatgtccgggtccccatgggggcccgcgggtgaactagctgccccgcccccgtccctgcttgtttgcggagccccgccccccacggggtcatctttcgccctgtccctggccctgtaggggcgggtccccacagggaaattgccatccctaaatatatttaaaccatggccctgcgtttgggtttgcacgggccgaaagaagggagaccccaacagcaaaactcctgaaccacaaacgaaaggggaaagagaagagtgatcgcgtcatccacgtagcagcgaccaatcgcctattaggacatgtacaaccaaagccactctatggatgctctcactaactgaagccacttaataggacacacatctcccaaagtcatatacttacagctggggcttcaaaatctcaagcaactgatgaagataccctagcccacaatggggtgccccaacccacgtagccacatatatgatttccttccctacccctagcccaccgagcatccaccgtcttctcccttctcttctcttttccttcggcatttttttcaccgattttcttggccttatcccctcgccgcttctcctctccctcctcgcccagatgcgccgccgcctcccgctctctctcccctccgtcgctctcctctctctccctctctgactcgtcgctgctctatccctctctatcccggtggccgtcgccgtttctcctactctttcctgttgccggtcgctgtccacctcaccggcagctggatccactctcccacatcctttctctcccgccgcctctctctctctcttgccgccactcgtcgtcgccgcctctctctctcccgtcaccgctgacggagaacgacgcgcagggctcggtggccgacagtaggggtgaaaacggtacggaaacggatggaaacgacctttaacattttcgttttcatattttttccgaaatcggaatcggaaacaccggaaacgaaaatggaaacgaatagtatcgaaaccgaaaacggagcgaaaacgaaccggcgcggatacgataacgaaaatttatcggaatacaaaaacccctcaaacttttgtcaagtccaattctcaagtctcaacagtcaacaattcatcataaaacacaattatatcaagactaattgtttagtatcaacagcaaaatatattcttctataacttcatataatttgcataacaaatattctaaaagaatacagcaaaacacaatggtataaggtatacacaattcaggtgctatactgctatcagcctatctctccaggaaatgggtttgagaacaacaacagaacatcagtccatcaatacttagttcatcaatcatcacagaacagcaacttctactcttgccactgcacccacatttgtggtaggatctcctacatttgcaagggttggttgtgatgctggcaaagctacaatgcccgcattgcatacacttgcactgctgctacttgcatttgatgattccatcacaaatctgcagcataaaagaaatcaaatcaatggtttaggctcaagaccacagtctgtccttagctggacatagtagcatatattatttttcagctgcatttgtattattccccacaaacaaagcagtatttctataattggagtgcttggcaaatggcaatagagcatattaataacttctacaaaattaacagaacaaaataaaatccagaagcaagaaggcataaacatataaagaaaataaaacctacacagtattcaagctccctacacagaatgtaatataaccaagctccttagtacaaagaaaataaaagacatcaatcattcaacattcactcaaatatatagagcctacacagtaacactaacacagagtgacagaggtggaggttaaggaatgaggaataacacctgctggttgctcagttgctgccgctgggctgctggctactgcgaggcgaggagtcgtcggcgttggtggcggtgaggaagagtcgccagtggggcttgaggtgtcatcggtggtggtggctgtcgcgtcgtcgtcggtggtggtggcggcggtgaaacggcgagacgtggcgggacggcgtcgtgagataacggggaccgagcaggccggcggaggtgcgagatggtggcggcggccagcggcgaaacggcgaagagcgagggcggcgcgagatggtgggggcgaggataggacggcggaccaggtggcgagcggtggcgcgggcggtgggcgcgggggcgcgcgatgccgcgatctggatgcaccacagccgccgctccgccgccggctcgcgtttgcgtctgtctgtctctctcctctctagggttagccggttagagacttgagttagggtagatgccgcgatttgggttgcgctggaaagttggggatgaattatggactattgaatctatgggcctttttaacttcggaaattccgacaatttttccggaatgtttccgaccgtttccgagttccaacggaaactgctattatcatatttgattccgtttctgggaaaacatttctgttttcgattccgtttccgaaaaaatctgaccggccgattccatttctgaaaacatgaccggaatctggaaaaattccgtaccattttcactcctagcagatggcgagcggaagccaagcccgtcgccgactggtggccggcggcggccgcggcgcgaggaagccgtctccgcccgtcaccggctggtgaccgacggctaccgcggcgcgctgtggccggatctagtcgtcgtggatccttgtggccatcgcagatctgtcgacgtcgcctctctctctcatcgccatgccgctggtgaggggcaagaaggggaaacaccaggggaggaggtaggggacagggcactgggtcgccccaacgcgtagtctcgaggaagtgtctctggaaaagagaaaaagagagctgaggagccagaggcgtgcgttcccctcgtgggggtcgcgcctccctacagggacacgccgcgcggacgtagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgtgcacagtttttttttttaaaaaaaaagcaaaggaaatgtgtaaggaaaaaaaaattaaaaatggaaataaaatgtttaaaaaaaagtaatgatttactaatgttaaaaaatgaaaaaatggtatttaaaaaatggaaataaaagttttttaaaaaagtaatgatatgctaatgttaaaaaaaagaaaaaatggtatttttttgttgtgttgaaaaatttaaaaatatagattgtgattcattattatgaaataatttaaaggtaaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtaacaatttcaagaaggttgtgcaaaattatattagcagttggataataaacatgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagctctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactctccaaagttaaggggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacacaggaggttctcgatctcttcgagccggtgtgtgtcgaaacacttccgctcgcggttccggaaaatccttccgaagctgtcgcctcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaaatgcacacttgagaacaaagagagcacttaaaacacttgagagcacaagatgaggagtgtgggatgaggagaaatggctggggttcatgccctatttatagggcgaaatttgagattttttggaattttttcggaatttttatgaattttttagcctcccaacggttattttcaaatttcaacggtcaaatagccgttagtgccacgtgtcgccgtcccattggaccgccgcccgcctgccgcgcctgacgggccgccgccgtgccgtgccgggccgtgccgtgccggcccgctacagtagccgtgccgtgccgtgccggcccgcgtgctcggccagcggcccaagcacggcacggccaaacgggccgtgccggcacggcccgttactgtagcaggccgtgccgggccgtgcctgctacaggtccggccgtgccgcgcgcggcccgtttggcccggcccatttggccacctctacgcggacggtgtgagctggggaacgatccaggggcacgcattgaacagcccttaggaatgcttcctgtcacaagtttcagctgtaccggataattctgatggcacttagcatcaatacaggagctttggaagagtttccgctcagtaccgtacgtcatcattcttagtgttagtctacagataattagaatcaacagaaggaaatttactagtcacaactcacaagtcataaccatttgtcttagaggccaaaagactgggcaatggcagccaaactaagagtttacaatcactcatccaggagcatcagtgcatcactaccgagttcaggccagatctgaacactacatatcacagtctacagcaccaaaaa

SEQ ID NO: 45641 - DNA, 2528 bp, Oryza sativa
cacggtgatgtacttccagttcagcactgacggctgtatggtccggactgcctcagcagtgccctccccgccagagtcatcatcctctgaagacctcgtcttctcttcctcattgctagggtctacaggtttctcagcctgtacacaatttcagtaacgcaacaagagtttgaaaacctcagaagtcggatcaagatattatccatgttctaaaaggcatttagaaataatcaatcaactatgataatgtcttgcgctgacagctacgtctgagatctcaaacagatatgctgcttacaaacttgtgcgtctttattagaaagaagaaagcggaattacattgcaacagaaccaagagaaaactgtttcatacatctgtgtgttaatccaagaaatttcaatacagttgtacaattaattcatgtaaacataattatataactatagctcaattgttaaaagaagttttactacacaatattttaaaagtaatgagatagactgacttgagtacatacaaatgcgtacttactacgaatgagagattgactgacttgagtacatactacgaaagtgtagttactaccaatgggtacttgggcttttagttgctaacacaacccaagtcgtacctgagaggttgagcccaatctggccatcttacacaaagctcaacctaaccacaaacttaaattggcaggttcagcccaaacccaagctagacctaattacttcaccacagcaaatgttaacttactaatggcatgagtatcaaatagttgtggatgatgtcgaccaagcagcagcaatttataccttttttgtacagtatgaaaaagagaatcaactaaagataattttcaccttagtctgtgatgaagaaaaatcaggaactatttcctccgctaatttagtagaatgaagctcaacatctttgccagtaacatttttgctcaattgagtgtcatccttaacacttcctttgcacttctgagccaatatcttgtttttctttgtcaacaacgaaatctggagccatcagaaaagaaatcatcaaataaatatggaacagcaacagttcaacttactgcttaacatagattaattcagatttggtagaatatgagttcacactgtatttagtgtagcacgagtcatacgaaagttttccttcctaaaataatccaaaacacttaccattgcttgaattggaaaacaaaacacaccatgaaaatagtatcatgtcagcttttttccaccacaaagttttagattttctgtttacattcaaaaggtacatgcagatctttgaactttgatgcactaaagctaggtcacaatcccccactgtctaagtctcactcacatcatgtattgtcttgtttacctttgtcaacaagaataaccaaactttgcaaataatgaaaatggttcatcggtctaaacacaagcatggacttcgaacatagtcataaacagatatttggatttacttagaatactaaaaggtaaggttaacatctagtcttttttgtatcaactcatgtcttgctaaatttggaagcaagaccaatccacagtgtcattcaacacagtaaaattaaaaggtctaattgaagatttgtatctttttcttgaatcatgtgtttccaaactatgcacgagtagcatgtatatataaaaaagctaaagtattgacaacggcaacaaaagtgtattcggtcgcgtatagacctgttgatgaagtcgttctctttccaatgcaagttttgtgaccaaatcagtaattatttttgttctgattccaatatccttgacggtagacatcttaacatggttggcttcatgtaatgagttctctagactttctgctcgacccctcagaaacgatagctcctcactaagttctaagttagtgtctgttaacaatgtacacttagattcagcattctctgctctggtttcagcttttaaaacctttcccttcagatcatcaatcatatgttccatgtccgacattgtagatctcagcatactctgctgttcaacagtggcatcaagagatgcctttgcatgctctaattgggtatgtgactccttaagtttcctctccaaaaggctagtcttttctgaaccatgacttttaagagagtttagctccccattaagttctatgttagcttcagttagctgcatgcaccttaactcagcattttgtgctctactttctgctcttgagacatcttctttgagactcttaataatgttttctaatgtgcttatctcggcatgcagcacattctgctcctcctgaaaagtttctgctgatgcctttgccaactgcaactgtgaatcagattccctcaactgtttttctagctccttaaccttatcctgcaaggatggcaattcaggacttggatgagtttctgtgcctccactatgttgactcccttcttgaatattctctgcgttgacttgcagtgaagataatcccatcaagctttctcctaacttcgactccagat

SEQ ID NO: 45642 - DNA, 11785 bp, Oryza sativa
cttcttttcaagatccagctcacttgctatcgattgttctaacatctgcaaaacatttcttcgttgatcctctgtcctcatgctagtgtgggatgacacaataccattttcatacccagcgtctccagtaatgcctgtataattgtagttagaaaagagtgctaattgatgcatataaaacccagggtaactgagcattaccttctttgtcatggggaaactctatggctttctcaaacttggctgactcttttctgatatcagaaactaattccttcatctgctttaaagacaccatagcagcatctagcctagctttaatcttgcctccagattcatcttgacaaaccatatgctcaacattttgaatatcagtctcaagagtactgatcatgtcatctaactcccctacttctgcatctagaaaaccatataggatgtccaattcaaaagcactctcggcagtttcagaagaaacagattcgtcttccaatgtaggaggctcaaaatcagtagccttgcgagctatctccatcaccaacatctctagatttagtaatttctcagaggcaaatgcaagctcaagttccactctagtaataatttccatacttcctccttctacattcattccatctccattacccatgttttgttggaaatggtcatcatccatactgttctcaacatccataactccttttctgcctgctacacatttggttatacacaaaaagggagacatgtgagatacaagaaatgcacaaataggaatattaaagaccaaaataaataaaatgaaaaagaaacaataaaaaaaattatctatcataagtgacgtttgtagcttctggttcatctgatggaccaaaggttttaagagctaatagcattccaaaaacacctaagagtgtttatattaaaaaaaaatcagaaaatgtacacatcagaaaaccaatcatgttggagcctgattggacaagaacattatgggaaaatcaagcttatcaggcatcggtccaaaatgacataggtaggtagaaaaggcccagcttacatgttcccccgatatcgtcaaccaatttaacaagcattaacctcggtaaggactgggacgcaatactactatttgagagaaaaaatggagggacagaaagaaacacctccccgaatgaactaacaagaacagatcagaaggaaattcaacctcatgatccaacaccaaatagaatgacaattcgtcctatgtgctccattcagcacaggaaatgctgaaattgggcttctcctaactcgggtcagtaatcctgatggattccccctctcctccaagtcggatttgctgttcatggtcactatgaccgtacaaaagtgctctgctttcgtgcgcactacatcatacaaaaccaaaccaaagcgccgtatcagccgttatcccaattcccaccagcaccagctagtccccccacccacggggtgatccagattcggcggccctccgcgcgcgagcggttgacccgaatctctcgctgctcgcagctaaaagcaacaacctacctaccagtgaaccacacggactagactacagagcaggaggcatcctcacgccgcgcgcgagcaggaggcggcgagatgggagaggttgcctgcggcttgccgttacctgggctcgtcggaggcagcttgccgccgccgccgccgtcgccctcgcgatctccgccgggaagcgaggcgagatgatgaggtggccggattcggatgctgctccactcctctgcctcgcctcctctttgcctttctctctcctccctttccttttcagaaaattaaaaggaaatggaaaaaacgaaagaagtgggggagacgtgcgtgccaactaggcgcacgtgcggcccagaaacggacgacgtggaaacagcccacgggccggagagcccctttgccttcgtcctcctcagcccagaacagccgatagagagacgtccattgccgccgagaaaattgggtattcctaatgggcgggtgatcgccgagaatgctaatgctaataggcgggtgatcgctcctccgtccgcccagcgatcacccgcccgccccctcccctataccgtacacttatccctcctctccctccttcctcctccccttcttctcttcctattacagtacaccacataaaatttttttaaaaaaataaaaaattagaaaaatttatgtatagaaatacttatatataaaaattttgaattcaaattcaaatttaaatcgggtatataaacttttgacttataaactttgggtctataaactttaggtgtataaactttagatgtatagaaatactatatatatagaaaatatttgaattcaaatttgaatttgaattcaaattcaaatttgaatcgggtatgtaaacttttgacttataaactttgggtctataaactttaggtgtataaactttagatgtatagaaatactatatatagaaaatatttgaattcaaattcaaatttgaatcgggtatgtaaacttttgacttataaactttaggtctataaactttaggtgtataaactttagatgtatagaaatactatatataaaaaaatatttgaattcaaattcaaatttgaatcggatatataaacttttgacttataaacttttggtctctgaactttagatgtgtaaacttaaggtgtataaactttatgtgtataaatttactaaaataggaaagtaatgcggtgccaaaaaagaaaaccaggtggaggggtagagggagggaggggggaggggatcgatcgctaccccagtatccgggcaatcgatcgcccattaggatcccccgctttgtatgccatattgtattttgatctctctaaattactattttcaaatgatgtttagtttggtctatccatagaaaaacagacctataacctatacagttgggtggcacacgtctgataggatgtcaatggcatgctagttagacgatgtacttctccatatccctctcttgcagcacataacgacgatgggccaaacaaataaagtgaggccaccggagttttagggcctcatcttttcgtgtatgctgcttatcagctaaaatttgaattttcaatcttaaatttgaaactgattttgagatttttttttatcaaagtttacttttcagcctttgattttagatcgctaagaatacgtatataaaatttatattcagcatttgcaaataagccatttcgtttattccgcaaagagatgccaaagtgcattatcttttaaagtgataatttaatgaagccaaaataacccgtcgttgaagattgcatagcaattttctcatggccgccgcggccgtggtggattggttgactggagggagctgttcgtctttgacgccttgacgggttcccgcgggtaaggagaagtaggggccaagaaaccctaggtttccagttgattggagggtttgactgctttgcagcgagtacaaaaactgggctcgacggcggccatgtcgcagcactctttccgcctccaaaccactggagcagccgcagcaagcaacctcttcttcttgttctttcgccgcctcacaaatcacaatccccccggtatgcaaatgcaattcctccttgttcaaatgttgaggatgcgatacttcatttttgtttaaatttttttagggttgaggggattatgtcaagtactgtagtaacattttggtttgcgttttttttccatgtgcttcatcagggtgtaaatgaactaaggggaaggaagggttctagactggagattgcattctggtcatataccaaggtactagatttttgctttgattgtgataaatctacaggaacgaattagattgtagataagaatcacagttttcaatagcctctgtttgcctgcaaattatcatttaaatatcaaatctcgttgtagcaaacttggaataatcccataccttcaattgtttttgaaaaaccaacctctttgcatgtatttcatcagaaaatgtttaaactcaggtctgagttattatttcagaaattttagtgaattagatatgaaaagtgaaatagggacgagatggctaatattgaagtagatatggactatccatataaacgaatagatatttcaaaattgaaattcgaatataatcttgccattaaaactagactaccaaatgtgctggggatggggatctgaaggtttacagcagtgtggccaacttccaaaaacaaaagctttaaaatttaaaaagcatgacaacctgaaacatttcctgaaaggcatgtcttttctgtgatagttgtgatttagtgagaactttcaacaaatttgctctgtacatattattgaatcaaaataatctactcatagatggtattgtctgttaccctccttgctttgttggattttgctactttgcatcaactatagctttccatatacttcacaagataactatttatctgatctgtttcatgcgactttctttgtcttgcattatgcaaataattctaacttttttgccacaatattctgttattctgttgtttactctcagtaaccactttattttctatcacaaatcaaagctgttcacaagtacagtttatttgggggttttgcatactgcattttaaatcaatctaccattggaccatacactggattcgtttgtagtttgtttcaggttttttgtacattacaaaaaatgtttatttctgtatttaacacccttttgttggttcattaggaaaagagaaaatgtcatctagttatgatgaagggaaaagttttgctcggagggaccttttgcttaagatccaatctgaagtgcaaaaatgttgggaagagaacaaggttttcgaagcaaaggctggtgatacacctccaagccctggtgaaaaattctttgggaatttcacatacccatacatgaatggcatgctacatttaggccatgccttcacactatcgaagcttgagtttgctgcagcataccacagactccatggctcaaatgtccttttaccctttgctttccactgtactggaatgccaatcaagccatcagctgataagcttggtaaagagatacaacagtatggaaatcctccagtgctcccacctgccaacaaaaactcaaaatttgagttgacaaatgatagaatttatggccagaccactgctagtgcccaagataagtacaggagcaagagatctaagtcagtagcaaaatctggctcatacaaatcccagtgggagatcatgaggagctttggcattgctgatggagagattgtggaatttcaaaatcttcatcattggttaagctactttcctccgctggccatggaagatctcgaggattttgggctaagttgtgattggaggcgttcatttataaccactgatatgaatccattttatgatgcttttgtccaatggcagatgagaaagttgaagaaaatgcacaggattgtcaaaggcaagcagtacatgatctactccccattagatcgccaaccttgtcttggccatgatcgggcatcaggtgaagaggtcgagccacaggaatatgtactgattaagatgaaggttattccgccatttccacccaagttgatggtcctggaaggcagaaatgtgtatttggccgcagcaacactcagacctgagacaatatatggtcaaaccgggggcgaagctacaggtaatcatcggggtcagtagaccccaacgatgttttgctaatgtccagtacccctcttattttaccagctatgcccccaatgaagagctaaactagaccccagtgacatccttgattgttccatcaaagagcaattctatactagtggtacctcatggtacctcctcaagaaccgtaaaattgctctccatcaaagctcaactggttactataggaacgagatactagcaagcagcaaatagaaaatgaactagcagttatgattatacaatggcccaatatgcatatacgattgatatttgagcccataaataagatcggaagacactactccacaaattccctggttgcatcatcatattcctcgttgtattgcatcggcatcgcacgtcctgacatcatatttatcatattttattttatttccagcataatggaaggcaaataattagtggttttgataatctttgatgcatttggtgtcttttacagcttgtaaaataatccaataatgtacatgttttaataattttatcgacagaagctgtaataggcaagatgtaacactactacaacaggagttggctttattttaataattttgtctcgtagtatgtagtctctaattacaagctgtaataattatgtagttttatttccgatttactgttggattccaaccagccgtatggcatttttcgcaaaaatttgattaatcttgatcaaattttggtctacttttttttattcaaaaaataattctcgaagaccattcaaaatttcactcggaatctacttttgccctgcgtggaaacatcaaaattgcatggttttcgatcggttttggttgaaaacgtaaatcctgattagtacgaatactgaccgcggtaactatttatcctggcttcgcccctgggtcaaacaaactgttgggtcctccttgatggaaagtatgggccttttgagataaatgaaaccgatgtttttatattgacagcaagagctgcacgtaatcttgcttaccagatgctatccagagttccagaaaagccaacttgcttagttgagctgcttggcacagatctgattggtttgccattgaagtcacctcttgcctccaacgaagtcatatatgttcttccaatgcagaacatattagtagataaaggcactggaattgtgactagtgttccaagtgatacaccggatgatttcatcgcattacaagagttggtaaaaaatcaagattttagagtggcatgtggagtgaaagatgagtgggttttcccctttgaagttataccaataattgatgttccaagttttggaaataaatcagcagagaaggtttgttttgatctgaaaatggatagtccagatgagaaagaaaaacttgctaaagcaaaagagatcacatatttgaaaggcttcgatgatggcataatgattgttggtgagtttagcaaccgaaaggttcaagaagtgaagccattgataaaggaaaagctattgaaggcagatatggctgttttgtactatgagcctcaggagaaggtcatttccaggtcaggtgatgactgtgttgttgctctcacagatcaatggctcataacatatggtgaggctgaatggaaacaaaaggctatagaatgcttggacaagatgaatacattctcagttgaagcccgtaatagttttgagcacacattgaactggctgacttcacgggcccgttcatgttcttttggactaggtactcggattccatgggatgagaagtttcttgtagattctctttctgattcaactttgtacatggcctactacaccattgcacatatactgcaaaatggtaacatttatggatctgacaactcttatataaggccagaacaaatgactgatgaagtatgggattatgtgttctgtaatggtccggcaccaaaaactagcatcccctctactgttttgacaaaaatgaagcaagagtttgagtactggtatcccttcgatcttcgaatttcaggtaaggaccttatgcagaaccatctggccttctgtatcttcaatcacacaacacttcttccaaaacatcattggccccgcggattccgttgcaacagacaccttctgcttaattctgagaagatgtctaagtccacaggaaatttcaggacccttcgacaggccatagaggaattttcgtctgatgccactaggtttgcacttgctgatgttggtgacggtatggatgatgaaaactttgtctctgagactgcaaattctgctgcactaagactgacaaaagaaatttcatggatgaaagaagtttttgatgataaatcttcctttcgacttgggccaccatctacttatgctgatcgcgtctttgctaacgagataaactttgccatcaaagacacggaaataattatgatgcttccatgttttgagatgctctaaaagccggattttatgatctacaggcagcacgagatgagtacagattttcatgtggagcaggaggtataaaccgtgaattattgtggcgttttatggatgtccagaccaggcttatcactcctatttgtccacactatgctgagcatgtgtggcaaaagatactgaagaatgaaagatttgtagtgagagctggctggccgattgctgatgatccagattctactttacgaattacaaacaagtacttgcagtcctgcatagttttgatgaggaaatcgcttcataagcaggaatcttgtcacaaagtggccaagaagggagctgcagcctctacaacatttgcggaaaataaattatcagttggtctaatatatgtgaatgaacactatgatggctggaaagagcaatgtttgagagtactccaggacaaatttgacactgaagcaagatccttcactcctgatgaagacattattgatgctctggtgaattgctcttttggacaggagctaaacttgaaacaaataaaaaagttaagtgtatgcctttcattaagttcaagaaagatgaagcacagaatgttggttttcaggccctgtaaccaaatcttccttttggtgaaatggagattcttgaagcgaacaaggaacagatcaaaagacagttgggtcttaatcacatagagatattgtcatcctcagatcctctgatgaggctggtgcaaacagagctggttcatatgcttccgtgctcaggaaaaatccaccttctcctggaaaccctattgcaatattcttaagtaaactggagttccagagtcaaacttgaaaatcactcacttggtttcggtaataacagaacactcaggttgctcctaacttgtcttatgcagataccactcatgctgcctttcaaacaaatagtttgttgtgtataaaatttgtcttacagtttagaaagcacaaactgtatatgaacctcgtatagaaataaatcattgtctgaacattgtacagaaatgaaccttgtaaataagtgtcattctatctgaaatttgtaaaggaatgaacctttgttatgtagactttgtttttagttgtatgtagtatgtactgctaatcattgcttcttcagtgccttgtgttcatcgtcccactgttgtttagttattagcagtagaagttccttaatttgagagaatccattatatgccactgattttgtcacacgtctacaatttaccatcgactttatcatgttctataatataccatcgacttttgcttaaattctacgatttaccatcaccatccggttagcctccgttgtactgtacaattttgtccaaataaccgaaatacccctaggacaaaaactttcaaaatttggataacaaattcaaaatatcatattataaatataagattgtaaacatccaaaatttggccaaaaacataaaatcttatattttagaatttttatccaaattttgaaagcttttgccccaagggtattttggtcattttgacaaatttgtacactaacggagactaaccggacagcgatggtaaattgtagaagttaagcaaaagtcaatggcatattatagaacgtgataaagtcagtgacaaatcgtggacgtgtcacaaagtcagtggcatgtaatggattctctcttaattttaacagatactacatgctgtctatctcgttgtggacttgtggtagagttcgctaaagaagtacggagtactaaattgaacaaattattggtctgcattagtattctatatttttgtatcgtactattgtagtagctcaaagtgatagccggacacagtggaatgctgccggtgatctcaaataaaacattagagatttttatagactacaaccgcttaggaatgtttttttttctttttctttttcttttttttaaaaaagagcatgcatgttaaaatatgtctcacagacaaaagaatgaaaaaaaaatggtcatatgtatctctactattataaaaattgaagatgttttgccggtattttggtacgtcattcgtgtatgaatcggtttttaaattcgttcgcttttggaaatacatattcgtatttgagtcgggttttaagttcatttgcttttagaaatacagaaggagtaggataagaaatctctttttttttaaaaaaaaatatcgcatgctaactttagatgatcggtctcctaattgcagctcatgattttgtagaaaaatatatccaaatgaattctcatagtaaatttcaccttaactaaactttataacaataataagattaaaatagcttcctttgcaatgcacaggtattttttctagtattaaaaggagagaaaaattaacgtgcttttttataacctatgtctttatcttaaacttcagttaacactacacctagtttgaacttatttgcaacacatggattttgcagcacttttatataaattaaattgattcatgaatgaatgctttatatatagttcttgcattctaaagaatgcctttggtatgatctgaaaccattcaagcgaattgcgccctcaaatttccttgaatttatttctgaaacaagtagttgtaaattgttttgataaaaatatatatattgagaagtaataggcaatagcacttgatttcccaagaggtgagttcaccatcaaatggtagaggcaaccaaactcaaccatatgcaagtacccaaacacattctcagcgcatctggcatcccgtccatctcttatacaaccaaccaaacactatcttacactatccagcctcatatgatacagacaaccaaacactttattttgcactcactcatccaggctcatgtcagcctggatggttcatacgggtcagggccaggttggagtggtgcaaacaaccaagcacacccttatttactggatgacatatactgcatagaaatattattctttgttggctaattactctcacacgtgggccggttgttgaaggacaaacttaggacaagtatgcgtataaaaaagagtaaattacacgaaaccactaaaattatagtgcaagttacataaaaatatacaaactagatgaaaccccgcgcattgctgcgagaatttaatatgataacaataaaaaaaatagcgtgtaagatagctagataacattaagattaagtaaattaatgtgatttataataatttaaatttaaatagtatgtagaatggtgattcaaacgtaaaaagtaaggtggtatgactttatggaagaagaaaaatagggggatagtttggaccgtagattaatcatctaaaggctaaaacaattgatgtgatatgacttaattagagaaaaaaagaagaaagataatttggaccatagattaatcatttaagcactaagtgaggatgaactatataagtatataggatatcataaaacataacaaagatatacattgaaacattatgtgaattatgttggatgataatttaacatatttgtatttgaaaagctcttaaattataaaaactataaagatatagcatgtttgcatgat

SEQ ID NO: 45643 - DNA, 16147 bp, Oryza sativa
  unsure (1)..(16147): unsure at all n locations
aagttggaggacctaaacgagtgatctgcaagtttagggacctggatgacatagtcgaactagtttgaggacctgaacggtcgatttgcgattttagggactgggatgacacaacggtacaagtttagggaccggtgatggactttactctaagctgaatgagtagtgtagcgatgttcattactggaccaaatatatgtatgaggaattggtttcttatatatttcactattgaattaggagaagattcaaatactaactaaaagagcattcaaattagataactggcaaggaacaatgtatgggtcgattttagagtagctggcaaaatatgccgctaggctatgcatggacaattacttgcatttgggaccttgaaattcccttcgtgatttctatttgtattccatcatgaaccaatggaggtcagataaggctgatttgagtttttcagagtcgtgtgcactttttaaggtctgttttggagtttacattaacttagtgttaaccataatttctatatagcacatgagtcctttactgaaaaatgaatacttttaaaaagaaacaaataaggaaagttggcattgttcatgaatacatctgatgattggtccaatttatttgtgactgcaaaatatccactcatttataattattgttggacaaatggcccatatcacaaagacacaaacatatagtgctttcccctctcggataagtgttctttcaccgattgtagcaattggaatggatgaataggccagattcctttgaagttttgctctttcatgtacttcacaaaggaaaataaaaatgaactgaagacaagggaaatattccattggaatgatggataacaattcctgtgtctcaaacaccaagtttctatgctttctcatcttctgttttgttttttttctgcatttatattcttgttatgttctcatatgttccaacacaggttctgattgtggcaagtttttaagacagtagagtctaggcgatggagttactttattctcagtggatatttgtagatatgcattttctttttgaatcaataggctagcatgctctttcattaatggaaagttaagagctaggaagataggtttgcagcaattagggacaagctatgaatccggtaactttttcactagttggacaacgcctcctaaacaaaagaaccgtgccaaacttttaagtgatcattctctatttgaactaattccaattcttctcaccaccctgtatatgtaacttcaatttcgggaactgagaaattgctattacactttacagggaagcaaagcctgtgggatttgcagagagataccctgctcttgtcaccggtttctttttcttcatgtggtatgcttactcacctgagcgcactttagaatttacaattgcaggtgagcgaactgagaagttgctgcctaatgtggtttagctattgccaattcacaatatgattttgtaggtattttctgaacgtgatatttaacatccttaacaagaagatcttcgactacttcccctatccatagtacgtttgctttatatgtgtgcctccttttctttttcctttcatgtgacaacatgcatcttcatgatctaaaacctctttcttgttaatatagttttgtgtcggtgagccatcttttggtaggagtcttgtactgccttgtcggctggagttttggtctcccaaagcgcgcggtattctcatgcccatgcccttcttcaaccatgattcctttcaataatgagcatgaatacccaaaattattaggggtggtgggggaacatatatcattgccaatggcaattgtcaaataatgtgcacccatgatagagcaaaattgctggtcttttacatctccattagctgaaaacctataatgaaatgctttatggccctcaaaatataacaaaatcacttattcattcttatgtgtgatgtttctgactgacaagcgttctggacgaatacgtaaattggatttaaacaggccaggaataatttttttctgtggctttacctgtttgtgttcaattaggatcaatattacctgatctcctacattagggcattttcaagtattttggttatatgtctaccttgtagaggggaagggaggatcggcagccagctactagatttcaagtctttgacttgctactggtgtccgcgaactttagatgtcgatgaaaatcatgtgaagagcacttgtaaaagaaagggttaaggctgtgtttgcaaccccttgttcccaacccctcttcctcattttccgcttgcacgcttttcaaactgctaaacggtgtgctttttgcaaaaagtttctataagaaagttgcttaaaaaaatcaaattaatccatttttgaaaaacaattaggtaatacttaattaatcacgcgctaatggaccgctccgttttctgtgcggagggaataagttcccatccaccacatgcgaacacagcctaagggctcatttggtaaattgctgcagtttgccactctttctctacttttaatattggagtaattggtggtgatagccgttctacattctcatccttgctccgacttcacatcaacttactgatacatatataaaatcttatttcctgttggaaaattagttttttttatgcttttagtataaggaaaataaatttccgtctaaacacatatgcgcacttctagttgtcccaataatgtggcataccatgatttttgtggcaagaaaattgatgcgcaaaatttgagaacttgtatcaatggcatattggacatggggttaagaaagtgtggcatcccaagtttggcaacaaattgccaaacttatcaaagtagaatccacaaaaaactccctaaatacatcaagctagtatacatactgaaaaagttgtatatttgtatgtatcatcagttgtttcatatccaaaattttttacgttaatgatatcatttctggaaggcaatagtcaaacttgggaaagtttgaacttttgtagccgatcaactcaacggttctgaagctactgttcccagttgctgtctgccatgctattggtcatgtaacaagcaccgtgtcctttgctgctgtagctgtctcatttgcccacaccattaaaggtactgcaacagtatcttgattttatttttgtatttttggccttttgcgtttcttctttatgctgagatttttcctgcaaataaaatgattgcagctcttgaaccatttttcaatgcggctgcttcacagtttatccttggccagcaagttccattgacgctgtggttatctcttgctccggttgtgataggtaatctcattatgccttttgcttgtgttcctagcagtacatcacttgtatcttaacatcaatgcaaataaggacatatgaaagtaggtttcatggttgtcaaggcccctgtgcaggtgatgcctcagcatccaagcactccagtaacatttccatgatcagatgccttgccttatgatgagggcaaatgagaaagagccaaattgatacttatagtcctttctgttgtgcagagtggacacatgttcctataggttgggccttgtgccttctttatttctttcttatttctctctaattcctatagcgtaatgaccatttctttctcctgaattctggtcatcatgatattacaatggcatatcaataagtggtgtgctacacgatggcatgcttaatgaaacctaccttatcgtgcgataaacgcaactctgtgtgtgggctttgtggggggggggggggggggtaggctgagctgccttggttattcgggaggagggaacagactaaagatgagattgaagaaccttggagaaactacagtttgattatttcactgtttattgcttaattccacagattcctccatgacatgcttagataggaaattaatattaatattctagatattatataagatgaccagggaaccagggatactctttactatcagttgtctcagtaacattcctcacagcctccatgcatctttaatcatttcaagcatattatgttttaggactttctagttgtctctatagcatctctacttctgtgcattggtaatcatttggagtatattctgttttgaaataatcaggtgtttcaatggcatctctcactgaactttcattcaattggactggtttcgttaatgccatgatttctaatatctccttcacattacggagcgtttattccaagaaggctatggtttgcttgttacctctaatgatctgcatgcatattcactcttccttttgatactcccgtttcatttttttactttgttgctgttctttatcacagactgacatggatagcaccaacctgtatgcgtacatctcaataattgctctccttgtctgcatccctcctgcaattattgtaagtctaattttatctttatgcatgtttgttacatatttaacacttcagctgttggtagcatataggtctatagatacctaaaaaggcatatcgcaacatagccgatgttaagcatagcatatttatcaagttctcaccatcttgttgtttatcactgtgctgatgatattttgtcgttgatttattggagaggatttgaaatacagtagaaaattattcagtattcactatgtaggaaaacaagtaaaggagtgtaatgaccagagtctacagttcgaatccatggagagaactagtaactagtagttaccagtttttctgacctggcctggattttgtgcactgaccatattgcgtatgttacaaaaaaggcaaattttgattatatgaatttgaagaaactacgaaagaatatcatgcatgtgttctacaattgccaaccaccaaggatagaatttgatccataaaccagtaaaccactacataatttagcaatttttaggagttcattgttgtgagtaaccatgttttgcaatactcttgcaagtagttgtgatttatgcatgcatgcaactcttgtgtttgttggtaaataatataaggcattttttcaattcagactaatgtgggggcataaagaaagatggtcacaatgattgtattcatttgacaacaattcctgattttcctcctaaggtcaaaactacctagtgtatgcaacacctccatttctctaattaccctaatcatgtgttctgacatggtaaaatccaattttccctttcatgctcaaaccactgttcctctatccctttgaaaaactgcacaacatttgaaaatttagttccatcacgaaacatcgcttcatgtgcttgcacatgatcttttgcagtaagcaagtaactgcatttacttttaaaattagaaatttaagatattacctgcgtggaataccagcctaggagcaggattttactcaaaattgttgttgtttttctataaccctgataataaccatttattacagtttgcgaatacatattagaaaaagtgattttagcagtttactttttgcaaagctcctgttgttttctcattccagattccatgttgcagcagagcacaatgccttcaaagttcaaactgggtccaaagcgcagagcggtagagaaatagtctgaaaataatcggagatccactgtaaccttgctactaaagtaatttgaacatcatgattgactactaagaaatgaaaatcactctgcttgtgaggttgagaaaacttgaaactgatgtcacagcttcctgttaattagctgtggttggtggccacatttgggaggaaattggacaaaccaaataatatgttttgtattcctgccctgctaactaacctggcctgtaccggcctctccctgtccctccagaggaaattggaacgtctgtttagaaatgtgctcatgcttatatgctgtttgtataggtgtatgtatggttgacaggcctgcaagtggcctaatccaattttgatgttcgcctgtacatgtcttatgcatttgtctttggtattagtccctggactgatggtacaatgtactggttgtgaggatcaagggtagggattcccactcatctagctattggcaggtcccttgcatgatgtggtacaggctcttgaggcaaggcaaggttaaaccatagatgtaggtactgctcatgtgaactaaccgtactgtaggaaggcatgctcagctacccgcagggccttagcccatagtagtgtggttaataaaattcttttatatgatttcttttttttagagaaggtattttttacccggcctctatatccaatcggatatatataaccatttaaattaggaacttagcccctcaaacaatacaatctgaaattcgctcctatgaagatttgaactcaagaccttggggtactactcaggtcactgcaaccactaggctacatgccctttctcatgatttcttaagtccgcaagatacctttaaagtcacctacgcattatcattgactttcatgttgattctttataacacaaattttgcagattgaaggacctcaactagtgcagcatggattcaaagatgctattgctaaagttggattagcaaagttggtttctaatctccttgtggtgggcttgttctatcacctttataaccaggtaaatagcttaatgtcataatttgcccatagatcaagaatatcatgaaacaacatggtttatagatgaaggttaaaaacaactttaatcactattacaaacaacatcctcaaataacttagtccacatgtcaagaataaaaacaagcatttcccacatcgtaagttcgtaactatcaatattttgaaactaaaactttttatagttgttcagatatagaaataaatcatagtattaggcaaatatggataaattttctgccattttgtgatgatagttggtattctctcttttatccaggttgctacaaacacattagaaagggtgacccctctaacacatgctgttggcaatgtgttaaaacgtgtcttcgtcattggcttctcaatcattgcattcggtacttttaattttaatctttcataatgattgtcgatcagtatgcatattcttgttcttgccattggcaagtgttgtactctttttttgtagaacttcatatacatagttttagtgtgcaaatgatctgatgtttttgtgtaatacttggtgaacttaatgttgaacaggcaacaagatcaccacacaaacaggaattggcacttgcattgccatagctggtgttgcactctattcttatatcaaggctaagattgaagaagagaaaacggtatgtgtgtatactatatacattctaaatctcaatatttgcaatgcaccctaacgttacttcttttttttagaggaaccattgcaactgaaagtaacataaactacactagtacacacatttgaagcaacctgaaaatttttgggttttgtttggaaattttgtaaacttttttcaacatggcaagaatcagaagatactttggttgctaatacagccaagcatgaaagcacaaaatgtaaaaaaagaaagaccaagagtttccactatcatcttttggggtttacaaataaacatcacttgaagggtaaatgaaattaatatggatatatgtgcacgtcctgttttggggtttggaaaagaacatcattcaatagacaattcgaacgaccttagcttatatcttgatcttctaagtgaaactccattgcctgagtggttgagcatacatgacatgctagtccagtttgagtttgtgcgcctaattgatctttgagctggttccatcttgttcttgtgattgatgcagcaaatgaagagcgcataaggagttgaatctgtggatatagttgggtagctgctttgatcgatctgtattgcctccgagaaataaaatgagctgtaagatttataacaatctaggtgcctgctgtatctcatcttgtttgttattgtcgatttcgctttgaacagcaaaagctaccgatgcattttttttttttttgtaaattataactgctaaaaacccgcagaaacaaagcctccatcatcccattttccccttccttggctatttggacttttgatgatgctcttaagtttgagcagctatacgtaattcgttattgtctctttctggtgagggtttcaagagaaattgacaggttttttttttcgcaaatgttgtcatgacgtaaatagacaatttcatttgcttcaaatttcctatcactgttgctctcagccctgcatttggtctaaaatgttaggtacaagggtgagtagttgtcctacacaaccttttccttttttttcttccaatcctttattactccctccgtattttaacgtatgacgccgttgactttttaaacaacgtttgaccattcgtcttattcaaaaattttatacaaatacaaaaatatttatgccatacttaaagaatatttgatgataaattaagtgacaataaaataaataataattacataacttttttgaataagacgaatggtcaaacgttgatcaaaaagtcaacgacgtcatacattaaaatgcggagggagtatttattacttcctccgtatagaaaaacccaacctagctaaggatgtgacatgacaattcagtttcgttgtattatgttgtgtcttaatgtcttaactttaattagattggattttttttttgaatggatggggtatatcattatgaaatctctctttttcttctggttaagccacatcattttgacatagttcaaaggacacaaggcaacctaatcattaacatagtttgcctggatttattagcttacaatttaattttttatttagcatttccatggttgatctaagatagcttgcacaaaaccataaaacgaatccgccttcatacaaaacaaatgtatctgggacattacaagtgtagtatttcgttgtgtaaatctctcgcaacactttggattctcatctatataatcagcaacatgacaggagcgatagtacaatttcatacaaaatagaatcatggtttgtacttgaacaagctacaaaaatcagaaattatatatgcttgggctagttcgacattttcctttcctttttttctggtgactgaagatttggttgggtgaactcagacacgcgtctctgtatccaattgttgagacaaatgtgttgtctccaagcaatttttttctttacctctgttacatcatcaaccaagatatttgtcgtagtcacccaaacatgaaaaaaaaaaaaaaaggaaacgagggttggatccaacaagtaataatagatctaattattcacattactaatatattaaaccagtcagtgtgtcagaccttatctcctaccaattttaaaaaattatagcaaatccaaatcatatccaagcacaataatatcctgaaccaacttaaaacaataatatcctgaaccaacttaaaattaaaactattgctcccgctccgtctgactgatgaattagaaatagtaaatatgatcagttctctagtctcaagattatcacttaaaaaattctactatagtactctctccgttccctccgtttcaggttataagacgttttgactttgatcgaagtcaagctgcttcaagtgtgactaagtttgtaaaagaaaataataatattttcaacccaagataaatttattataaaaatatatccaattattgatttaacgaaactaatttggtattataaatattactatatttgtctataaacttagtcaaactttaaattgtttgactttgatcaaagtcaaaacgtcttttaacctgaaacggagggagtataacaaaactacaattttactaacatatatctctactattataaaaattaaagatatttttgccggtactttgatacgtcatccgtgtttaagttagttttcaagttcattcgcttttggaatttcagatttgtatttgagtagattttaaattcatttgcttttgaaaatataagagtcatataagagatctctttaaaaaactcatatgctaatttaagatgattggactcctaattgtagctcatgatcttgtaaaagcaatatccaagcaaattcctacaatgaatttcattttagctaaaccatataataataataagattaagatagccttcatcttcgcaacataccggtatttttttagtttatataaaaagaacgatggttataagttgggttgctcaaggcttccaggtgttcgacacgtcatatcaatattctgtcatcctcttgcagcgttgtacgtgtaaaagcacatgtacggcatatccgaattttgatattgtcaaattcagtcacaagtcgctctcgcgaacactagctagcgaactagctagaacacgtacggacggtcgatggctcaaaaaagtcaaatcctttagcactgataaaaaaaagaaatataatactccgtatctttatttttcaatatatgaaaccattccatcatttgtcttattagtttaaaattatgtaagtatatatatttgttgttacgtgttttatcacgccaaaggtaatttaaatgacttatttttttatatttatattaaattttgaatatgatgaataactaacgatttcatacatagagattatatatgaaaccaccattaaattctgaacctgtcgacgattagtcattatatattgggagtgcagcttcgtgctagaagtggcgtagccgtagccccggcagccgaacatgcccattattagatggagcgtgtcagaattctccactcaaaaggggaaaattaacaagctaacccgtgagagtacttttcacacctcacggaaagaatcacggtgactaaccttgcaaaagtcaattttgttttattttattacaaagggacttagcaaatgataagttagctataggattaaaactgtgggctaaggaagcctttgcctgattttacaaaagcagacatgaaatacgctgaatgatgcgctgggaatgccatcccatccttcgctcacacattcgtaggaaagtctgttcaaagttttagcaactactatcttcgtttttaatgtatgatgcttgatcatttatcttatttaaattttttatgtaaatataaaaatatttaaatcatccttaaagaaacattcggtaataaatcgataaatcaagtcacaataaaataaataataattacataatttttttaataaagatgaacggtgaaacgtatctcaaaaaagtccatggtgtcctacaaagtttaaatcatggagtccaaagaaacacaaattaagcaacataaaactagtgcattgcactgctgtcctgaaggctagcaaaagaagtggaatatgttctttttgaagcagcaacatgtgcactcttcatcctcagcactggagccgttgcagtggcgccctccagccaaacttcaatttgaattaatgatctcattttgtaacctgccttagcagtcgatctcctcgtcgtgactttttcttgtttttcgaccaaagtctttgctaagaaaactcttgcaaaagccaatagcgtgcacatctatacaatctcaaattctcaattctacaggaattctgttatgaatttcatatgaattagttcagttccgtagggagaaagagaaagcctaaaatggaaccagcaatactatcatgtaatgtaaaattatacatgaatatatatacacattagattatcatcaataggtaaacattctgtacattatgtcaacttgtcaagcttcatctcgaactaaattaacatgataatctgacacaacaagcaacagctagctaatctccaatggcagcatcagccagcagctgagctgagctgatcgatcaaaccggcagctctaaccggccgccggcggcggcggcggcgagctcgtcgacgacgtcggcgcggcagatcgggcaagtcgagtgcgagctcagccacgcgtcgatgcactccacgtggaacatgtgcttgcacgccggcagccgccgcaccacctcgccgacctgcaccagccccaggcatatcacgcactgcgcccaccccgacccggccgccgcgccgccgtcctcgccgccgccgccgttcaccctcttgtactcgaacgccgggatcgccgacacgatggccgcggcggcgacatcaccgccgccgccgctgctgccggtgctccgagcagcctgatgagcccccacgatgaagaccacgtcgttgggcgccgccgccgccgccgtgccgcccacggcggcgcgccgccgccggaccctgaggtagaggaaggacagcacgacggcggcggcggtgatgacgacggcccagatgaggccggcgacgaggtagaggatgacgaaggagaagaagatgccgaaggtgagcagcaccaccagcgtgcggtcgccgtcgtcgccgtcgtacggactacggccgcccggctgcaggtcatggtgcaccgccggcgagatcccggacaagaacatgctaaccctctaggctctagctcaaaaattatcaagtgcatatgcccaaattaatgcatgttcatctttgcaatgtagtaacacctgtacatgtgggtgattaacttatgtgcttaattgcaatgttaattaattacatgcattatagggtagctgaagcaattagcagcatagttaattcacaggataatttatttgtttgtttttgttttgtccagaagacagagtgatgaccatttggccaatgaggaggagtaagagttggggttgttaatattgactttcttcttgttgttggagacatgtacaaggcagcactcaatccagacattaatgcttggatttgatcttggtttagtatttaattgtgggagacaaatgcatgattacacttgaagcagttcagttacatcgtcattgtccattaaggttagctgaatctatgtttaagtgtatgtttgtttgggtcatgcttttatacttgtcaaccaacttgcacggaagtgatctactcggtggttggttcttcactaaataatccccataaactcagattaattcccataaactcagtggaccgtgatagcttaatcttcataattcgttgaactggagtaattgtgaagcttaatcctttctaaattgttcaactatggtgaacgaaagttgtatggttatattttcgctagaatgtatttgaatgatattttatatttgatatactaatttatttataactaaataacagccaggtttaggttgaagggtgtaaagtgaatgttttgaaaagtcaagggattaatagtctagcctgaaaaaaaatatagggttgactttcatacataggtaacaagttaaaagtctaggagaggggccggggagactcaatcggtgaatagtaccctctccgtattcgtaaaggaagtcagttatgacaatgtttaagttaaaccttgggagataaatcataaataactctcaagttgttgagtttgaaaacgtaaaaattatatgaatagatttgtcttgaaaaatacttttataaaatcatacacatatcactttttaataaatatttttatagaaacaagaagttaaagttgtgttttgaagaccatgtcactgtccaaaacggcttcctttacaagtacggaaagagtatctaggttaaaaaaaatattagggtagattttcagacttctatataagtaaaaagctaaaaggtctaggggaggggagaggggagagtcaatgggtgaatagtatctagtttgaaagaaatagttagggctgattttcagacttccataagaaaataagtgtggtggtagactatttcctgtccttagtgatttattatatttttagcacattttattttaaccataaagactttatctttgaagcaatcaatacatttgaatttcgctaaagtgaagggcattctaatcgctttgtatttgtattggtataaatgagattggttaaaatgtatttactccgttttaaaatataacaaattaggataggataaaacatattataatattgcatttttggcatagagagagtagcgtctttcaggcaatatgagaattatattgtggtatgttttggtgaatgagtgccaattaatgcaaatgttcaagaaccaattttgcctctttttcttgtgatcatcaccgcttaatatactccctccttttcaatttacttcttgttatagtaaatctcctaagatacccttattaattataatttaatcatctttttaaagcaagcattaaaaattcctttcaaagtactactatagttgcattgataaagggtacaaattaagagaaagacgcaagtgctttctaacgtgagaatgataagtatcttgacacaaattttaaaagttagaataatttaaaatggagggagtacgctgttttctgtcatttgcacttggcaatgcttggaaggatatcgctagcttcagagttcagttcattacctaacgacaatcagtgcatcgaacaggtccgatagatgaagatatgtgcaaggtactaccttacaaataattatattcaatacatttagcacttgtatgataggcaaatattaaattaaaactcttcacttcactagttacttcggttcagtttttatgtcctagacacacctacattaataacaagaataggaaaatctgacatattttctccctttcgttcttacaaacatggtcagctttaacattaaatgatatgccattgaatatctcgccactacatcaggtcaaatattcaaaacctaaagcattctcacaaaatatacaaagcttatgtggacttacgactaccgagtagatatgccctaataagtttagttaaattgcctcaaacacatctgtcttacagaaaacagctaatagcgattacaactaaacccaagagaacagtaatattaggcagttacactaaagtttagaagaatgatttcaatcaacaatgtctagactcatctcagatctcacacctgaaactaacaaaaatcagcagttagtgagttcttcgattaaagtgccatgcaaactgatcaacagccaccattgcttgtgaagcagaaccaagagaaccatcatacctgtgcattcagatagcaatgccagtaaaataaatttttggcaggaacacatttgtataatggaagtaattaaaggaaacctggtatttagagttctgtaaatcaaaagttgaacaatgagatacgtacatacaaactaacaagtaagctccaatctccataactataacaccttcaccttctggctgtactgcattaacgcaacgagcacagaaccagtgttcatggattgaggtgaccaaatctgtaaatgcagaactggcaatcacaatattgctggagataacaaatataaaattagcgtttgacgtttctatgagtggtacggttgattcagattcataatgtgagtctcttacaccggtttgagccaatagagaagaattccatctgcagattgttccgtcgaacaaagtctagaaatggtagcagatcaacagctttcagttcagttccttcttgctctgctctgggcagttaaaaaagaatatttgaaaattttcgaccttaggatcttcatcattcatgtatcacaacaaataagttcatttctttgacactgaaatctatctaatatattcacatctgctgttcagttacaaaactccgtatctagtaaagtattccttgatttagttctgcgagatctgataaaattttgtatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45644 - DNA, 825 bp, Oryza sativa
  unsure (1)..(825): unsure at all n locations
nnnnnnnnnnnnnnnnnnnnnnnnnnnnnnnnnnnnnnnnnntcgttcttccactgtaccctcaatactccatatcgacaagtggatcaagcatccgtgttctccaaaacattgtcaagtaggctgctttctcatttgaattctcatctagtcatcttccatattactagatctttaaattctaatctttcagacgctgtagatcattaaattataatatttcagatgctgtagatcattaaatattaatatgatggcatcatgcagggaggattcatattttgctggattgccaatttccattatcgaatcatggtaccaacgtgacggttatgtgaaatcaatggctgacttaattgaaaaggaactgtcaattttttccaatcctgaagaggtttgaccattcccttttccttctatttttctccctacagtttcccacctttggattgcagactgtgaacacaatcatagtataccttttttggtagaaatttccttagggatacagtttgacatagttcttgtatttacctgtggacaaaattcgacattagatacatccttaatcttgtctacaactaattttcagtatcactgtttattcaattatgtatgagtacgttgtgacaaccacatcagagaaactaaattatttaatgccaactacttttaagaaaatgcactgtccattttcagctaactttttgtactagactgtggatatagggagtataccatgaaacttgaaccacaaaaatgcattttctgaaatgctacattgtagtgcttacctgcctactgtatatttgactatccagttat

SEQ ID NO: 45645 - DNA, 4689 bp, Oryza sativa
tatataaagtgttcgtttcatctctttttaaatggctatttttactttgaatgtatcaactgaactttcaccatctagaaaattttgtactagtgtgttttattcctttgctttactggttaacacatcattaacctttgtgtgcacacatggcagagtcgagtggggccagttcagtggctgaaaccatatactgatgaagttctagttgaactaggtcaacagggtgtaaagagcctcctggctgttccagtaaggtaataataactgcacatatttcatattttggcgattcagcgttttcttttttttctttggtatttccttaagaacagcaacttaaacctgtatctctttatgatagtttaatcttctgcctgcacttatctcttgatgcacatatattattgtaacccagcaatattttctggtataaaatcattatcaacgtagaaattttgtttcatatggcataagtttcttgttgatggaaggcatatgccattgcttgtgtgtgtgtgtgtgtgtgtgtgtgttgtgttttattttgaatttttctcatgttcactatttactgcatggttaatttgcttatccatcaagtacttacaacgtaaaactggaaactgccctttaggttcatctcattaaccattcaagaatggcttgttcagtttgcatttttcttccctacatcaccttgtgattaccttctagtcctaactaatttatcatcaatcagctttgtgagcgagcacatcgagaccttggaagaaatcgacatggagtacaaggagctggctctagaatcgggcatcgagaactggggaagggttccagctcttggatgcacctcatccttcatctccgaccttgctgatgcagtggtcgaagccctgccctccgcttccgctctcgtgacgaagaaggtggacgagagcgattccgacatggacctgatgcactacctgagcaagatgttcttcggctccatcttggcgttcgtcctcctattgtcgccaaggctgatttccgctttccggaacaccctgttgtaggtgatggtggcttcttttgtttggttttttgcactaggggtttggcttgagtaagtagaaaggcaggctcgtgggatgatagtgaatagtgatggttaaagttccccttttttacagaagtaatatgcatgaagtcattgcaaggtagcttaagtggtggttttaagcaaggagcctctaggggtaaattgccagtctgtaccagttttcttgtgctggtacaaggcaagcctatccttttttttctttttttttctttttgttacatgagcacattgataaaacatcattgatatattactaatgcataaacaccataatttttcctcgtttaatcatgttttcccccttttttccaattcaacttctgccgttctgcgtatgtaaagatcgttacagccaggagatgataccggtacggtatgatgagaaaactcgcaaaaggttctctaattcgcaagaaaaatgcaaatgtttgccgagaccggctcagtacatgcgggagaatagatcatataacctccatttagattataaatcctcaatttcaatctgacgtaagggtatacgatcaaattttcgcactatacgcaggccccaatattaattaacctcaccttattatgctctaggatgctagcgcctggtactgccattgtgctttggtttaaaaagttgatcgctgcataacagtataagaagcatgaagtaaattcaggcgatatttcataccgccagcttaaagaaagcatgcacggactatattcatgtaggcaatataaaggacctgcagttacacatttcttgacacagcatctgtttccaattttacatccctcatactgccaattttgccaaaccagatcacccttttcatccgactcatctccttaatcaacagccacccgacgaatcacgaggcgcaaagttggactcggttgttggtacacagaaagcagggcatatatcaaattgaactagaaaacaattaagcgcgggagccagataaatacaagttgatgatgttgaatctgaattctggagatgagccaggaggtaaatactcctctagaagaacgtcccttctggaggttgcaccaacttgcgattctgcggggttgccatctccttcttgagctgggtaaggatagtctccatggtgtactcgcgctgccagtttgctagaacaccaaacttcctcgagtcaacctataggatcacagcaccaaatgaatatcaatcagagggagtagcctgcacaaaataaataaacttggcatctacatttgggaggagagaataccgctccagtctcatgattaacacacgacatattgattcttgaatgaaaccggacagatggtggcttctctgggtagtccttgtcacagaacagcttcagctggtagatgcgaccttcatggacactctgccagattgaggaagaaacagacacttagtaaaagttaataatattttatataagcagtacaagaggagctaggtggactctcaaactgtcaaacatgagaaagcatctagagctaatatatgtaagttttagcttgtagtagtgattctcctgcctttatggtcaacataaggaagttgaaaagctcaagtgtgcctcttcccagaaatataattccataaccttgtcacacatatcttaatgccattcaaatagcctttttccactaataaagacatcttctccactaataaaaacccaagatgaagcacagtacgacggtaaagatataaagccacaggagaagattttccatatgagtaatatgatatattgtgagtgtatcaggatagagtccataatctcacattatgtggaccaatgatggtgccagtccaagaccgcatgtagatgtcatctgcatcatccattccatagctcacggttccatctccaatgcccttttcaccacgttcaagctcttctagcaacctgaagtttcgcggaactgcaggcattttacatattagtcaactcctcaggatataatgcagttaccctcttaaatctacttatatagaaattgcataatggtgatatcattgcacagaacaaaagaagacaaaatcaacctagaaacagcatgagaagttttcatacccatgcatcaagtactgaattacagagcaaagacggctacaaccgagataaataaaatggcaatatcgattcccagtttcagaatttagtggatttgtagatgattactattttctgaagaaaaaaaaagaataacaccaatgtatcattctcccgaatgagggacaagagcactgcagctcagctgttgttttcttgtgaagcaaaacaaaattgaatatatctgccattggcgtggggggttaacaacaatgcaaaaaaaaaaaaatgtattgttctgtttgcaagacgatgaagaatcttgtgactcgaataccatacacccagaacagatatgtcggcatttgttaaacgcaagtcattgttttatctagtgcacagacactcagagtgcagtggctctaaaacgggcaatcatggttttgacttctcagattgaagcctgaactttgacttgagattgattatacaatgtattatctcaaaacagaatagtagacagaaatagtgtaacttcacacacaaagttcatcagtggaatataatgaacaaataacatgatctttggcaagtagtctgaatcacaaggccgccgaggtgaaacaatttcagtacaattgtttgaatggtgcaaagttccaacttgtgattagaacacaaaaaggcattacgttcaaacctccaaaccggagacgctaaaagctatttaattccatctaggaaagaaaatattaagagaagaccgaacttaacactgcaagaaaaacgcaatatagcattcaatacccaggtttttataaagcacacaacctgcatgcccacacgaaaaaacagatccagcaaaaagaaaccaacacagtctcatccagccgcgatgaggcctatacaacagctatctaaggaaaccatgatcagaagagcatatctatcttcattaaaaacatttccacttaaagtcaagtgatacaactaataatcccgctgataattatgcctcatagtccacttagagctaatggtcccaggcacttctcagctctccccttgtaacacccaagcagctaaaggaccacttgttagcaaagggaacaatttcatcctctaaggataccacaaatttactgccaaagccaaaccatcatcaacatgccgtaaataaattcgcaaaccgagcaaaccagccatctagagagatcccatgaccatttgtcgcatgctaaccaagcctaatcaccagatggatggaacccatatggacaaaaaccgcagatcgctaattccaacaaacaaaccaacgcgtcggcgtctcgcctgatcaccaaccacatcgagcacagcacagccatggcgggacacagcgccaaagttacgaggcgcggaacggagcgaaacccgcgtggattctcctcctcagcctcctccgatccgaaggccctaggcactcgcgagaaaagggggggaagggaagaagggaaggggggattcgatcgatcgctcacc

SEQ ID NO: 45646 - DNA, 2090 bp, Oryza sativa
ggggggaaggcaggcgaagtcggaggaggattccttgcggctgtggcctcaactgcggttaaatcgccgttttttttgacaaattgacccttttggaaaacttatttcgaaactaacccctgccaaaaacttcaaccaaaaataggccgtcgcttcagcgccaaacacattggcgctgacgttggccgtgtcagcgccaacgggactggcgctgacattgtgccaccgtggcggccgggccgatccccagctgacgtggcagctacctcagcgccaaccggactggcgctgaggtgggacttggccgcaacccccaaggcccagaccagcaagccttctggatggcttgcgggctgggacctctgcgccagccataatggcgctgaccgtgggacactcagcgccagcccacctggcgctgaggtgggacttggccgcaacccccaaggcccagaccagcaagcctgctggatggcttgcgggctgggacctcagcgccagccataatggcgctgactgtgggaaactcagcgccagcccacctggcgctgaggttggacttggccgtttcggccgtggcccagcccagcaagccttctggatggttgggctgggacctcagcgccaggtgcactggcgctgagtttggacatgtcagcgccatttagcatggcgctgacgtcccagccctgctaaactttagcaaaactttgcacacaacagaggcaaacatcaaatcacagaaatttacaggcagtaatatatccagagaaccatacaaaacatacatccatccatcaatcccaacatcattccatacatccatagaatccatcaatacatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgtttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcat

SEQ ID NO: 45647 - DNA, 931 bp, Oryza sativa
cggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataatatgtgcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgctcaactgcctcgacaatcgctgctggagataaagttggttcagctcgcacaaatgcctgtaacctgtttccaataaaccttgaagtaagttgcaaatgcttgccggttacttccgcactacagcatgtgtggtcttcgcccaccctagtcacccgccacctatctcctccactcttccttgcattaatctgccatttgcaatggcgatcgagacaagccacagtatactttactgacgcgttagattccttcacatggtacggccggtggacacggatagaataactctgtagccatatttttagatcatccatcgatcgaaactccaaccccttccttggttcatcacacattggttcgaaggcaccgtcatattgtggatccccatcagcaattgctagcccagatctggtaagatcctcgaattgtgttatttc

SEQ ID NO: 45648 - DNA, 2282 bp, Oryza sativa
caaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacttccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacggaggaagaactggctggggcgacctcggccgggctctaagtagccaaggtcagcgccaacttacttggcactgaggttgggcacctcagcgccgaagcggttggcgctgaggtagctgccacgtcagctaggggatcggcccggccgccacggtggcacaatgtcagcgccagtctcgttggcgctgacacggccaacctcagcgccaatgcgattggcgctgagccgatggcctagttttggttgaagtttatggcaggggttagtttcgaattaagtttttgaaaagggtcaatttgtcaaaaaaaacgggttaaatcggacactatatacggatgaaataatgtcgatattatatttgttttcatattcctttttaaaatattgtattacagttttgacccatttttattgccaaagtttttactttgagccaccgttaaatcaacttttttttttattttggattgggtaacttgtggttattttttcggtttgaatcacccaactctctttattattcatgtttacccttcattttggtgattttggtgaatatatggctttgcacgtagatggagaagtttaacggtgtaccaaaaccgatttaattagggttgttgatgggtgctaaagaagttatttgggatagtctaaactggaaaaaaaaccgagacaaagttatgcagtccaaagtgaaaagattggtttaaaggtgatttaaagtgaaactttaacaataaaatatgttccaagctgtaattcgctctattgtttatataggtaaataagtatattcaatatgaaaccaatataaattaattttaacatagatatgaattgaataagcctaaatggggaggtctaatgagcaccgctcaagcgtgacaagaggcacaacccatcacacgtggatctagccattcactttctaaaataaaaaaagacttcatatatgtaaacttcgtacataaactttaaatccgaatcgacatatatattagcttgttgttgtacaaacttttagaactctaggtatataaagctttggtgtatttttttttaaaaaaggaaagatgcaaatgtaaaaaagaaaaaaaatgtaggtgtttgcgcgagtataccatgtgcgaacatttggtaggtagtagcattttcacatcgaaatcgctcactgcgacaaacactatcacgattaacacataattagctcatttaatggatcaaactatgttcattgagtccaacaatacaatatgacctgtataaatgcatgttgttttatactctaattagtaaatatgcttatagcactgagtaatgttggactgttggcaagccagactataattaaaggaccgaagaagtagactggacgcacagacttaagagggcataaatgatgtatagttgtttggcagggattcgcctagcaacaattcctaaatatatgtaaatatttttttatctatttatgacttatacatcgtacttaaatttgtagtcgggaaacattattcatattcaaatttgtattcacactatttgaagattgttcacttcaattgtatctatattcatttatgtctaagagtggacaaaacctatccgctctatataagatcccgacaaatcgcggaaaaattcaaacaatttttaccataaaaaattgaaatttggttgaacttagccggtttatttcacatattgcaacacatctatatatatgtccgataaccgtcggttatcgtcgatagtgaaagtttcaaatgtatcatctccatttcataatacatgtatatattcacgtattttttaaaaaaaaactagaaaggtagcccacgtacatgcgcgggcacattgctg

SEQ ID NO: 45649 - DNA, 39863 bp, Oryza sativa
  unsure (1)..(39863): unsure at all n locations
aacatgtgggtcattttttggtaatatttttttattatattctaaatctgtttttgtccatgatttgtttaggattgctttgaatgctggtcatgattttcttctaactaccatatcaacatataaattctacactaaaattatttgaattcgtaaaatgttgagtttatgagaaaatatcgtatcgtggaaatggagttgattcacatggacctatcatttgtactatacgtgtttttaatatttagtataacttatttttggagtttctaaactttaagtaatagcttttcttgtgtactatagatatctttattgaatttaggatattttaatggaagaaacgttcaattaagatatatggtaagaggaaaattgtatccaattatgacaaatttatatttacttctactacctccttttttcatatgcttactatgttcttggaaaaatgaatttaaaattgaaataagagagtaattatataaataaaattagtatgtgtagagtatttataaataaaattgttgatgacatttgttgaaattgggcattggtcaatagcatttttggattttgtcatcctatttggtcgtaaatatttgtcaactgataacagatatataatgatatactttctactgtcatttgttatataattttcatgtatgtttggattacatgaaaagaatcaaaatgtgacctaaaatataattttattttataagttgaaatatattcaaaacagatagtaaaatataatttaatggtaaataatatgatggtctaaacttcattttcaattgtagagcaaatttagttatgtatgtttgtaaaagtgatatatgataaaataatatatgtcgccatttgtttgtcatatatgatgaaaagggtcaatatacgacccaaaaaacatttatttatttattataatttaaaatatgtcagcaccagtttaatcatgtctcaactattacattatatgtatgtaaaaattgtatgcgtaattttgaatttatagttgtttagaatttattatgataaataacaaatattatctcaactactataaaatagattaaaaagattaaaggaaaaggaagagaaggtgaggagggtcggttgcgtgcatgcattatgaggatattttataagggttaatggaatccatgccactacaaatatgccattttagaaaaataacattactattcacgatattggctacgtgccactggaatttgagaaaattagaaccatgtcactccatcacattatctgtcaaaaatctccgttagccccaactgcacgtgggacctaagtgtctgtttcatcttcacctccctcccatcttttctctttcctcttcctctctctccaccactgtcgtcgaccaccactgtcactgccgccgtcatcgaccacctccgtgaaggcctcgggagccacagccgtcgccgatatcatcggccctatccacggcaggaggcttgggagccgtcgccgccgctgccatctgtagcaggaggctcgggagcagccgtcctcaacgccatccacgcgggagggctcggaacatgcagccgccgctatccttgacgccatccgcgtgggagggctcgggagccgccaccgccatctctgtcctcgatcgcatccacgatgggaggtcttgggtgccgtcgccgccaccatccttgacgccatccgcaatatcgtgaatagtagtggcatttttctaaaatggcatatttgtagtggcacaaaatataagtgattttggttgaattggatatcctattactacgaatctaaatccatgtccatgcatccaacaaaaatatcttatattttgggacgggggaatatgtattttctaattaagttcttattattttaatcttattaattagttttatgtgttttatattgtctagtgtaaactacgtgttgttaattacatggtttaaaaatctatgtgtttttccaattcaaaatgtgtgttgagtggccaatagctggtccaaagcaatgtatttcttttacttgttaaatacagttaatttgggatttgaattataagttttgttataaatgatctaatagtatacatggataaaaaaaattagctatatatatgatgtagatgttatagttgttcaagaaaaaatttacaacaaaatatgtttcaatctaataaggcatgaaaatagaaaagaggagatgcaccggccggttatgggtgtacgtatgtgcagtttgcagcacatgtacctgtacagggccttttcttttattattaaagtaaatgcaatgaaggaaaatagtgggtcctttgttaaataaaaaaattggtgggtccaccttatttaaaagtgccacgtgttgaatcaagagcgtttgtagaaagatatgtggcggcttaggagtgtttatatgaagtttaatgaacttttagtatataatagatagatgtatgtggacaatttttacatacaaatatattttagaaaacaaacaaatgcctttacattttgcgaaatggcctgtagcctagtggttacaagagcctcggtagcacctgaggtcttgggttcgactccccatgggagcgaattgactccccatgggagcgaattttctaggatttaacggcgctgtgctttcagtggtagacgaggcgctgtgctttcagtggtagacgaagcgaggcgcatgtggtgactttgtcaatctctccaggatttgccgatccagtcttcgaagatactcataaggttcatgggggtgagtgcgcgtgcgcatgtggtgactttgtcaatctctccaggatttgccgatccagtcttcgaagatactcataggattcataggggtgagtgcgcgtgcgttgtgagtgtctgcattgtactgtgtaattctaaaaaaaaaggcctttacattttagaatactgtcatacagcaacagagcgagaaaaaaccgggtcacttgcacacctttcaggccgagcccgatcgagacaccggagtgtctgcaaatgcgtctccgaatacgaatacgattacgaaatacgacgaaatggactcggaataccttctccgagacagacttgtacacgcacacacgtagtgcaagtcgaagtagacgaagtgaccgtatcgctataaattcaacgctcttccgcgcctcgtctcctcaacacaaaaccaaccacgtcctacgaattcgatcgcttcacaccaagaaaacctcgctagctagcttgtagctcgccatgccgggcggcggcgcgatggtggcggcgagcggcgccggccggcctgagtacccgggcgggctcaccatgttcgtgtccatggcgtgcctcgtggcggccaccggcggcctcatcttcggctacgacatcggcgtctccggcggcgtcacctccatggacccgttcctcagcaggttcttcccgtcggtgtaccgcgcgcagtcggcggcggctgcggcggccggcgggaaccagtactgcaggttcgacagccagctgctgaccatgttcacctcgtcgctctacctcgccgcgctcgcctcgtcgctcggcgccgccacggtgacgcgcgtggcgggtcgcaagtggtccatgttcgccggcgggctagtgttcctcgccgggtgcgcgctcaacggcgcggcggcgaacgtggcgatgctcatcgtcggccgcgtcctgctcggcgtcggcatcgggttcgccaaccagagcgtgccggtgtacctgtcggagatggcgccggcgaggatgcgcgggatgctcaacaacgggttccagatgatgatcaccaccggcgtgctcgccgccaacctcatcaactacggcaccgcgaggatcgccggcgggtgggggtggcgcctcagcctggcgctcgcggcggtcccgcccgccgtcatgaccgccggcgcgctgttcctcccggagacgcccaactccctcctggagcgcgggaggcccggcgaggccaggcggatgctccagcgcgtgcgcggcgagggcgtggacatggaggacgagtacaacgacctggtcgccgccggcgaggcgtcccacgccgtggcgagcccgtggcgcgacatcctgcgccgccgcaaccggccgccgctggtgatggcggtggcgatcccgctgttccagcagctgaccggcatcaacgtgatcatgttctacgcgccggtgctgttcaggacgctggggttcggcggcggcgcgtcgctgatgtcggcggtgatcaccggcggcgtgaacatggcggcgacgctggtgtccgtgctcgccgtggaccgggtggggcggcgggcgctgttcctggagggcggcgcgcagatggtagcgagccaggcggcggtgggggcgctgatcggggcgaggctggggtggtcggggacggcggcgatcccggcggggtacgcggcggctgtggtggcggccatgtgcgtgtacgtggcggcgttcgcgtggtcatgggggccattggcgtggctggtgccgagcgaggtgatgccgctggaggtgaggccggcggggcagagcatcacggtggcggtgaacatggccatgacgttcgccgtcgcgcaggccttcctgccgctgctctgccgcctcaggttcgtgctcttcttcttcttcgccgggtgggtcgccgccatgaccgccttcgtcgcgctcttcgtgccggagaccaagggcgtccccatcgaggacatggccgccgtctggagcgaccactggtactggaagcgcttcgtcgacggcgacggcgacggcgcacgacgccggggagacattgagatgggacacaagtagtagtagaatttactcactgcaccgtactacacttcatgtttttcttttgttgttattcagctattattagatgcggattttctttaattactactaaatttcaatgagtgaagatgttgtaacaaggattacatatttgtgttgagttgagtatgccaagtacatatgaagttatgggatcataaacgagttaacacgtttaaactttaaccattaatatctcttggaataattttgatttaagtttttgaaaacaataagaccgaaagaaaccaccaccgaaatagaacctttacgacactctttttccttctcttgtttgtcattaacatacaccaacattttaacttgatctcgagatgcgtgcaatgataagaagtgtatgatttcaactccaatatctcgtgttaaatctccaacacgctcataattttccttttttaattacacggcagacgcatacgcacacacaccactacatacgtaacaccacactcatacccctacaaatgcatatcccaacacatgctctaagagacggaaactaacagcacattcctaatctcactaaagtcctattaaaaatccacttgcatatgcgtagtatttgtgggcaccaggatttaaatcctagtgagtgaattcatgcacccacgactccatcactacaccgctggtgcttccccaacatgctcataatttctttttaaaagaatatttggagagatatctctcggcttcaaatctcattctcggtttatgagctgacttatgcttccatcttcattgcacctctgttgctggcatagtatttcctaactgcattctccaaatctgcctctgcaaccctggccaatatcgaacaacaaacaaatacaaacacacaatttcagtaagagtattggtaattttaactcaaagcaagttttcttacgttctaaatggcctaataaactgcaatcgagccgactatataaaccttcttatagttaggccgataaatgcatatccaaccaaaatattgaccaaaattaatcgggcagcaacctactccaatagcagttccgaattccaactacacaaacaaaaacggaaggcacgtattcaaataaaacaccctcatgttgttgacagaagcgatacactaagtctgcattccatctatttttcaaaaaattatacttaaacaccctccccagtccccaccctggttcaaaaataagtcacataaagactttgctttaaaagtgatttttgccttctccaaactttgcaatggacaaattgttaagtgatcttacacaaacaattacaaagggctctaacagtgtacctaaaagatttttcccatttccaacgcatcatcaacaatggtccaactctaataatttaatttagagtaaattttacaaaactatagatttagcattgaatttattatgatcctacagatttaagataagacgaagtaccataaatctacatgttcagtcacaaaattatcacaaagctacaaatttagcaccaatttaatcacaaaaccacaacacttatagctccaacacaatggtagtactagggactataatttcaatataaaatctatctgcggttttatgataaattactaaatctgtagttttgggtttgcatacatcttaaatgatagtttgatcaagatatctatagttttatgaaatttactttttaatttataatacaaggatagtaatacttccataaagaaacagagataatataacgttatattgcacgaaatttattgatacaacaaaataattgactgttcaagcataaggtggtaaagaagacacaaaaaccttgccacgattagcacgctagtaactcaactacaaacgatacacacagcagcatcagttcactggatggagcttctccaaggatcattctaagctaaggcactcattccgatggcgtgtggcaatgcttttacggttcttcacgatagataccaagacacaatcaggcagtcttgggcttgggtttaagccgcttcaattgtgagtacaggaaaactccggcaagagcgactccggttcctgcagggcgcaaatatttggatatgtaaaggaggtgcgatgcagtcaatttgatacagaagtgaacagaaaatgattcttacccagagagttgataggcgaaacaggggtgcggaagaacagaacggatgtcacaatgaccaccactcgcttgacacagttacccaccgagtgagtaacaggggacactcttgccaggatcatgtacgacaccttcaagaaattatgtgagatcagcaagacatgggctttgcacatgtatgatgattcatcaatgtaacaactgtaatgtattcagcacatagaatctatctgaaatgaacaagcgcatccagagatttcaaaaggccaagctatttttagaaaatcaattagatggctgacctgttggtatgcatggaaacagaacgcagcaatcagtgaccttgtgtatatctgttttaagttcagaccctacataagaaagaaaatagtcaaaaattgcaccaaacaatatgtaaggagcaatttgtctataattaaatatcaaggtgctcacagcagactgcagaactgtcggagtgactttgacaccctctgttagcaaggttactggggccaagaggaagaatgacatcactgtaatgattgagaagagggtaatgttgtccagagattcctgatcagaaattgggaaagaagatcattagaattaagttatgtaagagccatggtgacaaacaatagaggttcaaggaaaaagccacagataggcaagtgtggacataaataaaaagctctgttaaaatacaaattttatcttgaaacagaacattatgaagtgacacatcctaaaataactgatgaatattactaaagcagactattcaagagaaacacacacttgtactaattctgcaattcagttgccaatatctatgatgaccgcactctaattattcagttacctccttcttcaccataagcttcttgctcaacacattccttgactggaaggtgacatttgaggccattgcactccaaaatccagccctgatatcatataaattacagacgaatcaagcatatagcactttgttagctctgctatcagcaggcttatgttatatttgcagtttccacagcgaagacaaaaatagctagctatatcccttaccagttaaatgaagcttcagtaagagatgccaatgccacaccaccaacaattggaacaagagacaatacaacaaaaggagtaggcatctgcaaagtgattatgtatgagaaccaaaccaagaaacagatggtttttctaagattatatgcggttgcatagttatcactgggcaccagtgcagaacattaaaaaattacctctccgaggaaaagtgctgaaagcagaactgaaaagaaaggctccatagccttgatagtatgtgtaaatgacactgcaacctttccaaggctcatgttcgtgaaaagattgcccatggtgtggaccatagcgagaggaaggatagcagcaagctgaaataaggacagttacaatagttggcttcatagtgcaatacatgtgtatcgaatgttgtcacgatgtatcttatagagaaatataattacctgcgcaccggagatctttggtcttttaaggataccggtaatccacatgaacagagcaatgacagtgccgacagcaaactggacatttgtgatgtttatggggtatggaaaaaccttcaaaacctgtcacacataggaacaataaaggaaagttgttttatctacacgaagccaatgaggagatcaagaaatttcaacagattaaccataagtgacaccatatataatgaacgaaaacaaacttccatccctagcacaatttgttttggtagaacattggatatactcactataagacatggatacatatgagtctggacaactttgaagaaatgtttgttctttttccttctatattctatatttctaccagaagacatgggaaattgtctactgcactcactagaagacatgattttagcaatattacccgttcgacatcttataccagatacaaacataaactatccacaaatgtaccttttagaaagttgtgacaaaagtttgatagaaaaggtgtaacgtgggggaacatctctaaaagcccaacgaaataaactaaatcgctcttctttccacaatatacattttgagtttgtactaatccaagatctagacgagcttgagcaaattcttgcacccattcagtaagtgggttagaaacatttacagaaaacgacatataccagcatatggaggcaaaaaaggttataattagaagtgattcacaagacaaataaaatcaatttcaaaatagttccctcttttgctcaacaatctcaacggagcgagtagatctttgctgaatctaaaaggcgaatgcccgatccaagatcagattgccatcagcgaaccattcaccactaacagaatcacatgtaataaatcccaaatgaaacatcctagtctcccccaaatctccgccaaattggcgacggcaatggatcaaagttaaagccgcctcacctgcttgttgtagatgttgaagtagatgttgaagaggtaccacagcccgaagagcgcgccgagctgcagcgtcttcgcgagccctccaccctcctccgcccctgcctcacccgccgccgccgctgtcgccgccacggccacgtcgcgtgcgccccgccgccgctcatcctcctgctccggggaggccggcacgagcccgatgcgccgggcggagatgcccgcgcgcggggccacggcggagaggcggagccccctcggcgggagcagcggctgcccgactccgacgccgaagccccgggggctagggttgcggagctggagcggggcggcggcggtggtggcgccgcatggccggaggagcccgacggccgccgcgctctgcattgccgcccgtgggagccgcggcctcgaaggttctagaagcttcggctcgcgtggggggaagcggatgcgtcgaggcggcggcggcggcggcggcggagtgctcgaggatggcgagagcgtgagagtgggagagaggttttaagcagcgacgcggccgagctgagctggcaccggccgagtctgcatgctcaatgacacgtgggccccgctgattttgtggaccaacatgtcagtgtgttggtggctgtgacgttggctgggcccgcgcttgccagctgctgggtggaccgggagcacggtggtccagcgaggggcagttgtaggtaatggctgcggggcccacttgtcggtgacagtgtggttgtcagatgggtggtggagcaagctcagcgacgagtacgagggtgagactgtgaggtggggcccaagtttggcataggtgcggcgacggcgatgaccagctagctcatcgtggaatgcagattcgggcagaatattcttgacgccgatgctataacagatcttaaatgaaggttgagtaattattcatttggaaatcctgttagtatataagccaaactaatccccttttgtaattttattgagttcatgtgctacactgctctaaagttgtactatgcactaattttgtagtttaactaaaaatgtctgtgcgttgaaatgagcaagactttttccaatgctataacagctattaagagctaagcaacgaattaaaacattggtatcactatacactttaattggaaaaaattaactaaaatcattcattggttttgggtcgaaagcattccttcattccttttcaacccccggcccctagcctaatccgttgcttcctacctccttccgctcgacctaacccattatgtgacattctggcctaattaagatatagcatgtgtggtccatgagagctgtgtgtatgtttagtaccaccttattgtttagcaatagtggagccaacttatagggcatcttccctccaaccatattattcctgagttaaccctttaacacgaaacgatgacaaaaagtgtaaatgtgatggtatgtgtaagtgagcccgcccgtcgaatgagctggctacgtggactagtgacacctataatattagtgtctaaataaaaaccgacacctataatattagtgtcggtcttttcagaagaactgacaccgataattaagatcccaatttttttaagaaccaacacttatatttatactataggtgctggttttttaaaaactaatgcctatgaaaaaaccgatcgaagccaatcaaccttatctccgattccccacacctcctccaccaccatctcctcctcctccatagttgctcccactgccccactctcacccaccccaccaccactgcacagattgaggtccagtgcagttgctattgtgactgcacaatagcaactacatataattagccctctatttcttgatccaatgttccaaatcgcttgctatagtgaattcagaaatatatatattttttatagtaaagcgctacaatacttgctacagtcatccatttcaagcccagtagtgcttgtgtgactgcttaacttgcagtcacactagctactgcacatgaaccagatcccagttgcacgcccacttcctcaccaccacccccaccacctgccgcatccgcctcccccccacccccccacctacctccgccagcctcctcggccttgtcgtcattgccttcctcatccctttccctctcaacatctccctggtgcagtggccgcacggtggctcgggatctagctcttccctctccctctcggcatctccccggcgcagcagcgagtcggtggcttcctgacacaatggcgagttaggatctggccctgatctcgagacctccatgccggtgaggcagcgaggagcaacgacggcctcccactcacccctccctctcctatcatctcttttgtgatttattttgtcatttctgcttctactctcatcttctgtgtgacttattttgtgattttcaattgaattctcatatcctgtgatctatccggatgattttgtgatgatttcgattggattgggatttaatttttgagtttgatttgtgatggtttgggatttgaagaggtgtatgcgatgtggatgatggactaagacggacgaaaatcctctaccagaatccttattatgtagtatttttttattatactagcaaatatgcccgtgcgttgcaacgggtgaaaaaaatataatgataatatatgtttttcatgcataaccatatatgacaatcagaaaatcagaaaattggaacatcttaaatgtaatatcccaacctcgatgatggcaaccttacgatgtttgttttacctaaaataattagattattcatgtgacaacatgcatataatctaaaatattcttttaatctcattattgcaaccaatcaaatcctaatcactgtgcactcttctctaaataacaattaaaatatgtttattttctaagattatttccatataatatgttatcaagaataatagctatacttcacaaaatagtatgataattgcctataaagatgtgcagggtctccaatacgggagaataggggtggaaacgagccgagccgagttggctcggctcagctcgtgaaagcttgctcaactacaggctcggcttggctcggcttgattagttgaacgagcaaaaagtgcagctcggctcggctcgtttcaaagctcgagccggctcgagccagcttgtgatgtacagcagcaagtaaatacttcaacaatagagcaatcaattagcaagccaaatcaacatgtacgatcaacaagacagcaacaacatattatacatttcacaagctgacaagatcacaacttcacaagaccacaattccaccatctccatcattcattcacagcctcacactcacaggacatgccccaacatgacacacataatcttaatagtcatgaccacaccataatagaagcaaaagggagntaatatagttatagtcttatagagagtacataacttagagtagaccacattccaaaagtccaaagtctccattctcaaattcacaaaataattatagaacatctaattattatttcgcaaaatattaaaaggaactctccaaatctccaactcctagactttctccacactccacagcaacatgttccagccatgagccatccatttgcctacataaatgataaatcatcatgtaattgaataatatactacacaaaacacatggctcaaagcctcaaactatagtattggtacaacatttttgatttatttgcctcattctttctgtaattgaatcattcacagcttgacactgacacacacacacacgctactccactgaccacaacaatctacagctacatgcctacatgtacatgcatcacaaaaatgagaaaatacatcacgaacctcttcatcctaggctcgtcgttgcggcgtgatgcatgaattgtcgtcgatcggttggcgacatggcgtctcggcgaggtcatgatggacggcgtcgagtcagggacgccggcgacgcagggggcgtcgagctcggctcgagcggcactggggacggtggacggaggccggaggtggtgcagggaactagggaagggaggcggcgccgcggcgggccgacggcacagggggcgtcgccggggagggaggacggagccgacgcagccacagacccacagtaggggaggtaggcggcgcaaggagcgaggcggcaggaagggaggtggcgggccggcggcggcggcatagagggggcttcgaagttcgaacggcgctgccggcctgccgctggcggtctggcgctggggaggggatggatgcggcggccggcaactcctcttgccagtcgccgccagcgccagtggctgaggaacggaggaaggggattaggggagggatcggatctggggcgtcaggcgctcacgggccacggctcgcgctcggctcagctcaggacttagggtttctctctttcatgggccagacaattgttaatgggcttgggctcgcttagggaactcagttttccataggcttgacaagcctaccgagcagcttgcgagctagctcgggctcggctcggtttggaaacgagctgtggagggagctcgggcttggctcgtttagtcttcgagccgagccgagcttcgcgagctcaagccaagcccgagccgagctcgcgagcctgagctttttgtccacccctacgggagaatagatgacgaaacaaaagtcgtgtaggagatggaaaaaaaatcgatggagcctatccgaccaagtatccatcaatttagtcttttattctagcagttttttcctcatatgctttttttatttttacagacgatggaaatatttttttctcgcgtgtttttttactgactacggaacttttttttctagcgcgttttcttttgcgcttttttctggcatttttttcctcatgcgttttttaaaccgtttttattttctcgcgcaattttttttcttttttaatatacggtagaaacttctctttttaaatatttagattagattagattagagataaagaagatatataaaagaactactaaaacgacgaatagaaattagacttttttccgccgctcttttttccgtcctttttattttttttctcttgtattttttttacgaatggttttttggccactttattagtgtcggacctttcataggattcgatttttttatcgagtcacatataattcctttttctttggaatcagatattttttattttttcgcccttttttttaccgcggcgacggagtcggattagtttctatttttccttttttttatcggacagatttgtttttttttcacccctctttttatcggattttttttattttttcgcttggttttttcgttcggtttttttcgtccagtcgatttttttaccatgtcatatataatttctttttctttggaatcggacagttttttaaaatttttttcgccctttttttaccgattcgtttcgtttttttccttttttttgccccgtattttttttgatcggactgatttgttttttcgctcggttttttggatcggacttttttctcccgtttttttcgctcccttttttttatcggacttttgtttcacccggtatttttcgctcggttttttccgcccgatttttttttgacagacgaaggaatcatcttttatttttttaagtagtagagagtagagatagagatagagatagagaagagatatagatataaatatatagatatatatatatatatatatatatatatatatatatatatatatatatatatatatatatatatatatatatatatatagataaaaaccaacacataaaattgaaaccgattcaaatacggatgacgtaccacacttccggtaaaaacatccttaatttataacagtagagataggtaatagagatcagatggtattttttccttttcttttgactttttttggacggtgtttctttttcttttcttttttgcatcctgaacggactttagcgtttttctgtttttttccgtttattttgactttttttagggtgtttgttttcttttcggttgcatcagatcagactttttttccgtctttttagtttcttttacagccggcatttttttccacagtttttttcgcacggtttgtttttcgcccggtttttgatcggacaatttgttttttttttaattttatttttttcgcccttttttaccgtgttgacggagtcggattcgtttttctttttcttttttttttgtcctttttagatcggacagatttttttttcttttctttttccggttttttcgcccggtttttttatcggacatatttggttttttttcatccggtttttttacggacgatggaagcatcttttatttttttaagaggatagagaatagagatagagagaatagagatagagataggtacatagatatggtttcttatatggattgaaattggaaatgaatttttaaaacatgcatgttaatggtggcaatcttctgggatctctagcatataatgataaacacatgcattcggattacaggagctccgaatttgactaccacatccacaagcaactgcaagagcggaaataacaggttaattaattaattaattagattaattacgtcgtaccaccctgtgcagtgcagaaattaattaatttcagatatacatatgatcgatggggtcgatcattcaggacacgataagcatcaagaacgcggacacggcggcgagcacgggccgcgcgacggcggcgacaatggcggcggcggaggaggcggccttgtcctctccgggcttcatctggggggtgtcctcggggcactcgaggccattggcgccctccttgcaggtgttggcgaagaggcccggcgggtacttgccgtagaggttgatgtagctgaacatggaggcggcgcaggtggtctgggcgtcgttgatgtaggcggtgaaggggcacgccaggtccttgagcgcctggcagcacagcgccggcgggtacatcggccccttgcacctgctcgtgatcaccgtgtagttcgcctcctcgaagttcaccgggcaatccttcttcgcctgcagcaagctccgccccgcgccgccgctcgccgccgacgacgcgcccaccgcctcatctgcacacatacatgcatatagtgttcgtcagatctccagatgttgcgtttgacgacggtgaggaggacggacttgagatgaagccggcggtggaggcggcgaggacggcggcgagcgcggcggcgaagagcgcgacgcgagcgtgcagagacatggcgcgcgccctggcgggatgactagtggccgcgcgccgcgccggccgcctctcccgttttctcgcgtgcagagagacgacgacgacgacgacgtgcaggaggaggagaggagttaatcgctcggcggcggcggcggtggcggcggaggtggaggtggtggtggctcgtgcgggaaatgggaggaggcggtggcggtggcgggagagatggagaggagagcggaagcggcggcggcgggcgcgcgcggccgagccaaatttggcgggaagagcgctcaaaatagccaacggtttttggacggtcacgaggaccacacctcacagtaatctaatgatagagttattatgagtttcatcagtttcagagtttgaaatttgagacatgtcgagtgtttgaattttgaatttttgaacatgagtgtcctcgatctcctatgtttctattgctccatcttggccgatttatgaagaactgcagttcaggtttcctatgaaatgtagagaattttttttgttgttcttcgaagaattgaactggtttttgcgagaatcgtaaaaatatttctgatagaatttttattcgcttgaaattttgtgacggtgtagtaaaattttgagcaaatttgaattggcaattggattaattcaacgggttgttcgtttcttgtttcattggtactccctccgtttcataatgtaagtcattatagcatttcccacattcatattgatgctaatgaatctacgcatatatacttatttagattcattagcattagtatgaatgtgggaaatattagaatgacttacattgtgaaacggaggaagtagcaagatttcggcgtgcgcgcatgattgcaagattcatggagaatgccagatttgccagcaaaaaaaaggcaccaaaatccatacgaaattggttgatttatctcgcaaacatcgacaccttgggatgcttctgatctaaatcctaacaaaactaatcagaaatttattacaaaaaaaaatctgatcagtccgtcagattcttcagacggcgaagactccaaggcgttgcggaggagccggccggcgtacgggtttgggtggtcggggtacgtgcacccggtgctgaacagcagccagtgtcgccggcagcgcttcaccggcaggtcgccgacgacgcgccgctcgccgccgggcgccacgacggacaccgcgtcgtcctcgaacacgaggcggcacagctcgccgccgctcgccgccgggtcctggcacgccgccgcctccggccactcggtgtcgaacagcttcaggttggcgaggtagttcccctcgtagccccagctgcagagcacccaagcgacccgctcgggccccggctcgatgaggacctcggcgacgcgcgcgccgccgcggggaacgcggccgcgcggcaccacgctgagctccgggtagacgtcgaatcccgggccgagcgcgcggcagacgagctccatgccggccgcggcagggaggcggttctccaccgaggcgtagtaggacacggcgctgcggcgggcgggcaccgtggccgtcgccggcgacggcgccaatgcgaggaggaggatgaggacgccgatcgccggcacggtcgtcgtcgccgcggcgaggcggcggcgcgccatggtcgacgatcggtcgccgccctcgcttgggcgcgaacgtgatgtggtggcttggcgcgttgcgtgggccatgcctccgcgcgttttttaagatgcaaacttagctcgcacgtgctgtgcgttgcaacggaagaaaccgcatggaagaggatactcacccctctctgtttagtttaggcatcaatcgaaaacatgtgaactttttcttttttttttttgctactaccttcgttttaggttattttacgttttgagtttggttaaagtcaatctgttttaagtttgactaattttatagacaaatatattaatatttataatactaaattggttacatcaaatcaataattaaatatattttcataataaatttgtcctgggttgacaacgttactatttttcaacatacttggttaaacttaaagcagtttgactttaaccaaagttaaaacgtcttataacctgagatgagggagtatttgatattaaactgttggtctgtttttgcctctaactctgaccgaagattatctgaaattcttgcattccgtacggggtgctagtaatatttttttcgcatattagaaaccgaggaacacaatctcgatccattttcaaaattttgaatcaacttttggggaaaaaatattgaactttcatacgaatttgacagttttaattataaatgttgcctgttttagagcatagctcttagagcatcttcaacagaaactccaaatctcactcttcaaatgactatttgtccaacttgccaaaccaaatggaaagtctaatttgcatttcacttcaacagactctctattacactatcgaatctaaatgtgggtctcacctattagcctctctactatttcaccgcttcttcaccctctctctcctctctctctcccccctctcctcttctctgtcgtgccactggccaaatccccgcgggaccgtaggcggtggcaatggtcactgtcgccaccaccatcctcgtcgtctcgggcataagcggtgaggttgtgcatgggcgtgatgatgacgaagcggtgacgcagatttgggcaaacggcgacgacgtggattcagccaaatgggtggtgcaggacctcttgctcgcaccggcaagggcggtagcggcactgggccaacaaacaaaggcggtggtcctgtagggcgttgcttcttcttcggattctcctgcagggtgccgccgcctacggagatcttgccattggcttgccactccgaggggaccaggtcccgtgcctccgtatggtcatcggagatctcgccatcctcaagcttccgccgtcagccactacctctcccttttggccactctgctcccgaacggagaaaaagtgaatagaaggttgtgggacccatggatggcaagtgggataggttggccaagtttggcaagtgagggaaggagtttggccatccgaatggcttagagagtggaatggagaggctgttggagtacgattttctttcaaaataaagttgctaaattttgacttggagagtgagatggagaggctattggagatactcttaggcttggttcgaacctattggttcgcaactcattccccgcatggaaaacaaggtagcccattagcgtatgattaattaagttagctaaaaaaattgaaaaatgaattgataaaatttttaaaacatttttctatcgatttcttttttacaaatgccacaccatttagcagttggggaaacacgtgtgtagaaaataagagtgtagaagatgagaaaggagagtgtcaaatacaccctttgacgaatatagaatcactcatacttctttgttaaaaaaattcggacctacctatgtaataaccaacatttcaaacttcaaaaataaggaaaaataaaataaaattactcatagaaaagaaatattttggcacaattttggatagagctaggcgttagtcgttgtttcgtaagttggagaaaattgtttcatccctggattaaatgtttcagctcagttcatcaattgttttaaaggatgcaacatttaataaatattggttgcaacaccaacaaaccattgtatgaaatgttgagcgccaaccacactcatccaaaaatattacaaaatcaaaacttaaaatgtgcaatagatgtatgaaacatcaaattttatttgttaaaacatatatatttatcaatcggaatataattacatgagatcttattgtaaatatttaattacaatgaactcgttagcagatcatatatcagataaataatttagaagagaaaattgttttaaaaatatatttggagagatgcatccatgcatagtcctccttggaggcggtgttgaggtatgccctctttccttctctgacgagtttccccgaggaaaaacctcgctcaagagtccttgggcgggtgatggtgatgctcccgtgtcgcaacctccttggaggcgtcgtccgtggagatacctatgcctttttcgctttgaatgttggtcctcaactgcaacggtgcttggttgtcatgatggtggcgagtctgtgtgggggaagagcgcatctttcttctctctcacatttttcctccaaagctctaaattgtgatgatgttcgggagtcctcacttttggtgattagctgcctagcaaggcttatgctggttgggcggtttgcggtgctcttggctctatgttgacgggtgggtctatagggggatgggaagatctttctactctctcaccctctccctatgcaatctaatatcaggatgtcatttgcgagcgcttgtgtccttcagttgtttggctctatcagctttgagcggtgtcgcgatgttgtaggcctagcagcgactggtctcgcatagcagtagctagcttggtgcaaggttttctccctagtgatgtgtggtggtaccgtcggcatgtggttggcttgtgggtgagctggctgagtttttcttttcagttttcttttgcttttccttgattttagtctccccaaggttttaatctaactgcaggtgtgcgcgcagtctgagtggcgaggctacggcagtctgatcggcggcttgggagcggatcgaccgatggcaacaggggttcgtcatctactatgttcgaggaaaatcttttattccgcaaaagattttgggtttttggtttacctaccattaacaccccctcccccggtagctttgtttggtcttgttcaatcctggggctgtttggttcccagccacactttaccattacttgccaacaaaagttgccacactttgcctaaggtggggtgatcaaattgttagccacaacttactaagcctaagggaatcttgccacacttttttgagccattgacacgtgggacccaatttgttggaggggaatcttgccacaactgtggctacaaccaaatacctgttaaatttgcctaaccttaggcgtggcaaactgtggcatagtgtggcttgcaaccaaacacacccagcattcctgcactcctaattaatatatataaattcattagccataaattattttccagctcgtgatacacgccataatctgaaactcagatagttaatttgcagaaaacgaaaaggaacattagaatgagatggcaaagccaatttgctttgttgtgacaaagaaaaaagagaaaaagaaagatggccaaggaatgtcttgccgagagatgtaatccaatgtatttattgttgaaagaactttcaggcaggggcgttcttacgttattctacctggatctccgaatcccgagtagaattttaatttttagttgttttagcctattaccatattattagttcaaaattatagtaatatactccatatgttatgatatgtatgtgacttctgatgatttttttctgggttggctattgctttcacatactaacaaaatgaaaaaacagacatcacatcaaattttgcattacatgaaaaataagcaacacagtaactaatcaggattcaggaggaacataatactgtttgcaatgcaaattgtttccagcctgccaagttttgagcaagcctctgtgcctgtctgcagatggaatgtggagctgagcctatgtgggctatgtgtaggcgtgtagcctgacaattctgacggcgcctagctatgcgaaatgttcccgcgacaacgacgatcgatcgtatcaacctcgatcgtccaaacccgtgggatcctagctacgaatgtcctggattcatcaatcgaatggcggaatgggaggctttcagagattctgcgcgatcatctttcctgttcaaatctaaccatatgcaggcaacacagattcttcagcgtgaagaaaaaaaaatcatcagcaaagtgagcatagctatcaactactccctctgtttcaggttataagatgttttgactttgatcagttaaactgttttagtatcaaagttaaatttattatataaatatgtttaattattaatttaataaaactaatttggtaatgtaaatattactccatccgtcccagaatataagtatttttagagttggacacggttattaagaaagtaggtagaagtgaatggtggtgggttgtgattggttgagtagtgaaagtaggtgaggaaagtaaatggtggagagttgtgataggttagaaagagaatattggtggagaagctgttatattttgggacaaatcttgatggctaaaagttgttatattttgggacgggtggagtactatatttatctaaacttagtcgactttgaccaaagttaaaacatcttataacctgaaacggagggagtagttaggtcttttgtaatgcaacgtgtttatatatctcggtccaagatataaacttaacatggatactctcgtttacagctagctgtgttttaagtggtaagagacatacccttcaacagcaagatattcatgataacttcgtcgatatcaagatgcgccagcctagtcttcggaggttatcataggggtaaaatgtgtttgtgcgcgtttataaaagtgagtgttcacgcatttatatcagcgcatgtgtctgtactgtgtattgaaaaaaaaagaagaaagaagaatcactattgtatcaaccgtcccttcgaaagtccgagttagaagacttcacatacgccggcgaaacgagtgaaaaaccacccacagagaacgcacgaaacggcgagagagcaaaaacaaggtttggttttgttgctttctttccaggaggccggcgacgtgaaagggttccaacaggtggatgctgaccaacgcaatgcgccgacgaatcgaattaatggttgtttaaattttaattaaatgggagaacagaattttagcctttgatgatggctccatggccccaattatttggcttttgcaaaaggagacaagaatttagcatcgatcacccactttaatcagttctttaattgacgcgtgaaatcgatcctaggatttgatttttttaaaaaaaggttgatggcacatagcatgtttggacttatgttgctgggattaattttgtttgtgatttaatcttttgttttttttcctccgaacatttctccaaggatggcccacagactgcacatgtcactcaccacctggttctagatggtcactccacctgaccaatcacagctctacacaaaactcttgagcatcaacagtccaacacatagaccaattcctctaaaattgtgtggaatttcgataaatgttcacaaacaaagcccaagagagggttctgtacttctgttgtgatacttattatggtcagatgtatcaaatatttttttgtgtaggcaggttgattttatttttcttaaaaaaaataaaaataaaaaggtcacctgcatcctggcaacctagaaggccactccacttgaccaatcacaattcacacagttgcacccttgaacatcaaacacacagacaaatgcaacaatggaatctggggtcaaatttctgttggtgtcatcagagggccaagaaactgcaggagcaccaaaaagtctcactttcttcttcttcttccattgtctccctacaaaaagggctgcaagaacacaaggagaaaaaaaaaaaactgcaccaagaacaaattgcaaagtaagtttgtactttgtactttctttgcagcaagaagagcaagaagggagatgtccatgaacgcggacctcggcaagccgagggagctcaccgggttgcagcagaggagggctctgtatcagccggagctgcctccatgccttgaggtttgcaagctctccttcatcctcaccacttgcaagctgcatcaagctactttttttcatcactaattatgaaaagttgcaagttttgaacacagtatgttcactttgtatttaggtccttgtatttgtattctctcaaagtttttcaaccaacatgttcagggaaaggccatcagagtggagtttggcgattcgacgacgaccatcgacccgacatgcgcaaatatggttgtgcaggaatttcccaacacctttggtcagcctctggtacatttcctgaagccgaacaagatggatgcgcaagccaacgatgaacatccaccaatcaggttcgttttcctttttcagaatggtgctaaaccccatccatttttcagttgagaaaaaaaatcagaacaaatcaagtttggcttgaacaccgaattagtgtgatagcaactagtgtcaattctttatcattgaaaacttgatatttgatctatcaacacacaattctcaggcttgatatttacttgaatctagggttggtgtggtgttctctgggaggcaatcgccaggggggcacaatgtgatatggggcatctatgatgctatgaaaactcaaaatctacaaagtgttttgcttggatttattggtgagtaattgagcatactttcaatttctagattttaaatggactaacaagaagcagtgtgatatttacattattggattgcttgttgtgacatttattggcttagtatatatatattgatttcctgcaaaaagatatgataaaaataagtctcatgaagaactttgtatttctaaataggtggcacagaaggcctatttgcaaatcagacattggagatcacagatgatgttctttcagcatatagaaaccaaggtttaaatttattgatcttgattgctagctttctaaatatattatggcctatataacaagaaagtctttaccttcttgaaggtggttttgattttctcggcagaactgttgatcaaatccacacaactgagcaagtgaatgctgcaatgtcaacatgctgtgatcttgacttggatggcctcgtcatcattggaggtactaataggttataccagcaaatttgctgatgaaaaaaaaaaacatcacaatggattttacatgagcacttccatgccatttcaatctagagtgaataaagagctgtgaaaaaattggggttacatgaaaataaggaccaagcaatcaaccttatttcaaaaacattctctgccttaaggacttgtgtaattcttgatgttatcttgtcttcaggggtgacctccaattcagatgctgctcagcttgcagaaacatttgccaatcacaactgcaagacaaaggtatatacacattgttaattccacatcctcacattggaatataactcccattttcagatctttatcctgtttgacaggttgtaggcgtgcctgtttcattaaatggtgatctcaagaatcagtttgttgagacaactgttgggtttgatacagtgtgcaaggtgagtcttgcaggctatgcagcaaataaaattccaatttaaagctaagacagtatctacagttccccaaaaaaaattaaatgaaggatacaagtgtacgattcccccaaaaaaattaaataaaggatacaaagtgttacatcatgacatgtttttttaatgtaaatgtcttctatgaaaatgtcttttcaggtgaattcccagcttataagtaatgtttgcctcgatgcaatctcagctgggaaggtacactctattatagtctatcataataaattggacttattaggatcacttattatttatctaatttatataatttccctgcagtactaccattttgtccgtgtgatgggttggaaagcatctcatgttgccttggagtgtgcacttcaatcacaaccaaatatggtctgccttgtcgccttgatcaaatgcatcgtaaaatctagcataagtgaacagttgtagaattatttttataattgtacattttcacatgcaggttattttaggggaagaagtggcattttccaagctcactttgaaggaaattataagcaagatatgtgatggagtgcaagcaagggcagcacaaggtctctacaattcattggctgtcttaagttgatgaattctcactaaagactgaattgtgcatatatcaattaaatagaaacatgaggtaactttgtgacaatctaatatattggatataatttttcagagaagtaccatggtgtattacttatttcggagggactaatcgaaagcattccagaaatgtttgcacttattcaggtttatacttgttactacaataaaatgcagtgacatctcatttctatgaaatcttattggtttcctttatgcgtattgtaggaaattaatattctccacagcaataaagttcctgagaacaacattccatctcaactttctccatgggctactgccttgtataattacttgcctcctttcataagaagagaggtattggtgtattaaattactaacataatttattttattaataaaaattgtggtctgaagatttggaactttctgttatagttgctgctacatcaagactccgataactcagcacaattgtcccaggtttgtgttttctggaatgctcagcagtcagttattcatggaaatgcaatttttgatgtcaaactttttattgaaattttcagattgatactgagcaactcttagctcatttagtagaagcagaaatgaacaagcgaatggtaagttcagttaaaacttgagctttatgtgcccagttcagtattcagttctttttttttttaatttgattgtgcttgattctcagaaagaggggaaatacattggaaggaaattcagctccgtttgccactttttcgggtatcaagcgcgaggatccttaccatcaaacttcgattgtgattacgcctatgtaagtagtaaacctgaactatgttcgtcacaaataaaagatatatatatatatatatatatatatatatatatatatatatatatacacacacacacacacacacacacacacacatgctataggctctaaaccttgaagaatgcaggttcttggtcatatctgcatgcacatactagcagctgggctgaatggttacatggcttttgcaacaaatctgaaggaaccaacaaacaaatggcgatgcgctgccgttcctctaacagtatgctttttagttgactgtattgttttcattaattatgctcatttaaaatgttcgagtttgtgacgtgatacactgtttctaaatcttaccaggcaatgatgagtgtgaagaggcactcacgcagtcctggagctgttcctactggaaagccagttatccatccttctccagttgacctgcaagggaaggcttatgcgtaagtccatagttaacagccttaaaactattaatttgctgcttcaggcaaaagactgaacactgacatccatgaatctcattcagtggcttgtcataaaaaaatcatgtgttgattcctccggtaaaatgttaataatattgccacaaaagtttttagttaatgaggcaacagtaagatgatatagaattagtttagattaactctgcataatatgtagacacataaatgcatcattttttgtgttaatatcattgatcttttacagtgactcttcagattataaggcagaggaaaactataaactaattcttgtttctctcattactctaggctcctgagagagaaagcctcgagcttcctattagatgatttctacagaactccagggggcattcaatttgatggatctggaacaaatgttaagccaatcacactgactgtcgaagaccaagactacctgggtgacattgagctactgcaagactacttggagaaggtttgtcaacaaaatctgaacctgttaacttcataagagctaaaaaaaaaattcagtacctgtagttgaagcttgtcaaactgatatcccaggtgaggaacattgtgaagcccggatgctcgagggagatcctgaaggcggcgataagctcgatgtcatcagtgaaggatgtgctgaaggttatgtcggctcccttctatgcagagctccctctgttcaatctgaactgaaagttaccttcatcagacaagaaatttttgtcagttagtcattgggttcatcatatgacatcagtccatctagtagaattggatcagaatcatgagtgagtagtggttactgatcttaggtaggctgttttgtttgctgttctgttctgtttgtgatatgaacagaacccagctattcatttttattttgttttgaggggaagaaccctaccattcatgtcagtaaacactgcacagccgtgcatatgaccagctagtggatatgaataagtacaaattgcagtggcttcctagccaataatcatgacatgtcattcctacatgttagctgctttcaacatctgtaaatttgatccaacaaagagagggcttagcgaaacaaactataaaatgatttacaatcaaatgttcatttgactgatagctcaactgtagaaaatcagtattgtgttattttgcatatccatcttgatgtttctattttcaatatgggcatgaatagttcctgccagatcaaatcacacactggaaaatataaattctgatttctgaagtgcatgctaatggtcaacagcatcatgcaccaagataccaaaatctgagactgcaggccacacttaaacctctaaatcacaccatcatattcaggcgatcccttagatctaggttgcttatgtagcattttggtttgatatatgtgaatatcaaggacaaaatccatgacacaaattagctcctctttcatcagcaatgcatggaacattcaagcattaaaaagaaatggcatctaagcagaagaggtagaaataaacacaggatatttaaatctgatcatgcaaaaggacaaagattatacacatcaaaatacccacatttcagacacggttttcggacttacaacacctctaagctctagagcggttgctcatactagtaacagtaaaatggtgcctttaagtggcacctgtttttattttttattttttttatgatatccttgcaagttgatgcagagcttggtgaactggcagcatggaataaaccacagcgttaaaagttgattgcttgatgtgcactggagatcagatcaccatatgctgcaaggcccaacctgcattacagaacaaaagaatcacttatttaagcataaatatgaggcttaccagctactaagcaaattctagcattaagcaaggcagtcgatccaattttggtagaaattgtttgtaagagggaaaataaaagacgcttcccatttcatggtgaattggtgatgtccaaacgctctaaatagaataaatatgagaatttgagagaaccttatgtacagtggtgattggttgcctttatatgactgttccgctagggattaaggcgtccttgatcacagtgacaatgccacttttgatgaagtatccatcagtctcccttgaagcttcttggatattgtcgacattgattatctgtacaagcaacagatcatataagattgatcattaattaatgcaataaacattgcacatcattttgttcagttcagtatcaactggtcatctctggaaaagtgagagaaacaatatgtaaatcgatccatatgggttgcctggattttttcagtttgtgcttagtaagtaaataattaaagatccatactcaacaaggcaaaaacccatggcaagaaaagacatatagcatttgaaaagaaagataatttagggggaaaaagtatgatgacatagtagtattttttaatgataaagggctttcaaaccagtgatgcaagatgcacatttgcaaaaggccacctttaacaaaaagcatgagaaagtaccaagtttgtattcaaacaaatatgcttgtccctctcttttctttcaagtaatgaatagttgatcagttaatacagaaggcacacttcatcagattgacaaccaaaagtataaatatatatgaaataccttaacattttctccaatacgagcattcttgtcaattattgcttttctgatgtgtgcattctttccaataccaatgggaatgccaccagtctcagaaagggctttcttgtccgtctccgtctgaacaaaaagcacaattaagttcccacaacaccaatacaccataatatagtatagttttgttttattttacctcataatagtctgcacccattagcagagagtcctctatcactgcgccttcagatatacaggaccggagtccaaccacagaatggttgattgtgcaatgctagccaaaataaagggggaaaggcatgtcaacaaatttagggtctctgttttgaagcaatgaaaaagaaatgttcgactaacaagtaataactcaaggtcctaatatgttatgatctaatactatccacagatcatagaaggaagcgctatgataattcatctgaaaaggatacttactctaataacacaaccttcaccaataacactgtctgtcacatcagcatcaagaacttttgatggaggcaagtatcgaggttgcgtataaattgcggcagaacggtcatagaagctgcacacaataatgtttgctcaaaaataggaagaaaattcagcagaaatgcacccttttaaaagtaacttgttttcaccatgcaaaatgtaaaccttacctaaaatctggcacaggtttcttggttatccccaagttggcattgtagaatgcctctatagtaccaatatcttcccagtaaccatcatataagtaagcttgcacctatcaaatacattagcagcataagcaaacatgcaaagtaaaaattaagtaaagaagtaacatttcacaataaatgatgtaactgcagtttacataccaaacttcacaaaacctacagcatgaactgagagaaggataaaaattccctacatgctacaagtttcaagagcatagcgtaccctcattccaatttctgttgctccaggaataacctcgcttccaaagtcatttgcagcagggaaattttgacggagaagcttaagcatcacatctttgctaaaaacatagattcccatactagcaatgtaaggcaattcctttgccctctcagtatcaaggccaagtatggtagtgtcaacctgcaagatcaaaacatgcagacaatcactgaaatgtatgcttcaacagatcaggttgcatatggtctcaacggatgactcatcaattaccatcattgatttcaacttctctccttttggcttttctgcaaattcaatgatcctcccttcatcatcaatcttcataaggccaaatgctgtagcacgttcttcatccatgggcagcgcagcaacggttatatcagcatttgtttctctgtgggcctgaatgaacttttggtagtccatacggtacaggtgatctccagccaaaatgagaaactccataacattgtgttcctcaaatagccataagtattgtcgcacagcatctgcagtaccctgagacagaaagaaacaaaataaattaggcagcgtccttaaggtattgtcatacagaaaccatataacatgaaagttggtaacctaagagctcatctatcaatgttaactctagtttgcaattccaaagaaatcattggaacatctaaactagtgaacagtttcacttaactataaatgtgagaaaatatggaagagtgaatcaacaggagtacattaaccctaatatttcttttgttccgtaaaacagggtgtatgttcatattaattatgtatccccttcttttctttgtaccctataaagtataaactttaactggcattcatgcatctttgcagctaaacgagaccattcaataatacacagaagcagaaacatccagtacctgcatagtacaaaaattaccacttaccgagtcaattcaaactaatacagtactactataaaaaatttggcaagttaatacagattaaccaagatacctgaaaccagttaggattctctgggctctgctgcgcagcaagaacttcaacaaacccctcgttcttgtaaccaccaatgttgtttccataggccctcgagaggtgacgattgagcgacgcggagttgaactgtgtcaggacatagatcttcgacacattgctgttcagacagttgctgaccgggatatctatgagcctgtaattagcacccaacggcaccgccggcttcgccctcttctttgtcagcggatacagccttgtcccagcaccacctccaaggatgatcccaagaacactctgcaggattaaaaattggatgtaaaaataataatacaaatcatcatcagactatatatagataacagatgaaatgctcttgagttccaagttctgtacttctagttctaccacagaatctaataaattataaactcaaaagtactacaacagatctggagccaattattaaattcaagccatggaccacgatagatcctccactaattaattattatggggttctcactaacaatcacctttccaccgttaaagatatgtcaatatttcatccaacaactaaactagagatactgtcaccatcatctttccaccgtttcttgaatcacagagagtactgaacgcaacagctgatagaatcaccgagaaatcgacaccaaaacactctaaaaaaacaaacacttcgcactcgcaggaatccccacaagaaacatatcaaacacatttcgctcatccaaatgtgtcgagtaaaataaccgcaacacatcgaatcccaagaacgacccttcgattttcccaacccaaaaggatccgaacttttctccctcgtgaacgcaaagaaaaaagcgagcgctggaagagtagaatttttttgggcaccggcggcgagatcgcggcgtaccgtgctggcgtccggatcgaggcacgtctgcgagctccgggagtccgacacggcacgcggcgtgaacacgaacggcctcctcgccgccgccccacgccgccgcctcgccgccgcaagatcgcggccgggatagaatgcggccgccgccctcgccggcgccgggatcggggcccaggacgccgcgcccatcgccatcatcgccatgggagagcaacggccgagagaggtggccggagtactgacacactacagtggagtgtcagaggcttcagcggccgtgaaaagttccctctttttttctctttttttttctttttctttggttgtcccagtgatgatgtgtgcaggtgcagaggacgatttttgtctgaatttatagagcactttctgggcttccacagagatggtactatgtgtgtgtcgaatgaccataatgcccttaagaattttcttggaaaactttgggtgtgtttagaggtgcttttcgcagctgcaacttctcttagaatcttcggttgctaaaaacccttttaaacaatctagatcttgagatgttgtaattttagaatctagaccagctgtttattagaatattaagcgagtgattatggatcaaggatcaatcatgtaggggtatttcggggtttattaggttggagggctgagaatagacaggtgtaatgtcacattgatatcacgtgaagcactagatgttgaaacagagtgagttgtttatcaagtgattaagctgttaattagctagatggatgtatggatgacaggtgtctatgcagtgagagatggtgtgctctcctcaccgttggtttggctatttgttactagtaaactttgtttgttaccagcacaagtaggaaaagaattttgtgtttagtgaattgcatcaagggagatggaaacgtgcttgagtggaccacacaatgtcatcagaattggatctatatatagacaatgacaaatgattgatatgcaaatttcacgtttcggccggtcgccctgaacgagaaataaaagtaaggaaaagtagaaatgatcttgcacggctagcgaatttttgtgctgtgagttaggtgcaatttgtttttgttattagctaatgtgtgacagatgacatgatttgcaatgattgaacataatcaaacatgtttgttggattccatagttgtgaaatagactcgtcggtaactaaccaaaagtttaaaatttaagtatataactttagtcgacatcctttaccattaccaactcgtgttatgaatgataattaactataactattgtcacatgctttctcggaaaacccattcttagatagagcctttccaagatataacatccatataaattttatgttctttgtagcttattttacaaaatcaaccaaataagataagtgacatagccatatgtaatctttaaacgtgttgcatgtatcgattatcttattatcaccatcatgctgacatgtctatagatcacttaaagttacaagaatataatagtcctgagtacactgttgacactagcaccaaaaccgcaatacggtggattttcgctatgctatggatacactcgactatgataactatattattttattacataggagtatatattcctccttgttttttaggtgttagaacttaatgtgccatgaattaatgcataaaaatgattatatctatattattattatatattgaaagttactaatttcactaagtatagatattgcaactatttaggtatccttaaaattattacgcctcttagagcaagtaccatattgaaacaaagagcttaaggagagatatcttgagcgggcgactatactaatcccggttgtacgcaacctccaggaaacggatcgtctactgtacagttaatactgcacaggtgctgtagcgatcaaatcaagctatcagattacattggatggctctgattctgctcaatctgcccaccacttacttgacagttacatggctaaggccatgaaagcttcggactctgtttatacatatgtcatgtgttgttcatcaaacgatatgcctgccatttcacatcttctacaaatatcataagcagagcatcgcctcactgtgaagcctacacttattccaaagtgtaacactaaaaatgttgcatcgttcatttacaccttctacaaaatagtgctatgatgaaaaggtttcaggaagattaaacacaatgctctaatggaaacatgtacaaaggtaacttcatgtgtgcaaatagttcagtactaaacactgacagaaactgacagaagaatgcatagcataaattttctgtggcattgcaaaaaaaaaaaaagaatggatgttctcaaaagtaaatgttcaatggcctgatttgttaatctcaatttgatacctaggcatctagctatctcccatccaaatttgcattgaacccaaaattccaggtagtatcaaatatgttatgctccatgccatcaccctatgtttcatcatacaaaagagcggctccaaaaatgactctctctaaaatggttgaatccaacaaagacaccaaaggacctgtattctttgtttgtcccaaatgttgtgtcaaaagtaacaacatctccaaactgagcatagtcgattatcatcttagctcagcccaaaaaatatttgttatttgttcttcacaatccaactgaagggcataatgaaatgaagtgttctctgcaactttgtcctgaaagtacttcaacatacttccggcttcgccatacatcaactccctttgacgcttggtttgtaaatggttcttgagaccacgacgtgtataaccaaggtttactgaaccaccaacttgccgactagcaagctcatgtgcagcttttggtccaatgcccgaatcatccattgtttcaatttcaaatgcttgcaatgacgatatctttctttgtgatggcatcaaatggcatgttgaaggcaattaaagttcatggttatgttcaagaactaaatcatatactgaataatcgcccacttctctatctactgtgattccgatccgagctttgcaacctgttcttgtttcagcacgaggacgcttggtgttgtgatctcttttgtctattgcccggtatccctcattggaacaaacatatcttgcagaagtaattactccatcaactttactcttattttcataatttatcctaacatcaaaaccagtatgacctccataataagtccaaaattcccatgcctcttttgtagatttaaatttcacgccaaattgaggaatccaactaggaatcatatttgtgctgtaaaaagaaacagggatcaactctttttttttacaacaaagaaatacagtgttaaatatggattgctatgtggtcattattaagatcctattcagtaatgagatcaacaacatagtcagagaaaagaaaaatgtagatgataaaactatgttgacccctgaatgaaattgatcttacctatttgaattatgatggttggagtttgagtcgttcgccataaggcctcagatttgtatgtatactctgtttagcactacacgagtgtagagtgtatccactccaatcataagaatcccacaacaatgcttttggttttttttgtgaggacatgatcacaaaaagggtacaagacatggcatacatacctgttcgttggagactgatggcttactttatttgatcatcaaagtttctggacagaacaaggcaaagtgaaacctctgtatctccttttggcaccaagtcccaaggaggaagaaagcaaaaggagaacctgtattattttggcgccaagtactctggaggattcgtgattttccctccatcaaggttatcttgacttttcctccttaaaatcagtttgttagtttccaaattatcaaaaatattttcggtgtttaaggacagaatcagagccgcttaatctaatcggatggcttgatttgatcgctacagcacctgtgcagtattagctctacaatagaggatttgtttcccaacctccaagactagatgaagttgttgcaattgtgctagactcttgcttgcgcacaacgattagggttctagatgttcaagatgaatggtgagagtcttggaataaatggggtaggcccaatttaattcaattaaaatctcaagagcccacaagtaatgttagagacaataatactgccttgaaaatttaggtggaagaacctcaacttaaatagggtgatattggagattccctattgaccggttgaggtgatggttggacttccacacacgcgcgcgtgccaagttggcctcggctgtgggcgtggcgaggcgagacggccggccgagccgagcctgcttgttgctctttcattttgtaacagacgagaataaagtcactattaacaaatcaaattcattgtgttgtaacctccaaagcaaatgagagatttatttgttgtaacctccacaacaaatgagagattcattgtgttgtaacatccacaacaaatgagagatttatttgttgtaacctccacaacaaatgagagattcattgtgtggtaatcttcgcaacaaatgagatttattttgtggtaatcttcacaacaaatgagatttatttgtgtggtaatggagatctctctctatatataatgcaaggcagaggctctcaaagatcgagtcttcctcctgctgctgttcctaggcgatactctccttatgttcctgcgttgtctctccatttccccggttctgttcatcccgcacgcacgggtgatcggaacaagcaggtgcctccggaactccgtctgcttgagaacctgcacgggtaggtgggcgatcaagtttttagggagcgctatgcgtgactgcttttgttcgtcttcctctgcatcgtcttcgccaatatgtcgaatatcagcgacaacaataacactggagacaaggagaaggaggcacccatcaacaccaacggaggcaatactacctcaaactccagcggagggccattctcggggtataataatttactattaccgttcgttcttaattttctactactgtcagtcgcaatgttattgggcgttgccttatctatgttggtgcttattttatattaagtacgctcatgttgtacacatctagcactgtcactagatctactcaaattataaatgtcatgtttattgtcttaatattttggattaaaatataccgaattatgaacaaatttccaacagagaggacaacaagctgtctgtgcatgcaaattttggcctgcccaaggagcaaaaagctacaactacataccatagcccactagatgatatgacaaatttttcagccatcaatgtgtcacaccccaatctggtaccgccgtacaacggcacctgacaggagcatgtcatagggaaaacggcgcaaaccgcttcctacgaaaccgcgatctcagtaccagtcccaggacacagcgctggtacccacggtgacaaatatgaatcattgcaatccttaaaataaatagaggacttatttaccttaacttaggttgcaactcagaacagcctgagaatgcaaccgacgacgcggacgaggaaacaccaacaacagcagcagcagcggaaccaatggtctaacacccaacaccacaggcgacggctggggaccaggacgataccctaatcttcacttcacttcatcttcacttcaagacagaggaactatatatatatttatatagagcaagggtgagtactttcgtactcagcaagtcatgggaatttaggtgtttaatgcaagcttggaagagaggcaaggttgttttgcaaatcctttgtttgaaatcatttttgaagtcactaagtgatttatttctttttgagtttggatcgaaaagagacttgcgtctcgatttgacttaagagatacttatcaacaattcaaatggtaatgtaccgacctcccgggtcagatcattacttatcggctcccaaagccatttcacttgattaatcggctcccagagcctttt

SEQ ID NO: 45650 - DNA, 1779 bp, Oryza sativa
cctcatgccacatagaaggatcaaatcctcacataaatataggacattttaggcattcacaaatcaactccaaccaccttgatcggtaagtgagcaagcttctcgtccttgccttaccaggaacccagtttgtccgaccccgccctggcgttcccaactattggcatgcgaggtttccctgaaccgactagttacttagccagggtgtcccattccaccttgtggttgcactttgattatgttcgatgagtttcccacaggaatcggtccttatatgcgaatacaggacagtgccacataggcacaacccccgcatcacgagttttcacaattcattttattttcaaacacaccgacaccacatgtcgggttttcaaggcttctcaaacccatttcccaaatttttgacaaacaacggtgtatgtgggataattggtatacgcgctcagagagcacggataccaaagtaccacaatggtggagcgacaagggatcaaggtatgtcagcctacaggaagtagtgcgactacttggtaggtccgtcggtttagcatgcaaaccgaggccaagcaagttaagtgtgtgattctaataatgcaagttgcaaacaaaataataattatttttcaattataggagcaattgatcaaagggtgacttgccttgctgaaggtcttcactgatcttcacgaatcttcgagaaatccacgatcgacgaaaatccggtaaccgtaactatacgcaaacaatcaaaaacctagacaaaagaccaagaaaaagaccctatttagactaaataatagtgccattaaatagatctcaattttacggaattatgggaagtggaacggagtcaatcgaatgaacggttgagaagatatgaatttcggaagcttaattggaatttctggaataggagaaatggtttatggaatttttggaataaataaatgatctattgaatttatggaaaagagtattcccaagaatattctttaattactcattgatatgtggggccaacaagggggaaagatggacttttgtgtatgagaattgatttggtggagggaggaaatatagactttttaggccgagcgtgaggcacggcccaaaggagattggcccattagggcttgggtggggagagggaggcggtctggtggaccggatccaccgcgtgggggtcctaggacgggggccacttggcggcgacctggttcacggtgggggaggagtgcacgtggggtgcggtgctagggttagtaggctcggctcatgccgcatgcgccggatggaccgggaagaggcgggcccacgcgtcggcggctggcgcaccgtggaccgcgcgcaccgggatgggggagggaggccgacgggttgactcggcctagccgacgtggtgcctacgtggcggctgcgtcgaatggcgagaggaggaagacgaaggccggccggatggacggcgggcggcggcgcgcgtcggcggagcggcgcgaggcacggcggaaggaggggagaccaccggagcgaagatagacgcgagaggaggcgagccaacggctcggatttcgccgggagaggtcaagggcggcggatagcgacggcggcggccggcggcgagcaaaaggggaaatcgtggcggggcgatgagaggtcgattcaaggtggcgagagtatctccggggtgcaaggaattcatttccggtgccggatgggacggaggggccccgagggaggccggcgatgagcggcggctccccggaacgggcggcaata

SEQ ID NO: 45651 - DNA, 2461 bp, Oryza sativa
aggggcgacaatggcgcggcagcgtggagagtgaagcgagaggggttgagaggaggagctcggctgcggttttataggcacgggaagtcggttttgggggaggaaaccgacttaggtggtcaagggagctcggctggcgcggcgcttgcggtcaaggagcggcaggaggtggtcacgggcggccgggctgagagggaaaaagcaaaaggggaggggaaaggagccaccgatttgggcgagcagagggaggagggagagcgcgtgagagaggggagccgaggctctgcctccatgtcttggacgcatgcgcgcacaggtggagcgagtggcagggcggcatgggctgctgcgcggcgcaggcggccagggctgacgcggcggcgaccgggcggtcggccatgcacgagcgagcgcgcgcgctatgcaagggcacagcgaaattcgaaaaggcggcggcgggaaccggcgccggtgggggagcttcgacgggagagagaaacggagagagagaggacgagctaagtgaagagagcgagcgcggcgctctctctcggctcggctgtgtgcaacgcacgagcgaggggaggaggagaaggagcagccgagaggggatgggccgaggaggaaaacggtccacaaaccagagggaggcaaaatagactttttctgaaagattgatttagagagatttgcatttgcagtatgcattcaaaatgggaatttggttatttttggagtcagggcgaatatttggcaaggattcaaaggtagttagatagatcaatagatagatagacagctgggtaggtagatcgataggtagacagataagtagatggatagatggatagataggttagataagtggatagatcaatcgatggacagggaggatttcaaggacggatttgacattctcggaatcgggagaaatattggcaaggagttcaaggacgggattgaattccgatgtttgatttcggaagttgaaatcttgaggtggatgatttttgatggcggtgacagggaacaaggacggatttgaattgagatccacggcacgacttagactctcacacagtgaacggaattttcgcatataggatttttctcaaactagtttttaacgtctcacgaaaagcggagcgttatacaatggatggtaacattgatcctactcttagtatgccaataaccctatcatcgatcccggacatgtcaatggtgatggttacgcaataagagttaaatttagctaagagcctactttatatagtcctatagcatatttatataaataaagatagttttatcgaaggattagaaaaaaacaataggcatcatgttgatttagatgtcgttggcctatctacacttaattaaaaatttagttatgtgacaaaataaactctacttcataaatatttgaatgttgcaaactctggtgcccgttcaaaacttcaaattagaacaaaagatttctcataacaccctatagtttctcacatcataaaggcaatgattaggggggttcctttgaaacataatattattgaaacatatagatagaaaagaatggaggataaaatgtcatgaccgttgcatttccatggaatttcatagcaaaataatttttcataattgtaatttgattgacacataaaaacgagagaatcacttatatgccacttcaaattggctcctcccttctatgccaccgtttcaagtttgtcctctcttttataccattgttgtcactccaccgctagttgaccgttaacttcatagtaaaaagatgcatttgcccttgagaattggtatacaaccaatgataggtatttttcatttgatagagaaattggttgatatatgtatagcattttagtaccaagatagctactagatacaacatatgaaaattgatttttttattatcaagtacaattttagtcatcaccatcacaaatgaattttcaatataagcataaaacatgcagctttccaacaatatttttaatacaaagcaaatttttcactagttctgacaaaattttgttcactcaaaaaggatttaaaataaattagttatgaatttttgaagtttacatattatttagttgagagggcatattggtcatttacgaaaaaaactaacatctaacttaccgtcaacaaatgctaccgtgctgggagtgacataaaaggatgaaaaacttgaaccagtggcataaaagtaagaagccaattttgagtagcatataaaggaactggccaatttagagcggtgtataagggattctctccataaaaatgcatgaactctagccacaataagaagaaaacaagaggtaaaaccacatttatttttcttcaacattcctctagagtatataattacatagaaatttttaaggatttgggtagggatcaacccatttgtttcaaaaggactttcatagga

SEQ ID NO: 45652 - DNA, 14670 bp, Oryza sativa
ccccaaccgtccacgtaggagattcctccccagctacgtgcgtggcgttgtcaagtcaagactacggggtcaaaacaagtcactcattcttcgtcagaagttgcaggcacgggtggcgtggcgcattgagagatgctgtgtcctaatgtgcgcccccacatctcattcgaggcggcgccggttgccgatgaggctaccaccccgagcaggtgcattgcccacaaagtggtgtcgctcgctagatccagcgaacccgaggctagatctggcgagcttgtcggggcggcggcggaggaggaagaagaggtggtggatctgatgacctaacctcgttgtcgtcgccgttccgtgccactgagtaccacagcaacggcagctcgacggagaggaccgcgccgtccccccctcacgcgccggcgagctcctgccgcgccctcccctgcttgggctgccggtcggaggaggaagaggagaggtggagccccaccggcgctatcacagcttcgaccgtgccgccagattaaccccgctgagctcccgctgcaccatccccccctcgcgccagcgagctcctgccgcgccgtcccccgcttgggccaccggtcggaggaggaggagaggtggagccaccgtcgctgcttcggccatgccgccaccgctctgcttggctttgtccccagagacaatccgacgctaccaccttgcttcctctatgctagggaaaactggaaaaggcaaacatgcaaagtgatgaaaagtgaaggagaggggatgaaaagtgaaggagagatagtgctgagacccaccacaagtgacctgcactgtagagcatgtagcaaatatggttcttagtctacgtggtatgtgaggaccagcaaaaaaaaaaaactatggcgcactactattgcccttaccatgagcaactcaaacttggattaggccgtgttcgaacatcccatttcccaacttctactttttcgttttccacggtttcctgaaccgctaaacggtgtgctttttaacaatgttatatatgaaagatttttttaaaaaaatattaatctatttttttaaaaaaatcactagtatttaattaatcatgtactaatgaactacctcatttttcgtgcaagagaggtgggttaggaacccacaggttccaacatagcctagcttctgtttctactatgccatctctttttttcagtaaatggttaaagttgtgggaggcgtagctagctcttattgtggacttgcagttcagttttggaaggtccctgatagtggtttggtagaacatgaggtcatggtcaagatgatttgatgactttgcaaagacatcgtaatgacgcatgccaggtatcagcatgtcaccaagaaacatattaaggctacacctccaaacaactttaacttagttaaaatatttcaaaaaatgcattaacatgttttttaggtactagtgtccagtgcttgtagtgttttgtacatgtatctacatcatggagttgtatatagtttgtggcttttatttttgcctaatacttaaagtccccacctgtactaattaaggtggactatgacaattcttggtccaaccattttcagatatttctcatgtttggttcttgctttgaaaaaacaaagggttaatatgatccatgccattgtaaatatacaaatttaaataaataccactataatttatctattcgtagctgtgtcattaaaattttacaaaattagaaccgtgccactatcatcatattttccatccacctccagcttcttcctcatctgcaaatgggacccactcatcagattcatcttctttctccatcatcttttttttttctttcctcatctctctccaccaccggcgggaggtgcacgcggtttcgcggggtgcagaagcggccatgggggcggtacatggcggtgatctgtgacccggtgaagaaggcgcgggtgtggctggaaacctatgactccgccgaggaagacacataggcctacgacgctgcgcgggcctacgatgtggcagcgcgggcgctccgggtcccaaggccaagaccaacttcactctctccctccctcacgcccagccccagctccaccaccatcagcaccaccaccaccacctcacctacccaccctactccgctgccatcgctagctaggccagccaccaccagccttagctccaccattgagtcattcggcaccaggccgcgaccggtgctccttccacggctttcgccatcgtagatccttgatggtgactgccacaatgattgcgggttgtcggcgtcgatggttgatgaggactgcacggacgccaccgcctcactgtcgtgtcagctcacgtttcagtttgacctcaacctgccgcctatcggcgtcggcgtcggcgacgttggttgtgtctacgacaacgacgagctaaggctagaacatatcccgtcgttggtgaaagaggaaaaggagaaaaatatttggttcttcccttctcttgtagccgacatgatccctcacccctcctctctgttgtttttgtttacctgatctggtgacgattaatgtgccctgatctacgtatctgccaacttgttgctggtgatagatgatgattgttgcttctcgcagcagctccctgtggctgtggggggaggaggagatggccgctgtttacacccaaatttagcacctatggacgaaatagaggaaaattatcaaagtttgaaaactgacgggtttccttcacagggccggtcagaccacaggtgtgtgggcggtctgaccggctagtagggccggtctgaccgcaagtatgtgggcggtcagaccgtcaaggtctgagtccgagtttgttttcatcgggtctcgggtttctttgcccgggaaggtaggttttgtgtttcctttggtttctatcccgagttggacgtggagaagggcctgtagagggcaagaccaacctctatttaagggacaaggccggttcattgtaaaacccccaaatacaattcacttgaatcgttcttttactatgttttttattttaccctagttttaatccatctttgtcggtttgcgccgtaaaccgtccgccgccgctgcgagagtgcgacacctctttgtagatttgtcctgaaaaccttccgttttgcctatgagacaggttagttatcctcatatcgatctaaatcggcttagaggctgatttttgatctctaaatcggctccgctaaccggtttagctgtttttctacaaaacctatcttgatttggccatttggctagatcgaggtggttggcgactccatatcaccgcaaggcgtttaggtgctgcgatcgtaattgtcgacttgtcacaaaaagttatcaacacaatttttggcgactccgctggggaacgatctaatcggccatactagggccgaatttcgtttaatctaataattactctttcgtcgaatcatcgaattagtttcggctaaacagccggaattaacttacactgtaattattattgtcgccgacattggttttgtcttcaagcttaattgttctgttcggtcacggctagacgttaaactgtgttcacacagggagcagcggccggattagcaacattgtttcctttttgcttcacacggcaacagaaagatttgattgatcaaagctggtactgtgcacgtgctaaaaaaagatcaggctatctaagccgatctacttctgttcacataaaaacaacaaaaaaaaaaacaacaacaacaaagccgattcctactgtatcggttatttctgtgaaggttcaatttctccaatcttttgctaagtacagtagcattacaaggaaaactaagactgtatattaatatattctgtcaacgatttttggctatgagctatatggccggatttaatcaaggaatttcttcatcaactataacgagagggaacgggttcaataatattactacacaatacattagaaccgatcaaggcgtcgtgaaaggaaacgtcccgctacctcaagttgtagcttcaccaaaggtaacctccgattcacccaacccatactttgctattcaaaaggttaataatcattgtgtagatgcatatgctacttttagttttgctcctatacaatatgcttataatgctatgggggtcaatgggtgattatacagccgattaaataggaatcggctatatggaaaacctagctaatggtatgaccggtcgtgacaccggtctaaccgcaccttatgccggtcagaccgtatctactatagccagtcaaaccgtgccctattttggccagatcgggcctcctgtagccggtctgaccgcaccattgaccaccgatcagaccgggccatgggtcggtcagaccgggtgattggccggtcagaccaggctatctatagccggtcagaccggttccctgggaatttctccaggttttcataccacgactagcagtattgattttaattattattcatcacctgttaatactgttacccatgctactccacatatccctaatgtctacaatgatactaataggggatatcctcccgatactaggcaagaccaatataatcatattgcgccacaaacacaacctattaggccaccaaatccaccaccaaatcaatataggcctgataatatggaggaaataattagtgagattattagggagaaattcgggattgaaattaggaatcatgctaagatttaccaaaagtcgtatcctaattattatgataatgtgccatatcctcgtggttatagagttcccgaatttaccaaatttagtgctgaggatagttggaccatatgggagcatgtaggtcaatttttagcgcaatgtggtgaggctaatagtgatacttttaaattgcgcttgttttctttatctttgtccggtactgcttttacatggtttacttctttaccggcaaattctatttatacttgggctcaattagaacaaaaatttcatgatcatttttgcactggtaacactgagcttaggttgtctgatttaacatcggttaggtaaaaatacaatgaatctatcgctgattatattgaaaggttcagagatattaaaagccgatgttttagtttgaaaataattgacaaagatttggccaacattgcatatgatggattgcttgattctattaaaaagagattgaatggccaaatatttcttgatgttgatcatgtgttgcatgaagctttggctcaggaaagccgagtggatgacaatagcttacaagctagtttagatgaaagtgtaatatcatgtatagccgaaccaagcgatggttcgggttgtgttaataatttgtgcaatgatgtcgtgacaagtatagccgaatcaaatgttggtccgaattgtcttactagcttggatgataatgcaacaaccattatagccaaaccaagtgttggctcggattgtgttactagtttagacaacgatggaatagccgaaccaagtaatggttcggattgtgttgctagcttagaaaatagcatcattgaaaatatagccgaactaagtgacggttcaggttatatcacaagcgaaagtgaaatagcattatcacctaagaccgagtcacaaatcggtcatgtggatgttggaaaagatgatgacaatgtcttgcgggatagtggtgaaatagaatccaaagtagctatgcatacatatcaaagactgtatcctaaacacgtagattcggtcccatacctgcaaggatttgaggtgcccaacttcacgaaattcacagatgagaatgctatgactacaatggagcatatcggtcgctttattgatcaatgtggtaaggccggtagtgatgatttgcttaagttgaagttgtttcccctttctttgtcaaactttgcatctacatggtatagtttgcttgctcctagttcaatttctacatggtcacaaatggagtatgagtttcatgattatttcagagatgcaagcttgatggagtaaagaccgaatgatacttcatcggtcacttgtgaaactatttcggttacacctatgcctaagaccggaattgttaatagttctctccctactagtcctattggtgttgacaaaaagaaagggaaaagtgttgctattggggatcctcggcccaagaataggatcaataatgcaaaggctgaagatcgtaaggttacaaaagatgagtcatctagttcccaaaagactaaaaagccgaagctcacttttgagatgcttatggctaaatacaagaaaggattagctggtcaacgatttgataactaaactagtgattcgaaaagaccaagatcatctcataggaagagatttggtcaaacatcaaagcaatcggagccatcaaccataccaactccatataaacctccggttgtgatgccatggtatccatatccaatgtcactatatggttatccttttttgtattatatgccatggatgcatcaaccacctatgccgtattgtcaaggatggaaggaatcacctaggacagtgccaaatcattcatctaattcaagacaagactatttcccacaaaagaatcggttcggtggatcaaaggtgaaaaaggtgaagaaggtgtgggtgaggaaagaagccaaagctccgggggtcattgctgtcaaagaggagtctcaagatgttcatgtacttactggagatacggtggaaaccacgcaagcaaaggagatcgaagccgacgccgtgactatcaacattggtggtctaaccgagacagctggccggtctaaccgccagtctacggccggtctgaccgaccttactggccggtctgactgacggcttgtggccggtctgaccggggagcattggagaagagtgggaaaattgagaacaacataggatcttccacttcgaccaaaaatatgaagaatcattgcttagctcctggaaaacaaccacagccgaagtggataccttctggcctatctcgctctcaaaagaggaggctacagcgtctccaggccataggtcaaaaggaaaaggaggccgaagatgtggagaacaaaacatataacaatttagatcctcgaacgacacctaagcgagtgtggagacctaaagaagtaaaagttaagagaccggtgatttcccatagtagtgataaatccaatttcatgagagaagaatcatcggtcattagagataagtctccttcacatgatgctgtggatgttggtgcggtgttcgtcttgccttcgaaatcgtgcagtcgagaaagccgattttgcttagggggcaagacattattatgtttatgagggaaccaagagaagatgaacggcgatggatacaacatcacatctttgagccgccgtttgttagatgctaaggcaaggtatgggtttattgtgttcaatgttatattatacgcctatgccatgttagaacattgcttgctatctagcacatgtgtgtttttgcttatcaaattgatattatacatacatgttgcgaatgccagttctaggtagtagaattggtaggttggcatataatttgtttgaagtatgacttggctcatgactctttgatatttatttaaagccaaatcatatgtctttttatggatcaccatataagatatagatttcatatttattgcaccatgaaagttttgcctattagtaattcggctaatgtcaatggtcagtgtcatgatttgttctagagttattgtatttaggaacattggcattattaatattttgcatacatgctcaagccgattacttacatttttagtttattggaatctatgcatgtggcacatatgactttggtgattcattattgatcatacttcaattggctaagtgttgtgatgccatgatgattattgtttcaaaagccaattgaattagtattcatctagacatattagttgaatgttataatttttcatatatctagagagaaggaattttggtccaataatttgatacaccaagcatttggctattatgtgaagaaaaattatatactaaaggccgatgcttgatttcaaaagtttggacgaaattggcaaagtcatagacctaggatggtctaaccggcattgcacggccggtctgaccggctctacatggccggtctgaccggacagacagggtggtctgaccggcattgcgtggccggtctgaccgatagcgggccgagagctggggggcacgttacaattgattaaaaggccgaattaattgtgaattcggacatttgtgcccatgagttagaaatagcttggagaattccttcgattagatatttgaagatcctacacttaaggttgatcagaagattcggcggcaagcgctcaaatattatatcgccgaaaaatagatggagtattacttagataatgatcagtttaaagttgctaggagagtagtacatgaagggatttgtgaaattcatcaatcggcccgtaagataaattggttgcttaggagagtgtggtttcattggccgaaaataattgatgattgtttcaaatgttatagagggagtgaagcttgttaacggatcggcaatgttcaattagcgcctaccgctgtgttgaatcctatcattaaagtatggccgttctgaggttgagctttggatttcattggtcaaatttatccttcgtcatcaaaagggcgttggttcgtgctagttgcaatggattacttcactaagtgggccgaagccgtgccgctcgagaatattacttgtacggagtgagaagttttgccgaatcttatgctattaagttgatgagttcttctctttactacgctcaggctaatggataagccgagttgagtaataaaacattgttgaaattgtcgttttgccagttggggtaaatcttggctctcttcggtatttcaagcaagacgacttgtcggttgaagattacaagaccttgatgggaaacaattttaaagacgtcatcgacaagcgtttaaagactttgaaggagatgaagacacttcaagacggtgttttcagagagcaattaatgggaaatacttgaagaaatatttcccgagcatttggcaagatgcttaggaagtcctatgggcggtaattggattatcaccctgacataacatgttctatgcttttaggttcacgtatgtttacaaaaaaggcaggggggcatgtgtttacacccaaatttggcacctatggacgaaatagaggaaaattgccaaagtttggaaagtgacgggtttccttcacagggccggttagaccacaggtgtgtgggcggtctgaccgtctagtagggccggtctgaccgcaggtatgtgggcggtcaaaccgtcagggtccgagtccgagtttgttttcgtcgggtctcgggtttccttgcctgggaaggtaggtttcgtgtttcctttggtttctatcccgagttggatatggagaagggcctgtagagggtaagaccaacccctatttaagggacaaggccggttcattgtaaaacccccgaatacaatttacttgaatcgttcttttaccatgttttctattttaccctagttttaatccatctttgtcggtttgcgccgtaaaccgtccgccgccgctgcgagagtgcgacacctctttgtagatttgtcctgaaaaccttccgtattgcctatgagacaggttagttatcctcatatcgatctaaatcggcttagaggctgatttttgatctctaaatcggctccgctagccggtttagctgtttttctacaaaacccatcttgatttggccgtttggctagatcgaggtggttggcgactccatatcaccgcaaggcgtttaggtgctgcgatcgtaattgtcgacttgtcacaaaaagttgccaacagccgcagcggctgtcccctccaaagaggtggtggagagagatgagaaaaaaaaagaggggaaagatgaatctaagaagacgaagatggatggaaaatattactatagtggcatggttctaattttataaaatttcaatgtcacaattaaaaaagacgaattgtaataacatttatcggtatatttacaatggcatggattcaattaaacaaaaaccaaaggatgtgtccatggctccatggtaaggataacgcatgaacttgtggcatgaataaacaaaaaagtagaaggacgtttctgcgaaaaccctctcctcttccccgccgacgccgtccccggctctccctcctccgtctcgcgcccgccgccgccgccaccgccaccgccgccgccgccttgcgcctcgtgacgcggtgagtggggaatagcaaaaccagacccgtgccccagtccgcggggacaatggaggggaaagaagacgacagacggcggggcggcggtggcggaagctcgacgccggggatgaacctgaagaacctggtgtcgagggagtatttcggccacaagaagaaggtaaccttttcgattcccccctcaccaatcctacgcggggataagtttttttctcatgaggtcctaaaccctcaaaagtcctgcgagggggaagccctaaaatccggatgttacaagcaaaaattaggacgaaaatgcatccatctttggttcacacgtacggttttgtttctaattctagagcaggatatagtgattgattcctcgcgttcatgccgtatatatgctgattcttttgctctagggctaagccatgttgagattgaatgaagctttggttggttgctttccttctgggagctggtgaatgagcgcattgtcaaatatgattcctggtcataattactcctaatttttgaaggaatttggtttcacgaaaagggacttcttgtctgactttgtaaagttgctactcctctgaggggaagaattcaaagggaaaaaaaaatcttacttgcagaaagaatcatagtacaacgatatttctctgtttctttcttgaattctgtttcttgtttttctaaataatccttccacacatggaggtgcagcatttaactggttctgtcgctttttgccttcttttttatctatcttacatacataatcagccttaaattttgtataattctgatcttttgttttactgttaggtgcactctgtagcatggaactgcctaggcatgaagcttgcttcaggctctattgatcatactgcacgtgtatggagtatcgatccccatggccatgtaaacattctctcctttcctgattgcaaacaaaataaccttcattgttattatggaattattagataaacgcatttattgtcattcactatgaataactgtcaccctttttttatgaacatttctataaatttgaaagataagcatgatgattaattggaaatatctcccgctgtataatttaaaattatagaaactcagacagtaatcacacttaagcataccatagcctgtgtctctgagacatatgtttgagctatttaatgtgaaattgtgaatgatttcttagctaggggttcttttggatccctcagttgtacttatttcttcttcttaatgaaaggaagcgcagccctcctgcggttttgaggaaaataaattctaagctaaattatattgttttgagaacactaagacatttttggttggaacgtaggaggggaaaaaaccccagatggtttctatttccctggaagtaccaagtcagtactgtgctgattagggtttttatattgcacagtccaaggttaaagacattgaattgaaaggccacacagattgtgtagatcagctctgctgggatccgaagcatcctgatacagttgctacagcagctgctgacaagtcaattcgcctctgggatgcacggagtaagtggttcccttcatctttgaaggttaaagaactaagatatccacagttgtgttcagcattctcagcttctctctgaaattgatgaatccctttttgtcactttgttcaatccctatgttccatttacaatgaacttgttgttaccagacaagatgtcttattcttttgtgtagtgactctacctgaaagttagtttcagaatttttttagttgtacttcgatttttttcataggattgtacatcatacttttgattctctatttataactctacaagatttgggcctgcagtttgccttttaaaattatattatttatttgacccgctatttctcaaactgtttgacgtgttcttttccaggtggaaaatgtcaagtcgtcgaacttagtggagaaaacatcaatatcacttataaacatggtggtactcaaatagctgttggaaacaaggtatgtattgcctaggctgttatccctgttaacttcaagaacggtagtcatttatgactaaggaactggttttgatttgcatatatcatgccagaagagggttacaatattttgaaaggaatttataaaattctttccaaagagaaatgtgtaactataatctgatttatattagattgagtgatgagttatttggcaaattagcatctaaattgcaatgttcattcttgtgtttgacatgctctctgtataagtatcaatacaacatagctcagtatggacacacttgaatatatacatattgatcctaaattagatggaattatttactttttttgctatgcaaagttagtaaagtgttattgagcatggggactggggagtggtgtgtaaattttataataattgtagtaaacctatttttataaagtttacaagttagttcgcaaggtcccgcgtacaccaatgtgtttactttgtgagttctagttttataaaattgtacaagtgtagtaacagctgtcactatgatttgcaggaggatgagttgacaatagtggatgttcggaagctaaaagcccttcacaaatttaagtttaattatgaggtactttccacttgaaggtttgaattgttgaaacattcttctagcaattttcttcttccttttggaatctttcgctgctctgaatgaacatgcacatatagtcatataccttttgagaaaaagtagagtgggcataggcggcagcatgtgcatcttgtctggaacaggaagatgtcccgtagggattggaattagttctgagaatgcagtgtcatgacctaactattcgatgtactttaatttcatttgtgcattacttatgttgcagttttgtgaattttctatttcaactagctaaatgcccgtacacctgctactgataaaaatgaatcatatagctcctcagatcagttaacttttctgaagtaaattattgatttgttgttcctcagataaatgagattgcatggaacaaaactggagatttattcttcatcactactggacttggtaagatacaaaacccatatgttgttttaagtttcaatatcacaccagttggtatcagtgtaattacattgtttgctgtttatgtaggaaatgttgaggtatttggtgatccttcccttgatgacacccttcatgtggttggcaaattgaatgctcatacagcgggttgttattgcattggaatggatccccttgataggtgatgattttttctgtcttcgctcatttgttcaacatcaactcacatctcagccaatgacatttcattgtaactacattatcttttgaactttatgctataatcattaggttctctatatgctgtttgacttcgctttgaactctaattctcttaatgccttatactgatgctagttgttttatgtagttaacgattttttttatttcaaggtaatataaagcataggcatgagtgaagttatttgacatactatattttgggtattactaatgttgtattctatctcggtcttttgacagttgatagtgatactggtatatgtaaaaaaaagaactttctgtccaagctacctttaagtgaatctcacctgtgatagcacctagccataagtgattctatgatgacccatgcctaaatataaatgggacactgaattcagtgtttctctactactctgaaaggcaagtttcgttcgtctgtgcatgcttcctatcaggagtgaagttttgtttacccgcagaaaaaaaaaaacagccctccaaaagaagtggacccacatataaaaacgccccactggtaaaaaactgggatagaaaaactgaatagcacgtccttcccccatctcccgttgcaactaacaggcacctttactagcatgtaaaagaaagggtgcaaaatagtttgccacttgttgccttctactccatgtaaaagaatggattatttgctatacaccattgcaagtcttcatgttaatgtttggagatttgagctgctacatgaacctcaacaaaatttattgtggaaaagtatcatgttcttgttcgcatggatatagtggtatacaaacatgtttcatgcattagtgtagctatgccaaagtattgtacatttgttctcaattatctggtgaatattttgtttctttgagccctaaatggagcttaaaatgattttgacaaggatacttacagaatgtgttgatgccaggtattttgctgttggaagtgcagattcacttgtcaggctttggga

SEQ ID NO: 45653 - DNA, 8712 bp, Oryza sativa
agttaaaccaaaatggagtggtattaattataaaaatagcttcaattaaccctcttaccggttattgtttttttgcaggtgttttccgaatatttggctttgaaagcacataactgatggttagcagattaccgtcaccaactattcattgtagattgatttccgagttctgatctgcatttctgacagcagtttgggtcctgattgtaacttcaattttattaatgtcctggccgcttgaactgaattgtattgtactttgtgactcgagagtcgagacccatatttttgttagagtaaatttcagaaatcctatatgttttgttgtctacgtagggaaaaaacaactgcatgtttgcatcatgtggcactgagcctcaggtgctatgggcgcaaagttttatgaccatacgttcttttaaatccaaaataatataacgtggcacctcttttttttaacctttttccatgccacaattctctatgtaattttgagtaattgattcctcaaattatgataactgccttctaatccggaatccaaaggagtcgatcgtccatcgcccgggcaactcgattaagatgattgattaacccatcaatgttttgtaagagtacaagggagcatgaaaatatgaaaccaaacctcttaaaaaaatatgaatcaaatttaagaaatgacagctcaataattacaatgaaatatcagagaccagtaaacctgcaattgctagtataacgcatcatatttgttaaatttctttgaaaaacagcatgtcactttctttttaaaataactcactccaatgcagccatatttcattctttgtgctgagttttgttcacagtccgattcacacatacagattgagaacagaaagccttgtgcacattgcacacatctgatgcaaaaccagacatcttacaaatggatccctgatccacaacaaaagccaaaaaagcaaacatttcctctgatgatcatgagatgcttgcaggaatgttaagagaggaaaaaaaaaataaagagccaacaagaatcatatgctgtcaaactggtaaaccagacttgctgagctgatcacttcaaagccccaagctccccctctttttaactcaggccctatacacattgaaatgcttcgcccatcgccgcgccatgaacggatcaaggtagtcccatctctcggcgcagcagctgctcctcctctcaccgccgatactcagaccaccggcatccctgaccccgcagtaccggttatcgcctttctcttcgaaaccgacagcgacttcgcctgtcctgaactgatcctcccttccaccttccagatagctatagccaacaagtatgaagccgcagtccgacaccaggtcaagcgggatcctcctctcttcgccacccctcagctcacctagcctcaccactccaccgtgctcgccaatcctgagctgggtgtcgcttatgacaccgccaagcaaccgcgctaagagctcctcaaactcgtgcatcacaaagccattctgcaccccgaaaccgaggccgacatggaactggtgaaccgggatgttgaaacggttcatgtcgaccccgaaacagcttcggattggatggtctgacaggtgaagaatgcaactgcttgggttctggtgcgcccggtcctctagtatcttcaggcccttctgcaatgcccctacaggatcagtaccaccaacacagcagaggtgttcaatgacctgcaatgccattcgctttccatgggatgacattcggcgcaaggggaaggcgcgggttgcagtggtggcatttgtgacaatggctaaccggtcaattgcgcgcatggagaagacagccagcgccattgcctgcttcaggagcctgagatgtggcccattagggctggcaaccagactaggtccatggctggctgtggcgcgagactgacggagaggtaagcgcgcctctgcccacttggtgaagcaatctgtggcggtgagagcatggaggagctgctgtactggcaatgctgctgcagtggcatcacacggccacaagggtaatgtccgagagcatgatggtgagccgccactggggatgggatcagagcgaagcgaaggcatggatccacatgctcggtcaaggtgtaaggctcaaccggatcatcgtcgttgtaccgggcagcacggatggatgaccttctgttgaaacgagatgtcgcgatgttgtcatcaaggatgcggaggattgggtcagactggttgttctgcagcaatggtggcaccttcaagtcacgcggcagctgagaccactgtgcacggcagatgggacatgtaacattgccgtgccgaatgttggaggcgatgcataggaagtggaaggagtgggagcattgtgatgtgaagattgctggcctgtcaccattgtcaatatcaacgctgccggtgctgaggggctccagacatattgcacagagattctgcaaatgaattgaataaaatattacaattaatggtattatttatcagaatacacatcagatgagagtataaagtaaaatcgcatatcaaataacttaccataaaagaatcactacacttattataaaacaatggaaactactcattatagagcgaattcctggacagagaactattcatcgattattacgacgcggacatattttgttttttaattattcattgtatgaatttttcatggtctgttagcaaacaaaaaaaattccaaaaacatgcatccaatcgaagctaatcttcacaaactacatttcaatctttgcagaactattcttgtactactgaaacaaacaagctgattatatttatatgcatcatgacttacatatgaattaattcatgcagaaggcatcatgcataatatgcatggccaatagccccgacattccaaattctctgttagacaaataaaaaaagaacatgtcttcctcaagatttctgtaatactgatgcattgacatgttggttgcaatgtgtcgtaaggtatttacctgttattgtttgtacctttatgtggcactagggaaacaattatcatgttatctgggagaccacataattgttcaccaattgccaccaaaaagtactaaagctcccaacttattgaaactaacaaaaaaacataacgcttatatggcccaatggtagatgctagtggatggccatgcaacccatcattttcactaaataaattggtacatacttttttaagaaaatgcttacaatagcgtcactgttttttcttcaaaacaaaacatgtagtcgtggaaatggcaaaacgctaaccacattggctagatcatcatgattcaacatttgacaatacactttggctaaccagaataggttatttcagaggtaatcatctagagcatcaacaaccttcaacgctgaggaatctatataaacaataatatttcctattgcaatcaaccgcttaacccaattcttctttttagcctgtcttcttgctcagttgttaattcctgatggcagtcaagcataactctgatttattctcaagttaataggaggttaaatataaacataattatactacttggttagagaaacacatttacatatagaaaactccatagtggatccatgcagttgtggtccagaacatgaaaaggaggaaaatggacatagggatggcaccttgtcagccattcttgtgctagtgggctcctccagcttttcctggtcttcatcagtgctgtctgcaggcgcattcagtgctgagcatgagatctgcatacacaccacaatctgttactacattgcaatacagctaataggcaaaatacctactgttcttgactagtagaataatctgcttctacatcagaaaaagtaaatgaaaaacaagattgtctcctccagtgtattttggtactttcccctcctatttacctatcaatgatatgataaaatgcacatgggcatcgacaatgtttggtaactgttaagcgagaaaatctagacacacaattcagtccccacacactgatctcatacagtaacagtactgcctagtgcctacacattaacactaataacagttaagttactgaagaaagatattaatctagagtttgttagcaaggtagtacaatgcaccgataagtggacaatatgtaaagatgataaccaattccaagaaaacacaacttcgggaggataaagaaatataaatgcccatttttaaaaaaaaaattgaggaaaagggaagacataaaagctccgtggaaatatgtgcccaattcgcaacaaccatcaacagacggtctacgtggaaaatgtacgaagaccagagagaatgcacaactttcaccaacaactgaaacaacaacaaaaaaaaaatatctcaagtataaataaacccaaaatacaacttgttcacagcttttaacatcaaactactactactactactatatatgtctagaattgtagatccaaagtagatctctgggagaaaaatgaagggaccataaacatggaccgaaccacaagaatggtaccccccccccccctattgcaattcttttttctcaggatactagtacaagatgggatggatgagagctactcctagaacaataattccaataaatgaatgatcagtatcaaataaaccaggtaggccacacacagccactgttagcacactgttcacaacgcaaactcaagaaaaggggggaaatgcaaaaggagtacacacctcattctggttggaacttcagtacagaatacagataaaatagaagggcatgcaagatactcatttctagaatgcccaaaagaaaagtataaaaaacgagaagcaaagtttaaatgttcaaacgtatgtaactttaaccacaaaattttgtaggccaagatcaccaaaacaaaccaggacatatctttctgttggaaaatgcaaaacagcaatgcagcaggccactaggggaggagatttttctcttttggaaaaaaatgcaaggagatgtggcaatgggagacctttttttttcttttttgcttttgatgaaacaacatctgaaatggaaggagagaatcaagcagggttgcaatgtgggaggtgaaaaggacaggcagtgacagctcattgagttttactgctagaaggaaaggaacttgaaaatcacctgcagatggtagtagagagacaaaaaatgcccagtcccaaaacatagcaagaaactgaaagccaagaacaaccagaaaccgatacattgatggtgaaaacaaaatcccaaaacttaattaaccacagaaaagaaaaaaaaacagcctcatttttttcccttcttagtgtatcttgaacatctaccaactgggaagaaacaccccaaaatgcagaaaaaaaatgaggcattttgggtagctggactctttcttaagaacaaattgctgctaaattatatctgaaccgttagaaaagaaaagaaaatctatgaaatgtagagagagaatgcatacggtcttgggaggcggggaaggggaggtggcggcgtgggagaagaaggaggcgcaggagagcccgatccgcctggctgccgccctccgcagccgcgccagcatgccctcgccgccgccgtcgccgccgccggcgcatctccccgccattgcgtctcctcacctcagtcgtcggagctagctacagctagcaccataggatagctagctcttcctcctcctcttcagctcttcttgctctctctctctctctctaaagctccagtgtttctctctctttctctacaagctagctagctagctacagcccaggcctggtcttgctgtcctggcctccttggtggtggtggtgtgaacgcaacgttttctgcttgttgccttttgtactccatgggaggaagtaagaacaacgcagcaaagctgagggactctctctctctctgtctctctaggtaggaggtgagcagatttgcagtatagcccttgtcattttcctcatttggattttctggtccatccaagtggaaggaattatgatagcacaagggtcatttctctcgtgctgaaaaagcgtagtcgtcttccttcccttaggtgtgtaacacgtctccacggaagaaaaccatgaaaattattgagtgatagaaaactaaatagaaatagttggttaaaacaaacggttggattggaaccttttgctcgattcacactcctgggcattggctttatcctcggctgtatggtccattgtgatgtacaaatatattgctagtagctgtaaatgtgacttttctcgccaacataatcttttatctaacattatctgtagttatgtgctagtgtttttttcttttagggctaatttggagcaaagcaattttggatgaattatatagggttcaaattctatgaatttttttacgtacatgtttatgtgaaacaatggaatacttgttccaaaatcctatgaaattccttaagattgcctcaagcatagggattttggaggatttttttaaacatgaggtccaatctcttagaaaaaaatatttatctctcttttgattcatggtttttctctatttttcatccatagaatttgaggtgtcaagcaaattttatgtttttttaatccttatgttttggaaatcatgtgttccaaccgagctcccaatttatgttatattattaattaacttagatcattgcatgatatgaaatatggattataacttactcatggcccatgggtaactcctgatcaactgagcaatttagcattgtttagcttgcaataattttatatggttctcatagaaacaaaagtttaaattcccaaatagaatggataaattataagttatttccgcatgttctgttgagcataaccaatactcccaccctttttaatatatggtgtcgttgatttttaagatacgtttgaaaattcatcttattcaaaaaataatataagtattacttcctccgtttcaggttataagactttctagcattgtccacattcatatagatattaatgaatctaggcacacaaaaaataatgtgggtaatgctagaaaatcttataatatgaaacggaggaagtatttattttattgtgacttgatttgtcatcaaatgttctttaagcatgatttaagttttttatatttgcacaaaaaaaattgaataagacaaacgtttataaatactcaacggcgtcatatattaaaaaaacagatgtaatgtatgctaaacctatgcacatttcatccaaagtagagtcctttccaaataaatacacacttgggggtgtatccccaattattcctccaggggcctttatgcaaaatgccattgcttgctgagctgctcttttttttctttcaaagtggtccctccccctccccttttcactttggacaagggaggaacaatttaaaaacctttttttttttttacaagcctcaactcactcctgcccagcttgactaccttggactaatcacacacaccatacaatcggacggtgattgatcaacgaccctggcaaaatcacagccgcccataccatcacagagagcaattaaccagtcagtcagtctcaggcaggcagtcagagttggcacaatgccccaaatgttcagctcaagctttaacttcttcctctctttttttatttttctacttttactgttactacaacttggaggagtagcctaggagtaggagtatttttgtttgtatctttaacactttctttttctttatttcagttcaagaacttcagtcacagggaaggagacaaatggcagcagaagtggcttaaaagttgcagaagatatggtgcaggcattgaagtgaagttgttggattagttgcaaccattttacaagtatatgaaacaattgtgcattgtgaaaaaaaattaaaatgtataaaggccaagttgaatcgggacaaaggattatggagacactgtaaaatggtcccataaatattatgtatttcattctccttttaactgttggtccctttaaaaagttagctcaaactccaccactaataataaaggtgataggaacttatgagcagtagttggattttagtttggaaatacgatgatagaaatgtgttaatctgtctgagtttaagtggttctttcagcctttccccgattttgctgaggagtttagataagagttgttggagctgataaccctcagtgaaaacaatgtcacaatcggacttatcttttcgcttaatcaaaatttgaatttttaaacttaaatttggagttgattttgggatttttttttcatcgaagtttatttttcaaccttaattttagatcattaagaacacatatataaaaattttattaataaattatttttggtttgcaaatatgttgtttcgcttatttctcgaataagctaaacgatggggctgcatgtttatgttaggtgttatgttaaacaagtagtacactttttggcatgctttaagtaaatgttcacctgtaaaaaaactggtcaattcagtgttcaatgttctttatggcaatttgctggtaactggtaagttaactctgtattttgtgacgcaccaataaatgtctttacctgaccttttgctttgtaagcatcatgaaaaagaagcaatttaatccgttccattaatgacagaata

SEQ ID NO: 45654 - DNA, 9560 bp, Oryza sativa
tttccaatttcccagagaaactaaattgaatcttataaagttctgcaaaaatcacttattgtgaggaaccgaggataatcaccttggacgtggtgtcagagctattggattatcggtacatgactttacaagctatgttaaattattttttatttatgttaattagtcgtaggtatatgatttcacccactggttaaactatttcggatgaaactctatatggggatttgcttggcaatcatgcatgcaaattaaaggtcaaaaggtgcatggcacattgcatggtggatccaaggtccctgtccttgatgattgcccatcgtgcatgctttgcgacgttggaatgttgaggcctacaagaaaatagaagtgacctcctccctccatctcaaaatactccatctcaaaatataagtaatttttaacttggacatactactttaaccaacaatgtctataaaataaaatgttttaaataaaaagagttacatgatagtttgtttaatgatagatctagtaatatcaattttacatgattgatcttttttatttttttgtcattaatacttaaagttaaaaatatttaacttgacactatgcaaaaattacttatgtttggaacggatggagtaatatatattgaatgcaaaatatgttgtcgacttcctccgtttcaggttataagatgttttgactttggtcaaaatcaaactgtttcaagattaactaagtttatagataaatataataatatttataatactaaattagtttcatcaaatcaataattgaatgtattttcataataaatttgtcttgggttaaaaatgttactacttttttctataaacttggtcaaacttaaaaccgtttgacttttaccaaagtcaaaacgtcttatagcctaaaacagagggagtagttgttaccgatataagaatacctaaatacggttatctacgagtattttctttttagatttttttatgaaatggaaaagcaaagcacaacagttcttttttcctttttgaagaaaaaaacacaacagttcatacacatacactgtgccatataggtgtatacctgttatacaggtgaaaatgttttcacaagcaaacactgaatttttttttgtggttgtcacctagtatcatgcaaaagtgatttgaggcacgtctggtttgccttacaaaaaatgtatttatgccagttttgttaaagtagtggtattattatatggttaatatggtttgatgtctacctagctaattgatctagagtatgttaagtgttgatctttctggagtagtcagtaaattaaatttggtactactaagccagcagtactctgggaaattaaccacacacacaaaagaaacccattaattcaaaaaaaaatctgggaaattttagtatccccttcattgatcagctgactatcgatgatatctaccaacttttactgtatttcagttattgcaaacttttctgttacaactagatgagcagtattctagaatcaaagaaagaaaaggagcagcatgttcagattccagtactaggtagctcagcatgcgcctgcatatacaaacattcgttgagagatttaatttctcacgcacacacataagatgcatcagtactaattaatgatttgcttgaatattacatcaatcactaatggatcaacaaagtagtgtactatagtgactagtagtactcgatcaactttagtttgtaatggtgctggatggagtacaggaaagaaagttaatcgatgctctacccttcgagagtgtttatacggggctaaaacttgttaagtacatgttacatcggatatttggacgtaatttagagtaataagcatagattaataaaaaactaattttataaataaaagctaatctgcgagacgaatttttcaaacctaattaatccataattatcaaaagtttattgtagtatcatattattaaatcatggcgtatttaggctcaaaaaattcgtcgcgcgaattagtctaatgttatggaatgtgttttataattagtctatatttaatacttcaaattagtgtccaaacatccgatgtgacaggtatttggaataagtccctgtttcccaaacagccctttagataacttcatgagtttatttttgaggcaactcaggatcgggcgcccgatgaggagagagaaaaatcgggtgctgatgtcagcataacgcatacgtgcaaaaccacattaaactattttttttcttaaattatttatccaaatcatgatatgattgcaccattaaattcgttgcaattaaatctttaaaacaagatcacacatggatatattccgacgaaattttttttagcttattattgaattatttttatatgctgcgcgctgttccaccaagtatatcggaattgttagatcgaaaatctttcggtcatttaaattgggcgttgtttcaccttatataaaaacaatgtttcaacaaatagcgaaagaatgtttcagttcactgcaacatttgatctatacatagtgaaacattataagtatactaggtgaaacattttttgtggaacaaaacatgaaacaaattccattaatagagggttttcaaaatatgtgggtaatttgttgcaaaagaatatttcaattcactgcaacattagatctatacatagtgaaacattgtgagtacactaggtgaaatattttttttggaacaaaaaatgaaacaaatttccttaaaagaggatttccaaaatatgtggatgatttgttgcaatggagtatgtgctagggtgcgtggtgggggcaacgcgtaagctggaggagacgcgaccgagatgcccgatttttcctgctggcgtcgagcgcccgacgccaaggattcccggtttatatttccttttttggggcattttaaatttctaggcaaacaaaaatatgttccagacttgaagggaagtagctagaataagagttatatcggatttttctagaacaaaacaatttatggttgtgttcggaagagtatttctgctataggacccaacaaactttctatcaggactgctgctgcactgcagatgtgcagccataataaccgaatattgtaatccctccatttcatattataagttgtttgactttttttttctaatcaaactttattaagtttgaccaaatttatcgaaaaaaataacatttaaatatgaaattagtttcattaaatctaacattgagtatagtttgataatatgtttgttttgtgttgagaataatactatatttttctacaaatttagttatactaaaataagtttgattagaaaaaagtcaaacaacttgaaatagaaaacggagagagtataagataatgccacctagttgctaaacaatgtcataacccaataacccatgaatatgaacggtgccctagggtcgttggtgctgtaaatatttaacgttgcatctcttcctcatgtcaaaaatatttgatgttggaagaactgggtttagtttgcgacaagcataaatcttatgccatgttttttttaaggaatagaatgatagatgaattctctagctcctaaatgatacggctttttcaagtttttagagaatttttttaaatttatttttcctaatatttaatttattcattaataccttcaaataattatcagaaatcattcggccatcgaaccattcagcacgaaacctcaacaataacacttttgcgagcgagttctacggagtagcaagcatatatcatgcatgacattttttgcgaattcacatgaaaatcgaactacttcatgtgggatttttgagtattttgtaaaattcatcatattcatggcaaatccatgtggggcccaccatggaggtgaagagtatttttttcccttctaaaaaaaagaaggcaaaacaaagctgccaaaggggggacatagtagttggcacttggtaggcaaccaggagacgttacagtgtttgggatcgccacccccacagggccacaggagtacaggaggcatcatcatgcgttcacgccgcatgagatgctgccgttccatcgccggtttccgcatgcacacgcatgggtggtgacatggcgtgatgttccccgcgcgtggagctctacattgacagcccacctgcatatggagggcaacaagcggccacgccctcctctcggcggggcctctctcagcaacagcagtctgccacagatttttaccgatccttgcacaccacgtagactaaggtcccgttcttctcttcaataagagttagataaaaattaagattttcatggtacgcttttcagactgttaaacggtgcgttttgtgtgaaaattttctatatgaaagttgctctaaaatatcatattaatctattttcaagattgtaataattaaaactcaatcaatcatacgctaataccacctcgttttgcgttaaaaacttaatcttaatcttcatcttcatcttcaggagaaaagaacaccacctaagaactgtatttgctacatgctccacaatgcatatcacttgtggtgggtcccaccactatcactccttcacttttcctcccctttctcaacgtcttttccttggtggagaggaagcaaggcggcaacgccaagcatctccctagcgacggagctgagcagaatggcagcgacgcggcccaagcgacaacagcgccagctaggctccacctctcctcctcctccgaccggtggaccgagcagcgacaacaccatcggggatccacctctcctcctctgaccagcggcggggcctggcgcggtagcgggggacggcgaggtcggtggctcggtagcaggggacagcgggagctcggtggcaggaggcggcgccgtcccccctatcccccacaaccagtgccactctccttttccccattatcgacgccgctcaccccgctgcacgcacctctctcctctctctctctctccccaacggatctgacggggcgacgggcagcaggtcggcgatggtgagaaagagctcaacggcgacaacaaggctcactctccggcatggatctaaccatctccgtcatggatccaaccaccctgagctccctctccagcacagcaacagctctctctggcgtcgacgttgtcccatcgagctcagggtggtggcctcgccaacaacgacccccaccatctcgcacggggtgtggggtgggggcgtcgcaccatgccacgaagtgcaaggcgacgacttccacagcgtggccgcatcgttctcccccgcgatgcatgatagcttttcatcaaaagaatgcacgcccagctttggctacatggacctcgtttggctacgtgaatctcctacgtgttatgggttgggctgaatgccacatgtgtgtgctgttaatggcctaattggattgggatcttcgacttattacatgtcactaaaatgtgagatataaagttgaaaaaggcaaatcatagacaaatatataatttaaattgatgggcgaaattcagcttacaatgcagtttttaagatcgaaaatatggacagttgcttatagaaattaattaaaattaaaattatatattacaaagccacttcctctgttccataatataaggtattttgggtggatgtgacgcattatagtgaaatgaatctggtcccttatattatgggatggatagagtaacaaatagcttgggaaaagttacctaaccaatgtagattaagaaataatcttacgaagaaatcgtagtagtttcgaaagggtggcatggatattccaattgatgctccatgcaaatatttatataaaagtagaaaaaattgataaatagattaatatatggtatatcactctgccaacgtacacgtctaaatttgacttctgcaaaacaaatatgatagtgagcacacgtatactaattagagcttaatttattatttttgttacaacttgtgaatattgaatttgaatgcatatttgtaaagtaatatatcacacattaatctatcttatattttttttaatttttttcataactatttggaagacaatgcaatatttggaagacaatgcaagaacagtgaacatccctcgacacattaatctatcttatttttttaattttttttcataattatttggaagacaatggaacatccctcgaggattagaatccatttccgtcgttgagttatgcaagtgtataactggctcaaatcatgatatgcaaaattaaatggctgtatgtatttatagttggtgtaaagatagaaagctactccttatatttccttgcattatcatcgtatgaaattcctaggtttcaaacggcctaacattatcagcacaatttgtacaagaaagcttctcgttgatgtgtcgtctactcgttctccttgtttttttttaagggttttgtacagtatatgaaggacgaaaaatgtcctccataattttatatttctgcaagaatcttatatccataacttctggcttgctgctaggtttcctctcatacccaagaaataaataaataaaaatcctctcataaaaaaaaggaccaggcaacaatcgcctgaatcacccgtacgaatttgccttgctttcagcaaacaaagcagaattaaataaatctcaaagcactgaagccacacatagggccatcattgggttgagaccaagagtacttaaaacaatagtacataaaaaaaaggaaagtgagaaagattggctgctgcaatgctgttccatggaactctgaactctgatactacagatgaacacttttaacaagctaaagtttgcagtaacagcaaatatataggctatgcactttagcagacagaccatacatggcagagagataaagctggtgtgcactgaaagtagtgaaagaatttacagcacacaaaggttaataaagctcccacccctgcatcatgggaaaccccttaataaaatctgaaggataggcatcccagggagtactccaaattccatagcagtaagcttgtttcagtacagtagacagtagaatggcatatgcatttccctcttcttgcacttcaatcttacctgcggaggacatcttttgggatgctctgttcacagtctagttcataataactgcccacaaaattgttgtattcaatgagatatactacctagtcccaaaataagtttgcttttgtacatgaatctagacagtgtacaaagtaaacttattttgagacgaaggtagtatacactactagtattcctcatgaatggaggcgtacaccacactgtcaaaaaacatacaggcgaacagcggaagcatgcaaaaggaatttcagagagacgacacatcgatgagacgaatgcatgatgtatgaatgcaaaaagggaagtggtattcatgggtctatgcattgattaacacaaaaacagagagaaaagatgaacggtgcaatcttatacagacaagacaacggaggtggttgccacctaggagtaagctttcaaaattaaactgcaatgctaattcatagcagaacctatgttaacaaaacatccggtataggtatgggtgcccaccagcagtttcagactctcaggctcttcagtaataaggagaaaatatcaccatatgatccttgcaggctgcaaatttccttaacctgtcatgacaggtaatataactgttgtaagtggtgattgcagcaaataaaggtggttcttgtttctactactgacatggaatgctgaaattgaagagcgggttcagactatggcatttgaaaatatcatcagcataagcacaaatgatgtattgaaaattttttagtttaaatcaagcatactaaatatatctcactaaagttgtcctgcttttgccacaattactacataaacatgagaaagtaaataaaatagttccaactcataattgcccaagtcccactagtttacgaatatatatatactcagacgaattaaatgtatcacatacagagagggattgcatcctgcttcttcaacaaatatcttttccccttaaaatttatatgttaataacagggttttcacttttgatttcgcttaaaatctcagccatttcggtagcactgaaattccagaaaattcaggattttcggcactttttggactgatttttttttttgaaaaaattaacataatttgactgaatttgaataaacttttaccaaattaaaaaaaaagagagaaaaactggaaaatttcggctgagagaatgactggccagggggttcgaaaataatgaaattgtttctgaaattttgaaccgaaatttcattcactggttaattgacagccagggttccaaacataattctatctagcaggtgacagaaatacaacacttgtgtaaagacaggcattaagagtaaaaatgataatgcaatgtccttgatgtttgattatcatgtaaaagtttggaaaacaatgaccaaacgaacaatacaaggcaagagtttctcctaaacaatatacaaaccatttagcaattacattgatggcataaacgatttggttcaaataggacaatgattcatattcttgtgtaaatggtacagaaattaaaagagatctttaggcaaacaattacctcgcatctacttctggccaccaggtttagattgttgctgtatctgctgaagtagggttgctgccaattgcaatgttgcttgaaggcgcttttgagggtctccgtgatggtcttcctgagcagacggttgctggctagtctgtggtccagagggaagtgcaggttgcgcttgtagagcacttgatgtgtgctgcctaaggggtggagggccttcaggaagaggagggacgaacgatctcaaaggcatggaagaatgagctggatttcccgaaggatgcatagggggtaaaggcaaagtgttgtgagaaggcataggagcattcggtgtatgcataatggatggatttggtggcactgaaccttgaactggtggcgcatgaacctgtaactgtgatgcagatggcggagcaggtggcaatgagttttggacagggatagaacctgagctgtgtggcatcattgaagaatgtccatgtggattccgtatgaatcctgattctttgtttaagctgtccacaggctcttttcctggttggttttgttgtgcaagaagagtggccaattgtgcaagttgctctggtggaagcgataatgggagagatggaggttgttgaggtctaactacctgctgtgatgcaggttgcatgggagggtaggacatgtttgatgcctcatctgcaactggtgcataccctgatgtactcacttttggtactccttgaggagcaaatgagtatgcctctggtgtcctatcagttgatgtatgtgggatcgcactctcagccaaataattcaaatttccagaacctggacttggattgtaaatgttatctgaccatcttgagggcaatacatctgggtgttgctgctgcttgtcatgtgctatct

SEQ ID NO: 45655 - DNA, 33960 bp, Oryza sativa
caggcttgtcctagcagtgcaatccaaaaattcgggcctgaaagtatgaaatcaacagcggtttaaaactaaatgttgaacttagagatgctcaaatctagaacaatagaacagagcataaacaccaaaggcatctcatcagatacaaccaaaagaatgcagatagaaattgatcaactagattatgtagtttggaccgtgaaggcaaacgtctgtatttattaagattatgagtagaggcaaatggtgcagagatataattaaatcaagaacaacgtgaacaaaacatagctctacaaaagccttcatcaggtgcaaacaaaagcatgcagtataaattagatgtaaaaggcaaaacgatatctatgatatatttgctatgtattatatatcttgaaccatgaaggaaattttgtgatttttattaagacgataagcagagctaatgttgtagatgtcaataatgatactcagaatgaacaagaaaatacagtgaagaacccagacttacagcatgaagttaagaaccttcccaacagggaagcatcgcgctcggcaaattggtgtgcctccctttgctattgtaccatcccatttccattcttccttgagaaggggttcatggtattcaggagttgatctttccacttctacatgcctagaaaagctgtcctgtgcatgccctggtatatgcctatctacaagtggagttggattccttaaaggatcaacatgatttctaccatgcataggagcaagttgatagcctctggggtgtatgtcatcatctggcacaccatagaagggcctccttgggtaggcagagccaaccttccctcgatcaaattcagagaaagggtattcaggaagttcagagtcatgtgcttcaccagtcctcaacttctttgaaaatgggtatggatcttccctagcataccgagaatcctctaatggtaaggctccctgagatcgctcgaatggaatgttgtgccatggtgcatcaccagcagggctacgcctatgctgttcatatgggtcctcagacatccttctttctggaccgagcccttgtatcctaaaaggttcaaaattagatctaggatcaggctctactcaggtccatatcgcaaataattatccctgctgaaacccacatcatcatgatctctagaaagtctcttagggccataatgtggagatggcatgtacatatctcttggaggactatcaaaaggcctagccctaggaaaatcttcaaaatcttgctccctgaatataggtctaacactagagtttaaatggggggaatatggggcatctaaggaaccttttccaaattctgctgaaacactgtcactccgagaaaagcaaatgctaactcgagggttattgaaaatatttccctgcagtgtttccttcgccctgcatgccgctgcaatagtagtgtactggacaaatgcataagtacgccctgggaatgtagttatcttgacaacctcaccaaaaggtgaaaaggcttcccagagagttgcctcatctaccttcagaccaacaggaaaacctatccataatacttcactaggttctgctggcctgcttcttttggatttatcagttgatttttcaggacttgattgctgattccttcctcgttcagtaaaacgtctttgatcagcatgttgtgagtatctgtcatccatagagctacttgaacctttatcctgtaaattcaaatatttcaggtccagagtagcaaatggatcatgatgaacacagataccataagtacttgtatgctcatattgctatttaactgacaagctctaggacataagattggtctgctctacctatgtccatgctgcttctgatcaattagccctaccagatgcagtttaaaacaatatgaatgataagaaataatcagtcaaacaaccacatagaaccgcaatcacagcctgctgtttcaaacttggaataaggccacaaaaggagagttgggatcaactctatcaagtgctagaatccatttttcatttgatactcataaatcacaaggacaacaatgtagaaatttggtacttctgctgttgtgaatatcatctgtaataatatcatatttgttctataatttctatatcatgaacaagacttctgttatagtgttatggcacttttgggtcatctttaatggcaggtttttaactaggagttttgtatgaagtcttttttttggggaaaaaaaactcaagccagtttgatattgatgatgaaattgggtgagatatagttccatcatctgaaatgaacctttggctcaatattagtataacaacataagattgtatggtgtatcaaactagattgtatggtgtatcaaactttacgaaggtatagttccatatttacaacatcacgagacagttcaatattgatgctgcattgattaagatatagttccatcatctgacatgaatctttggctcagttttagcatcaaggtggtatggtgtatcactgatcaaacttcatggaaatagagctatttacaacaattcaactacccaaaaagctcgattgataacctgtgatcaattgcaaaactgtctcatacactatgtgaattcaagccacaaagctagtcaagacaaacgtatgcatttctatgccacaaataaaccaaagcactactaacaaagtaacaaaccctgcttttaatagggatatagatgaacctatatattattgcaattgttagcatgtatcgcgacataaagggtgagaaaggtgaagattaatctgttagattaagcctgtgcaagtggcaacatctcgtagtccttgtccttcagaccaaactaaacattgataatttcaatcaaatttgctgaaccactgtcattttctgtcatttaatagaatgcatcaggattcaaatgatattattctggttgggtgttagttcttgtcatgacatgaagggtgagaaaggtgaagattgatctgttagattcagccatgtgcaagtggcaacttcaacatggtccttcagaccaaactaaatattgagcatttcaatcacatttcctaaactagtgctgttattttctgtcaattaatagaatgcctaaggatttaaatgagactattctggttgcacaataatagcaaaaagctcttgtgagtgcctgtggtaatttatggaaaccaagtcctgcaccggtataccatagcaaagtggttgtcatatgcattctctatttaaccaagcaaggagagattatcttcttcataatagaatttgagttccatctcaaacttaaaacataagctgcagaagatagaaagggtaccgactagcccaaaaatattaatgtgggcatgccaagattattaaatgatcttgacgttctgggatttcggaaggccttcattgatgtctcatgagctgtttaaatttgcttatatgtgcgcaaaactgaatatccagatagtttcatatgcaatatattttccccaaatttttatcactcaggcagtcaggccacagcaatgtactgcatcagatctaaaatccctgtttttggagctttggtgttatggaagttaactccttgtagattcacagacttgagacatcagctaactgttgtgcttatcacaattagtgaactttgaatctttgattgagttcgagaactttagttcccagtgggataacaagggaaaaccatgtaatagtagtcctaactatctgcaatctgagttgtcagtcttcctctctgtagagcattcgaccttttattggtcggtgatgaacaaacatagtgggaatgaactatccgtttcagtgaaaccaaaggtctgacaagtctctttgtatgaaagactcgtatgatagcaaggatgcggataaatgaacaaaattaaggttctgtgttatccgagcatgcctgagaacggagaacttatagttcattgttcaagcatactaggttgatcctgttttggtctgatttttgactaagagcaaaactccaaaccaattttaacttatcgcgacacttggtctgttgtgaaacatagtttttgctttatttttcggcgattcgtgtttgcaaccatgacaagataagcacaattcattggtggatactggtgattttgagacagggaatatgatgaacaattcggtaaaagcgtggcaaaccgtggcgaagggggcgggaggaggacgatcgacactaacccccttggaaaactcgatcctaatgggcgccccgcggaggtggatcccctgcagctcccgcaccgccgccacggcgtcctcctcccgcgcgaacgtcacgaacgcgaagctccggccggggtcacgggagatgccctcgacgtcgccgcaccggaggaagagctccgagaggtcggccgcggcgacgcccggggagaggctgcccacccacaggtgccgcgacggcggtgccaccccccacccggaggaggagcgccgcggcggcgggtcatcgcgggcggcggagaagcgggaccccccgccgccgccgaacctccccctccctcctcctcctcctccgccgcggcctcgaggtctccccatctgcaagaaccaagaagccgaaccgcgatttcgtcagggaaaccgcattcccgtcaacagcagcgggtagtggatcgagcgtgggagggagcagagggcaccgtgtacttcggttcggcggcggatggattagggttttcgccggcggcgatgggttgggtgggttagggtttcgcctccggggagatggatgggtgctctctctctctctctctctgcaattgtttttccattttttttcttgctgccctttactatttttccattccgtgttttttttcgtttgccgagaaaatggatgcaagcatggcttatcactggacaataattaatgcatatcaaatcttataagcttacaatatcatatctatactccatctatctcaaaatataaagagttttgattacatgaaacacatactagtttatccagattcgtagtattagaatgtgtcacattcaacaaaaacttcttatgttttgagatgaagggagtacgatttattgaatactacaaatcaacaccatttccacaatatttcaacatttctatctatcatatttataaaacttagaatatatccatccatatattttagagttaagcacatgcatgctaatattatagaaaaagattttttaccatccttgagggcatgcggtaccaaatcatggccatcgatttggtagcatcggacgactggaatttattcataccgcgtggtaccgcatacccagattgaggcggtaccgtaggtgggagggtagaattgtactttcgcgttctcttccgcattagtgcatcaccacgcgcagcagcgagagaaggggctcctcttccgcgtctcttccgcccgcatctgtctgcgtctcttccttctcaacacacgttgcaaataagagatggagcccgttccaagttcagatccatctcagatgagggggaaagcatatcttcatcaagcactcccggtcagatccctccatccggtcatgcttgctcctctcgtcaatctgtggaagtgaatcggccgcacgcggggtggggattggggaggtgtgaatttggcgtggtcaacgtcacttgctgcatcgtgataagtcgtcgagcgagccgctacggctagggtgctgccgaataatggagatcgagggccctactgaatggagagtgaggctaccgccgaagcttcaggttcatatttttgcatgttttcgttgctgctgcggatggaattagctataagaagctgatggttttaggaggaaacataggtaaagctgatgattttagtctcaaggtctatgttcttaatttgtgtgatggatgacaggatgaacatcattattttgtttggtaatatgtactgcctccctttgatgtaatctcgtcaaaactatatgtagtagcagtttgtgctgttatactatctccctctgttcaatggacagtatcaagtttggtttgaaattagctaattgcatcataccatcaggcggcagctacggctccactggaatttaacttcaattactaataaaatcaattcgcataatcaccacccaaagatacacgacttcaattattaatagcaggcaccatattgcctaaacacaacatgcgtattcaccaattccttactaatatctatccgccggcggcggcagcggaactgagaaaaggggtcggcgttgggctcgggcactcccagcggtggcgtcaccttgcttttagcaatttgggcgagaactcatgacagacggaaagggattgcggcgctctatatcgctattggcgatttgggtggtgccgattggaaggaccaatgaacgataatcttgtctattgacttatttttccaatcatgcccctgcttaatcaatggctagattagattggtacctcatggtacctagtacttcatggtacctcatggtacttcctcaaggatggaaaaagagctcttatagaaatgatggatatgtatatcaaatgatgtgagatgatctgccatgcttacatgttgagttctaaaatataataaaatatagatgatgtactatacttgtataacatttaaaatactttaggcattaattgctactgaatgatgatgtgttacactcatatattgagtttagtagctagtcagcatcaattatatagaagatatgatttttttttttacagcctgggtgcattttaggtggaatattttcaagttccattagcctacggtgaaaactccactaggagggttaaattcacaaacaaccccatataaaaaaacacatagttaaataagatgaatgcattcagcgcaattagacgcttggtattgtcatgctacaatttgttttgcaactaaaagaacattttcggaaaaaatgtttagaggagctttctttcttgcttagtccatatttattggctgcactcttttaatcattttaactaaattttggcacctcttctaacactatccataatactccttttcatatgaggcccatatatcttgcgatatatagtaagttcttagtttaatagaaaattaaatgtgttatgtgttttaagggttatttgttcttgccaaatcaagtttggctttaagatcaatattttgtattgtgaggagatataacaatcatctacacacaaaagagatattttttttaaataaagccattgcacacactaccaatctgttttggtccctaataaatgatagcaacacatttagtacagtacaatcttactagttgaatcaagtgtttaaaggaatctgcttgtaaaagatataaacatatgatagatctaaaaaaataggttgtatacaccctaaatgataattatatcacacgtagtctactaaaatcatggatctgaagaaatgtgattgtaaaatccttacacacaatagatataagagaacgggttgaatccactctaaatgattgtaataccacaaacaaatcattaatcaaatcatagatctaaaggaatatggttgcaaatcctaaacataattgattttgaagaaagttgcatgagtatggtgaagcaaaaacctgttccatgataacttcagcacgcatcatccaagttcctctgcttcactctgcatatatatatattcacattaaaattgtgatattcaatcgatgtgctgcaacctattcatggtgatggaaatgggaaatgtagggaggctagcaagggtgtatgcacgtgtagtagagaaggaaagaagggcaaggttggacattggacaaggcagtggtgaggggagataaggtgcttttaatcccttatgctgtcattgccagtgcatctaactttggaatcatagatattaacaaaaattgttgccatattaactgatcagtttttcttttttctttagtcacaaataatggttcatttttggattttttttgaggggaaacacatgtcttttcatatctaaacataataaggcacatgattccttacatcatgactacttcacaggattcatttcaccacattatatcttgtctggagaaatgacatgaaaaataaacaggcgatattagaagatgattctttggaaattaaggagctgtcacaagtgaatgctacatgcattgtgtttgatgaatttgggtaagtatgtatttgcatgctgaaaatgataggtggctaggaataaatgtcatttattaatatatggcaatttagtgcccccggcaaaggataaaatgaaattatgggctgtttgaaaactgtagtgtgatgatacactagtaaagctttgcttcatatagcaacaattatcaatgatatcaagatacctgagttttggctgtgccttgatgttgattgttgagaccaaaagggagggggccaaaaaggaaatggttaattggatctatgtcattgcaaatttggtcaattaggaaaaatgtcttttatatctgtgatacctgttacatgtcattgtaattttgtaaaattgaaactatgtcattgccgttgaatattttgtcaacctccgtctaaggtcatgctttcttcctccttggtcttatgtgtgtcactataattttgtaaaattgaagccatgtcattgtagttgaatattttgtcaacctccatctaagaacatactttcttcctccttggtcttcttcttcctttgcagatggggaggagatgggctggccgcagatgtggtctcatatttgagcacgcatgaagggagggagggggggattgtcacgccctgaagtttcccccttttcttgctaaaaaaaattggttaaataaattgctcgaagaaattgtttaattaacctagagttgaatccctaattaatcaatgcaattaataatcggaaatggcgtggtggaatttttcttgagttccccatgttgcaatatattaacaggatttttagtggaattttcagagccttgtaaataatttttaccaattaaaaatcactaaagtgcaattttaaatcccagggaatttatttttcctttttcccttttattttcctcatcttccctcttcttgggccatcggcccagtccacctcgcctcaccccgcgctcagcctccccttgttgggccggcccatttccccttccccctccctccgggatgccgacaggtgggccccacctgtcggggtcgtccccttcctccagccgaccgcgccccggcggcaaccgcccatgccaccgcctttcccgcctccccgcgcccactccgcgccctgcgcccacgtcgccgccccttccccgctcctcccgccctcgcacgcgcccaaaaatgggcgggattcattttgaatcccaccccactctctctttctctccaccccacatcgccggccaaatcggccacctccccggccacgtccgcccccttccgcacctataaatcactccctcgagccccctcgacctttttccgctattgccgcgcttgcccgtgcactccgccgctctccccacgccacacccgagctccgccgccgctgcccatctccggccacgcgccgtcgccgctagggcctccgccgcgccaagccgccgccgccgttagctccgctgccgcaagtgctacctcggccaccgctcgcttgcagccaaactcgccgaagcgccgcctccctcgcacgccggtgagctctccatttccgcccaactccggccggccgttctagtcaccgtggtcatccttcccttctcctaacctagtcatcgcctttcccaggttgtgcccgaccccgtccaccgttctccaaaccgtcgccgccgctcgtctcttcccgcgccgatcgccgtcatcgcctcggtaagggatcccctctccttcttcctttcctccctcccatgagcgcagccaccctccgcgtgtgcgccgtcgccttcggccgacgccgccacctttcgcgccgtccgcgccgcctctcgcgccgccgcttgccgtcgtcgtcggtcgtgcgccatcgccgcctcgtcatggccggccggcttgagccgtgccgagccagcagccggcaccccctcccccgccttgtgctgctgccccagtggggccaaccaaccggtggaccaccccgcccacttttagccactgcctatggggcccatgtgccggcgccccctccctctccccttgtgccgctgacatgcggggcccgcctgccgagccgccccctctcgctgacgtcagccctaggtaatattgcgcaataaaagttatttaggcttttctttattagtaaaaacacagtttatcttctaaaattcataagtaattcatccgagctccgtttaagtccattcaagtctcagtaaattcataaaaatccctagaatccattaaaaatggttttgtttcctgtttcagtagtcttatagtgtgttttgcttatgtgctctgtttgtcgcgtagatttcggccatttcgtcgatccgcggtttctcgaagacgttgctgtggtctcatcagtgcgagagcaaggcaagtcatgcattacaattgatcatattatacctaatttacaaatatcccgcatatattgtttaccttatgccattgataacttgggtatcagaaagattagatgttggtttaggaaatgcttagccatgcctagttcaactagtacacaaatggggatcacattattacatagactttgactaatagcatagttttggattggtgccaccgcaatggtgttagttaattaaaatacactaaatggtgggctgtgggtgcatggttttgctggtcgcacccatggcaattaagaactggttcacgggaaaccctgggagacttactgtgcttaccacaagcgggagtgggtaactgcttgatctgaagtatagcttgaccctttcctaggcaccggtggcgagggtgggcgtgatggagttgggtcggccggggtgtccggttgtccagctgccagatttaccgcggcgcaagaggggaccgcccattgcccgttgggggtgggggtgaaaccttagcgtggtgtgaatggttaggggagggttatgcggagggtcttgtcatgatttccccctttgcagtatcatggtgatacttcggggcatggcgacatgtgtggaatcttgtcttctaggtacagttgtacacctctggccagagtaaaactattcgaatagtcgtgcccgcggttatgggcgatcaactagattcaccgtgattagtctcaccctagtttagcttaatgaactggtgtagttcaggtggttggttgggcctgttgcaacgtggtgtagcgttggacagtgattggttaatattgcttaatctactacaatttttttactgctttcaacttttgtttttaaatgcctgctttattgcaaaagaacccttagcctcctttggttatatcctgcatcataccttctcttccggtatgacttgttgagtacagtgggtagtactcagtcttgctctcttttcccccacaccagagctgaagatcttccaagttggagctgtcttgttagggttggtttcgtcgctaccgtcaagggatgcctgtggagtggagttgccctgctgcagaagtcaagcgtccaagtttagtttgttttatcttttccgctgcatttgtaatcttttctattttttgtaagacatgggtctgtatgtcaacaattgtcgtttgtgtaccctggctggtcctggacagggatttattgcacattcagcttagaaattctggttcatgaatttctgggcgtgacagagatgagcaggacggagtcatcgagaagcagcagggagcagtggcggttcgacgacaagaggctagtggtgcagacgtcgctgatcatgtggcatatgcaccagaatgacgccgacgccatgatgaagctattggaggaggattccgtgctcatgaatgctcatgactacaacaactgcatgccgcgctccgtggcttgcacaacatcgccgagtgcctaatcgctaacggagacgatgtcgtgggttggatttgggcgtgatgtggcttgggttctgtttgtatggtgtatcaaaatgattcagattagggattgggtttagctatttctggattttgttcggattggatattcttttttgttccgcgatgattcgatgcttgtttgacaaatttgcagcttcttctttgaagctatgcttagttatcaaatgagtgttcctacaatgaatccattgtcgagttttagccttgtttgctgatgaggacatcacttcatcggatacacacataatttcacaagttccaataacaagtcaaagtcctgttcggcctccaaaggcagagacaacattgacttcgaacggacctagcgccttcatgccaactccgatttggatgatctagtacttgttggaaagcctatctcctcacctttcaaacccatctgatatcatatcaaaattcatcctaaatcaatgggaattgtcaaaataatattgtgttattgctgaaaccgaacttgtgccttgggccttgtaatatactagtcccatctcagaagtgtctctatccacctccatgaaccaacacctatctctagctttattttcatctataaatagctttgtacacctaaaaaacaattgggttttatttagttgaatttttccaagtgctatttaccttgtctctaatccttgttcgattagttggcgactatagattcagagaccccaatagttggtgtgttgatttgccgggtagattatatctaccacttcaattgcaactacttcgttgtgcttaattacctattcgcaatatttagatcgtatattatcttgttcttgcaatgttctctcgtttgcattgcagggattatcaaccacgcgtcacggttggtatgacatcgtttgtggtgtagtgattgcacgacatcctgaacctgttctggttggtagccacgtcgcaaatatcacattcgataaaagcgagagttatcctctcaccagaagatcgggcccgagagagggtgtcatcggttggtatcagatcgtcaattgcttggtgaggattatgtgctgggtgttgttctacagtgtttctagaggagctcatctatgtgcctatcattgagattagattgatatctctactgacagccagacatgatgtgcacatgaaaaatagaagatcagccttctatacggtggttttgtttctgaaatcttgaaattgttgcgtgaccatttccttcctgccgagatttccgcatgcaattttttcctttgatcgctatctcgtttaatttggtaccaacctctccttcaatatcaaccaacggatgaatatttccatagcagtacacatgcgcatgcattccactatgtccaccgagtagccgcttttcttttcggttttctttaaattggtttgtaattttataagccgattgttggcttctccttgcgcagaacagctgcttgtaaaaaaaagagagaaacaaaaagaaaagaaaaggcagaaggtgaaaaaaagaagaaagaaagaaaagagctgcaccaaaattttcagtaaaaagaaaaaattaataaaaaagcgtggaatttttttcaagttgttggatttcctagagggagttatttaatataatcggcttgttatagtctgagtgttgatcatttgcttttttgagctagggttaagtctagaccagggccgttcctaggccatggcgagaggggcgacggaggccccccaaaccatgtatatgtgtatgttttgtttgagacccattagagactagggcagcagtcaacacaagagtatgcacgtaatcctcgcgtatcttgcagtcttgcctccattcctcgtcttctcgttcctctcacaaccccagctccccaagcgactgcactaaatccagaaatgaagaataatagcccaatttcgaacaagtttgtctttaatttcttcaatgtgcaatggaactttctctcgtgcgcgattaaaacagtatggcttattagcgcataattaattagaagtatcagctataaaaacttacataaatgacaaatatatatttttaaataactttcatgtacaaaccttaatagttcgaaaaacatatatataaaaaatgagggattataaattacaaacattacccaccccaaagagtgtagacagccaatagcacttacctgtagtatggcagtgtttagtaacacaggctctattttctatcctcctacgactgagccactcatcagcatcacccaaaatttttaaatgcaaacttttagtccgttctaagttccactagttgttggtacggtatcattactcgatctcattttgttttgtcttgaagaaactccaaactttatctaattaattaatcaaacaagaatcctacgatgaattaagcccatgaatcctggagtgataattcgtcccgatacagtgatatatattatcggataatcattttttttattgcatcgatcattaattaaaccacttcgatgctcattggagctgtagcctgtagaccccaatttttttatttatagtaattaataatttacaaattaaatatgtggtaaataaggctctgttcgttaggtggagataggagagattgtgtctcgttttccgcgcgcacgcttttcaaactactaaacggtgcgttttttgcaaaaaattttaataggaaagttgctttaaaaaatcatattaatccatttttggaatttaaaatagttaatactcaattaatcatgagctaatggctcacctcgttttgcatatcttcccaatctcctcaatccccttctcctcaaacactccctaagagctcttatttagtaaaataggatggacactaactctaatagcgtccaggagtggacgctgttcacctcgacgtccacctctggacgttgttcatctcagcgtccactgtctggcgccgcctaccaacctatatcccataaaatacagaaagaaaaaactacgtatacccatatatctcgtcgttaacacaaacaactggagtatttggtaggcgacgctcgcctcccaggcaggattggactaagcggcagcccttgaaattttccgtttgtcgcctgccgccctcggcatctcgctgtaatgaaggcatgaagcttccgtccatgaagctttcgtttccgccgttcacctgtgccgccgatggcaggcccaggctgggaacaggcacaatgagttcttgtgcgttaatcgttattgaagaagctcacgcactgcctcgcaactcagatgaaatacagatgtaactatttttgtgggtattcacatgaagcagaagaaaaataagtccattcatataattgagtatttcggatttcagaatacgtgcatgcttccaaacttcacactacagaagaatatcacaacagtaccaaacaatagatcatatgactatgggcgtgtaagtaattcagtactagtacacatagaaccaatcaaacagaaaagagtcatagaaagtctgaaactctcatgaatacacatacatatgcttctaaactaaaacacatctttgagctacaacagcaccattaactacaaccccaggcaaaaattataacttagatttccactactaatcctaaaattacttgtcgtttctaaaagaactgatagatatggttcttgtgtccttggcggatatcgccatatcaggctcccgacaaggcggggacagcagcggcttcccacttcccagtctcctcctgttggatcggcggcagtaagccagtaactgccctaggccctagcctcgaatcctcgatgccgcaccagttctccctgcagggattcctcgcttctatttctcgtatatagaatggatatggctttgggatagttaggctgcacaacatagctggacgctgaggtgaacgacgtccagacctggtcgctatggaaagcaacgtcctttttttggacgctattagaattagcgtccatcctattttgctaaatataggatatttgctaaataccggtcgttcgtaagaatattttatcctctgtatcaagagagaaatattatctctgctctaaagtaaataaaggacttacgtaggaatttcatatgatttaaatcctataggaaatttttctattagccctttgattcaaaggattgaagtttttcaaatcctatgtaatgacacagattcaaaggattgaagtttttcaaatcctatgtaatgacacattgcatgtggattttagaggaaacttagcaagagctccaacctcttggaaaatttcctttgagtctatctcccgcatctaattcctgcgttttttcttgcggtctaatcaaatgatcattcctgagtttttttatgtgttttacaatcctctgttttacacttcaattcctatcagaatcatgtgtttctccctttttctctattttttcaaccctacgattcaaagggatcctaaaacaaagcaatttttacatttgaaaaacatatcttctacgctatacgcatagatgatcataagtaactactttgaaacagagagggagtagtggccgatgatatacgcttagaaatatacaaggccgacggtttttataggtggccgatggtataaacacctaggtaaaaattaggatcttgtagggtacgaatttttattatttttaaactttttaatgatttaatttacaaaatagatcattacttatttctaaatcatctttttggccacacaaccccaaaacaataacagcaatttgtcttaccacgtggcgtgaccaaaagtttaagatttgaaaataagtttagaattggtttattttttaattgaaaattaaaaaggttcaagaaaatataaatagaaaatcgtagtgtgctaccttctttcacattctctttctgtctatgattttgataacgtgacaatgctaggagactgcatgtcacactgttgacatacaaaatggtttttttggtttgttaagttcatagaaaaatctatgcatcaatcattaattatatcttttttaaaagggcaaaagctttgcatcgtttgtattgatagggaaggataatatatgcaaaacacatcaaattttaataagcttattattttgtcttttgtatatatttccctggtcgagtcaatctcctgtaaaaaaatatgacatcagcatctttggcatatattctcttctaaatatttctaactcaactttagctctatatatacgtagtttgtgttcttcccttcttttccaactcacctatctcttttttccgcgtgcacgtttttcaaacagctaaacagttttttttaagtttcctataaaaaagttgctttaaaaatcatattaatctatttttttaaaaaaaatagttaatatttaattaatcatgtgctaatgagtcgttctgttctgtgtgcctgggagatgagttcccaactcatcgagaagaatatagccgtagagtcagcccatcgaacttaatttggagcttagctcccatcctcaattgtctacataccacctctatcatatatagctagaggcatcaccgtacaagcaatcttcacaaaatagtggtccctaacaaaatatacataatttgcattttgtacattttccattttcataccagtctcacccggactacatacatcctcccaacaatcatatacttgattcttttctcatggtttgaccccaacacccaagtacccaacacaaattaagagaacacaatcggaagcttacacgttgtttgtcacacattatttaccgtttagcagtttgaaaagcgtgcgtgcgaaaatgagagagataagttgaaaaccccagcgcaacacagcttttagtcgacacgacaaacaaattccgatgtaatcaggctgatagctttattactaatttaggtctattgtatatacactcttagcaaggtgaaagagaccatttgaagcaccacatttcctgcatttgtacgcgttgaaacacacatgacgtctggatatggacattgagcatgtgcaaagccgatgtaagcaagggtttttacaaattaaataacacgcgaaagaaaattaaacaaatggagaagggccactcagctgtctgttcagctctcacatgatcctccacccactagctttttttctaagcaaaaagggcacaaaaaaaccccaattaaactaatcccatttgtcaatttgctagcatcaccaaacgccacacacacacacacacacacacagagatagagattgggagatggtagacagataagagaggccaggctgaattttccatgcaccaatcatttgcccagctcccaatacctacctcagcaccaaagtgcaagaaacccaattattatatattttctacaattaattgacttgtgtttgtgttagagcaaggattacagtgagctaagtgagctataagcaagctaaatgcttatgtgaaaaagagagataaaaaaaatagggagtgttggctctcatgcaagagctagctccacacaagctccaagaaataagcattaaattcataaagagataaagagagatgatgaaaaaaataaatcctactccctccatctacttttgatagtcatatttcatcttggcacacagaccaaggataagtaattctacttatcatccatataaacatgctactagtcattcctcgtaaacaagcgattcatttatatttacgtttctcaatgcccatgtagccaatcatgtgtggaagaatggagagtcatgcattaaatctgagaaagtcattaaaatgataagttgttgaagtgaaatatgcttatcaaaaataaaatttttagatttggaaatatgactatcaaaagtagatggagggagtatcttatgatgaaagcataagctattatacatgttagctttaacattggcttatagtaagtagtgggctatactactaaacttgctcttaatgctatgatagtttgatatagtgctaacaagtcagtggaaaaataaactaaacacctataaattatcatggataaaacatctatgtgtgctgctatcgatttaaaagccaagaagactaaaaataagttgataaaaaaaatctcaaaattaactttaaaaattaagttttaaaagcgagtataataaatgatgaaagcagactctaaaaattaccaaatcaaatttatgcttaggttaagaatggagaagaggagagagaaaaaaaatcaggttatagatttaagatgaaaatcaggttacaatatatcatatatttataacatggatagactattaaactggttgaaaatgacgcgttaatttttagagcgtgctctaaaacagcaagcaaacgaccagattctaatgttttcatgatttaagccgagctaggagagcataattgagacgttgtactttaattccatactaaacgagttaattaataaggctctgttcttttggttgagttgggaacccatccctccggtacggaaaacgaagcagtctattagcacgtgattaattaattatttgctaatttttttttcaaaaatggatcaatataatttttttaagcaactttcgtatataaactttttgcaaaaaacacaccgtttagcagtttgaaaagcgtgcgcgcggaaaatgagatgggggagttgggaactccagtaaacgaacagagcctaagagttgaactcaattagagcaagtttaatagtatagccaactaatagctctaattcgtatatatccaatctaatagtttatcaatagttatataatacaccattaatgtatgatcctacatctcatacacacacaatgcattggattctgtgctgcagctggctataaatcctgctttccttctctctcttatcttctctctttcacgtctctttcacatgtgcttacagtcgactcgacttgtagcctgctattgtactcgctactatacgtcgatggggagggagggagggtggctgtagtgtgctaatcacaaataattatcacctactcctagctctgatgacagtagtaagttagggcgtaataatctaacaacagtaagaaaatgacgttgctctgcagtctgcactagtagtaacacgcatcattatggccactgctgttcccatccatctccagattatactacaaccctccaatctataaacacagaagttgaagagagagaaagaagcaatagaggagagagaagagaagaggtcaagaagagaagcaagaggagagaggagaatcgctgcctctgccactggaaagcagcagcagcaggggagaggcagcaggcagcagcagaggagaagcaagaagcaagaaagagagagaaagcgttgggacttttcattggatcctccgcttttgggaggagcagcaaaggtctcgtctttcctctcttcttctcttccttgttgccggcgaggaggaagaagaaagaggaggagatgttcccgcctgggctgatccaccaccggccggacggcggcgaggcggggcgtgcggcggggggagggcccagcctggtgctgaccgccgatcccaagccccgcctccggtggacggccgacctccacgagcgcttcgtcgacgccgtcgcccagctcggcggccccgagagtgagatttcccccttgcttctctcccccccattctctccgatctccggtagcttagctcccccattggagaggcggcgcattggcgttgcgcttgcgcggttggttggtgggtgggtgggttgctccttcgttcttggtggtggtggtggtggttcgcgccaaagctcggattgggagcggagatttcggcgcgggatttggggggcattgttttgtttgttcggagattcaggaaatgctttggatcttttcgtttggttataataagtcttcgattttggcaaggagagaaatgcccgcttggccagcgcttagggaagcggatttagcccgctctaggctggttttggtgtgatttggaggggaaacttgtacccattagttgtttacaaattacaagtttggggagtttactgattggaggtgaaaaatcgaggtcggctactgatttgagctgcttgcttgtcctgtactttaacgaattctgcaccggtagcaatcaagagtgttttgttaatacgaaattggtggtggtttcgggtgttagaattgggacaaggatgagggagaagtttctgctcattttgggtttatttcagtggtttgtaagtgaacgcagtgggataaatacagcgatttcgcaatttcccacatgatgaggtgcagtatctcacattggcacaggcatagagcagatcagtatttggagaaaatggctcattcggtttaaaggattttcataggattattgtaggaattgaatccttaggaatttttcctatatgcatcattcgtttcataggaatggatcctaccaaattcctaaggattgtagtctttcaagctaattctgtaggattcttagcatgaggtgagacctcttaactttacctattcctttgatttggaattcctatgaaccgaataagccctaaggtagcggcttgattgttgccaccaacacggttcacctgctatgcttagtacttcagaaagacatctgcctagcttgcataggtgtgcaactcccgcctcacctgtatagccaatcgttccacctagagccacctgattggtgattaggcgttaggcgcttgccaccgtatataatcaacctagagtatgcattgaatgttttatcatataatcatgtttttggtggcaaagggtattcagaagcagaagttataaaggattgattactctagcatctgatgtatgaatcttggttcaacacgtaaccatggagctgtttgcactagtgaacagtaatccctgcacacatcatatttttaacctgactatattacatagttgactgatagggtttgtgcataagtttttcgttcatgtttgaattttgtgagatgggtgctatgcattgtctgtgctagtctatgcctaaaactttgtaatgactaatcactaatggttgatgcatgacttatgcagaggccggaataaaggcattcatttatcttaaaaacaacatagttgttcaaagatgatactgtttgatttttcttgggcgcagtctaggcatttttggtgtatttcttagaatctggtgcttacatgccaaaatgcttaacttatggtatagagctataatagttctatactgatttagtttagcttgatgctttgattttagtggactgtggtgtctgcaagaagtctttgattcaatcattaaaatttattaaggacatacagtgaatagaagtggctgtatttttctcctttgaggtcttactcaattttgttgacatgagtttagttcaatttactactgtcaattttcttgggacttgtttcaaatttcacagaactatgcaaatttacatatttaagccacaatatcaccaaactatagatttaacaccaaatttatcacaaattttggcctgtagttttctgtaatttactctattttctttataaaaattcaaggattcacttttacctttaggttctaattattttgatgaaccatttaaatctcagaccaacattacaagtgcttctgtgattactacctccgtccataaaaggccttagttttagctatgcacctggacaactgtctatacaaagaaaagcgtgtattgtactgttccttattttcttgtaggaggtataatcagtagcacagcgaaactcacactagatcaaaattctaaatcttaattgaatcatgtaggtagtctaaaaaaggttgtgcctgtggctttgtgcaccttctagtgcagtccctgggacaattattccattatctaaaaaaagtaaatgttggcactctaaattgctggtgcagtgcctgggataattattccattatctaaaaaaagtaaatgttggcactctaaattgctggtttatcattagtcaattgctaagggaatcaagatggattttttttacattttagacctttctaaaaacttattttacaaatagacccctaaaaaacttattccaggaatagacccttttcgcgacaccaatgtcattggcgccgtggtccaacataatgatgccaaagatattaccgccgtccccctttacattagtgagttagcttctgtggggatgctagggggacggtgccaatgtcattggcgccatcatgttggactacagcgtcaatgatgttggcaccgcaaaaagggtctattcctggagtaagtttttttggggtctatttgtaaaataagtttcccaaaaggtctaaaatgtgaaaaatccaggggaatccagtaaaacagtttaagatttgatttcattatatatttttaaattgagtactcaatgcatgattatcttgcagaagcaacacctaaaactatcttgaggacaatgggtgtgaaggggctcactcttttccacttgaagagtcatcttcaggtaattcataatacttttgcatgtctgcaaagtttgaaatacagctgtttaagtttgatcttcctcgaccagaaatatagactggggaaacaatctggaaaagaggcatcggagcaatctaaagatggtaagttacacaaagcaatctactgacctcactgttaatttcgattaatattccaacttccaagtcttgctgcaacaattccaatttgttcacattgtggaagttcattctgaagtcatgcaactatcctaccattgatctgtggacatgttaaatacggctctgctcatgaactggtgtcttatgaagttggttgatcatcgattgcaatttgatcaatattgatgtattgcaaggaatcactatgtagctaacttcttgaaaagattggagattgcttgaagttatatgatttggagatggtagcttgggtttactggtgttaagtttggatgcatcttgggaggaatcaattggtagcaacttcttaaaagaccagggattgctggaaatcgtatggattggagatggcagctatgttaacagtgttatgaatttcctttaagcttaccataaatctctgttctggggcaccagtctgtagggacatgaaggaatagagtggacctgatgtgggaaataatgggaggattcgtagttgagtggtctgcaggcaaccaaggactgaatggtgagagggaatctgtatgtggaggagtattttacgtcagtggacaagcttttctttttcagggactagctatatttttgacttcacatttttcaccataaaatagtcaattgttttttacattgtaaattacatatatttacactgtattacacaaatttacactgtagttttcaaaacttacattgtaaattccaatatttacaccataatttttatataggatttacagtgtagtagaagcaaaccagaaatcgactgataggtaaacacccatgtacctgcaaaactagcactaacaggtgcgctgtgtacaaataccaaagactccatgcataaaaaactgactgaaatctatcaatatttgtgtcgccacaaatatagcgattccatatgggtatatgcaaattcgtagtggcacacatgctgatccagaagctataggtcctgtccagtagggagaatttgtgggttgtacttttgccttgtgtagaaaaagttcagtcttgagttaaatttagccccagtaataattgcatattgctaagtaggagtactaacatgaataatcacatcaaggttcatcagtgggaaatggaagagaaattatacacaaaatgttggcaatattaagcgtagtgttggtacatgtatcgttgaattgcagtttattgtaattgtttcaaatggaaacgtttgtagattgaatttgctcatctagtcaaattctggactttgttatgcagatatgtctttttgacttgaaaaccacacttttaagagttcttttgaccttttactaacctctgacctctgctatggtttgcagcatcctatcttctagatgcccaaggtggaatgagtgtgtcgcctagagtttctactcaagatgttaaagagtaagctccatgggatactcatcctggacatttgtttctccatctggcaaatacgaatattttaataatagtgctcgtgttgtgctagtttaaaaagagttaaaatgtcacatgtacttgttacagaaatcaagaggtcaaggaagcattgcgagctcagatggaaatgcaacgaagactgcatgaacaagtggaggtaactttgaaagcttgatccgtcataatattctttggtttttatacatgccattagcaagaaagaagagctagtgctcaccaacttcagtatttgctacataagaataaagccctcaagctttaaacaaatgatataccgtgaggctgatacttcaccaatattcagaacagccggtccttcaggatttgtgcgctgcatctcgtgttaccgaaaaatgtggaacacacttgttcattatcatttctacaactgcacttttaacacttagcatgccacacaatatgtcaacatgaaaagctctattgaagatctgttagttttaagattttcattgtaatcaggaatacattgtccaacacacaatagttgactatttcattttcccatgatcaggtccagaagcatgtgcagatcagaatggaagcctaccagaagtacatcgacactttactagagaaggcatgcaagatcgtctccgagcagcttgcctcaagcggcttcagcatctcggacaatgatctcccggagctctctggtggtgtcatgtgcggctccgctgacacattgagctcctccatcttccaccagctctctgtcagcccaatcaacctgcatagtcctgagggcaagccgacgccctcgggcatcgaaggccaaatgatcctccagaagtcacctgagcttaagcgcaagtcttgctgagccgtgtcgttcgacgcaatctggatgtgcaaacaccagttttcttgtcatgggggtagtcatgtcgaatttcggaattcgaatttcggtaagaaggggggatgctctgccaatcttgtagaggccatcttgttctctggctaatgcatgccaacattgtcaagtagcaaggttttctctcttatgttatcaatccaatcagcatatcttatataaaatgcctaatgtgctagatcaagtgccttccttgataaataatattattaccgtgagatttgggttctgacatgattaactgatatatccatctgaaacaatttcgaatatcagttcctagctttctatgcaaataggggaatgcaaaatgctcctgtcgtttttgtctacacatgtaccacatagagtcctcattgtctaaactgcttcagaaaacacttcatttcttagaatcagcaaataaaatttgatcaatatccaaatactgtatgcaccatcaataataaaaaaaatatttgaatttgtaagtcaacaggaacaaattatttcttttatagttgaaagcagtagcatttcgtaggctacatcatctttcttaaacatgacttgcaaattgaatggctcttgccacttggtatattcaattattgtccttctaaatttcatttcttcctcaaaatttcagtcgtaagttgtacatcaccatcatcattttcacttggtatattgctgtgtttggtcacctacatgatctccaagatgaaaccatactactttgaatcataacatgttggaataaatacacagaaaagtatactggagttttttttttttttgcaaattacaatttataaacattatttgcacacgaccaatctaaacacttcttggaacacccatgcagagctgaaagttgctactaccttctacatattatatcatcaggccaaagttagagaatcatggtctcacactcactaaaacaaaaacaatacaaaaggttccaacaaggaaagctttgtcctcgtgtcacaccctaaaaatcttaaatatataaattgttgtttaattggaattattagaatttgattttaaaagcctagaagagaagatctaattttaaataataaattccaatataaaagtgggccagataaatttttattaaatacttctcttgattctatagttcctagatttttctgggatttatttgagccaaggaagtatttttaataaatagaattgcatttcatgaataatttaaattgaaaaagttttaaaaatctctcttttggctttgggccaaaagtcagcccaaaaccctctctctctcctccctggcccaagtcgacccgcagccgagcgccgctcgtgtgcgtgcgcgcgtccgccgctgacaggtggggcccacctatcggacccgtcgtcctcctcgcgcccgaaccctaaccgtgcagcgccgccgccgcccttccaattcgaccgcgcctttccttctccggtgaaatcaatagaggggaaatgatcgccttgatctcctctatcttttctcttttggaatcatcgcctaattcggtttggaaatcatcggattcgagtttgattcggattcgttttcttctcccgagccctaactttccatcgccgtcgccggtcaccgtgggccttcgtcgccgccccctagccgctttaaaaggacccccaagcccttcgctacccgccgccaccctcgccttcgcctctcgccgccggtagagccctagcaccgtgcagcctagcgctgccgtcgccgccgtttgtccaaccgtgcgtcgcccccgctccggtcgtcatcgtcgctcagggaagccgccgtcgtgatcgtcaagtcgtcgccgacctcgtccgcccctccgtcgtcgccttaggtcaccggagcaccgccgtcgtcgtcaagccgaaggtcgccgccgcttcttcctcgccgccgtcgccgtccgttgatcttccgccgccgttttggtcaccggtgagttcgccgcgtcgcccgcaacccgtaggtgctgtccgttcgcgccgccgcgccgtcgttcgccggcgagcatgcgccgcccgagccgtcgtcggtgatgacgtcaccgctgacgtcatcgtcgccgtgtcccgtggaccgccgtgaaccctagccgctgacgcaataatcccctttttcttttcaaaaataattcattattgcatcataattcaattaaaatctatataaatgatttaatccgattaaatctttgaaaattcataactaattcatcttagctcgaatttagttggttcaagtctctaaatttttctaaaattgagacctacatgttaaaaatatccacatgtactgttcatgcttgtttatgtgctgttttggtgattttgttcttttctctttagattccgacgttcccggagagtccgaatttgcaggagaagactttaaagagttccaaggctagcaaggcaagtcacacagatcccaaacgaccctttgagcatattgatcccgtttaaagctattgtttctattcaactattgcatttattttcgaatgtcattgggtcgaaataacctattgccttgttatagcccttttgctattgattccctattctttgtcacttggttaataatttgattagctagaacattatatggttttagctaaagtgattaggatgcttagccatgcttagagacactagctcacataaatgggataacttatgatttactactacttaatgatggcttaatgatagctcatgatggttaatcatgattggttaattaattaatttgccaactaaaatctgataatggtgggttgtgagcacatggttttgatggtcgtgctcatgacaattaaggaccggttcacgatttttagttgtgaaacattaatcgtgccaaccacaagccagcgtgggcaacggctttactttctgtatagtatggttcatagtagagcaccagactgtgaagtggcggagataaggccacgggggtcgctggggagtccatgccttgtttaagggggtgattatgatccgggaacggtgcactgctttgaattgtgttatgcaggaggtattgtcacaatctctattcgggtacttgtcaagtatcgcgacgcatggttgacatgatgttgaggttgtgtcttgtgggtacagtggtacacctctgatcagagtttaaactattcgaatagccgtgcccgaggttatgagcgggtctaacaatgtctttagtgattagtctcacacttctcactatattaaatgatgatgttaataacttgtttagctcctggtttggaatggtatattcctggtttggagatagaactgtgcagccgggattggttgttcagaatggttggccctatgcaacacgggtgtgttgtatagtgttgatttaatattgtttaattactcaactgttttactattctctcaattgcttattaaatgctgtttatgcaaatgagcctatattatgccatcatttgttatccattgcacttgcatatttgctgcgtggcttgctgagtatgtcatatactcatcttgcaatcattcatcagaggaggagttctacagtgatgctgatggtgtggatgattaggcgtagccctggtcaagctgcctgtggagaggagtcgcctgcgctatttcttttattttccactgcttagaactttattgtttgagaggaactatctacctctataatgactttatattcgcttattaattagagtaataattgtactctattatcaatttgttattgtgtgcctcggctgattcctagacgagggtttacacacatgtaagcgtttggaattttggatagaaattccgggcgtgacacctcgtcttcaccttaatccccatttgtttatgccctaatgcccaattaaccccttccagcacatactaagcattacagaaacgaagaagagacagagaaaccatttctcacaagtgatgactagccctagggacaacctcgaaggaatattccgggcatctttttctaaagattcctgcaacggatgcctccaaatccaaaaaatactataatttcgggcaactttcgacaacgaccagctcatttacaatttgcaaaccagtagtgaattaggtgtctaagatttaaagatgaaatcgatgcctctcccatgcaagtgatctctttatagcttgcaacagatgtcatgcatggctccaacgagcagtacaagatagtagaaaactagaaattaatattgcaccggatataccttagtttcaagattttgcatggacagttccaattcttgttcctctccaaccttgttgagggtttcgcatttgtacgactttctcgattctaactactttcgagtgctggcatgtgcatcaatagacgataagggctttgctggaatgctcggaatttgaggatttttatcggaattgtgcaaaaaggaaaatcctttaaatttcctggatatatggtttgaatttttttggaagctttatgatcctacgtgatttttttaacgcagaattcctacatgactattgtgaagccatgaaagaaatttgaaaatatactttattttttcatatcttgcgtttatatacctacctgtgattaatttgtaaaaatatacctaattcgcggaacggatgggtgggagcgaggacgaaccgcatactggggatgtgggagcggaatccgagccggtcgcgcggaactgggatgcgcaaccgagccggtcccacatgactggactgcgggactgagtcggtaccgcggctctgatgtgcgggagcgatggagcatgtgggatagcgagtgaacgcggcggtgccgcagaacggtggcgcgggactgacgctgtcccgtgtttccaacacgcggaaccgagcaggccgcgtgttgtttgagatgtgttcttcctctaatttttcctactcatccacgcgcacgcttttcaaactcctaaatggtgtattttttaaaaaaagtttctatacgaaagttgtttaaaaaatcatattaatatatttttgaaaaaaaagctaatacttaattaattatgtggtaatggtctgctccgttttccgtgcataggagatcagatccaattcgggaaccgagatagggggcggcatgtgggagagccggtcccgcacatctggcatgcgggagcattgccgcgctcacccagtccatgggaccggcgcggtactgcatccccagcctgcgggaccggctggttcgtcctcactcccgcgcaaccgttccgcggattgggtatatttttggaaattaatcacagccaggtatataaacgcaaaatatgagaaaataaagtatattttcaaatttctctcgtgaagcaatattctacacatatggatatgatgtacttcagtatacatgttctccatattaaaatctgctgacatggaaattaaaagggaaaataaacaaaatcaacttgatcatgggccatttcagaacgcaaaacttttatgaggaacaacatataactcatttatccctaatatttgcatcgaccttttctttagttgaataaaaatccataacatcattatcatggcagaaaagaaaacgtaaccataaaagtggtagagaattgtagctcggaacacatgtgcaaaaaaactatggatcttccatcgagcaaccatgttgtgctcctattttgaaaagaaaatgctatgattcagctgaccatttagcctatattagaaaagaagaaatttccccaattcttacagccattgaagatgccttttagttttcttatatgtaaatagcacatatgaggaaaaacagttgtggagcgattgctcggctatccttggcaacagcctaggcttgtcagcaaatgcacaatataatttttttaatgttaatattaaaattgaaaatagaatttccctaataactactccaacaaacttaaatttgtatgaactctaaaaaggccatggctctgccattaaggaaaagcgatttacggtggccagcaagtcgttgaaatgagttcttttaataaataagtttttcctaaaaaatgtgaaataatcttgttatattatattatttccaatattactggtgtgataaaataatactacgacactagtaaaatactatttgtggctaaggtttaataatatatgcggtgtttgtcaacattatggctaaaacatttatttaaaaatagtagagaatccattttaaaattttattaaatatgttcaaaaaataaaaactcccattcaaagtgcgcgttctcttgaaagtgttcatagaaaagccactcggtagtcggtacccttcctagcagcaagctttgaccatttactactttggacgtatagaaatcttccacgtggcacaatccaacggcctgcacgccgagaggagacgccatggcccattggccagcgagtcgagactcgagagcaggtgtgctcgttgtctccttcctgcgtatgaaaattcagcttgcacccactaaaatcgccatattatgaacatggatgattaatcatgtccaggttcatggaaggcctctcgttgcatcaggtttgtctatgttcatgatgcatcaggttatgaacatgtctatgttcatgaggcatcatatcaggtttaaacttatacaatgtcaaaagcttgaccttatttgttggtctgttgagttgagcagctcgaggccagcctttaaaccattgttaatctacttagagcaagtttaatagtagagataactatgagcttatagctaatattagagtttaatgcaactttatatcacatttattaccgatgtttcgctatggatcaccttttaaccaatattttttactttgaaccagatatttttacctttgtggtattttagaccaccctcaacttttttattcatttacatccaactcgtcgtatgctaaaaaatgtcttacatataactatgagagttcattgatgagtaggtgtcgacatacctgagatcgttcatatggttgagaagagagacaagtggtccaaagtgaaaacatagaaaataaaaatatggctcaaggtaaaatttactctataaacaattcgacttggcataagtgctcgcatttacgacttgtaggcgatgaatccgtcaatgcgatgacatgacagtaagacgtctatagttccttcgtcaatcttaaaatatgatggtccagcctattagagatgctcatagagatagagcatgcacatacgtgttcatagaggtaggtgtgtactcatgtgagcacctgcgttataccctatttcttttataaaaaaaatactactacccccgttctaaaatataacaaattctattttgggaggagtagatttgccgacccaatataatatacaaaaacccagggtccaaaccgaaaaaaaaggtgtatcatgttttttaactatgggcaagtcattctatagcgtagtaggcccaggtagaaaggctggcacaggcacccagcagcagagggccacacacacctacgcctacgcggggaagagaagacgagacaagaagaggagaggagagaagagaatctcgtggaattctctccccctctcctcgccgctccaagaacccaccaatccttcccc

SEQ ID NO: 45656 - DNA, 3054 bp, Oryza sativa
  unsure (1)..(3054): unsure at all n locations
tttgctttgatttcatctttttctactgtgcaattgaagggcatcaagaacatcatgtatcaaagctaatttcatatgtctggcgataggttgtgtgggttgctcccatggagctctttaccttttttttgcctggttataaattgagagcaaaataaataaatactaatggatgataattcgattgatgcaccatgcaagctgtggatgcaagtattcgccttaactatgtatgctggctggttttctgttagagctttgcatctaccatttttatgggtcactctatttgcctaaccttccatgtaaagcagtatggtatgatgaatcaaattggatagatgtattggacagcgttgcacacgctagttttcttggtacaaatggcattttccttgtctatactagtactagtagttctttcctctgcaacaatgaaaacttccctatgtagttaagctcacaaattctagaaacacttgtgactgtcttagagatggacagaaaactgccactgcaactttgcactgattagttgtgtttttgtacttttatcaccggcaaacattgtttgtgatcgctgtttgtaaaactgatatctggctctctgatgtattttttcccaggtgatgatcattgtattaaccaaaacctgaacctagtgttggccctactgtaataattcagtcacttatcagcagcatatggaattaggtggcaacaatatgggcccagataatggagcaaacaacaattccaacttggctgcaaggcaacgcttacggtggacaaatgagctgcacgaacgatttgttgaggctgttactcaacttggtggtcctgatagtatgtattcatactgcaattgttgcaattatgttttcatttattcatttatttgattttatcaaacttatatagagactgttctgtatgatgcttttcttggagacaataactttactgcatgcatgtaatcatgctctcttaccattgaacttattaactgtaaatttctgcttctgctaacacttgaattcctcaaatgcaacaggagcaactccgaaaggagttctaagaattatgggtgtacaagggttgacgatataccatgtgaaaagtcatttgcaggtacatcttgttacagtgtgtcactttccctttaatattttttgtagctagtattttttttatcctatttaattcccctcctgtttctagaaatacaggcttgcaaagtacattcccgactcttcagctgatggtacgcggacaatctcttcatcatgcattgcattttttagtactctggcattcttttagcttatcctaatttttgtctccttggtaggtaacaaggctgaaaacaaagaccctggagatttgcttgctggacttgagggatcctcgtaagtatacataagcctaattatttctccgatatcatatcagtcgttttgtaaaaagaaaaaagaaatgctactgacatactgttatggtatgaaatggaagtatgctggtttgccacattttaccatttaccagtaaatctaccatgaccaactattgaaattattaccattgttgtttgcatgctgccatgctgctcggcaaatatcgctttctagattgtagtccctctgtagttgaaagtatcaaggaataataggctgctgctggattgagattgaaactactactagtattttacacataatttcttctgcccaccatttttggctttcaacatcctcaagaacataaatcctagatactagaaaacaacaaaatatgtgaaataacttaagtctgattaatatgctttttccttttagttgaaaaaattaagtcatttgttattgtgctttctatttatcttctgtaagatttcaatgcctatttatcttttcaatggacagttccattatgttactgttcgattggtgctgttctccacctcaatagtcaatattcatcgtgatattttttttgtacagtggcttacagatatctgaagctctgaagctgcagatggaggtccaaaagcgtctacatgaacagttagaagtaagtttttgtggaagttcctttcagcataaaattgttagcttctaacatttgtactccatccttatatatttattaagcctattccgaagttactaaaatattccaaatctatgcaaagaaattgttctggatgcacatattcttcaaatctttgtgaaatatccagcaaagagcaggccctaatgatatgataaacattctcttcaggtacaaaggcagctgcagttgcgcattgaggcgcagggcaagtacctcaagaagatcattgaggagcagcagcgtctcggtggagtgaaatctgaaacacctgctgctggtgcttccgtcacattgccaagcgatcagttccctgattccgaaagaactgacccctcgactcctgcacctacatctgaatctccaactcaaggtgtaccttcgaatagggacaatggaggacaaaacgaagcaaccaagagcccccagcgcgatgattctctgtcccgccatgaaccactaacccctgattccaactgtcagcctggttctcctaccgctagtccaaagcatgagagggcagcaaagaggcaacgaggtaatggtgcagagttctcggaaactgacttcgcccttcctcattctatcttcgagtcgagttcggggtcagagttccaacaatgttccatgtcctactcaggtcattagcatctggtgatactcctcacagcatcttcgctagcttgttcgagacgaagtaatgatctaagatccgtgttgtagctctcagtagtatatttctaagtcccaatggagatgttggtagacaaaaatgttgtaggtgttcagatgattgtttacatgatactacatatgacagctatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45657 - DNA, 816 bp, Oryza sativa
tcacaacttcagtttgtccatcagtttggagatgacaagtagtcaaaacaaaagcttagtccccaatttggccgacaaagttctccaaaaatagctaagaaatttagtgtcacgatcagaaacaattgtgtttcgcacaccatgcaagtgaacaatttctcgaaagaacaaatcagcgatatgagtagcatcatcagttttatgatatggtataaaatgtgccatttcagaaaatatatccacaaccacaaaaatgctatcacgccccctcttagtcctaggcaatcccaacacaaaatctattgaaatatcttcccaagaaacagtaggaacagagagaggcatatacaaaccatgtggatttaagcgtgacttagccttttgacatgtagtgcagcgagcaacgaatctctccatatctcttctcatatttggccaaaagaaatgactagcaaggatgtcctccgtcttcttggcaccaaaatgtcccatcaaaccacctctatgcgcttcctgtaacaacaacaagctaacggagctagctagaaggcatagcctgttagctctaaaaacaatcccatcattgaagatgaatttgttccatgttcttctatccttacaatgcagcaacacatctttaaaatcaacatcatgcgcatatcggtctttaatagtttggaggctaaaaatcttatagtcaagttgtgtgaacaaagtatatctcctagacaatgcatcagcaatgatatttaccttccctttcttgtgtttgataacataaggaaaagaattaattaattcaacccatttagcatg

SEQ ID NO: 45658 - DNA, 1329 bp, Oryza sativa
tgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagttcaggtggatggctgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccccatcccggtatgacttgctgagtacagtgggtagtacttagtcttgctctatttttcccaaccccagaggacgggtatgtgtcagatgaaggtttccccgaggagtaggcttcgtccgtgccgtcgaggatgcctgtggagtggtgttcccgctgcggtttagtcaaggcttaagctccagtttcttttgttttccgctgcatttttgtaagacctttataatgtttgtaagacgtggatctgtatgtcaacattgtcgtttgtgtaccccggctggtcctggacgggggttttaatacacattctgcttggaattctattcgggaatttctgggcgcgacatttgtacgccatatgccatgccatgtgcctcacatagagcccacatgcgccatatgcctgcacactgacccgtgcgtgcaatcgcgagggttagctctaataccatttgtaacagccctccctctagaaccgcgtagcccagcccaaccgacgagcgggctcacttacacataccacctcgcttacactttcgtcctcgcttcgtgtaaaagggttaacccgaaagtgacatggttggaggggagagaccatataagttggtttcactcatgctaaactagcaaggtggtactaaacatgcgcacacagctcacatgggccacacaggccttatcctaaatgggccaggatgtcacaaatatgcaacaagttttccttcttgtagcaaaacaccacccaatccaatcccactagcatcacattcaag

SEQ ID NO: 45659 - DNA, 1013 bp, Oryza sativa
caacacatatacaccatgatccatctttctttggtaccaaaatcaccgcaaccacacatggactaagagactcacatacgtacccttttatcatgcaattcctgaatttgacgctgaacctccttggtttcctcagggttggttcggtatggcgcacagttgggtagtgaagcacctgtgatcaagtcgatttgatgctcaattccacgcactggtggcaaccccggtggtacttccttgggaaacacataagagtactcctaaaaaatgttagaaacagcaggggggaaaagaatactgcatatcgtgaagtgaaaacaaagcatttttgcataccgaagcataggcaaccgaaggtaaggcaatcaattcattaatatcagatttagtagcaagtaaacactttgttttcaaattgatctcagttttcttgccagcagattgggcatttttatgactcccacccttggatttggcagctttagcaacatcagcatgcaaaatatctttaggagacatgggatgcaacacaattttcttatcatggtatagaaaagaatactggtttgacctaccatgatgcatagaatccctgtcaaattgctgaggtctacctagcagaatattacatgcttgcatgggcacaacaccacattcaacatcatcatggtaatttccaattgcaaaattaatgtacactagttttgttacctttgccttaccactgttgttcagccattgatgtagtatggatgtgggtgcggtttggcgctgagttcaagcttctccaccatctcgctgctagccaagttattgcagctacctcaatcaatgatcatgcggcaagaacgttatttgatgacacactttgtttggatcaacgtgtgtcgctgattttgctccgccttcttcatttgtgcgctgaggacacgctgcataatgaggctctcatagtgatccgcatcttcagccccaatatgctcttcaggtggctcattatctacatggtcagc

SEQ ID NO: 45660 - DNA, 1259 bp, Oryza sativa
actacgatttgggagaaacgttgacgatccgactacaaccgtacgagacgttgtgttgcgccttagcgttcaatacacctctccgtggattgttgatcttgccggtgcagatcaaccctattcctgcaagcaaatcgaagaaacaagcaagaacaagataaaagcaatctaatattgcaaataggaatttaatacaaatgataagttggggttccgaagaacaagcagacggacggtctagccgacacgcgcgctgcaagcaagtagcaatggctaaactttaatctatcaaaacccgcgataccctgaaggggtaccaagctatttatagagataggaggaccctagctcgttcgccacctgattggggcgcaccctacatgggccccacttgggccggggtcccagacgaagttacaagcccataggcccattacaggtgtcgcagcaccttgtttctttagttgctgcccactgagatggaatttggtaatgaggcttgatgcattggaaagaggactccgagagctttccatcaagtactcacgggccgaaaacggaggtcgtatggagattcggcggccgtttgaagtcagcagtgtagtaggtggccgaatcggattccagcacttggaggacttgaacttgatatcttgttgttcatccatgatgtgagcaacggatgtatccgtagtagccttagtcacatcattcagtatcaccagtatattcatcctctaaattatcatcgacgtactcaccatcaatgtcatcttcattacgcccaccattgcctctagcattgagataatcaaaatgcctcacaagagcagcaaggctaatgtcaatgcgggcgatcaatgtctccaaccctgtaagcttggtgttggtggtgatctgcgtggactccaattgcccaatcttctcatttgtcacctgcaaatctgcatcaagtccttctgtgtgatgctttgcttgccttgtaaaatattgtatgatgcctttggtgcatggggaatgagacgcaccctcatcatctttatccttggacctgccatggttaataaaacaagagcaacaaaacaacatatgaggtaatttaagccctacggctattgggatgtagcttttgcaaggcgctcactctcagttcactcgaagcctgtctcacaagctcttaccaattcttaccttgcccatagaatgggatggcaacccacaagtctgcaaccatagaacgaggtgtatcggtgccgtag

SEQ ID NO: 45661 - DNA, 845 bp, Oryza sativa
aagcaccctagccaggatgagtatgacgacctcgttggtggtcggatgcatggggggttgatctcgttggtggaaattacagctctcgacgagatctacaattttataggtgataactttttcatttgaaatcttttagatattcaaatctatgatttaaatctcagttaggtaggctcaaatggaactgatatgcattttctaacagaattgatgcgtaggtgagttggtaaaggagagcacgctgtgaaataaatagataggatgatagattaatatttgaacttttaatttggtacgtagaactaatgccacatatggagtggtgacaataatttttattataacgatgtgaagtgttgcaatataatttattaccactaaataaaaatagttgcaataacctattaccacgttatttcttaccatggctagcaatgattttaaaattgtggcaacatgtatctattgtcataattttaatattgatgccacgatttttttcgtggcaacaaatgatttttctagtagtgagagttatggcttagaccttttatggcagatctcggtgcgcagactcctttttttatatatttttagagagagaaaattaatatatgatctatttgaagctgctacatgtatgcgaatgatgcataattactttcgcatcggaggagttgctgccgatctgccttatggatggatcgataaatgtttagatttctctgattattttttacgaggagttattgaatatcaacaacttattatacagaatctcatttttttgaacgagttgagggagttggttttattagcggagaagaaattgtaaattggga

SEQ ID NO: 45662 - DNA, 8404 bp, Oryza sativa
gtgtgtaggccctcactgcccgtgtaataattttatttacgctccagcttgttaaactctgaattgtatcaacttttggtgtacctagcctcctgggacaaggattaatgcacgcacgtaaggaatgcccgttgggttatttccggtcgtgacacgatctccgcccattaaagagaaaaagaacagtccagtttggaaagggaagggtgcatgtggtatccccttgaagtataaaaggaggaccttgcccatagagaggggatggattgattcttgccagattcagagcctagaacgagggagaggttggctctcactttgtagtcccttcatacacagatccaccaaaacacaggagtagggtattacgcttctcagcggcccgaacctgtatacatcgcttgtgtttcatgttctcttgagagcacgcaatctttccacatacagagagagcttgagatctcaccctaagcccccggccgaactggcaaaggggggcctgcgcggtctcccggtgaggagccacgagctccgtcaatgattgtttaaagtaattttcttatataatgttcttagaaagaatttttagtagttgagaaagcgtgcacatggaaaatgaaagggtagaagttggaaaaaaaaggaggctaacaaaggtagaagttggaaaaaaaaaggaggctagcaaatgttacaatggtgtgagatgaaacagaactttaccacaaaataatgtcttagcatggtctaatcatgagaatgcattagaaatcttatctatatattaagtttacggttaagtatacactagtccagcataagttacatatagcatgggcttgatgacatcattttatagtactaccctacttgtaataaaaaaaatagattgcaactaacttagataatgcaatcatcaatatttatttcatcccaaaacaaattcatgttctactttcattcagtaaatggaagcaattgagttggaagcaataaaacctagggcgacagatgtctctgatgcatactaccatatcaagcaacatggcccatttaggttgactttcataccacttattaattacagtttatcttgtagtactatatggaaatggttctgaggaacaatattatagcgtatcaaaactcatccccaaaatactcgtcaaaaatatctctccaagacctctctagtttgaggatttcaacctctccacgtgcccaaaaacaaatacggttgtcgcttcattcatggcaagacaaaaacatccaaattgcgaaatttaaattgtggatggagagagaggatgcaagaactgaaattaaatttcataacttcagaaaatattcattacaaaagtgttgaaagaaaacactcaaagacaagcaaacatacaacttcacatatgtttgattttaaactctccgaaagcggcaaactctcacaaagaggcgcgcaagggacacaacaaacactagcattcatctccctatttataggctaaaccccccaaaaattatccaaatgtccttagggagaaaccctaactcatctgaaatcttagccgtcccactactaccaccactaaaagtcatgcaatctttcgcctcaagccctattatcccataaccactcaatcctatagtagagaaccatgatgtagcactaatagattctttcttaaaaaaagtaaaccataaagaatgttttggaaaaagtgtgtgctacattatttttgcaacaatatctattatatattaaaagcctactaaactttctataaactctctcaacctgccaagtgtcactcctacaaatgcttctaagtcgctatgtggcactctaataaataaaaaaaaaatcatagaatgtaaaaacaaaacaaaacatctatctttcgatttccacttaaatcggtgggcccataattttaaccattagattagaaacaaaacaagtacacggcaagaaaaaggcaagcattggtggttctggatggttctttttctctatagcgctaaccaccgcgacgcacttcattccaaaggaagagatacgcggctgtgttcgttacttgagggttgggaacccatctccctgcacggaaaacggaacagtccattagtgcgtaattaattaagtattagctatttttttaaaaaatagattaatttgtttttttaagcaactttcgtatataaactttttttaaaaaaacacaccatttagccgtttgaaaaacgtgcgcgtgaaaaatgagggagagagattggcaactagaatttccaaacacagcctcatgttattaccaaaaatagtaccgtatactctctctctctccctcatgtacatcattcgaaaaagaagactccatgtagttcatgcaccattgcaccactactagtagtattctttttataaaactatttatatcatttaaaccgaatattattttaaagatccttttgaaccatcatacttgttggtatttcttaacgacattaatagaaatataattctcacaaatggcgcagaaatactcctggtatattatgattacagagtttatccgcaagcgcacggatatactattatagcatttcacctgagagtattccaagggtatcgtatttattttatcccgtgtgacggagctcgtggcccctcaccgggagactgcgcaagcccccctttgccggttcgaccaggggcttagggtgcaatcccaagctctctctctctctctgtatgtggaaagatcacccgcccgcaagacacacgagacacggcgatgtatacaggttcgggccgctgcgaagcgtaataccctactcctgtgtttttgtggatttgtgtatggacaagttacaaaagattaacttcctttcccctcagccttccaaaaaggaaaaagtcccctctctaaatgggcaaggtcctccttttatatctcaaggggataccacatgcacctttctctttaatgggcggagatcggtacggtttccatccgggagcccttctgatgggacagcccacacctacccccacctcccccgagggcagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttccccagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagatttgtctcgcccggagatacggtaacgccgcttcggtcggcgagcgtaattaacgcgcgcacgatacaatccatttcgattgccacaaccgcatatccacttcatgcgccgtatgcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttctcaatcatctcttcctccaccgccatggcacggggctctgctctgctcgatggcagtgtactaccgccttcccgcatcgtgagcgagaggcacgccggactgccgcgccgcttcatgccggagtccgccaccggtcgggagatagtgatgctgggcgagggacgcccggcaccagactacccggggcggtccatcttcttcctccccttcgcaatggctgggctggtcccgccattttcttctttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctccgtggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagctgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccggggaaacctgatttcccctccaaggtggtcattcaaccgaccccctcgcaggttcgtctcactctcattgcaaccatctttctcccaaaaggaagttttttcttactcattttgttcgtcttctggttttttcttctgcttcagcgatgtcccgtcgcatccctcccgccaccccaagtccggccagtccgaggccgaagatccagcggccgcagaggagcggaggcgagaatctgaccggcgtgaagccgcagatcgccttcgggaagctgaagaggccgcccgggaggccgcccgggttcgccaagcggaggaagctgctcgggaggaggccgcccgggctcgccaggctgaggaagctgctaaggaggaggccgaccgggctcgccaggctgaggcgacagctgctgctggcgcgtcacttgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgcattttctccaaggcggctcttctcctcatcttctgtcgccccgctgagcgccgagccccttctgcaggccctggccgcgcgcaaacaccgcagtgctggatgggttcaacgcccaagtggaggccttgcgtgcggaacgagcggagctcgaggccgcatggacgcgtgttgaggaggggcggcgctcggtggacgccatggtggaggtgggccgtaaggctcaccgccgtcatgtctcggagcttgaagcccggaaagcggcgctggcggagatcgcccgtgaggtggaggaggagcgggcggccgccctcatctctaccaccgcgatggtcgaggcgcaagacaccctccgccttcagcacgcaagctgggaggcggagctgaagaaaaagctcgacgccgcccaaggggtccttgactccgccgctgcccgagagcggcgggtaacggagactgaagcggcgtctcggcggcgcgaggaggcccttgaggcccgtgccatggcgctggaagaacacgccggcgccgtggagaggggcttgacggaccgcgaggccgccgctgatctccgagaggcgacgctggcggcgcatgaggccgcctgcgccgaggaggagtccgcgctccgcctccgcgaggatgcactcgctgagcgggagcgagctctcgaggaggccgaggccacgacgcaacggctggcggacagcctgtccctccgcgaggcagcgcaggaggagcaggcgcgccgcaatctggaatgcgtccgcgccgagagagccgcactggagcagcgggctgccgacctcgaggcgcgggagaaagagctggacgcaagggcgcgcgtcggtggggcggctgcgggcgaaagcgacttagccgctcgcctcgcggctgccgaacacaccgtcgctgacatgcagcgcgcactagattcctccatcggggaggccgaggccctccgcttggcgggcgagatggggcccgacatgctttgggactcggtctcccgcatggatcgcgctggtcggcaagcgggcctctggaaaggccagacgaggatgcgccccatcaatctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccaatttctctccctggatggcgctggaggagttccctcccgggactgaggacgacgcgcgcgcgcgcgtccgggatgccgccgaccacatcgtcaacggcttcgagggctcggcccctcggctcgcgttcgcccccaactccgacgaggagggcaacaccagcagtgcagacgatgggggtgacgaggccgtcgactcgggcgcgtcggaatgagcccccaagcccccgccaatctttacttttttctttttctttcttctaaggccttcatgcctcttttgtgtacaaattaacttaatctgcaatcagaaatgacgaaaaaatttttgtgttagttttattttgctatacatacgcgatgaggatgatctgtgccatggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgaacccccgaggacaaggttgagtacgagtgaccctattttaagtcaagattcttcaaaaggaaataacagcacagacacaacctttaggaaattgaaactgcttctattgaaatgttgaaaaaagagaaataagaatgtaatgcatgtgtggtagcccccggccaaccctgcacacccgaggggggtgcggggttggcctgagccaaaacctgacacctgacctccccctcctcaggggtagaagctaccaaggggcgctatgttccatgggttaggcaagtccgtgcgctcgcccgtggccagcccgaccgagcccggccgggggacacctatcactcgatacggaccctggcggttggggagagttgctcaatccagcacgcggtgcgacgccgcgtgcgaccagttcgtcgcgcagagcgatcgggctccgacgtggcgctgatggtagcgccgca

SEQ ID NO: 45663 - DNA, 1278 bp, Oryza sativa
caaagcttgatgcccatgtcctcgcagtagtcgccgaagagttcactagtgaattgggtgccattatccgtaataatacggttaggcactccaaaacgggtcgtgatgcccttaatgaatttaagagcagagtgcttatcgatcttgataaccggataagcctcgggccacttagtgaacttgtcgatcgcaacatacagatactcaaacccgcccggggcccgtttgaacggtcccaggatatcaagcccccagacagcaaatggccatgatagtggtatgatctgcagggcctgggccggctgatggatttgcctggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgtacttggcgcacgtaggcgtccatctgcgggtcagagcaccggtactccttacagacttggttaacaaccagctgagagtcgcctaacaccaggaggtggcggatccccagcccggctgccaccctgagtccggcaaggagtccctcgtactctgccatattattggtcgctcgaaagtcgaggcggaccagatatctaaggacgtctccggtcggggaggtcaacgtgacccccgcaccggcaccctggagggacagagaaccatcgaactgcatcacccagtgggtggtgtgaggcagctgcgaggggttcgtgctggcctcggggattgagacggtctctggagcccgggtccactctgccacaaatcgg

SEQ ID NO: 45664 - DNA, 4538 bp, Oryza sativa
agatttgaccgagggggtaggacgtaaccacagtgacccgatgcgcttggaaataatggcgcagtttcctcgaggccatcagaatagcgtaaagcatcttctgggcctgagggtatcgggttttggcgtcccggagggcctcactaacaaagtaaacaggccgctgcacctttcggcggggccgatcctcttcactaggggccgtatccccggggtgctcttcgtccaagtggcctctcggggcacactcgtctcctgcgctgatgacctcggggtccgaagatgacaggtgcggccttcccacagtggcctcggggccgtcctgggggtcgggggctcctggcgtcgtcagacacgcgggcaaagggccagctccggtcgtcaggggcctcaggcctccgttcggctcgggggcctcttctccctgctctctcccgggtcgaatcagcacagggttagcctcggggtcgaagggtggtaggtgcggccttcccgcagtggcctcggggccttcctgagggtcgggggcacccagcaccgtctgacaagcgggcagagggccgactccggtcgtcgggggccttaggccaccgttcgactcgggggcctctcctccctgcctgctcccgggccaagtcggcacagagtgggggtgcgcagaatgagaattgtcctcatcgcgctccacaaccaacgctgcactaactacttggggggtcgctgctaagtaaagtagcagggactcatttggctccggggcgactagaaccggaggagagctgagatacgccttcaactgggcgagggcattttcagcttccttcgtccaagtaaacggccccgagcgcttgaggagcttaaataagggtagcgccttctctcccagcctcgatataaaacgacttagggcggccatgcaaccagtgacgcactgcacatccctaagtttgctgggggggcgcatccgctctatagctcgtatcttctcggggttggcctcaatgcctcgggcagagaccaagaacccgagaagcttgcccgcaggcacaccaaacacgcacttatcggggttcagttttatgcgggcggagcggagattctcaaaagtttccgctagatctaaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttgaggtcggtgtagtcgatgcacatccgaagcttgccgttcgccttgggaacgaccaccgggttcgccagccactccggatggatgacttcacggatgaatccggcctcgagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccggcatcttcatctggaggtaggcgtagtggaccgccgccatgaacttcaccaacgcgggtctccccaggaccgcgttgtagggcagactgaggtccgccacatcgaagttcacccgctccgtgcggaagttggctgatccaccaaaggtgaccgataggtcgatgtgacccaacggccatgtgtgccctggcgtcacaccgatgatcggttgagacggctggagcaccatccccggggccttgatagcatcaaaggccgcgggggaaaggatgttgagagccgctcctccatctatgaggacacgccccaacttcacattgcagatggtgggagaaaccaccatcgcaatctgccctccccgggcaacgcacggtgggtggtcggtctggtcgaaagtgagagcaacctccgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgctggaaggaaccgccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctgctgggagtaccagcctctttctttttgtcgctcgcaggcctcccctttcgagtggcccgcggagcgcccttgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcaccctccgttgcgcggggagtacgccggttattacgccggcgctcgatgtcgatgcgggcatccggctctccatgctgatcctcccgagttggaggtgtcgacgagggagtggcggccgaatggcgcgcagcagccgccgctcgccgcgccctccgccttgacgacacggagccggtggtagcggcgccggaggtcttggtggtggcggaccgtccaccagcacccaggcgctgctgtgccgtcatgaccaagttggccacgtcgtccagccatcgctgggctggagactccgggtcagggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggattcggctccccatcgtcgccgctcacactcggagagaggtcgtgcgcttttccttgctcggccattaggctgaacaagaaaaacttggcgcacacggaagagtctgagagctcagaaaacacacactgagccccctacctggcgcgccagatgacggagctcgtggctcctcaccgggagaccgcgcaggcccccctttgccagttcggccgggggcttagggtgagatctcaagctctctctgtatgtggaaagattgcgtgctctcaagagaacatgaaacacaagcgatgtatacaggttcgggccgctgagaagcgtaataccctactcctgtgttttggtggatctgtgtatgaagggactacaaagtgagagccaacctctccctcgttctaggctctgaatctggcaagaatcaat

SEQ ID NO: 45665 - DNA, 1414 bp, Oryza sativa
cccccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaatcatattaatttatattttaagtcttctctagctacttaattaatcatgcgctaataagatacctccttttttttgtcacacttctttttgtcacacttgtttttttgacaaatttttaggcccatcgcttggcatattggaggaaaaagtgaaacgacatattcgtaaatgaaaaatgatttgtgaataaatcttttgtatacgtgttcttaacgatctaaaagcaccagttgaaaaaaaaaactacgatgaaaaaaccccaaaatcgagaaactttactataagaaaagatgcataacagatggatgatgcttggagggtagaatactaatttttttcagtccattgctaaaaaagatttagaataaatatcatcttgcagatctgtgatcagtctggataggttatttatttgcataagcaaaatgtaagtctagttttaagaatagaatgaggatctctactttttccacaatgggttttgatttgttagatctattctcacatccaataattttggacagtcttgtatatcctttctctagcttgattaacataatctttctgataaagccctttgccaaatgggtttaatggttatttcttgaagaaatgttggtatatcattgctaaagatttttacaggcttacagctcactttcatgctagttgatatgaacccactagggtataagaagagggggagaatgaccacagggtcgtgctctaaccctaggatacgcccctaatgggcccaacttataaacaatccattcgacccaaaagaggtgacgtagcaccgtgaacaaaaaatactcggtagtaaaacgacaattgcggctgctccataactgatatggacatgtggctagatccatttgaaagtagacttgataagctttccgtgaagtacttgcacgcccaaatcggagttcgcatgaagtcgtggcggccatcagaagttggcgctgtcctgcagtccgaatccaacccgcgtgaatcctctcccctttgtatcctctccattgttcctgaataaaacaagagtgcacatatctccggggtataaaaaagtggaacatgaactcaagaatgaactctcctgatagttgatttgacgtgcatgagcgtgggtaataggaccatgaagttgtacttgtggggacgtggatgtatcaatggtgttgatgtcctcatcatcctccccttcttgcattttaatcgtcctcgactcaagctcatcttcttctcccaaatacgacttcaaat

SEQ ID NO: 45666 - DNA, 1024 bp, Oryza sativa
gctggagaagtccggccggtcgttggtgctctgccttgacacgctggcacacatcacatagagccacaaactctgcaatttcccgcttcatgctgacccaccagtatttctccttcaagtctaagtacatcttggtactgcccgggtgaatggagtaaggactttcgtgagcttcctgaagtatcagctgtttaagttctctgctatctggaacgcatacccgctttccgttccatagggttccgtgttcatcctctgtgaaactagcggctttaccctgtttcatattcttgaggagtccatgcatgtccggatcattcttctgagcctcgcggatttgatcgagcaaggtgggcttggcttctaacgcagccaaaaatccgcgaccaactatgctgaggttcagggcttccatctgttgattaagttcgggtggaatgccacggacgttgagagtgttgcagtggctctttcgacttagagcgtcggcaaccacgttggccttaccaggatgatagtgaattcccacatcataatccttgatgagttctaaccatctcctttgccgaagattcaggtccgactgggtgaagatgtatttcaaactcttatgatcagtatatatttcacagcggttcccaatgagatagtgccgccagatttttagagcatgaaccaccgctgctaactccaagtcatgtgtagggtagttgccttcatgaggtcgtagctggcgtgaagcataggctaccacatgaccgtcctgcatgagcacgcaccccaatccttggcgcgaagcatcacagtacaccatgaagtccttgcgagtatccggcaagattaacactggcgaggaaaccaacttttccttgagagtttggaacgccttttcgcattgcgggctccacacaaacttctcttctttctcaacaactgtgtcatgggtcgagcgattttggagaagttctcgatgaacctcccgtagtatcctgccaacccaagaaactgcgaatctgagtgactg

SEQ ID NO: 45667 - DNA, 11091 bp, Oryza sativa
cacctctgatcagagtaaatctattcgaatagccgagccctcggatatgggcaagcctagcaatgtacccaagtcagtgttataattcttaaaatttgctcaacaactaaaatgtggaatgggtggcctgggttggcttgggacgagctgggacccaggtcgggttgccagttcggtctgaatcatcgtaggccttgggttaaggcaggttcgtgagggttcacggccttgatttaataacattgtatagctctaggatcgtgtttacaaaatagccctgagcaactaaatgtctttaaatgctgtttactgcaaccctaacccctctatggtatatttcccttgtactcccttgcatttattctgcatttgtgggtgtgtcttgttgagtacggtggttgtactcagtcttgcttaattttcccaagcccagatgaggagctccttgaagatgaaggcttcggtgtctagctcgtgcctgccgtcaagtgcctgtggtcgtcgccctagtcttccgctgtttttcgttgtctttgagtgtgctgggccttcgttgcccgtgtaataattttatttacgcttccgcttgttaaactctgatttgtatcaacttttggtgtaccttgcctcctgggacaaggattaatgcacgcacgtaaggaatgcccgttgggttatttccggtcgtgacatcaacgcacatcctcttcgtcttgtctttcttctctacaaaaatcacaggagcaccccaaggggaagtactcggacgtatataccccttttctttcaactcttccaactgtttcttaacttcggccagttcatttgctgccatacggtagggtcgcttgtacagaggagtggttcctggagcaagatctatccggaactcaatctctcgcttgggcggcataccaggtagttcttccggaaacacgtctccgaactctctgactatggggatttctgacagttctatctgatgaagttctgaacttctgacagaggttgggggtgcaaagaaaacaaccggttgttctggccctcggtacagagtgacagtgcgcctcgcgcaatccactactccttggaattgagccaaccaattcatcccaaggatcacatccaagttctttgtgtctagaagaatcagatccgagggaaaaggaatcccctgaatttctataggaacggcagggctataatactttgctgtcataaccccgccaggggtggtgatgagcagagggtttctaagcctttctacccccaactgatttttccccacgaatggcacagatataaacgagtgggaagctccagagtcgaacaaaattgtagcagggatggaatggacgaggaacgtaccaacgatgacgtctggagttgtcagcacgtcctcggccgtcacgtgattcacacgaccacggatgacatccttcccgccgttgttggagcggggaggcgcttggccttgctgacgccttggcttcgggcatttatccgcaaagtgcccgggctcgaaacagttgaagcacagacgctgctgaccttgagcgtccctgcggccttgaacgggctgcacagttggcgtaggaggacggggcgcacgagtcccttgctgattctgctgctgctgcggctgtgggacgcgcaccacgaattgaggtcggggcgctgggcgaggttgctgctgctgctgctgctgcgaggaggatccccctggatagggattggtgtagcggaccctctggttagcaccctgctgattgcggaagttcgccaagcggcgcttgtgcgattccagttccttgtgcttggcctccaagcggatgctcttgtccaccagtcgttgaaaatcaggatagtccccagagactagacgaacagacagctcagggtccattcctgccaagaacttctcctgcttctcctcatcttcccgcacatcctccggggcctaacgggctagattgttgaactcatgcaaatactccatcacggagcggttgccttgcttcaactcccggaattcccttttcttaagagccacgactccggcgggcacatgggttctccggaaggcggcggtgaagcgggcccaagtaatcggctgtccctctggctgcgtagcctggaagtggtcccaccagagagatgcgggtccctgcagctgatgggcggcgaagacgactttctcctcatcactgcactgcaccgtgtctagcttcttccccacggcatgcaaccaatccaaagcatccacagggttgttggagctagagaaggtaggtgggcggatgcggaggaactcggcgagtttggagtgttggggagggggtggtggagcattctgttgtggcgggttttggaggtggtggaggaaagcattcatcatgttggcttgttgggcgaggatctgggtgagaatggcgttggtgtctggtggtggtggtggaggtgggttgccttgggggttggggttgctgccctcgggttggttgccttcaccggtgttaacatttctcctggtcgtcaccatctgaaaaccccacacagaaccagcaaacagaggaggagagctgacgattaaaactaaccacccacgactaccattattcttaaatttatcactgctattaaattggttcattaatgttcaagttgcttaggcaaacaaaaaaagacaggctccgacatagttacaccacacaccggcgtaaccatgccccacacaactcaagaagacaaacgaggaaaaacacacgcgcaagcctactaactgctcgtctaccgctgcgacgggccaggacggaaggtgagcaacagcgcaccctccgagctaccaacgccggaggcttccccctcctggggaaccacgggcgcaggctcggcacgaggggtctcgacgaagcaggtccacgccagggactgacggacaagctctggcctggaggtgctcttgcgggcggtgatcttctggctgcggcagacgcggcgacgcttgggacggctgacctctccctgggcgatcttgagctggtgcagctgcgcctccaacgcgtcgaggtccttcttgagctgcaggttctcctgacgcagctccaggatcttcatgttgttctccaccatgccacgacgcaccatctgatggaagtcgatacgagctgcgtcgtatgcctccaccatgcgtgccaggtgcacgacggtagcgtcatcctccgagctggcgtctcggaaggtggcgaagtcgcgggctcctccgcgacgagggtggtagcggtagggcgagtgctgcaactcgtccgggtagcgctggtgaagggtgccgatggcgaggagagcggcgttctggcaagcggcggggaaggagtccccacccgcggtgactgccagcgaagtccgctcgggagagccggagaggatcactgcagtgacctcccaaccagcgtgaggctctgcatcctcaccctcctgctccgggagcggcctggcctggtaatccactccatgtggataccccaagaccacgcacatgccccgcagctccaagacgaagccagtcatgtccaaaccacgacgggtaacgctgccggccatctacaaacaaaagaaaagcaacatttaaaagatcagattttgatggtaagtgaagcagcaagacaaagagagaatagcgggttttcacaaataataaaggatttttatttttgaaaatattgctaaggcttgggatctacggctcgtcctagggtcaagggaggctctgataccaacttgtcacgaccggaaataacccaacgggcattccttacgtgcgtgcattaatccttgtcccaggaggcaaggtacaccaaaagttgatacaattcagagtttaacaagcggaagcgtaaataaaattattacacgggcagcgaaggcccaacacacaaagacaaacgagaaacagcggaagactagggcgacgaccacaggcacttgacggcaggcacgagctagacaccaaagccttcatcttcaaggagctcctcatctgggcttgggaaaattaagcaagactgagtacaaccaccgtactcaacaagacacacccacaaatgcagaataaatgcaagggagtacaagggaaatataccatagaggggttagggttgcagtaaacagcatttaaagacatttagttgctcaaggccattttgtaaacacgatcctagaactatccaatgttattaaatcaaggccgtgaaccctcacgaacctgccttaacccaaggcctacgatgattcagaccgaactggcaacccgacctgggtcccagctcgtcccaagccaacccaggccaaccattccacattttagttgttgagcaaattttaagaattataacactgacttgggtacattgctaggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccatggtgtccaaatgatatgagaatttcccaagtctaaagttataaaaccacctaatgttgcctaattaatcagcgaagcatctacctaaattcatacttgtggaaccatgaatagagtgtccactagttgaggttttgtttgtctagggtgaacaaggtaataataataacaataacaataataatatggtcataacaaaggtaaataggcatggctaagtaaaacagtgataacgcgggaatttaaataaagcgataatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaatcatgtttattgcgtcagccgagggggcgggcgcgcggaccgggtccacggggtggggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagtggcgcgcacccgcgccccgatggtcgccgccggcgaccaacggcgcggcggagtggcacccgagagagaggaggaaagggggaaggcgaacggcggtcttcggctcaccccgggacaacgacgacgacgagagcggcggccggagcggaagaagacggcggcgcggctcgggatgacgatgacgacggtgctccggcggtcgacgggcgaagcggagcggcggacggggtcggcgacaacacggcgaagcggacggaggggtcgccgagtgaggaggaagtccggagcggcggcggcggcgaaccgaagctcggcggcgacggcggagagagaggagcacggcgcgagcacgattccgacggcgagagcgagcggcgagcggcggaaacgaaagagcggagctcggggagggtttaaatagcgccgggggaaggaaagagcggccggagagggaggaatcgcgcgcggaagattcggctccattgattgcgccggcgacgattacgggcttgattcgaacgaatccgagggagagagagaggggaaagagggggaaacgggggaggggattacggggagtaattcccccctcttgattgcacgcggggcggacgggagcggcgggattcgcggcggcggcggcgctagggcacgggcgctggcggcgggcgcggcgagaggagggagatgacaggtgggtcccacccgtcagcgagagcggcgggcgggcccgcctgtcagcggcgcgcgcgcgcggggagccgatgggccgcgggagaggagagagagagggagagggaaatgggccgagccggcccaagaagggaggaggagggggaaaggacttcttttagggttttctttttataaaacctttttaactttgtttatttcttttcaattattatttgtgctctgaaaattccactaaaatttatttaagcattttaggcttttaggaaatatacaaaaatcctccaagcctcatttgacttttatctttgcacattttaattgttggaggctttcacatgaattttaattattctttgcacaatttcgaggatagattttagagtcgatttgggacgcgacaaacctaccccccttaaacggaatctcggccccgagattcggaagaactggcgaagagatcgggatgggctgccttcagctcgtcttcgcgctcccaagtagcttcttcttcggcgtggttgctccactggaccttgcaaaaacggattacccggttcctggtcctgcgctccatggcgtccaggattttcactggcttctccacataggtcaagtcttcgcgaacttcaatttgctctgagtcggcctgctcggatggcactcgaagacatttcttgagttgcgacacatggaacacatcatgcacgttgcccaaggaggcgggcaactccagctggtaagcaacttctccgcgtcgagcgatgatacggaagggacccacataccgaggtgcaagcttccctttcgtctgaaacctgtgcacacctcgcaatggcgtgacccgaagatacacaaagtcatccactgcgaattccagatcacggcgtcggttatcggcataacttttctgccgagactgtgccacctttagattatcccgaatgattctgactttagcttcagcttctctcaggatatcagtcccgaacacttggctttctccaacttggtcccacaatagcggtgtccggcatttgcgcccgtacaacgcttcataaggtgccatttgtatgctggcttgatagctgttattgtaggagaactcagcataggggagactcttatcccaagtcttcccgaagtccaggacacatgcgcgaagcatatcttctaggatctgatttagacgctcggtctgtccatctgtctgcgggtgataggcggtgctgaaattcaatcgagtacccagctcttcttggagcttcttccaaaagtgagaggtgaattggcttcccctatcagatacgattttcttgggaataccatggagactcacgatcctagcgaagtagagctccgctagtttgttccctccataggtggtcttcacaggaatgaatcgagctaccttggttaatcgatccactattacccatatagagtcatatccaccttgggtttttggaaggccggtgatgaaatccatcccaatttcatcccatttccattccggcacttggagaggctggagaagtccagccggtcgttggtgttctgccttgacacgctggcacacatcacatagagccacaaactctgcaatttcccgcttcatgctgacccaccagtatttctccttcaagtctaagtacatcttggtactgcccgggtgaatggaataaggactttcgtgagcttcctgaagtatcagctgtttaagttctctgctatctagtacgcatacccgatttccgttccataaggttccgtgttcatcctctgtgaaaccagcggctttaccctgtttcatattcttgaggagtccatgcatgtccggatcattcttctgagcctcgcggatttgatcgagcaaggtgggcttggcttctaacgcagccaagaatccgcgaccaactatgctgaggttcagggcttccatctgttgattaagctcgggtggaaagctacggacgttaagagtattgcaatggctcttccgacttagagcgtcggcaaccacgttagccttaccaggatgatagtgaattcccacatcatagtccttgatgagttctaaccatctcctttgccgaagattcaggtccgactgagtgaagatgtatttcagactcttattgtcggtatagatttcacagcgattcccaatgagatagtgccgccagatttttagagcatgaactactgcggctaactccaaatcatgtgtagggtagttgccttcatgaggacgtagctggcgtgaggcataggctaccacatgaccgtcctgcatgagcacgcaccccaatccttggcgcgaagcatcacaatacaccatgaaatccttgcgagtatccggcaagattaacactggcgaggaaaccagcttttctttgagagtttggaacgccttttcgcattgcgggctccacacaaacttctcttctttcttcaacaactgtgtcatgggtcgagcgattttggagaagttctcgatgaaccttcggtagtatcctgccaaacctaagaaactgcgaatctgagtaactgtcttgggttgcttccattcggtgacggcggttactgtttcggggtccacagcaactcctttagcagatatcacgtgtcccaagaatttgacttcggacaaccagaactcacacttgctaagcttggcatacaattgatgttcccgcaactttcccaacaccagacggagatggtgctgatggtcttcctctgattgtgagtatatcagaatgtcatcgatgaaaaccacaacgaacttatccaagtattccatgaacactttgttcatcaagttcatgaagaaggcaggtgcattggtcaaaccgaacgacatcaccgtgaattcatacagcccatatcgcgtagtgaatgcggtcttcggaatatcttcttcccgaatacgtaattggtgatatccggaacgaagatcaatcttggagaatacagtggcacctttaagctgatcgaacagatcatctatccggggaagagggtacttgtttttgatggtgacttcattgagagctctgtagtcaacgcacatcctcttcgttttgtctttcttctccacaaaaatcacaggagcaccccatggggaagtactcggacgtatataccccttttctttcaactcttccaactgtttctttacttcggccagttcatttgctgccatacggtagggtcgcttgtacagaggagtggttcctggagcaagatctatccggaactcaatctctcgcttgggcggcataccaggtagttcttccggaaacacgtttccgaactctctgacgatggggatttctgacagttctatctgatgaagttctgaacttctgacagaggttgggggtgcaaagaaaacaaccggttgttctggccctcggtacagagtgacagtgcgcctcgcgcaatccactactccttggaattgagccaaccaattcatcccaaggatcacatccaagttctttgtgtctagaagaatcagatccgagggaaaaggaatcccctgaatttctataggaacggcagggctataatactttgctgtcataacccctccaggggtggtgataagcagagggtttctaagcctttctacccccaactgatttctccccacgaatggcacagatataaacgagtgggaagctccagagtcgaacaaaattgtagcagggatggaatggacgaggaacgtaccaacgatgacgtctggagttgtcagcacgtcctcggccgtcacgtgattcactcgaccacggatgacatccttgccaccgttgttggagcggggaggcgcttggccttgctgacgccttggcttcgggcatttgtccgcaaagtgcccgggctcgaaacagttgaagcacagacgctgctgaccttgagcgtccctgcggccttgaacgggctgcacagttggcgtaggaggacggggtgcacgagtcccttgctgattctgctgctgctgcggcggtgggacgcgcaccacgaattgaggtcggggcgctgggcgaggttgctgctgctgttgctgctgctgcgaggaggatccccctggatagggattggtgtagcggaccctctggttagcaccctgttgattgcggaagtttgccaagcggcgcttgtgcgattccagctccttgtgcttggcttccaagcggatgctcttgtccaccagccgttgaaagtccgggtagtccccagagactagacgaacagacagctcagggtccattcctgccaagaacttctcctgcttctcctcatcttcccgcacatcctctggggcgtaacgggccaggttgttgaactcatgcaaatactccatcacggagcggttgccttgcttcaactcccggaattcccttttcttaagagccatgactccagcgggcacatgggttctccggaaagcggcggtgaagcgagcccaagtaatcggctgtccctctggctgcgtagcctggaaatggtcccaccatagagatgcgggcccctgcagctggtgggcggc

SEQ ID NO: 45668 - DNA, 830 bp, Oryza sativa
acgaatccgagggagagagagaggggaaagagggggaaacgggggaggggattgcggggaataattcccccctcttgattgcatgcggggcggacgggagcggcgggattcgcggcggcggcggcgctagggcacgggcgctggcggcgggcgcggcgggaggagggcgatgacaggtgggacccacccgtcagcgggagtggcgggcgggcccgcctgtcagcggcgcgcgcgcgcgcgggaggccgatgggccgcgggagaggagagagagagggagagggaaatgggccgagccggcccaagagggaagggggggggaaaagaacttcttttagggttttctttttataaaaccttttcaactttgtttctttctttacaattattatttgtgctctgaaaattccactaaaatttatttaagcattttaggcttttaggaaatatacaaaaatcctccaagcctcatttgacttttatctttgcacattttaattgttggaggctttcacattgaattttaattattcttttgcacaattttgaggatagattttagagtcgatttgggacgcgacaaacctaccccccttaaacggaatctcgaccccgagattcggaagaactggcgaagagatcgggatgggctgccttcagctcgtcttcagcgctcccaagtagcttcttcttcggcgtggttgctccactggaccttgcaaaaacggattacccggttcctggtcctgcgctccatggcgtccaggatttttactggcttctccacgtaggtcaaatcttcgcgaacttcaatttgctctgagtcggcct

SEQ ID NO: 45669 - DNA, 1252 bp, Oryza sativa
caagccgagcaatgtaccaaagtcagtgtctaattcttaaatttgctcaacaactaaaatgtggaatggttggcctgggttggcttaggacgagctaggacccagggtagggttgccagttcggtccgaatcatcgtaggccttgggttaaggcaggttcgtgtgggttcacggccttgattaataatattggatagttctaggatcgtgtttacaaaatggccttgagcaactaaatgtctttaaatgctgtttactgcaaccctaaccctctatattataattcccttgtactcccttgcatttattctgcatttgtgggtgtgtcttgttgagtacggtggttgtactcagtcttgctcaattttcccaagcccagatgaggagttccttgaagatgaaggctttggtgtctagctcgtgcctgccgtcaagcgcctgtggtcgtcgccctagtcttccgctgtttttcgttgtctttgagtgtgctgggccgttgttgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacaagttggtatcagagccttccttgaccctaggacgagccgtagatcccaagccttagctatattttcaaaaataaaaatcctttattatttgtgaaaacccgctattctctctttgtcttgctgcttcatttatcgtcaaaatctgatcttttaaatgttgtttttcttttgttttgtttgtagatggccggcagcgttacccgtcgtggtttggacatgtctggcttcgtcttggagctgcgaggcatgtgcgtggtcttggggtatccacacggagtggattaccaggccaggccgctcccggagcaggagggtgaggatgcagagcctcacgctggttgggaggtcactgcagtgatcctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccaccctcgtcgcggaggagccagcgaccacgccaccttccgagacgccagctcggaggatgacgctaccgtcgtgcacctggcacgcatggtggaagcgtactacgc

SEQ ID NO: 45670 - DNA, 1215 bp, Oryza sativa
ccggtgaaggcaaccaaccgaaggcagcaacccaacccccaaggcaacccacctccaccaccaccagcagacaccaacgccattctcacccagatcctcgcccaacaagccaacatgatgaatgctttcctccaccacctccaaaacccgccacaacagaatgctccaccaccaccaccccaacactctaaactcgccgagttcctccgcatccgcccacctaccttctctagctccaacaaccctgtagatgctttggattggttgcatgccgtggggaagaagctagacacggtgcagtgcagcgacgaagagaaagtcatcttcgccgcccaccagctgcaggggcccgcatctctatggtgggaccacttccaggctacgcagcccgaggggcagccgattacttgggctcgcttcaccgccgctttccggagaacccatgtgcccgccggagtcatggctcttaagaagagggaattccgagagttgaagcaaggcaaccgctctgtgatggagtatttgcatgagttcaacaatctagcccgttacgccccagaggatgtgcgggaagatgaggagaagcaggagaagttcttggcaggaatggaccctgagctgtctgttcgtctagtctctggggactatccggattttcaacgactggtggacaagagcatccgcttggaagccaagcacaaggagctggaatcgcacaagcgccgcttggcgaacttccgtaatcagcagggtgctaaccagagggtccgctacaccaatccctatccagggggatcctcctcgcagcagcagcaacagagcagcaacctcgcccagcgccccgacctcaattcgtggtgcgcgtcccaccgccgcagcagcagcagaatcagcaagggactcgtgcaccccgtcctcctacgccaactgtgcagcccgttcaaggccgcagggacgctcaaggtcagcagcgtctgtgcttcaactgcttcgagcccgggcactttgcggataaatgcccaaagccaaggcgtcagcaaggccaagcgcctccccgccccaacaacggcgggaaggatgtcatccgtggtcgtgtgaatcacgtgacagccgaggacgtgctgacaactccagacgtcatcgttggtacgttcctcgtccattccatccctgctacaaattttgtcgactctggagcttcccctcgtttatatc

SEQ ID NO: 45671 - DNA, 856 bp, Oryza sativa
gatttttaattgaaaattaaatgaagaaattcgcaaatatccatttaaagagcatataaacttcaaagggccatatcttggccatttgaactcggaattggaccattcaagtctctaatttttccttaagatgtaaagaacccatttttgtgcttcgtttttgctgttatgtggagttatttagtgttaaagcctttttctttttccgttggtcgtgtagacgctgcagcttcggaagatccgctcttcgtggaagtcgaagccgtcgagtgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgttattgttattattattaccttgttcaccctagacaaacaaaacctcaactagtggacactctattcatggttccacaagtatgaatttaggtagatgcttcgctgattaattaggcaacattaggtggttttataactttagacttgggaaattctcatatcacttggatactctggaatggttggcttatgttggaattggacacacacctctcttcctctttcaaaacccctaaaacctgttttcggtggggtttgggtgcatgccagttgtgggaagtagcaaccccgccactataggactaaagctcggcctctgttgcaagcactaccgtacttccacatgtctaatggggaaggcttagtttggggctcagtctagtcataaacaaagtacacggattggagatgatgaagtc

SEQ ID NO: 45672 - DNA, 1209 bp, Oryza sativa
aagctggtgcttaatgacgacgaaggtgatgacggcaacaaatctggggacaaaggctcgcccaataaactcccaaagcataccactcccaggaaaaaactggctagtcgtccaaggccaaagattagaacatcttccaggtataaacctcttggtaccatttcacttcgacatgcttctctcatggaaataatactgaatattgaaagaacactttgcaggaaaccatccgacatagatccaactggaaaagatcctgatccgactgtgacagaaccaagttcatccaaggattctgagccgactgccgaaagccagccgactggcgcccatacttcaggtgataatgccaatccgagtgaccagcctccgactggaaaccagtcggcagcaactgaaactacaacaacccaagagcccccgactggaaaccagtcggatgtaggtctagatcaagaaactcccgaagttgaagcgcagacgacaacttctcaagaaccggaggctggtaacgactcgatgatcgggtctccagataaagaacaaggatctccccacgctcagctaggaacatcctcaagtaactcatcttctcaagtgatgccgatttaaataacttcagcttatttgtctaatgtcttggaaatacatcaggaccaccaggcgatgacgaagaagaaattcctcgcataaaggtgactgatgactctcgtcctcctatcttgctcaaatggtgggacgagaactcacaagctgccggcatcgtcataaatcgtcaaaaagaagatgaggaagtgtgccagctgaagaaggcacttggagaagccactcgcattgtgaatgtaaatcttccgggtgactgcctttgatgactttgttttctcttcagcaaaactaaaccatgaatcatcatgcagagaatccatcttcgcaatgaggccaagaccgtaactttagaaaagctggttcctcatttgggaactcttgaagcagttagggatcagctacatgaggccaaggagctcgccaaaaagacagagaaggaattaagggaccgaattgctcagctccaggattcaaacttcgagctgagtggttcatcaaaaggtaatctctagatctgccccattaatttacgctgtcgtaactgtatcctcaaccatttggatttcaaacagcgcaagccgccagaatggctcaaatggagaa

SEQ ID NO: 45673 - DNA, 3808 bp, Oryza sativa
  unsure (1)..(3808): unsure at all n locations
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttcgcctcacctgcccaccccagaagcaatggccaagtggagcgcgccaatgcagaaatcctcaaaggccttaaaaccaagaccttcaatattctcaagaagcatggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggctctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggtgtcccccggccgggctcggtacggctggccacgggcgatggcacggagctgccaaacccgtggaacatcgaacaccttcgtcgcttctacccctgaagggggggggtcgggtgtcaggttttggctcgggccaaccccgcacccccctcgggtgtgcaggattggccgggggctaccacacatgcgcatatattcctttttcctttatttcagcatttcaatagaagcagtttcaattttctaaaggttgtgtctgtgccgttttttccttttgaagaatcttgacttgaaataaggtcactcatgcttgaccttgccctcgggggttcggttcggtcagctaaaatcgccaaacggggcccagaaccgagccgtgccccggggcgtggtgaactccgggggggaatcggcaaaaacctacaatcgggtcacccatacccctcggtcaccacgttcccggcctggccagtctcgacatgtggatctccccaggcactagccccgacccgagccatccaagggcacgaacccttatttcaagctaagacgcaaaaggaccacggcacagatcatcctcatctcgtatgtatagcaaaataaaactaacacaaaaatttttttcatcatttctgattgcagattaagttaatttgtacaaaaaagaggcatgaaggccttagaagaaagaaaaagaaaaaagttaagattggcgggggcctgggggctcattctgacgcgcccaggtcgccggcctcgttgccaccgtcgcttgcactgctggcgttccccccctcgtcggagtcgggggcgaacgcgagccgaggggccgagccctcgaagccgttgacgatgtggtcggcagcaaccccgacccgtgcgcgcgcgtcgtcctcggtcccgggagggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagagacccgcttgccgaccggcgcgcttcaggcgggagaccgcatcccaaagcatgtcgggcccaatctcgcccgccaagcgaagggcctcggcctccccggtggaggagtccagcgctcgctgcatatcggcgacggtgtgttcggcagctgcgaggcgggcggctaagtcgctttcgcccgcggccgccccaccgatatgcgccctcgcgtccagctccttttcccgcgcctcgaggtcagcagcccgctgctccagtgcggctctctcggcgcggacgcattcaagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcgtgcgccgccagcgtcgcctcccggagagcagcggcggcctcgcggtccgtcaagcctttctccacggcgccggcgtgttcttccagcgccatagcacgggcctcaagggactcctcgcgccgccgggacgccgcctcagtctctgttacccgccgctctcgggcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcgtcacccggggaggtgggcccaggcgatgtgcccgaggcctcgtcgcgagcctccccggaggctgtcgcctgagggttgcccgagggagtgggtgtcacgaccggaaataacccaacgggcattccttacgtgcgtgcattaatccttgtcccaggaggcaaggtacaccaaaagttgatacaattcagagtttaacaagcggaagcgtatataaaattattacacgggcaacaacggcccagcacactcaaagacaacgaaaaacagcggaagactagggcgacgaccacaggcgcttgacggcaggcacgagctagacaccaaagccttcatcttcaaggaactcctcatctgggcttgggaaaattgagcaagactgagtacaaccaccgtactcaacaagacacacccacaaatgcagaataaatgcaagggagtacaagggaattataatatagagggttagggttgcagtaaacagcatttaaagacatttagttgctcaaggccattttgtaaacacgatcctagaactatccaatattattaatcaaggccgtgaacccacacgaacctgccttaacccaaggcctacgatgattcggaccgaactggcaacccgaccctgggtcccagctcgtcccaggccaacccaggccaaccattccacattttagttgttgagcaaattttaagaattagaacactgacttgggtacattgctcggcttgcccatatccgagggctcggctattcgaatagatttactctgatcagaggtgtacatctttacccacaagacacatcttcctcacgtgttgcca

SEQ ID NO: 45674 - DNA, 8095 bp, Oryza sativa
agctgacgacgatagcgtttgagaagattttatacattctctccttcatgattttaaaatccagagaatctggttcttcacgattaggatcatgattgccatcaaactcgaatgctgcacgggatctttctttaattggtgccagtcggcatttgatgaagtgccgagtaatctgctctccttgtaagccttgttctttgagttttagcatgcgatccatcagctccaaggcttgggctgcttcatccccaatcggaagcgagttccaggtatcttggtacaccggaggaagacaagagtactcgggaagagcaggctcaggattctgaatataaaaccagtttgcatgccaccctttgtttgaggtcttgaagggcatagagaaatacttctggctcagagtccccctcagctgaaatccggcccctccgactacacatggcttactcttgtttggttggggcttgagaaagaagattcggcgaaacagagcgaagtggggcttaattcccaagaaggcttcacaaacatggacgaaattggcgatgtggactatggaatttgggtttaggtgatgcaagctgattccatagaagcttaatatcccgcggaaaaattttgaggtcggaagagcgaagccgccatagaagaaatgggagaagaccacaacctcgtgtgtatcgggggtcggaaaagcctcaccacatgctggccgccacccgatgatttccttggcagggagaacgccgtgcgccaccatctccttcaggttctcctccgtgacgtcggatggcgcccattggccttcaaagctttccttctcttccgccattaatttcacccgaatgtgctgatttgattcgagggatggctggggagaagtgagggattgaggcggtggatcacgggaaggattttgatgaacttttcgaaggtggattcgagtggaatggtgaaccctagtttgccggcgcagctttgtactgtagcagggagtggggaaaatggcgagagttccggcggggaagatgaagagtcgcttggatcttgggttttcttgttaagggtatcggaggtgcaaatgggcttaggcctgaacagtacctcagcccagtacttttaacagcgtggcccattgtgctccttagggacttaggcatttttttttgctttggcaatttatgcgcacaatagtgttgcccaatgctgataaaatcctttttacgcggtcatataattctttggaattattgcaatgcaaattaaaatgtgcccgacagaaaggtgttatgctgtttttgtaagcttttttaggctacaaaagctgtctgggttaacttggaatggcttgtttttaccatagtcatttccctggtatgttatatgcctgttttcattatggtaaatagtcatagcctaggctattagacttattcattaccataatttttataatatttggtgggtaatctttagagttttttattcggatgcctgtcaagtgtgttcattcgtgaaccttttagagtgttaaccactcggattccttttaattgtggctaaaaagcagtcggctaagaatgcctctttaggcgccgtgtatgcttttgtcatatgatgcatgattgtgctattattttgttctcaactatatgtttagtttgttaactaatcacatagttgggggctacacctaattaggtgcatctattcgatgcaccatattctttatcttttcgccctttacagtcttcgtcttcgctactcggcaggccttggcatgaaaagtttgaagcactcggattattatctttgagaaggctatgatggttgactgcaaaggtctcgggggctactgtggagattatggatatcccatatctacacggcgatgatatttgggctgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccctcccatatataaggggggtccgggtgcctctaggggcagaggttgattttctccaaattatacaatcaataagacactcggcggattcatccccggacaggagtagggtattacttcttgaataagaaggcctgaacctgtataaatcttttgtctccaaacccatacacttctccagcttgatagccacccccttttattattgccgaaatctagtttcgacaatgatttttgccatccagataaagatcaattctccagtagtgttccttccaaatataaaattctaactatcattaaccttttttttatcattttcttatcacacctgatttaatttttacaacatgagatatcatcccttgaaactaattatctcacagatgctcaaaacacaattaatcgacaacactacccatctcgcccatatatgtatccgctctcacttctcctggagcttgaagaaggccatgagaggcgcatacaccctctccccggcgttccgggccatgacgaagtcggcgtgcgcgtagtcggcgaggtactgcacggtgagcttgtcgccgtcgcgcgagtgcgactggcccagggcccgcaggaggcggctcacgtcctggacgtcggagaggctgtccctgccgccgtagctgaggaagagagggaagtcgcccgggatcgccgtcacgtcgtacgctggcggcgtcgcctgcccgtagtgctccctgttgtcgccggcattgccgtagtcgtacttggcgatcgtgcctcctctaatcactgcttggcacaagcattttggttttaggaaaaatgcggataagatattatatttttcagcgtaaaatttaatatctctatatagctatgccaaaattattgcacatctttctggagtataggtatttgattttagaaaaaaataatatggacacttgaaataaaaagtatgatgataagttttttttagtgcgaaggtattgacgtatctagttaataattgtatggtttctcaagagatatcgggcagtaacacaattttaatgttgatttgttatactacctcttgttatcttcgtcatattatagagtgatgattatgtatctcgtgacaccctctcaaagccctcaaaaattctctaaatactgatgctaaaagtgtggtaccttgtgttaccttctcaaatactacggatgactaaagatgggaaaactgtcatattctttcaggtggtaggattctttaaaaatcatttgtacagactatttgtcagttctcatactcactctgagccaggtggatcatgttcttggtggctgtagcttgaggctcatgggcaaggaagacctgaacagaggagttgtcgaggcagcagttgtcacctgctccaatcgtcaaaatgcaggtcaataacatattagatttgaaaaaagaacacaattatattcggtcgtgacaacttatgcatatagctactattacctgtgaatgctgacatcagattgtagcaatcgatgcctggttgcttgcaaatgtcagtgaccaagctgtgaacgtattctctgcatagaaatataaattgtcacttgtcagcaagaaatgaatgaacagtaataaacacaattcaccaaacctcgtaaatatcgatataaataggaattctgaaaacatcttggtctgaagattggagaaatcgaaggcttgaaactaccttaaaattccacggtacttgagaggtaaaaaactatcaattgtttttaaaaaaattggtacccataattaccgaaggtactgagagatactaaaattttttaacatttaaaaatatggtatcttctggtactttattaaggactgtaaaatcactcaatttgaaattgtattttgtttaaaatttctgatttttttagaacttatttctgaaattttagatctaccgttggaccctacaagtgcctgtagcaaacagaactgcatttgctcgaatgaagcctatactatttgttcaaatttagcaaactaaacttcaaactttatctgaaaattcctttcatctccttgaattttttgaaactcggttttctgaaaagcaatgggaagaaattgagctttaccctgtaggatcgaactcactgagccccagccagtagagtgcctgcacaagcagagaacacacagaatcaatcagcaagctagcccgtttaatggccacgccattcgtcgtcgtagtcgtcggcgtcggcggcgtcagctccggcgaacttacctcagccaagaagacgtcggccgccgcgcgcgccagcggcgacgacatcttgtcgaggaaggcgatggggctgagcagaccggccgaccgcagcatcccgatctgctgctgctgatcgctcagggcagccaacgcgatcaacgtgccctgcatccacagttcagaagatcaaccaagggcaaaggatcgatttgtctgtgtgcctaaacttggtggttgattatcgagcggattatctactcaatcaattatagtgataaatttaatattttaaaaaataaacttgatatatagtttaaaataagttgtctaagcaatactgtagaagtacgtttacgtttaagagaacatatttgttcagaacgtgaagtacataatccgtttaaataagctgaaaaatagagttaagttaaaaattttttaaggatgaccaaaattcgtttggctgcgggaatttttacccatgtggtactgaaactgaaatgcattttttttttgttcctaacgccatttcacttaccaaagagtggcctacgtagtgcatcttctgctggccggcttggctgtacacgtactgcactactgctgataggtccttgctggacagctcgtcccatgaccagttccagtatgcctaggtttcatatgccaataaatttgtaaaatttcccattttaattagcggcataagcaagagcaagtaaaataaacacaaaagtattagtcctaagacgcaacataggttcagacgataaggtgaaatagagaagggatgagggagaggagccgtgtctactagtagtataatattttatatgaacaggctgatcgagagttttttcttcacgggaatccaataattataattttcttttctgaacaaacaaccaaataatatttctatttccaaacaaactaacccgaactgtcgagcgcacgctgtgcactgaatccttgtagtagcaagtatccataaaattaaataagtgtacaccataagattggcatgatacgatcatagataaatagataaagagtagcgtcctcaaaataaggtacgtctatattgcataataagtgagtgaagtctggacggtagagaatcagactataaaagtattaaagaattaattgataataatgtattgtatgtactggagagaatatatatactattttcagcttaactaatccctaatcaaaaggagcacgggtctttgcccgtgacccataacaacctctttttttttcttatataacaatacattttgttaatcatgtgtattatttacatcattagatggctatcatctcaaatttctaaaatattacttaatacttttaagatagatagtttgtttctcattttgctaagatctactccctccgtcccagaatatagcaacctatgatcggatgggacgtatcctaatactacgaatctgaacatcccggagaagttttttttctaattgttgcctatttatttagacttttcgcctagaagatattatcaccgtttatgatccatttgcacagtattcttatcgctaaatctattatatactaaaagtccattaaacttcattcaaacgctctcaagtcagcacgtgacactcctacaaacgctccaaggtcgtcatgtggcactttaaaaatcataaaaaatctaagaaaaaaataaaacatctagccattgattttcatttaatctggtaggaccattatttttaaccattagatctatcctctaaattaacaatcaaatttatatctccaaagatctaaattgttccatatctgtacgtgagtacgtacatttgtatcccgaaacccacacccgacccaaaaaaaattgtacgtgcacttctctttcctttttttttaatttctcacttagttgaaaaaccaatctaataattagcacatcttaactataatttaagttgtaaaaataaaaatatatgttatttcaagttatgttcaaataaaaaatatatctcatggaaacattcatgaaaaatataaataaattaaaattatagatatatcacttaacaacatgtataattctattagatttttatttttaaaagtaaaacaacttcgactgtgagtagcattctcaaaatttactcaatacctactagaaaaaaatattgatatgttaaaatgacattactaaatttattttgaatagtttcttttcatatattgctagaaaatcaacgacgaaatatattcttttgataccgtgtcgatgtcttttatctcctacctaggctttcaatggatctggctgagtttatttaggacacacaaaatgatgcacgtcataaaaaaaggattaattaggtattaaatattacaaaattgaaaatgggtttatttcatgttttaaaaatacttttgtatagaaagtatttagaaaacacgcatcgtttagctcaagaaacttctgtagtttgggaaacacgctcatcttaaataacaaagtagccaatcagataagcactttcgaagtcaaccttacatactaaaacacttaatatgaagtacataatatactttgtcaatcaggaacaagccaaatatatcaatcttatgctcccactaatcctatgtatataagttatatatagaaaccactgtccaccaatcgccaagtcataatagttatgaggcatccatgcattgtgcaactaataattagctgataaccaataagcacatgtgttatcaagtacaaaagataaaggaagtactaagtgagaaccatcaataaatgatatgtaagtagagatacaccaagctggaacaaataatagttgattacaagtagactacgactattatcaatagtgttcctacacacctgcatatacttctaagataccacaaaaacactctaataaaatagagaaaatgtaagaaaattataataaatagaaaaaaacatttagccattgatttacacttagactagtggatccattattatcaaccattagaatatatctatgtaatccctcactcctaaataccggctaatccctccctatgtacgtacgtacacaagagatgtcaaaaagaagaaaaagtgtgtataatcaactcatcaagtagttttctctttctttctttgcagctctaaggttttttctgaaattatgtatatatatagtgaccacttctggtgaggttgtcgaagaagccacgccgctgcagtgctgcttcacaccatcccaccaaatctcttcaaagtatttattttaataatggtataaaagggaattgtgagcactcatataaatacatgcacatccaacttataaatacaattacacacctatcttatcagagaaaaatatttatcaaaaaaggaaaaagtacattcgtacaggtgactactatttgctagaaaaaacatacatacttacaataaaaaatatcacatggaaccacattatatcccatttaattatgacattctcatccaaatagtgttgataattagcacaaataattttgccaataaagattattccatcgtatattacctatgaatatgcatagatgaatcggatgtataatgaaagagaaaacaaacacatattaactcatacttttgtgaagaatgatgataggcgagttcacatataactgggatataaatatttctatatttactattacaatctattttcttataaaaaatagtgagatctgacttcttttagtattctttttacaaacaa

SEQ ID NO: 45675 - DNA, 1594 bp, Oryza sativa
cttatttaaaaaacttatgaaaaaaataaaaaaaatagccacgcgtaaagtcacctaataacaatcatataaaatttttaagtaagacgaagaaacaaaagatatatcaaaaacaaaaaaatagagtgtctgtgaaatcaacccgatgcattataaattaagcaattgattaattaccgtgtgctcttcacacgcgtagccaaacggtgccacccttgactggcacgtgccattggccgccgccacacgcgacgtcgacgacgacgtcccggcgatcggagccagccatgctgcagctgctgctgctgcgacggcgaggataattgttgccagagcctgcaggaggctaattggctgcaaaccgcatctgttgcctcctcctggcattgttttgtatagtgacagtgtgtgtgatcagtaagtagtatggttcgatgtgaaattaatttcagtttggtttcctgctgtgataaccttttatagctggatgactaggattatatcaggattaatttagttatgtacgtccatatgtgtgttctatgcatgtatattatatcgtctgtcattttcttcttggattaacgtgcgggcgcttcatgcgagatattatacatacatatgtgtacattgtgtcagagtcatatctcaatctataataaactactccagcttgcaggacgtttgttacaatttatttttcttacatgttgattttctttttaagaaatgggaaaataactatttccaatcaatagagataactaaaatatatgtcaatcaattctttggctctcttaataaaacatcaaatttagccattttcttagtaatgtccctccagtcaaaaatttcgctttaattcatgcaaattttgacccctcccacatgaggatgttaaggtggaccagtgattagcagggaagttgcaaagaaaatagtagttaaagcagcttttttattagaaacactcaattattgaatgacaattaattaattagctaatcctatatatctatatagttaatccccacttagtgcaattaatatgattttcctgcaatgtggttgttccacgtcaccttgattgcttttgaactgttggattgaagttatacggtaggattagatcgtttttgattggtctgctgctgtaaaacgtgagttgaaccatggtccaggcccaccaggcaaagcattgaaatttctcgcgtgcatgtgcgtctctgtgtcttccaagcgcctcatcttttccaataccgttgatctagctcgccccactataaattcttcattgacgtggtctacagaatcacaggtactatttttttacctcttttccagttcttgtgctttgcctcttctgatcgactgttcatgttcttctttttatttgctttcttaaactgccacatgctatattgccaatctttgtttcttttgagattatgttttccgattattgcatcatatatcatgtaaaattatgctaattatactcttctcatattaatcttataatatagctttgtcatcatatattttccatatgaatagatgcagaaatctatttgattccagattcaatagtgag

SEQ ID NO: 45676 - DNA, 4101 bp, Oryza sativa
acatatgtgataatatagtatatgtgagttctaaaattttctttcctacctactatataattttttccatgtgtttatatattttttttacctttatcagttatccaaaggttataaatgattaggttgtatggtgtgccttttagaaaaaaagagatgcaatttatacacccttgatgaattatccaaagtctagaaacaattgagatgatatgaagatatgcaatttacaaccttgataaatcatctaaaggttaaaaataattgaggtgatatagcttcacgacagaaaagaaaattagcactaactacacttagttgggatgaactaagtgttgcgttttctagataagtggtattaaatacaaagatagagactactgaaacagtctagttaactaactttagaatatgggttgtatactttttagcacatagcatttcttctttcaattagtgaacaagccaccttacatttctttactgtcatacatttatataaataagtttccgcagcaacgcgcggagtaattttctagtatcaattaagacgcaaatcactaaatccatatatattgaatggcatatgaaataatcaaacaaacaacttcgtatatatgcagtagattttcgtttctattacacaagagacacacatgtatgtaggtgagttggtacatgtgtaggtgagttggtaaagataggtgcacgtgagggagatgtctcgggatcaaatccctacctgacaaaaattatatttgacttagaaaaaaagttactagtggttggggcttcgtatatgttgagattataggcatataatgatttaatatattccataaataaatcatggcattgcagatatatactagcattaacgcatcattagatctacacatgtaaactaagcagtaaaacatgaacagatcaaatatgcgcaacatattgaacacgtaccgaggtggtagaaagaccggctactcggcaggaacttttcgtgattgcaggcgtctacgaaggcgcgcaacacgcgagcgaagaggaagacgagccgtcgcggacgaacagggagcagtcgcgctaagcgcttcccaaaaaccttattgtcgccttctcccggtgcaggacgtcgaaggcagaggttccggagacctgctctcccgattgccggtgcacgccggcgagcgggatagagtaatctacgagcgacggcgtagcacagagtaggaggcaaaccctagattgattttgcgtgtgttgcgtgaagacggcgggtcggtttatatagagaagggttgcttgatcatggcgcccgcacgatctccactgcgcataaccgaaccggataagtcgcgcgtaacttatccggactccacgccgttttcacgcaccggatttttcggaacatttccaaaacaaaaacgaatccgaatttgcagcaaaataagactgcaaaaggaggctgcatctgcgcaaggtgaggaaccaatttttggcggaccattcgacgcgtacatcgtgcacgcgcgccgcctgccctgcccggccaggcgaggtgagcgagcgcgcgtgtgttccccctcttctctccaccacacatgcttcaagtggctaggagggcatcctcccttttaaggaggtccctctctcctagaataagcaaggtggtactaaactccacatgcatgccattccatgaggtgggcttttgtgattttccaaagaattaatcttcgagtgggctaaggcccatccattaattccaacaatcccccaccaaatctcaaaatcccactgagatttgccttttccaatgtactgtctatataccagcggttcgatggagaccgattaaggttgaacttctatctagaactccaagctacacttactcacaactttaacaatggattacgccttgaattgtaagtcttgtgcaagcaagtttcactcaaagtcttatctggtactagaccgtctgtagactacccctcgggtggagcgtataagtcatactgctaggtctttagtaagcttcctagaagattcacccaaaatcttcatagactgcgaccagcagtcaagctcacaaaggtgagttctttcaagaatgctctgcaggacagcatcttcgctaattaaagtcaacagaactcattaaggcatagccaacctgccttgcagctcacgagagtacatgcatcttcacttagagagggtatatatcggtactctcctctagtttactaatggtttgttcttccgaggatctaattcacgggatctccaatcacatagacttggttaccgccatagtataactcacatgggtctcaaacccatctccttcgatgcattgtctatcatatttcgtgatagtcccttcgtgaagggatctgccaggtttctagttatttggatgtaatccaacgttataactccggagtttctcaacttcctgacagacttcaatcgtcttttgacatgtctagacgatttcatattatccttagaactattcactttgacaattaccgtttgattgtcacagttcataaggatagccggcaccgttttttcaacaataggcagatccattaatagatcacgcagccattctgcctcaacagtagcagtatccagtgccatcaactctgcttccatggttgacctcgtcaaaatggtctgtttgcaagacctccacgaagcagcaccaccacctagtataaagacatatccactagtggctttgatctcatccacatcagagatctagttagaatcactatatccttccagtaccgtagggtacccagaatagtgaagcctcaattccatagtacctctcagatagcgcattactcgctcaagtgcacgccagtgatcatctcctggattagaggtaaaccggctcaacttgctcacagcaaaggagatatcaggcctaattgcactagctaggtacatcagcgagccattgatttgggagtattccagttgattcctaacaattctcttgttcttgcgaagcaacaagctaggatcataaggcgttggagaaggcttactatcaatgtagccaaagcgattcaagatcttctccacataatgagactgcaagagtgtaatcccattctcacctctaattagcttgatgtttaggataacatcagctactcccaaatcctttatatcaaatttttgagacaagaatgatttaacctcatttatcacctcaagatttgtcccaaatatcagtatgtcatcaacatacaatcacagaataactccctcacccccaccatggcgatagtatacacatttatctgcctcattgactgcgaagcctgcagatgtcaatgttctatcaaatttctcatgccattgcttaggagcttgtttcagaccatacaaagacttcaacaatttgcacaccttatcttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctggcaacaggtgagtaagtgtcaaagaaatattcgccttctttctgagtatagcccttagcaacaagccgagccttgtacttttcaatggtaccgtcaggcctcagcttctttttgaacacccacttgcaccccataggtttacacccacttgtcacctcccaagttccgttagcgataatggaatccatttcactacggacagcctccttccagtagtcagcatcaggagatgcatatgcttctgaaattgacttaggagtgtcgtcgacgaggtacacagtgaaatcatcaccaaaggacttaaccgtcctttgtcttttactccttcgaggagcttcactgtcatcctcctcagtgacatgttcatgtgtatattcagtttgttctggtggtgtgattgaactgggaattatttcagaaggttgactagaactactatgtgtatccttcattgggaaaaagctctcaaagaagatagcatcacgagactccataattgtaccggg

SEQ ID NO: 45677 - DNA, 1115 bp, Oryza sativa
agcctcgtctttcgttttcaacaagtacacatagcaaaatctagtagcatcatcaatcaacgtcatgaaatatcattttccaccctttgtcaacaccccattcatttcacaaagatctgaatgtaggagttctagaggtgccaagtttctctcctcagcagccttgtgaggcctgcgaggttgctttgattgcacacaactatggcacttagaacctttgacaatggaaaacttaggaattaaacacatgttggaaagccgagacatcaagccaaaattaatatgacataaacgtgagtgccagacattagcctcatcatccacactggcacaaatatggttcatagacttattgcagaaatcagaaagggaaaagcggaacaggcctccgcactcataacctttaccaataaaatatccatgtttagacacgactactttattagactcaaaaaccaacttaaatccgtctctagttagacgggagccactaacaagattcctgtcgatagaagggacatgctacacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagactgattaactgaaaaaacagtacgtaaattaccatacccgcttccatctccagtgttgccaatggtcacattagcagacttagaagtctgccctgcaggtgccttcatccccttgcgctgtggacacttcctagccagatgaccaggttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatggcccttagacgcagcatctttttcccgagcttcctcctcaacatcaagagacgctatcaacccctcaacagagtattcctgtctcttgtgtttgagtgcag

SEQ ID NO: 45678 - DNA, 2654 bp, Oryza sativa
taaaaattcctaactgaaatcccattcatttgtgtataatatttgtggaactgaaatttgatttttgatggataatgtcatgcacctacgacctcaccatcttagcacggcatcaacatgtgtaatcggtggactccgtctctcatatatcgacctgtgtttgttcctttcatggagacaagacaaaagatttgatgattgcaatgagaacgctaaccaatcaggttcttgatcatgagttcttgtgcctgtaggagtattttattagcaaagaggttaacatcatcttggttagttacggccttatagcgtactctattactactgttattgcacgcacaagtatacgtcgaattgaagctttttattctgagaaacagaagaacgcaaaaacaaatttctagttaatcttttaattctacaactacattttcataaaacctagacaaaaaactagattatttaaagaatttttttatttttgaataagttacagcagtcagaaactctaccctattttgcaatatatcatgcgagtgcatttctggtattggtaatgcgcacggtgaacctaaaacacccacagagtgagcttcaccagttttttaacgggtgaaccctcccgagagcggtgtatgcactttcgtacaataaaaaaaaatgtccaatcactaattacgtgcgtagcctttttctaggattaaagtactcacgggaaagactaattgccaaattatttttgtgttatttcgttgggtgcctcatcgtttggcaaattcatatgcttatcagccaaaatttaaattttcaacgttaaatttggagctgattttaggggtttttttcatcgaagtttatttttcagcctttgtttttagatcgctaagaacacatatataaaagttttattcacaaattgattttcgtttgcaaatatgccatttggcatctttagaaaatattcagaaaatatatctagaactactttgatcgaatctctctatatttgataagaaatatcaaaatgtgttttaaactttttttaagcaatgacaaacgaacaatacccataagacttgcggcctatcttaaaatcacatatagatcgttcttaaattagccaaagaaagcaaaaaaacaaaaacttatatccgtttttgctatagtaattcctatttttttaatatatgacgtcattgtctttttagatacgtttgaacattcgtcttagtcttatttcaaaaaattatgtaattatcatttatttttattgtgacttgatttatcgttaaatgttctttaagcattattaacttaaatttcttcatatttgcaaaaggaataaggaaacgaatgataaatgtttataaaaaaattaataacattatatattaaaaaaggtagtagtaaattaacgaatatgtgcatgctagtaccttaggtgtagtccttggctcctggcttcttcattgggcctaggaagtaaaacctaataacttctttttatttataagtgatatgtactttaaatgagcttttattaccgaagttttatattagaccactatttatcatttttttactttggacaatgtatttccttttacttttaaaataagacttcattacagagaaaatttatggtccttgagacaaagtatacctcagactacctaaactttgccctaaaaaaattttggtacctcaacgtatccgaagatactaattttaaataaaaaatacggtacccccagtactttcccaagaatggtaaaactacccttcattataaattcattactatgcaaatgattttcatggctgagcaccctttggaggtagatcataagtgtttgcgtctgcaaaattgacccatattttcgcatacagctcctcaagagacccacatgtaaaaatctatcttcgcaggcatacctcttaagaagccttatgcgaaaataggactacggacctcttaaaggtccgcctagatgtctgacttacctcctcgtgtccttcttagcacttcaaatttttcaagtcattcttgtcccctcttgtctgtctcacctcctcttctctctctctctctctcaaattcctctctcccgggagagaactttctctcctctctctctctccccaactcccctcctgggtggcagcggccactgggcgcacgacggcgggcagcggtggacgacaacggcggccatcccccgctttggtccacgcggatctagcgaaagagcacagcggacggcgagcggatccagcgagggcatgtggcaggcggacaggccttgcccggatccggcaacagggttcacagttccgacgaaaaccagtcgaattccgagaaattttgaggtttcgacaaagctcgaaagtagaagccgtctgagatttcgatgagtttcatccaaattcaaatttgaattgataaaaaaagaaaaaatcaaataaaatcttataaaaagtatgatatgcatatagaacctactgggatataactttttgaaaaaaatgattcatttcgtgtatttactgaaatttatagtaggaaagaaaagaataatgaattaaaaaaaataaaaaaaatcactttacctccttttctagttaccgattgaaattttgatgatttcgctcgg

SEQ ID NO: 45679 - DNA, 3823 bp, Oryza sativa
aaagaaaaaatcgaataatatcttataaatagtatgatattcgtagaacctattggaatataaattttttaaaaaaattgatgtatttcgtgtatttactgaaatttacagtaggaaagaaaagaataatggattaaaaaaagaaaaacaattttagtttaacttttttttaagtttccgattgaaatttcgatgatttcgctcggaatttcgacagtacactccagtcttaagtaggctcaactaaaacactcggtaggtccaaattaaacattccaatcttcagtaggcttgaatagaacaaccccaaaagaccaaaacccagaaaatgggtcgatcctgtcccaatccagcaatcctcctcattcctcgatctccaaaatcaataccagtaaccctagcggccacccaacgctgtggctgcgtgcgtggctgcacctcgtgcttgcgctcccaccatcctaccgcgagctcatggcgacgcggcctcaccgcagcttgcccgtcgccgtcggcctcgcggattacgaccagggccggccctggccctatgcagcgaggtgaccaccgggggctcatgatgatggggggcccataatggtgaggggccaacacctaatactagtaatctagtacgtcatccgatgttgagatcaatgatttttattctgaattaaaggtgttgcaggtgagtttgctagattctttgatgtccgcgtctgagattctgaagtttgttatggatgtagatttatatccaaatatttcagttgccaatcgaattctcttaaccgtacctgtgacggtagcttcagctgaaagaagtttctcaaaattaaagttgttgaagaactatttgagatcaactatgtcgcaagaaatattaaatggcttggctatgtgctcaatagagaaggatatcttggacactattgatcttaataccgttcttgatgattttacatcaagaaatgtcagaagaagtatctttccataggaagcaatggaatagggttctattcttcattaagttaataaataatgatattagttccaagttacaaatatattattattttagtcgactttatttcttgataattatcaagcatgttaaatttaatatatagatgtacttgttttcgttttgcaagtaaaattagcgtttatatatatcaataaattttatatgtagcttagagggcccatcacgatgagttcgcctagggccctcaaaatcataggaccggccctgattacgactctcacaaggtcgcgcctgccccactacacccatgcggctgctggccgtgcatcctgccatggccatggaggatgaagaagaaaggaagctttgtgctctcttattttccgtcgtcgctcgactttctactctcttcgggttctccttcggtggttcaaaccaagaaagtactgaactgatgaatgatgttgcgtttgtttgttggggtggtacttagatcatttgcaaattgacttagattgcatattttctagctgcagacttttgatttgaagtcttcactcacgagttaaatgagctggctcgagctgaacagggtttctagctagctcattaggccgactcgttatccaaacgagttgagccgagctgactcgttatcctaacgagccataccgagctgacctgaaccgagtcagttggatattcacccctagatatataaaatactgaatatatggtatatcaagtcatctttgtgtgtcatcaccgttagtcaaaatttattaagtgaatctggttttcttgtaaagtccaaaatgcccatacttctctttacataaacaagctagtgaaccataacaatgtacgttacaatatctgaaatgagaatatccggtcaattgaacatatatactccctttaaaagatattaatagttctgacagtggatctgccatcacctcatcaaatatgctattttttttatttaccaactacgtactctgtcatgttttctaccaactactctatatgctttattgttataaaataatttctctacacaaacgactctatcttatcttacatttgcaaaaataaaattacaaaaaaataatcataatttgttttagctagtaaaaggaaaatgcaacaatggcaaagttcacacttggttcccgtggctagcttcttcttagcgattaccaacggtcttcaactcttcatgttgctgttttttcttttaaccaagctaccgcagtggactagtagtctagtactggaggtccccgcagtccatgtgcgtaatttattctcacatgaaaaattgtctccttgacctgtctctcattacaacagtgaagctagaaaagttactatcaagagtaattgaaatgatcagggtcgtccgtcccggtgcaaataattaagtccatttccagtaaaatgtatcatttttatgttttcaagagtatcacataaataataaggtatttaattgatgattaaaatatcttatacaacgttgtttcaactttgttgtttcgtacatagtacatgcaagagataaatagtgttaaaaacagtggagacataatttcatccagatgaaactcatttcatctcttacttccttaatttcttacaacatcattaacattgctgacatagtaacctatttaatgagaataaaactcccactaaaaatagcccaaaacaaaatataaggatttatatttagcaagctaactttaaaaaaatagtctatgtgtaatacgaaacacccccaaccattcttgcataacagaaacacactcacatgtttaaatcagtgacgaagctatacagtgtttgggggtgcacatgaacctctaaattcctaatttctcacttaaaaagactacaatatacagtgttgtaataaaatgttctagattttcaatgatagtatacccccttgtcttcccccttatcttgatgctagcttcgcccctgctttctgcaaccccccctccccattagggccaatgaacctgtgaagttcaattttcgaattttgctttggcaatatgagcccgggcaatactcaatccaattttcgtctagggcactgcctgctggcaatgatgcgaacgatcgagcgtgggtggagtcaaagcctttagtacgacgtgggggcatgggccgaggcatgcatggcccgttggcctgggaataggatgataagcacgtgtgctttcattggtcttggtgccaatctaaaatacgacgataaaaataaatggagaaagtatatagaattattattgaggtatatgcatgtacgcaagtatcggttctaaatatggcttgacgaggcctaccaggtcgtataccaaattctatatggaatcaagctttatacatatggcagaggacttaagtagataaggaaagagttccgataagaaaagaaaaacagtcctactcgagcattataaatttataagatttactcggatcgtatctatatttgcctccctaattctatccagacaatggagcatccaagggtgtaaatataaaacccccagaactagagaggacacaccgagactaaaacaatacaagtcaacataaagctacaaaagtcaacacatatgaccacacaagaactatatgatccacaagtgccacaaaagcctatataagttcaatcgcacactctatatatgctaatgtaaggtcctcatcagtggcgaagccagcgatgccatcaaagtccggatgattaatagtgtttttcggtgatcgattaatctttatagatgtcaatggctattgatagtaaagatggta

SEQ ID NO: 45680 - DNA, 4238 bp, Oryza sativa
taatttccgaacttatttgtgcataaaaccctcgtccaggaatcagccgaggtacacaaactgacaatttaatatacaaatccatcataataataacgttacatacttacagaagaaaaaaaacagcagcggaattaacggtctagcgatggcttcagctccactcccacaggcagctcaactgggatataagccaaacgtcttctccttctggatcctttttcttcaactgaggttgattgattattgcaagaatgagcatatgatatactcaacaagccacacagcaaatatgcaagtgcacaaggataccaaatgatggcataatataggctcatttgcaaaagcagcatttagcaaacatttaagagtagtaaaacagtagagtaattaatcatcaattttaaccaacactgtacagcaccccaatgctgcacaggcccaaccatcctgaataaccatacccggctgtacagatctaactctaaaccaggagctaaacaaattattaccagttatagcatcaataattattgtgagaggtgtgagactaaccacgaaaaacattgctcaacctgcccatgaccgcgggcacggctattcgaatagttttactctggccagaggtgtaccactgtacccacaagacacagcctcaacatcatgtctaccatgcgtcgcgatactggaaagtacccgaatagaggctgtgacaataccccctacacaacacaactcaccacagtgcaccattcctggatcataatcacccctctataaatataaccataggcatggactccccagcgacccccacggacttctcgccgcttctcagtctggtgccccgcaatgaatcatgctgtacaaaaggtaaagccgttgcccacgctggcttgtggttggtacggttaatgtctcacaacagtagctcgcgaaccggtccttaattgtcatgagcacgaccttcaaaaccatgtgctcacaacccaccattgacaagttttaattatcaattaattatcataacacgattaaccatcgtgagctaccattaaatataatcataaataataacgtagtatgattcatcccattaatgagctaatgtttctaagcatggctaagcaattatatatatttatagcttttagctgaaccaaaccaatatataaggttcaagctaatcaatttgttacccaagatatcaaggaataaagtaatcaatgcaaattggccataacaaaggaataggttcacaccacccggtgacattcgaaaataaatgcacagttgaaataaatagagaatttaaatataggatcaacatgctcaaaggatttgtgtttagtatctgtgtgacttgccttgcaataatcggtcttcaattaatcttcttgaacacttccgacgcactcacgaaccttcgcaacgacggaaacagcaagctaacacgcaaaacggagaaaaaactaataaaaaccaaataaacagtatataaaaaataaacaaacatgtagatcatgattttagatgaatttagagactcgaacggcctcattccgagttcatatgaattagttatgaattttacaagattaaactgattttaagatttatttttagaagggaaaagggctttatgacatcatcgatgatgtcatcaacggcctctcgggacattacggtcaccggcgatctaggtcacggcggcgagaacggagggcaccaacgcgacgagcacgacgcggggaactcactgaggggcggcacgacgacgaacgaagacggaagacggccggcgacaaactccgaaggcggcaaggtactgatcgacgacggcagcggcttttcggcgacgagcagcggcaacggaggggtggacgggcttctccttggtgctgcgatgccgagggaggtggcggcacaagtcggggacgaccgaggcgacggcacggcgcggatggaggcgaagcagatcggtttgacgtcggcaatggccttccggttgtcttcggcttcggggaagtggaggccgctcttcctctcttcgatgcggtcccgatggaggcgacggcgctgaccggtgatggcggagccgacggctatagccggctggagcggcggccggaggaggagagagatggctagcgtggggagagagatcgggcttggaacgcaaggaatcgcgccgggaaaacctgggtttggtggagagataaactcgaatcgagctcgattccgcgttatttcttcgggataaagtccattcttgggggaaaagatagaggaggataggaagaatatttcccctcaactaattcaagaaacggctcagagaatcgagcgaatcgggcggaggaatcggcagcggtacacacggctcggcggctgcacgggttatgtccaagcttgaagacgacactgtagcagggacgcgaattagactttgactgggcttctttttctccagcccgattgaaggagggacaagaaatggacttcagaggaggaataaagccagctgaaaggaagggagaatgggccgaggactgaaggtgaacttttccagtttcagccggaaaaggaaaaggggatttgaattacttttccaattaaattaatcactgaaatgatctttgaattgttaaaaatacttccaatgctcaaataattccaagaaaattcttgaacatacttggacactcaaagtatttaggaatattaaaaacagaccatttaattattaatttaatatgtggataattactgaaatgttctttgtatgattaaaattaggaattgagctccgagaaatccgagaaaattccagagagtataattaactatggagaatttaataaaaaataaatccatccatgctttatatttaggaaattttatttcccgcatttaacttctcttataaattaatgaatatttaatataaattctaataataatttattaaataatttataaattctaaaactaaaatcaggatgtgacagtgatctagtgaaaacattgtcctcgggactagccatccatctccatcctattcaatgggtttactaaacagtcgtaattataggtccaaatgagaagactaacaaactggaggttaatttaatgttgacgtacggatcatatatcgaacctcgttgtatgcattgaacttgatcggcttccttcgattcgaacttttatgacttacttctgttcgagcaattgtaaaagatgagtgaccattgaccagttttcactcatcctataattgatgttacagtatcagtgtattatccatatctttctgatccttaataagaaaaggttaattagattcgtgctattataattttcatgattttaaaatatatcattataattcatctatttaaaaccatacgattataatttgacaagtattcgaaatataccactgcttaccccttcaacacattgaaagagaattttggacaaaattacccatttcttcttccttaatccatcccattctccttccaatcttcctcccatctctctcggatctgctcgactcgtcgcttgtgttgcagatggctgctgcttcgcgtggaggtggcaggggccggtgttagggaggatgcgaacgtggtagctcacgcatgcccccgtggagggtgaatcgcttagggaagcccggggaggagctagttgtgcccaggaggacttcagtagctttaattcttctgtgctgtggggttaactagtggcggaatagattgcatttactagaagcttaatcgcaagaaaatggcaggcatccgtgctttggaagtggtagcgaaatactgaaatagcagctggggtagtggaacgggaaaaaaaaataaatagtgattccactgctgcaccgtggacgatggacgttggtggcgacgggccacctggcagggctcagaagcaggaagcggggcttccgctgcagctccggcgattgcacgctgtaacgaggtcgcgcgtggagaccgggccacggtagaccaccaccggtgccgccagatttcctggccgacttcatttcttgctcatgtgcatctttatccagctgcataactctcattgtattccggaagctcgtaacatggggcctgataagtcccaatttacagtttcttctccgctaataaaaccaactccctcaactcgttcaaaaaaatgagattctgtttaataagttgttgatattcaataac

SEQ ID NO: 45681 - DNA, 879 bp, Oryza sativa
atcctatctctgcacccgatttctccggttggcctgtatgcctctatgagacaccataaatccaagtagcttccctgacggtactccgaagatgcacttttcagggtttagtttcatcctgaaagcgcggatgcttgcaaaggtttcttctaaatccgcaattagaacatccttctgcttggtcttgacgactacatcatcaacataagcttcaacatcgcggccgatctgagctgaaaaacatctctgaatcatgcgttgataggttgctcctgcgttcttcaatccaaagggcatggtgatgtagcagtaggccccaaaaaactgaggtcttcaagcagttggattcgtttagtcggatctgatgatatcccgagtagcaatccaaaaaactaagtagctcacagctggccgttaaatcaactacctggtcaatgcgaggtaaaccaaaaggatcttgagggcaagacttgttgaggtcggtgtaatcgacacacatgcgccattgcccggtcttcttccaaactagaattgggttagccagccagtcgggatggaggacttctttgatgaagcccgctgctaacagcttggttaattcctctttgatcgcgtccttcctatcctgtgcaaaacggcagaagtcgttgtttgatgggtttggcatcttccttgacatgtaaagagtgctcaatcacctctcttggcataccaggcatatcagatggtttccacgcaaagatatctttattattctggagaaaggtgatgagcgcgctttccttttacaatctaactgagcgcctttacagcagttttggtaagatcggagggatctagtggaatcttcttaatcttggcgtcactttcttgagtctt

SEQ ID NO: 45682 - DNA, 847 bp, Oryza sativa
gaggtgagggggctgccgccgccgtcgccggcgacggggccgcacgccggcggcggtaggtcgcgcggggcgcggcggcagggggagaccatcgccaagggccacaagaactatgagcttatgctcaacctccagctcggcatcaggtgcgtgcgtctgtcccgtctcttactcttcttctccttcttcttgttctttttatttttgtccgttctttcgatccgggtgctccatccaaatttccctacatggatttcctctcctttttcaatgtatttatgctgattgcgcattttgaatttcgtatgatgtaatgccatcgccaattaatctaccgtgcagataaatttgcaaaaaaaaaaaaggttagaaggtgatgtttattacatgattttaattagattattctggtctcatggtaagcaaaacttttcaatggctagctacaaatgccgaatgattttacctccccctcctgacggggatgtggcaattttacaagaagtcattgtttgcacgtagaggaagcgacgcgttgaaaaattcaacaaaaaattctatgcctaacatgtgcatttgtttattgactcgaagctgaaatggtggcaaattgtgattaattggaattttacgacaagaagaggggattctttttattgaaaaatttaatatgaagtcaagcataataacagcagggcatactgtgggccaaaagcatacttgcatattttcatttaagcagatattatatcttcttacactagaatagtaaaatgcatgtatttgcaacatttcagaatgaatttgtctatgctctaataactttgtctgggcaatagacatgcag

SEQ ID NO: 45683 - DNA, 2234 bp, Oryza sativa
  unsure (1)..(2234): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggttttgacctgagattggctctgattacggctgaatggtgtgtcagatgttgcgtggggtttgacgtgatggtgacacgcgtgaattggggccgagtggagagagaatttgagggcgggagatttgtggcatggtaaccgtgaaggataatttggagcaaaaatgataagagcagggtggagcggtgcacaggtaagaaaggaagaaataatatctggttggaagatgatcagctgtcagcacaaggagggagtagaatttaggaagctcacacatgcagatacatctattatttcgtgaaactagatttggggaattctaaatggtttgatgtctagcatatgcatttcatgaatgtgcttaagctttctgcgtggcttcccattacattagtaaattgtaaataagcatgcatgtaaactcagatcagatgacatggtaaattgatcgacttcagtagttcagttccccaagccctaactcttgataaagctagatagaaatagacatcttagcatcaatctacattctacttgctgcgctcacctcgtctatatttagaagatcaaattccaatactactatgacattaccttcaacactaattttgttatcatgccatcacaggatgcaacttttagtaatgaaaacctaatcatattcactttgttaggtccatgcacagtgattttctccagaaaattaatttgggaattcttggaactgtttttattcatcatgttgagcataaagcagtatgcttttagttagcactagagttgaacacacaagagttaattaacaacgtggtcatgtatcggatatacatatacaattcctttccatttcatctactatgaattttgaatgtttgtctatatacatattacgtacttgctaggtattgcaatctcttagtatatttaatattattgtcctgttcacatttctgatgtcaactagtgtgctaaccaggttttcaagagtggacctctcttcatttcatcaaagggtacattcttgctctctacctctgtcacatgtatcataagttgtttcaggccgtttatgtgatgtaaacatgtaaagttagtccaaatattcccattttctcttgtgtctctgtttgaattcttcaaagaattgaggcactcacatatttttggtgatgaacgccgacaccatgattatatagaggatgccataatattcttcttttttgtgatattaattatttcttggtttcttggattataagcgaagggggaggaacatatgttctgtaatttccaacataggttaatcaggttgaagtatcttgctagcaatcatgtacgcacaaaggaactatacgaatccaggaattatctagagaataacttttctcaaagttagatatgcttgtatcatgcctttgtcaccaacttacgtgggaaagataaacctgttgccatggggaaggctccaaaatccaaaccaaatgatagtttggattgccttatgcctcagaaattcaattagagtgccaaatatgactcctgccagctgaatcatgattttcctgagcagattgattcctacgaattgtaatttagttaatctaccaaaatcaccctttcatatttgaattaaatcatgtgttgtgagtcagtatcacattgtctatttttggtatgtcttctacaactttctaatatgatatcatattcttctacagtaaagaaaactctttttatatataattttcaggaatcgggtggaaatcatggaaaaaacggtggttcatcctcacacgaacatcattggttttcttcaagagtgatcctgttagtatttctatcattatatgtttcctctgcttgagaagtcaataattagcctggtgtacctttgcataacttgtttctcagagccctgaatttagttgatgttatagatgaagtatagcatatgaactttttccggcaaaagcacaaccaccacag

SEQ ID NO: 45684 - DNA, 14526 bp, Oryza sativa
catttccttttctattttcgatagggagttgagttaaattatttaatgagtcctttctctctctctcccacccacccactagtgcagttataacttgtgtaacaacaaccatttcctaattcttgataaaccttttgttgacattgtagagtaccttgccccagagaggtggtgaagtgaatgttactctgggaggaattgacttgaataattctgggaggtatttacctcattcttgagattttcttttcccttttaggatgtacagataatactgtattaaaagctcttatcatttgcagtgtggtagtcagagaagacaagaagttattgactgtccttttcccagatggccgtgatggtcgtgcattcacccttaaggtaagatggtttttcctttcctatttaataattggatcatctcaacacagatgagagattgaatgatcagacatatgttcatgctccttactccttattagtattttctgaatgttgtatatttgcttaatacaggcagaaacttctgaagatttatttgagtggaaaacagcattagaagaggctcttgcgcaggctccaaatgcagctcttgtgatgggacataatgggatctttcgtaatgaaacgactgacacatatgatggagctatcccaaattgttggtctacttatgctatttcatttttttttcttctcctactcattacaaccttgtttgttgttaactcatgcctttccaattatttgcagggagagagaagaggccgatcaagtcgttagttgttggcaggccaattcttctcgcacttgaggatattgatggaagcccttcttttctagaaaaagctctgcgttttcttgagaaatatggtgggtgcacaaataatttttaactagcaccatctttagaacctggagtactgctagtttagcatctgtacaatgtacaatagttatgttaatcttttcttgtagggataaaggtggaaggaattctacgccaggctgcagatgtagaggaggttgacaggagattgcaggaatacgagcaaggttgaaccatttcttagtttattctatgactagtattgttaatttgatggtattggtagctctgttttgtttttgtcttcgcttattgattaatttgcatatggttccattattgtgcctgtttatatcccctaccaggaaggacggagtttgcaccggatgaagattctcacattgttggtgattgtgtaaaggtaactctgtcacggtacctcttcttttttgtgctgggagcttgaataatccgttctatcactaactgtatgttcatgtaaacatctctgcagcatgttctccgagagctaccatcctctccagttcctgcttcctgctgtacagcattattggaagcttttcgtaagtgttctattcagtttaaactaagtgatattgctctagtatattccgtcactgttgagtattgacatatgcataggatactaggaaacacacctaggttcctgttgtgtatcacttacaatttaattccatctcagtctattccaggaagtctgtagataactgtggaaatggggataattatctttttgaattatgtagttattttgctcaaaagtgcctggcattggcatgtccccttgtatggccgatgattatatttctatatagtttcatagtatgctcctctattcccgtgtattctttgcctctgaattttagttgatctaggcaagcatctaagatgctagttgatgtacatttatcgctaagatcttacatgctttctcatttcctttgctgtctttttatttgactaactgtctatattctgctttactttcctagggctggagactaaggatgctcggataaatgctatgcgctcagctatagttgagacatttccagagcctaatcggcggttactgcagaggttagtttcatggttttcctcgtatcaatttttttttctgtttttcttttttgttatactggatcgcatctaaatgttctaggaagttttattactctcgcttgggcttcaagtccgccagcttatgctaaatgatttatactgtttatgggttaaaaaccttgttacaagtgctttcatgttttgtaatacaagttacacaaatcttgaagcactagtgaagggtaagtagttggaatccacccttgacttatgcttcaaactttgtggcggttctcaaagggtgaagcgtaagagcaccttgcataatttgatttttggaacccttacagaatagagcatatactaacctggttattttagccttggttgaattttaagtttgaagtagcaacacctcaataatctttatctagatgtcttgtttgatcaattagaatttggataataatcatatgtcaaaaactcctttttctaattgagattttatttgcagaattttgaaaatgatgtatactatcgcttctcatacttccgagaaccgaatgacagcatcagcagttgctgcctgtatggctcctctgttgttgcgtccacttcttgctggtgaatgtgaaatggatgaggtatttgatatggatggcgatgattctgcacagcttcttgctgctgcaaatgccgctaacagtgctcaaggcattgtcacaactctcttagaggaatacgagagtatatttgatgtaagattctcaactccttttgtggattcaccttttctgtgaacaatctgttgatattaccattatccatcgaaaagctaacaatacttcacatcaacagttgcgctaattctttttcattggaatctgtctgctggaagctatgcctttttcttttctgtgtagaacatattttgaaatgtgaactagaaataaagacaacactaatctattgatcattcatatttatatatcttacagggtgaacacaaccttagatgctccctgtcgccagagtctcaaattgaagatagcggtagcgaggcatcaacagatgatgtaaatttggatgtcaagggtaatggatttcatgatgctgaaaatgatgtagatcaggaaatggatgatgagaatggcgcagaacgtatacttagtggaaaactgagtgagagcagtggatacgctggcagtgacctctatgactacaaggttttgatatgcttcctactttttaaatctctaatctggttattactgctgttatttattgttgtacatgtataagtatgcctttttatggtcttaagaatgaagataaaaactagtagggcattaaaagtagttcctgacttcctgttgagttgttgtacatctatgaggagcttgttttttggacaccagtacattttcagctgcaaactgtgaatatgtaatttaaatgtaattattgtagtttttttggaggaccaaaggatatgataggatgacccattttgacccctgccagtagatatcattgcagatacgaaagactcgggtgaaatctttgttgctaggtctgaacaaatatggtttctcaaaaccatttgacctggtcagccaatgagtttgaatgcatgcaaacttagaacccagcaatgtcccgccaagcgataaactgcctgggttcagaaaaactaataaacaatattttgagaacccttgcttattgtttttgtcatcttgcagtattatttaatcatgccagtctgggttatgcttgtaaatttccacttccatgtattttatggattagagcttgcggcatggatctattatggttatattgatggtaatataaccctgaaggctgtcatcttctgttaaatgcttctgcctatagatcttccactttagaatattaccttgttccatgtaagaaatgtcttgaagttttggtggttgtatttctaggttatatgagtatctcatttgtgcgtttccctttctagcttcaatactgtgttgagaggcaatttttaattttatttctgtgtacttttgaatgtcccaatcttaatactttatttcttatgttcacctgattgaacaggttgttcatgctgatgattcagatgctgaacgttctgaagatgctaaggcagcggaagtaaagattgagttaagcaaaggtccaaaaagtcattcagctgaaaacggttcagcatatatggaaacattgctgagtgaaaagaatccttctaacccaatatctagccatgagactccactgtctatgggagaaatactttcttctttggatcctggaatatctttagctaatcacagtggtgaatattctgtagaaagcagacagccagccaaaatcaatggatctcacccacatgtgaaacgcagtaacttctgggggaggaataatgtaagaaaaacctagctatgtttatttcttttctgccttttttttggagctactgggtattaatagtgcattgctgttccaccttcctactccatcgaattatggtttagttggctccatattgttcctgaagttgtttctggaattattagaaaccttattctgttctgagttctatatgcatgttttatgcaggcaagaaagagtcaacactctgaatcagtcgactcatctggtgaagaagagtaagccctttgccactaaagcaccaacaaatcatttttgtttacactttacagtgctgtttcgttgagtttagttgttaatagttgtgaatctgagcagttgtattgcattaggccattctatattgactgtggaaatgtttgccaatgctctagcacttgcccttccttgaccccctccattgctgctgccaaggcactgaggcctctggctgagaagggagagtctacggacttctattttcatttcttgcctagttgcctgctgaaaaggatgataatgcccctaacaactcaatttaatattcccaactaataagctgtcgatagattaataggaattcccctatccaaatggagaaacgttggattaacctagggtctaacattgttttgaatgaggctgaaacagaagtcttagtagtcgtcataatggaataccttgaacacccaaaccttcctatatcgatcaataacttgtttgttaactaagcctaacctaatcctttaacttgctgattcataacttgctaactaagcctaacctaatccagagaagttaaaggatcaataacttgctaaggacactccctggttgctgatattgctactgtacgccgctgctgttcatttgttgaatatgcataccatagattaattgattgtaattttgctttgcaaataaaaacttccaggcttgctattcaaaggctcgaaatagcaaagaatgatctgcagaacagaattgccaaagaggtatgtgaagaaaatgcacataagaatattctattttatgcttgccatctaacaaggagtggcttcaggctaggggtaatgcaattctacaggcaagtttggaaagaaggaaacaagcactgcatgaacgtcgtttggccctggaacaggatgtatgttgcattcccttgtaccatcaaatttgcttggtcgtcaagtgcatatgttttactatagtatattggggaaagataccctttttttttgtcccttaggcaggttctgaatcttagaattctttcaaatccaacatcccactggtttgctggaaaatgcctagttttattgacattgtgcatctagcgttcttttcatttgtcttttattttgtgtgtttcttgaagcttgtctcttctttttctacacgttgaatcatcagcgctgtctatattccttgaaaatagcaatcacaaacctcactgttcactagttacatgcaaaacacagaaatcctggttcttgcctggatttccagcaattcagaatgaggtccaggcagagacttggatcccctcgttgacatttgaactgatagctccttgggccttgcttatcgttgaatcagatcagggttcctaatatcagtaatcctggtattatcgttcatcagtgaaatacagtaaccttctggttactggattttactgcactgataactgtcagaataattataaattataaatataatctcaacatcattcctgttggtgagcatcccctaaccagtcccaggacctggactgcttaccaccagttttttttaaccctgacccagaggctcgataagtttgattaatttgttgctgaggttgccttcatcccttgcattggaaatgctgtaaaattgagggactaaaatgaaataatgcctgcacaaaagtcacttttacccatagcccatagactgaggaaccaaaacgatactttcccttacatttggttttggctgaacacttgtgatatatttgatggtgactgaaacattcagatagtaatttctacaagtgtgatattgataggtgtctaggttgcaagagcaactacaggcagagagagatcttagagctgcattggaggttggattgagcatgtcttccagtcagttttctagttcacgtgctatggacacgaaggtacctctagtgaccgctctactttatggaattactttacggagtctcattttcactcattgtttttctcaagacgagagctgaacttgaggagattgctcttgctgaagctgatgttgcaaggttaaagcagaaggttgcagagcttcatctccaactcaaccaacagcgccaacaccagtatggccctatggtagatgcaaatgatcgttaccaccgtattcctggccatttttcgcagcagtaagtaatcaactttgttgttttcttttttactactgctatttatacggatggatgttgctagttcagtaggtttggcaccttttgattttctgtaattgtgtttattgttctgtttcatccaagtggccccatttctgtaaagagtggctgcaggtatgcagccacagaattatgctgcaactggtgcttacttgaaatctgattgtggacaacatttcactggaaaacaatctgtgcagtactaattgatagctcaatgtatcgagacatattggatatgctttactgagcttaatgatttctatcttattttgactattttattggtgccaggaactttgttcagccaggattcgacatgaaccttgccttctgcaaccaagagaagcagagaaatgaggtttgttaagaactatttactctacacattgtgagcttaataacaacacagaggtgtgttgaatttcaggtccaacttgacccctgtgcacatcagcataacaagaatgctctattatactgttttattagtttttactcattttcagttttggaaacggatattactgctattgatcatgtctcctaaacaaataataattgctctattttgatgtgtgggttgtggtacccaaacaatttcttgcacgataatattgttaggagtttccaccagaaggactgaaggaaacacactcgctttaatctgatattggcatcgtatccctgactaacatcggatcatattttggcatggcaggagagttcggtggactcatcacagtggagaaatatcaagcagcatgtgctaccttatggttcttcaaggccactcacccgcaagctctctttggacgcatcttcaagcgattcaagaggcatggaggcatcgacgagcatgccaacagataacactgctatggctatcaatgccccaaagtttactgaggttagggaaatcacagccactctatttagcactactaatatcctccaaaggaagattgttcttatttttatcgtatggcagggtgttgattatgggaggcaaccaatggtggcctcctccactttggtagaactgacaactaggctagacttcttcaaagagcggaggtcgcaactgatggaacaactccacagtctcgatttaggacatggatccgcttctcagggttttccatacaacaaaccgccctctccttgggacagtccaaggtaggatgttcattcagttccacgattgtatattcttggtagttattcttttcccatccatgttaatcatttgtaggaattgctgttgagaatgtaaatttatttttgttctccaatacgggttttatcgtatcgctttgcacgagttagcaacttgagtgtgatgttatagtctcctgtatgtaatgtgtcaaggtggggtgccattcaaaacaaaaatttccagcgctataacagtatatatttgtatttttgtgtggctactcaaaaggaaggaatagagttacgcgtttgtacggttgtttggtttataacacttggtttgatgaaggtgagaaagaaaatgattaaatgagaaccctgttggtgcataaacaatctgtgtttgaagcttagctttattaccattgcaagtaattttcccttgtccattctgatgccatgctgtgtcgtaccgtacgtagtggaaattagaacacagcgagggacaaaccgaaccgtaaggctcacttggaccgagaaaaatggaccggaaaaaaggaaaggaataagttcaccggctgtcccttaactttacaccgagattttttgaggtcccttaaccataaaaccagaaatctccacccctaaactatataaaaccgttcactcaaggtccctaggcagtatatacaggtggttttgctgacgtggcatcctagccagaaaaaaaaataaaattaatgtgtggcccacatgtaagtgagacaatggtgtgggttccacatttctctgttttttttctttttctcttctcttctctccgagttctctcgagtgtcgagcaggcgcggcgaccggggggagagaagtggccggcggcggagcggggacggcggcagcggagagggagagagaggcagtcgatgcgacggcggcggcgggagcggaggagaggtggcggccggtgcgacggcgagctcggcggcggagatgttcgaacgtgccgggtgctcgaccacgggccccgccgccgcccgatgagcggcgcgctctccctgtcgaccctctctccctccccaaggcgatggggctgctccgctgccgaaagagctgctgcctccactcgatgaactaccttatccccgacctcaagtgcagcaactttcaccgacgacgacgacgagctcaccatcaagctccacgcccttctcggcaacaagtaagcaaaacaaatttcaacgtgttgtcatctgctccggttagctcttcttgtgttcttggtgctgattgattggttctgcaggtggaacagcacatcaagcgcaagctcatgagccagggcatcgatccgcagacgcatcagccggttagcgccgggaccagcgttgccgcggcaagcgagctgaccacgacggccagcgctgtcggcttcccatccctgtaggcgccggcgccggcgccggcgtgagggagctcgaggaggaaggagggaaggctgggaggggtcttcctcgaagtcgttgtctccggcagaggccgagtcatcggcgaaggtgagctcgagctccgagtcgaggagcaccgcgaagtcatcgctgccgctagaccacgacgaggaggacggcgacggcgacttggcggcggggcttatggccgagggcaaagggcgtgctttggtcgattggggtgggctggatgcgcatccgcgctcgcccacctccgctccaatgccacgctcgccctccgccgctccacccgccgccgcgctcgccctccgcttctctgcccgcggccgtgcttgcgctccactgctcggcccgccacgattgcgcccgccgccgctccgctggcgcttgccctctgctgcgccacccgcatctgcgcgcgctgctccgcctgccgccggcctccctcactgaagaagagaaatagagaagagagaaaagagaagataaggagaagaaaagagaggaaaaaaaagtgcagctgacatgtgggccccacgtattttttaatttttttttggctaactaggatgccacgtcagcgaaaccactcatatatactgcctagggaccttgagtgaacggttttgtatagttttggggtgaagatttctggttttgtggttaagagttctcgaaaaatctcgctgttaagttgagggacctccggtgaacttattccaaaaagaaacctcgcgtaggccgtaattcctttcggaccagaatttaatgggcctcatgtgggcggcaatcccattccggaccaaaaacacaataggcttcatgtgggccgcagtgtcgttccgggccgaaagtatgatgggtctctcaatactgttacggcaaaaaaatatattttttaccgttggatgtcgacgaaaaatccaaacggagagaagaaacgactctgcggcttcggccagcagagcgggaggtgagcaatggcggcggcggccggccacagcgctggatcgagaggttgcgcggcttttaggccagttccaactcaatgatcaggatggtgtccatagtattaaataagctaccacctatgatgaaagatgatgtggcaagcgaaaaaaatgagaaaagagaataaaatcagatcttgcataagacatactccctctgtactcgtaaaggaagtcgtttaggacaatgcttaagtcaagccttaggaatataaatcatgaataactcttaagttgttgaatttgaaaatgtaaaaattatatgaatagatttgtctttgaaaaatactttcataaaagtatacatatatcactttttaataaatatttttatagaaacaagaagttaaagttgtattttggagaccgtgtcgctgtctaaaacgacttcctttacgagtatggagggggtagtttctacacaatatccaacatatcatgagagataagtagaattaaatttaagtatggaagaatggtgtttatattgaaagagtagtgtctagtagtagtttattgatgatgtggagtttatgaaaactatgtctaatgtcttgggttaggactggtcttaggcggagcttgatcatgaagcgccgcgtgagccctatacccttgacacggagcagccgcgactggcatatgctggtcctctgggacattgttaatttgcttgatggtatgcaagctgttcggacgactgccggcaaggcatcgacggatcactgaccgctggttcgctgcgattgatagcaaagatgttgttgtcaacatgtagaggattctggtgatcccaatcccatgtaattttttattatttccttcttcttatgaaattagggagttcagcatgaatttttgtagagttttaaacacaatcttttttttttgttgttgttagtgagtcagttgttgcaagtcaacatgaagtaatatttgttatgttactgtgaatataaatagctagtcatgctaagtaaatgtcgtccacttcaagagcgtctggccggtaattcctcatgtataatttgacaatgaatagcatttgaattgggaagagtttctgtgtaactgaaaaccgaagaatgaagaatgctcccaattttagcgcaaacaagatgcatctcacaaaatgttgcatctccaatatctatttgccactcttagatttggcatttaagtgtttaactatttggcacctatgtatcaattacgtgtgagccctcattgtttcccgattccccactccacgcacgtaagcgccctgatcgggggcgctagccgttccatggctgtgagcccctctcacgcagcgccacaataaaaggggagtcaccggcacacgcgaagtgagtttttcccatgcacatgtgctccccacaaaccctaagtccctccaatctgggaaggcgttgaagtgaggggattactcacgttctcactgccgccgccatcgtcatctacaccaacaccacaccactccgctacaccgtcgccgtggccgcatcaagctccaagtccgacgcctctctctctctctctctccctccgctcacccctcaagaacatcaacccattattgctatgagctagcatctcaacccccccccccctatattgacgtgcaatccttttgcgcattcgcgaaaaaatagcatatcacccctagatccgcacctaatgatcctatatttctaacactcatatgtcggacatatgggtccgagtggcaaatcattaagttaattttccccattatcttggaagaaatctgacaacccggcaaaaacaacagtatgtgcttactttgacctaagtgacatagctaaaatacaccatcttaccgttgatatcaggttcaggaatgctaagaaaataccctgagcaatacgtttcattgatttcagaggtggtagcaaaaatggtgtcagtctcagatattcctgcatgccattgacttcaacagtgaagaatctcctaaagttatggactttagaatgattcatatgagttacataaggcgaatatgccctcgttaataacacacataaacaagaggatagcgacatgttatctcataaaacatttacatctctgaactttgtcactacaaacttcgctctgtaagttgaatcttcaagtgtgccaaaaaaaagaatgaatcttcaagtcagcatctacactaacattagtggattctatatgatgtatatagctatatttaggcatagcttggcattgatgggctatgctagactggccattgtaacaaagtagctgtagataggaagctgtgtctatttttcaggggaagaaaagactgttgaatctgagattattgaaaagcaccattgtcccaatcggagccatctgaattccttgggggtctgcaagcagggccttgatcagcctgatggcttctgcttgatcatatacaagtagaggcatcaaacctgctgaaatatgaccagcatctatgtcggcagctgcggtagctctggagtcccaatgtgttttcagatgtctatcttctcttcttggaacgctttgtacacaaaatctttgaagcgtctggaatactgtttcggatctactgctgaaatagatgttgggtcatactgaaaggacttgtatgcatgctcaagctttttgctgatatcgtagtcttgaaggatgtctataatcccaaaatatagtataacatcgtagaactccccagtaggctctccgatgatctgaggctcgcactcactctttcgtactgttagctcagctcttgttggcatgttggacccaagttttatcttcgaaaacctgtccacccaaagaatcttagtgatgttaaaattagaacttggagacatcaatacagccaaattatttcttatcatatagaagtgcaaggaaaaggaggtaaaatggtggtggcaacgaatgctgcctattagttcttgatgacaagtatcgtatatctctactgcaatgaagcccgttgaacataacattagaatcaaggcgaacatcaaggaagcatatatatggggcatctcaatatggaagatcgtatagcatgtgtatgcctgaaaagtattgacaacaagagcaagagtaatcaagtatcttattttacctgtttggatcagtatctcctctagacaggtgaggcgatgacgctctgctactatcactatcaaaggaaccttcaacccatgcacttcgtaaggtatagaacaaccatgtcaaaaacttaaattgattatatttttcatcttaccttcacttgctaatagatttcttttgtctctgaaatgtacacccaccaaaagactgtagtccatgatgttctcttgctcaagaaagtcgcagtccttatcgacttgtctgcttgaacacatttaacttctacattaacacaacgagtaaaaatgtgatgaccactcactcttgcactagcctcacttaccttaggaactcttggtgccagtgtttttgcaatcgaaagataaagttaagatcgaggtctttcaaagtagtgtattcgtcaatttctgtttgtggcttgtcagttgtacgtccaagtgatgagcctttcagatcaaatcgtctatgaatggaataatcagaacaaaacaagtttcccatgatgacgaaacgaacctggtaataatatagcaaacagatgagcagacatgacatattgatttataagcttaataagaatctattggctaataaattagctttagcatgatatacagatatatattaagtactgaccttcttttggttagctccagctaactttacacaatgtagaccaaaaaatttggtgactagagtgttctcaaatgaccgaacatgattgtagtaagctcgaagcatcttaagaaatatctacatgatggcaagttctttgtagatttagtacagaagtgccagatgtgaattcagaaagcatctggacaaactaaacatgatgcaccaacctttacttcagatttcttcatcgtctttatcatgtactgatcattgctcgtgagataaaagaagcttccactctta

SEQ ID NO: 45685 - DNA, 4329 bp, Oryza sativa
actcggatctgttcaaagcttttccgcctccttttttctctcctcccacccgggagttttgctccccgcgcggacgccgagctcgcgcgcccgctcgctcgcttcaaccatggcctcccctgctccccccgccacgtgccgcctacagggcgtcccacgtcaccccctcctagctcactttctcctttagccgcagccagccgcagccagcacatgcacacagatgcaccaaatggatccatatgattttacaatgttaaaaaaatcctccctccgttgacgccgttggtttttttaaacatgtttgaccattcgccttactaaaaaaaatttaagtaattattaattctttttctatcatttgattcattgttaaatatacttttatgtatacatatagttttacatatttcacaaaagtttttgaataaaatcaatggtcaaatatgttttaaaaagtcaacggcgttaaacatttagggaaggagagagtatataagaaactatcgccgcaaaacttgagataagagatgtgtctatacctatattaattgcactgcgtatttttccttttgttgcaattttgtaccgttacccctttttaactaaagtggtactccctccgtcccataatacaagggattttgagtttttatttgcactgtttgatcactcgtcttattaaaaaaattagaattattatttattttttttgacttactttattatccaaagtactttaagcacaacttttcattttttatatttgcataaattttttgaataagacgagtagtcaaacaatacaaacaaaaactcaaaatcccttatattatgggacggagaaaatagcatcgtgaggtaatcttcttgattttggaaacatcttaaattttttaagtaacctctgggttgtcgttgtaatcgtgataccaccatcggataacggtaaccccgtcaaaaatagtaaggaaaatcttgctttctactaaggtcctgtttagatcccacgcaaaaattttacactctgtcacatcgaacgtttgaacacctgcatgaagtattaaatattggctaaaaaataactaattatacagattgcgactaatttgcgagacgaatcttttgagcctaattgctccatgatttaacaatgtggtgctacagtcaacatttgctaatgacaaattaattaggcttaataaatttgtctcgcggtttattgacaaattttgtaattagtttttttattagtgcccgaacaccccatgcaacaccctatataatatccgatgtgacacgataaaactttatacccttggatctaaacacaccctaagaataattaagtaccgccaatgtcaaatataaaatggttagagggagtattacaaaaactttaatgttcatctacaggtgtagtgcaacaaatgaaacttaaatagcaaaatttactacatgacacttaaagtttgtaatttttagtttggacactgcaaagatgtgacacactcaaggtcatataaaatagatgatagtaatttgctaaaagacaacgtgaccattattttatcattttcaagccaaatggaggaaaaaaaaacacttagaaaagacgatttatctctcaggccaacaacatgtaacccagctaggtatgtttcacagcagacttcaatttctagatttttggagatggggtcagtggagggaatggggcttgggtctggtttgaactagacccaaccaagttacatgctgctctccggaggggcaaacttgtcttttctatgcattttctgtcttgatttaacccgaaaatgataaaataatagatatggtgtccttccgtaaattatcagttttgggttgtactcgagccatatcatgtttctgcggagtgcaggagcaaagaccagaaacttttggtattctatagaaaaatttgtcaatttatattacattatctataatgtagtgtagaaaaaaaattgagccaccgaaacaatgatcaggtcaaatcatggaacatttcaaacttttaactgtcaaactgtattatttttcccagcaatactcagattttctgtcgttttacctaacaaaatgaatacgcagacagatatgagcagaaaaaaaaaagagaacaaaaccaaggtaatataagtgtattgcacatacacctccaacaaattctttttggctgggccggcaaaagatgccggcttagtttattcagatcttacatatgccttccatgtaatagcagggttgtaattacttttctatttaatatattggatactgttttggaaagaaaattaaaaaaagaaaaacgccagtccagtatattcaaaaaggagagtacaacaacaacgtactacctccgttacaaaatataagacattttggctttgcgatggaagtagtatagttgttccccaccaacaaattctcgcatatagaattttgctacaaacagttcatactctttaaaattgctgattaaacctgctttgagctcacttccccctgctcagaggtcacaacttcacattattatggcctttgaatgatctaacaacctgcagttgaaaccttggacatagctgtttgatctgtctctttcatcgccacagtcaggtacacactgtgcaacttgcttctgtgttttttttggcttgaagcagattgccatcatcacaaacagacctgcaagcagaccaaatgttgatgcccaagctgccaccagtggggtcatctcacaattgcataagctgcctgggattaggcaggtagcacaggcattgtcactgtcaatatatcatcaccagattatattccatctggaaatcaaactgagacagaatgatcatgccccttcaattgcatctcacattctgaacacaccatcagcaaacagttcatcacatcttgccttttgtagcatcaagagagaaattaagagggacgtgatcaatttgttacagaggcactggtagaagaaaggggatgatgactcacaatttggatttaatgtcgcgcaaaatcaagaacagaaaaaaattccttccaatatgtcaaaggttttcagtacatgaaagaatgatctcctcaggcaaaggagcatttacattttacaacctctgactggcttgtgcacccgtggtttacatgtttctatgtgtaattttgaatctgtatgttacatctactcttgtaaatattagtgaactccgtgtatatgtacgtagctactcatatttacaggaaagtcaatcccgattcctggaaggcgaggaaccagcagcctgaatggtgctccagcaactactgataccttctacaaaaacagccgaattccagatgaccagtttggtgcaggcaatcgaatatgcgagcttgtgtagcgccgtgctgtcctgcgctgtgcttgatctttggcctttgcaaagtcctcactttggagctacattttgtcagataaactttcagctctctgctcgatcttcttggaacgcgttgtatatgaaatctctgaagcgcctggaatactgtcttgggtctactgctgagatggatgtcgagtcgtattgaaaagacttgtaagcatgctcgatctttttgccgatatcatagtcttgaagtatgtgtattatcccaaaatataatatcacgtcgcagtactgcccggttggctgtccaacgacatcagtgtcattctttctgattgtcagttcagcccttgacagcatgtttgccccaagtttaatcttcgaccacctgaagtcagatttgttgaattactttataatgtagcattttcaaatatacatagggcataaaaaattccatttggacaattgcaatgaacagttgcaccatctgtttgatacttggaggatttacatttcttggcatttacataacaaatacaatttaccaagaaattacagaaagtgagataatatacctaaaatactttctactccggagaatgaatacccccaacagaatactacagtgaacttgtatatttaaaatggataagcagaaggttacctaaagccttttcataacaaaattactggtaaaaatcattagttaccaaactaagacggctatagcatgaatcaaactatcaatgagtagggttctccactacatacatactaactaaatgattttgaacgaggaaaactaactaaaactaggattgcagtatagctgagagaggaataatttagtactccatatctcggttacctgtttgggtcagaaagaaagtgatccctgtcccatcttgaaaggcgtggtgatgcaggtatg

SEQ ID NO: 45686 - DNA, 2048 bp, Oryza sativa
aattcctgcagccctgtatacgcatcaatttctgccagtggcttgttagttgtacggccaagagatgatcctttcagatcaaatcgcctatgaatagtgtgatcagagcagaaaagatttcccattatgacgaaacgaacctaggtagtagtacagcagcaaacaatcaggcatattatgcttgaaaaatagcatattcatgagggcggagtggataatcatatattgttctaaccttcttctgatttgctccagccaactttacacaatgtaggccaaaaaactttgtcaccagggtatcctcgaatgcccgaacatgattgtagtaagctggaagcatcttcagaagcatctgtgtggcaaagtttgtccatgtattcagaatagaacttctaaatatagaagcttaaatggtgctatttgaacaaagacagcaaaggacaacctttacttcagatttcttcattgtctttatcatgtagcggtcgtcatttgtcaagtaaaagaagcttccacttttaccaggggacgagagttcacggagagcatcatctccacaaagggatagcatatagtcagctggatcaaccttaaacagcttgcgcaatgtcctgtgattttgtaaagaacaaatgtgcatgttgacatggatgaagccataaaacagtcactaatctataatgtatctatcatgggagtgataaccaaccggaacacctttgggcagtaatccttccatctgaaatcagaagaattgtgtggaggggtgtattttgagccttctggagggaatttagtccatactttttcttttgcgtcaaatgctgatgacttcaggtctaatataacctggccttgccttcctactgcatgcctatgtacaataagcatactcagtgataataagttactttctgagcttacaaagaaatatggcaatcttactgtcgaataattacatcttctcaaaagatatggaagtgctacaagttctgaaaaaacaataacaatcttggtttctaaagtaaaatatgttgtaaacacaaagattggtaatggagaaaattcaatgataatccttacatgattaatcgttgataatgaactataagaatttcattttataactttgtaagagtactgtctatggagtctatgatatatgatttcattttcaggatttcaaactactgatagaaggactagtgaggcagtgttaagatgataagaatgccataagagtccacaaaaatgcctcagccaagtcatcgaattgtgctcaaatcattactactttacatgcaaggcctcggattctttcttgatgtccacactaccaacgcatatgaattttgtcgctgaaaatgtttgtccattctagataaatgcttcaatgcacacccctaatatttcgcccaaaattcccatttcgttgtttaccgacgagatgacaacatgattgttcatgcgagatttcctaatttcacatttttaaattcctcgcatggaaacaaattgaagtattgcgagtgcaatcaaagagacagaaaatcgcgggaaagaaacacacgcacctgatcccgagctgcaggttgagcatgagctcgtagttcttgtggcccttggcgatggtcaccccctgccgcttcatcacccgcggcggcgccgcccccttgtcgacgtgcggcggcggcggcggcgccgccagcgaaggcggcggcggtcccctcccctccctgacgctgctccggcgcctccagtcgtcggcaatgtcgggcttgacctcgccgtcggagccccagaggtgcggcacgcccaccacggagccgatgctccggcccgacgacgagctcccgcggccgctgatcgaccgcgccagccacctcagcgaacgcagcgacggcagcgccgactgcccttccgtgctggagcggacgcactcggggagctcccgcgcgaacacctccctggggtcgcgggactcgcccgccgccgccggggacgggtagtagacgcccttctggtggacggcgccgccgggggcctcg

SEQ ID NO: 45687 - DNA, 2892 bp, Oryza sativa
tcagacaagttttgggagtacgcgtagaacattcgatagttttgtagaagaaaaacttacaaatgtaactagtatataatcacaatgcaactagtatgtaactaacacgtaacgtgatttttttttccaaaaacacccagcatcataagtggctagggcagtggacttgcaaagcagcaagtcaaggattcgattctctattcgcgcatgcacaattattatatttatctcggtagcatgaatcttaaagaacatttgacggtggaaaataaatgtgtcgaaagtttttaacaaaacctaagtcagatatattttggtatactcgggccttgtttggatccaaaaatttttgcctaaaaacgtgaaaagaaaccaattgcacagtttgcatgtaaattgtgagacgaatcttttgagcctaattatgttatgatttgacaatgtgatgctacagtaaataattactaatgatggattaattaggcttaataaattcatcgagcagtttacaggcgaaatctgtaatttgttttgttattaatttacgtttaatactttaaatgtacgtccatatacttcaaaaattttacacccaaaaaactaaacacaccctcggatattatttccaagttcatgcataaataatgacacctgtaaaattgatgcatgtgtctgaagaggatggctaaattagtgcaatttaggtgaaattggagtaagccacttggacaggaaaatgaaaaatagggtaaggagtaattaaggtggggcagaaaaggaaatatcaaatatggggcataaatagatgtatctaattttctaagagaaaaattagcaagagaaatagttgaattgttgcgttgacacgtttattaagccaactcaatcaaatattccatccaagatcttctctgttttttttttatttttcgtttgcttcaatcaattctcacacagctatgtgtacagtacatgtgtctgtatacaagggacagtgtgtatgattatttaatatgcattattgagttgcacatgactctttttgcatgtatgtttagacttttgatgaacgtaaagtcatgggatctacaccaaaatccaaattagtggcgtgtatgaataagaacggaatgtgtatcacccacaatctggggcaaaatttttctggtcttcctctccaccggggaaagtgaatgatcgattgatcgggtactggataatatcagactaatatacttttaatgtacaaccttagactgtttttctttcgaaaaacagattataagtatttaaaagtatacttacactatcaaagttctttgcacgttaaatatatataactacatatactacttgcgttcatcaaaatgtactaatttaaaagttttttttaaagtggacgaagatgagactgataccagaataggtaggagcccatggcgatatgttttttcttcctctgtaaatctttcggtttctttatcttaactcgacaaaatcaacttcttttgggaggctgatacatatttttttcactaaacaataatgtttacttcatctatctcaaaatataactatttataagtgttaaaattatcttaaaataaaactatttctccatgtacctctcttatttaatttcctcatatactttctcgtatcaatcgatcacaaccatctctaacgtctaacattaatctcttaaaaaggcacacttagttgtactttgagaccaactctccaaatgtccaaatgcattgcttgtaattaatgcctgaattccataggactctattatgcatgaaatcatatttctatatttttcatgttcatgcgtttttaaaatcttactacgttctaaaagagctaacactaaaacgatgagggagggggtgctctcttctccgctcctaaagaggagtccccgtatggttaccgtgttacatgtctaattcacttatctattttttctttgtccttaatttgaagtacaatagtagaaaccgtggaaacaactacaatagttttcttttttttattattttcttacctcgtaaggaaaaacgatttagttttgaaattttatagcgtcgttttattacccctgctggtagaggattatgggtgcatataacttctattgaaatgttcgtaacttgtacacgcgtgcaaaagaaatttactgagatcaaggaatcatcattggtttcagactgaatcaaagaatttatttaggaatttcatatgattcaagtcctataaaaaattttcctatttgaccttttaatttaaaagattgaagcttttcaaatcttatgaaattcctatggaatggcacattccatgtggattttgaaggaaacttaacaagagctccaacctcttgttttacatttcaattcctattaaaattctttgttttttcaaccctgtgattcaaaggggcccaagcatatgttaataagtgtatctgttgatgtatactgcgtttggcagctggagaaagggagagagcttgtttcgttttccgcgcgcacgcttcccaaactactaaacgttgtgttttttgcaaaaattttctataggaaagttgctttaagaaattatattaatctatttttaaaatttaaaataattaatactcaattaatcatacgctaatagctcacctcgttttacgtatcttcccaatcttttcaatccccttctcctcgttaagtatggtgtgacctatgtttctttgagcatgttttgaagtggacgtattttcgaatatgtgagagtggtgcatgttcaacgccttccgtgtaatttcaacggaacaatagtaccatcccatactgccatacattcgaccgtgtaattccaacaaaaataataatatcaccccat

SEQ ID NO: 45688 - DNA, 4924 bp, Oryza sativa
tgtaaaaaaagagaaaaagtaaaacaagatggaggagaacggtgtcctcgtcgtagtcaacgacgggcgtccgccgctcaccagccattggaaacgccacatccggtggccacgagttcgccaccgccggatctagtggcggcgagctcgtggccgccgaatccggtggtcctgtggcacaagatggttgctgacgacggcgagaaagaagtggaggcagcagcagcggcaaggaaggagcggaggtagcggcggtggcaatggagaggtgagaagcgttggcagtagcggagcggtggcgctcttctcgccggatttggcggcgggcttcgagtggccatatccggcatcggggagcttgtggctgacggagctggcgaggcgagtggcgatgtcgatgacgacagccgtgcgcggggtggaggcgaatgacggtggccgtgcgcggcgtggaggcgacgacggcggccttgcgccgtgcagaggcgatgacgactcggaaggtactgagcgggtaaatggtggaaaagaggtgatgagatgcgcgattccctctcgcctcctgcacgcacgtgaccccgttctacacgcgctcgtccccgtgcctgcacgcgctccactccgacgaggagggaagctcgattcgggcgtttccctttggcctggttgggaaggtgattttgtatgcgatgagccaagccctggaggctatggcaggtatccaaacatcctccactgcacgcgcggatgcgagccatgcaacatgcaggtaaccaaacgagccccaaatgaatccatacttgctgaaatgagaaggcctgaaacttcttaagttagtccctgatatttattgggacattttatataacattcgatagaaacccgcttaaaactctgttaaatgtaactataatacgactgcaatgtaattacaacgtataattaacttgtaattataatgtaaatagaatatatataagtgacttacattatgaaacggaggaagtaactattaaggacatgtttggtagtactctaacttctaaatttaactttaaaaattaggtctagagtaaagttgtgaaactatataaatttagctatatatctagtttactttaggagaacactctaatcaaattcactttttctggttgagcgaaaagatggagctaaaggtgaagccatgccagacgggctccacgctagctcagctgctcagtcagcatagatggaaaatgtctaatgcagtagaaccgaaccaactaaatacaaagatatgataattaacagcacttaagagttactccatccgctccataatgtaagactttctaacattatccatatttatataaatgttaatgaatctaaacatacatatatgtctaaattcattaatatttatatgaatgtgggtaatactagaaagtcttacattatgaaatggaggaagtattatactaagatcatacaagatcacagtagacagtagcttattgagaccctgtttagatgagataactttttaagtccctatcacatcggatgtttggacactaattataaatattaaacgtagactattaataaaacccttctataatcttggactaattcgcgagacgaatttattaagcctaattaatctatgattagtctatgtgatactgcaataaacattatctaattatgaattaattaggcttaaaaaatttacctcgcgaattagctttcatttatgtaattagttttataaatagtctatatttaatactctaaattagtgtcagagaataaattaagttactgaatccaagtaccacctgacttaactacggtctacggctaattgcatgcagtctataatcgagccccgttgtggctgtccatttccaagatccatccactgtctccgtgttgtccccgttatagtgtcggcctgtcagacaaggacaccggctagttagtagtacaattaagctgacactgcgctgccgtgtcaccattacttggctggtcgtatgggccccaccttattcctaggtgatcctgatgggccctgatattctgcatggcctgcatcttcccggcccacctctatagctgatttcgtatttgctttactccctccatcctaaaaaataatcaatcttgaagggagtactatacgcatgtgtattagcgtatgcattgtctctccttcctctcagtgtcctgcggcaaagtgtcaccaattaagtgattaattaaatcaccctgttgccataaatcgtgctggcaactttttgatctgaggatcaatgtagcgcgtaagcatgtaaacatgcccttactagtagtacaagcctgaagtgcctcaatggataagtaaatatggccccttacaagtacagacaacgaaaataacggaattattcttttattatattatcgtggtagaattaatttagtactatctccctccgagaaggagttaatttatactagcaatttcaaaacaaactaagtatagaggaaaaaactaaagtatcatcattaatacgagcattgttagatgggtaggtaagtagaattgaagggataaaactaaataagtacttttcgatttgtgaactaggatatatgtaaggggctagagatcaagtgtttttgggacaaagggtgtgcttgttgacggggtatgcccgataatggtattttatggtacggctgatacgaatgtatgcacgagtttggaataaagagataaggacaatggtttttatattggtttagactcctgagaaggtgaatatatatacatttgagatgtatcacaccgagtacaaaggtggagcaagctagctattctaacatatcaaactaatctcgatgagcaaggtgcccggttgtagtccacggttagcagaaaagcggtgggctacacatgctggtcggaatcactgtgagggatgtcggtcttgggcaacaatggttatcggggaagcggcgtccaaaggagtcccattaggcaattggtgcggggcaggccagtccaacgaccatggcaaggagtgccatggctgagatggttattgcatgactgcatgctatccatcgtgtccagcgggacgacttcggtcctgatgatgatgaagacaatggtactgaatcccaccatacagcattggttcgaagacctcatgcattactttggccattgtcttaatagtgctaagggtccaccaaagggcaaatcagtggcgacgactaatgagggagggagatcggtagatcgaggcggcggcgttgtagggagaatcggagtaccaattggctcggcttttctgcttgtggttctggttctgggagccacgcccacaagtgaagcacgagttgagccaagcgaggcacagttgtggataccggccagcgtgaggtacgcttggagtcacgaccatcgtatgggcaaaattgctatttagtgatcagccacgcgcgtcccaatcacgttttaggcctgctttttttctgggttgttgagccccctgacattccaatttaagatttttaagccatccatcatttctgaaacaacatgtatctcctatgcatgatcacaagaacatcgaacattctccaatggcaattcattaaaacaagagataccaccttacacaatacatatggggtggtgtagttccttacaattttcccaaaataactactcctgtcgtgcacgaaccatcatgaactactaaagcctagctgaagactaggcatcattggacatgctaagcatccaaacatcaacaccgacagcactaatatctggtagggggtatgtaggaccataaacgatacagagagtcaagggtacattagcactaagcagggagccgccacattcgaatgcaagcaagaaaatcagaccactctggctgcgtgccatcggtctcccctgccacatcaggtggcagaggcgtgcctccatccatcctggcgagtgcccgattcccttcaccacaaccatcggcagaggagcctcaaagtgcttgatgtactgatcagcaaccacatcattgcccaccagctctccttgttgcaaaatccccatatccttgatgatacggacttgagctcgcagtgaaaccgggaccgaagataccccccttcgagactcttggtctagcagcttgctaccagaaccttcttgcactctctttagcaccgaagcgacgacgtcgctaccacgagcaatgactgcagtgtagcgaacaacactaggtcctcttgggccgtacctatgcctccacgggaaccccgacttgcccaagcatgataagcccaagcggcccatcaggcgacaagaatggcccatcaaacgacccatccaagaaggtgagacctagggcatacgcaggcatctccctcattgatagcacaacagtagccgttgccagctccagaagcatcgggtcgtcgtctcgtgccggcctcctcgtcgtgtccacgtcagagcagcacagggctgggtcaaccctgactggcgttggcgcgatgcagctgatcggcgttggcatgatctggggaaggatgcccgaggctagggaggcatgcttatggagcaggcctttgtcgttttcccctccacaattacaattggatttgggcgaaacagacaatttgggcctaatttttgggggattgggggagggggggtgggtctccgagccaaattctggggtagtctcgagcccaccgagactaccccttggctacgcccctgtattattgcacaacgtcattcatgccattgcaattgaacatggcatgctactacatactactccctccgtcccaaaaaaatataaaaacttaggatcaaatggaacattttctaatactacgaactacgaatctgtacataatgttctatatg

SEQ ID NO: 45689 - DNA, 4100 bp, Oryza sativa
gcaggcccctcccctccctcccagatccgaccggaggaggggagccgtcagcgacggtggaggcgatgctccccctcccctcccccctccctccctcccgcacagatttggctgaaagagggaagccgacggtggcggcggagtcggctctcccctccttcccagatccaaccggaggaggggagccagggagccggccggcggtagcggcagaggcaacgctcccatcgggtggtggcggcggatggaggaaaagagccggaggtcagagggggagggcagcagcgggggacggagaaggagaaccggtggctggaggggggaagggtggcagcgggggattctttttgttccgtgagattgttttttgcaggcgagtggatgtagcagcctacgaaagtgactttttgcaggcggggataacgatcggatgcaaaaatcgtctatttttgcaggttttgaagtgcaagcggggctaatggccgcctataaaaatctttttttcccgtctgaaagaaatcagtcttctagtagggaaatatgggttgattttttttaagacaaatggcctatggtcaggccggtcataaaatatcggatcgatgtccggtactcgatcaggttaatgcacgcacgtactacctccgtctcaaaatgtagctatttctagcacagtactttatcctaaaatgaagctatttttctacctaccttctcctctcaaccaatcacatccattctttttcacctactttctcttttcaaccaatcacacaccttcttcaattattctcacctactttcttaatacctatgccaatctcaaaaatccttacattttgggacggaggaacggaggaagtaagccgtaaggtacgggttcggctgatacactagtagcgccgcccatcgtcgtcgttgctgtaccatgtcaacacgcgcatgcagtgaagtcgtactgaagtacgtggatcggcgtgacggccgggcggctttcatgcgtgccgttgcctcatgggctatacattacccggaccaaaacgtctctttccttgtgggctagctaagctcctcccggcccatcggtcggacgtcgcagcccatcgaatcgaggctcaatttcatcgtctcgtgcactgcacacccgtgatggcaattggcagcagaaaccaccatgcatgcatgacccaaccaccgtgcaccaacgcctccccgcccacccgcccgcccacgcacaaaacacccgagagagtccacgcgcgctcgtacaaatcccccatcccctcctcgccgctcgcgccacgccgcggcctgtacaaaaggcgccgccagtatcgtctcgtccccccacgcgcgcgcgcgcgcgtgcacaacgatcgacttcgaacgccgcgccgcggccgcaccgatcgatcgatggcgccggcatcgacgacggcgacggcgacgtctgccgcggcggccgccagagccatctgcgtgctgctgctgctgctggtagcggtcgtcgtggtggcggggcaggcgccagagccggagggcgacgatcaggccgcggcgatcgaccaggcgggtggcggcggcggcggcggcggcaacaacaacggcacggccggccgcgcgagaggcggcggcggcaacaacaacggcaccgggcgcgcgagggacggcggcggcgaccgcgaccgtggcgcagacggaggcggaggcgggcggagcaagctggcgagcagcatcgactgccagatctgcgaggcgacgtgccgggtgaagtgcctcgtcaacagcctcttccagtggggcggatgctaccagcgctgcaggtccgacaactgcaacgactggtgcaccagaggctaacgtaacctagctgatgaacggatccatccttcggatcggacggcttgcgatcgtttagccctcgatctgacggttacagctgcagtactaatttttttggacaaagatgatggtatataccagcttgttttttttttcaaaagatagaaaatggtattacttatgtgctcaggatagatccagcatgggtgtgccagagggacttgagtcctccgtgcccactagatcatcattgataaaaggagagagagtcgaaagaaaaagagagataggaggaagagtaggggttgaaggaggagatgaatttcctctctagttttattctagattcgcccctgatactcataatgttggaattaatgaatgggccttagcccactagaagattaattctttggaaatcacaaaagcccacctcatggaatggcatgcatgtggagtttagtaccaccctgcttattctaggagagggggacctccttaaaagggatgatgcccttctagccacttgaagcatgtgtggtggagagaagagggggaacacacgcgcgcgctcgctcgcctggcctggtaggcgcgcgtgcacgacgtacgcgtcgaatggtccgccaaaattggttcctcgccttgcgcagatgcagcctccttttgcagttttattttgctgcaaattcggattcgtttttgttttggaaacgttccgaaaaatccggtgcgtgcaaacggcgtggagtccggataagttacgcgcgacttatccggttcggttacgcgcagtggagatcatgcgggcgccctgatcaagcgacccttctctatataaaccgacccgccgtcttcacgcaacacacgcgaaatcaatctagggtttgcctcctactctgtgctgcgccgtcgctcgtagattactccatcccgctcgccgacgtgcacctacgatcgggagagtagatctccggaacctctgccttcgacgtcctgcaccgggagaaggcggcaataaagttttttgggaagcgctttgcgcgactgctccctgttcgtccgcgacggcttgtcttcctcttcgctcgcgtgctgcgtgccttcatagatgcctgcgaaaagtttcgaccgagcagccggtctttccgccacctcgatacgtgttcaatatgttgcgcatatttgatctgttcatgttatactgtgtagtttacatgtgtagatctaatgatgcgttcatgctagttttcatctgtaatatcatgatttatttatggaatagattaaatcattatatgcctataatctcaacacataacgtacgtaaactcacccctataaatatatacacatacttctatccttatccaatatatggtaatctcgttaaatgaaaattaaacggtgtgttaattagttgtccgacccagtactagacgagtaaataactgcgtaatttgcatggcagaaccgtgcttagaccaactactcaaattaattaacaagctcaggttgtgcataaatacagacggtggccgttgaacaaggtacagaggtagatgtggttaccggtgtcgcaaggactaaatgcttcatgtttgtctatttaattattggttcctgtacctatctcgtcagacttttcaaagactatacgaataaaaccaccagcatgatctaaattatgaattcatatacatatccggattgaatttaacaggcactccaaagtctaaagatgacgactcactgtttgaatctaacatcttaatttagatcatgccaaaacaaagatcttaagttagctatttaaatatactctttaattagttagtctatagggatggatggatatgatcatagatgctgcgatatagagtagttgtcactgtactttaagtaattgacttgacctatgtagctagctcatccggatggattattatttgtttatatatgtaaatcatactagtatttgccacgagattttctactctcggactagtccatatatatatatatatatatatatatatatatatatatatatatttgcacgttttttctcggcgtcatgcatgcatgaaacggagtttggcgtttttcttcgccttttccgagggccgacttggtgtccacatcagcaatcacatgtcctgaaaagaaaaacaaatagagtactcagtcgtcactgcagtctctgtagtatggacatgatattgaagcgtgggtacacagaatttttttaaaaagca

SEQ ID NO: 45690 - DNA, 1713 bp, Oryza sativa
cgaacaaccgcggttcgacagggatacctatcgaacaaccacagttcgacaggtacatgtcgaactacgtgagttcgacagggtaggtggtccaaaaacaaataaaaaattacatgaacagtatcactacaatactaggcagggacatatcgaacagccaaagttcgatagggttgcgtgaacagcgcgctacagtgatgctacagtgctcgcaggcacatatcgaactgccatagttcgatagggtattgtgaacagtgtgcaacagtgatttttctctttttttaattattttaatcacctgtcgaactaccgtagttcgacaggtaccctatcgaactgtggttgttcgataggtaccttgtcgaaccacggttgttcgatagggtgctaaacttgcgatttcgcctaactgacctatagttttgcgattttccattaaaatcatattacttttaaaaaaaattctgggtacacacatctagtctgagctccacctctccacacaaaaaagtattatctattaacacatgattaattaaatattaattaaaaattaaaaataaattaatatgcttattaaaacaaatattttttagaaaacttaaaaaagatcatttagcaggttaaaagtgtgcaagaaaaaaaaaagagagatgtgagctagaaatgaaggggaagaacatagccgtagacactccttaacttcaagctggctgcttagagaaaggatacgatgacaatgtccaaaatatgtttcagtaaactacatcagcatgatatatttatttatatacatcgaaaataactactgtactaattacctcgtgagcgtatatgacattgttgattattattttacttcctccgtttcaggttataagacgttttaactttggttaaagttaaactgtttttaagtttgactaagtttatagacaaatatagtaatatttataatactaaattcagtgacggacgtagctttaaaatatagatggggcggagaacggagatgttcactcgataagagcattcgaacacaacagatatcatattaatagttcattcgcataactccctcaatttgttgggtgttcacaccttgttatatctaaatttgatggcccataactactataagggggtaaggggggtcttgagggttgacccaccccacctaatgagtagatccgcctgacggagcgtggggctcctcaccgggagaccgcgcaggcccccctttgccgattcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctacaaagagctggagagccagagagctcttattctaaaaaccctcttctcctttttttttctctcgtgggatctcctctctagatcctccccccttccaacccccctcttaagtgggcaaggtcctccttttatatctcaaggggataccacatgcaccacttctccctctctctctttttgggtgggggcccatcctatctatagtaaaacttggcttgccttctcttggaagctgaaacactgcctgtttttgagtgtggccacgcgtcctcgttcgtctgacctcggggatcaccctgtca

SEQ ID NO: 45691 - DNA, 17075 bp, Oryza sativa
tcacctttgtccaccacgtgtcagtttagcaatctgcatgttgggcctttctcctacaaagttatggattataatgggtgggataaagcctggcatatatctgaccaggaccaacgtgccatctccaggagctagcacgctggctccggctagggacgagtgcctagagactctcatcctgacgggacggggcgaggcgtgtgtcagatcgcctgttgcctcctaacccgcaatctgaccgatctgtgaccggtcacagaccggataaacgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcaccgacagtagcccccggcgttatgccagggcgattgccctcctcgagggaagcggtcgggcgtgacgccacttcctaaggcctggtgacaggtggggccggtctaaaaatcgggacaagccggttcgtttttcctggagatatggtgatggcgctttggtcggcgagcgtaattaacgcgcgcacgatatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgtcctaccttcgccacacgcgctcgctctcaaacatctcttcttccggcgtcatggcacggggctccgctccgcttgacggtagcgtgctgccgccttcccgcatcgtgagcgagagacaggccgggctgccgcgccgcttcatgccagaatctgccaccggccgggagatagtctcactgggcgagggatgccctgcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccggggggtcaaatgggactgggtccccgaagacttcaaggtaatgatccaacgggtgctgaatctcagctccgcggaggcatccctcatcccccaaggagtcctccccctctgcagcgatccagatcgcgccaacatcctgtccatcataatggcggcggggcctcagaggaacgagctcctaagggccatgacggtgcgagcgggagccacaagggagatcaatctaccccaggagggggttgtgcttccgggccccgtgatgggggctcggggggcagccgccctgccgacgcccgagggaagaggaagcaagagggtacttcctccccatctcctccccgagggggcggggcggcgcgtgtcagcagcaggcgcccggagggggccgcgccgacgccgcagcccgagggggagcggaagaagaaacggctccgcaagatgggggggacagaaccatcccggggaaacctcatttcccctccaaggtggtcgtttaaccgaccccctcgcaggttcgtcccacgcccattgtggctgtattcattcttccaacacaagttttcattcacccatcttgtttgtcttctggcttttcttctgcttcagcgagatcccgtcgcgtccttcttgccaattcaagtccggccaatctgaggccgagaatgcggcgaccacggaggctcggaggcgggaatctgaccggcgagaagccgcggatcgcctacgggaagccgaggaggccgcccaggtggccgtccgaactcgccaagctgaagaagccgctcgggaggaggccagacttcgccaggccgaggcggcgacgacttccgaggcagctcgcgacgaggccgcgggcgcatcgcttgggcccactccctcgggcgacgctcaggacaagccaggtccgggggacatccctgaatccggcacgtccatcggcgggccgagccgcgcgacatcctcaccgaggcggctctcccccacgccttccgctgccccactgagcgcagagcctcttctgcaggccttggccgtcgctaacaccacggtgttggacgggttaagtgcccagatggaggccttgcaagcagagcgggtggagctcgacgccgcatgggcacgtgtcgaagaggggcgtcgctcggtggaggccatggtggaggtgggccgcaaggcacaccgccggcacgtctcagagctcgaagcccgtcggaagatgctgggggagatcgccagggaggtggaggaggagaggggggctgccctcatcgccactaccgtgatgaacgaggcgcaggacgacctccgccttcaatacgggagctgggaggcggagctagggaagaagctcgacgccgcccggggggtccttgacgctgccgctgcccgagaacggcgggcggcggagaccgaggtggcatcccggcggcgcgaagaaacccttgaggcccgtgccatggcgctggaatagcgtgcctgcgtcgtggagagggacctggcggaccgcgaggccgccgttgctattcgggaggtcacactggcggtgcacgaagccgcctgtgccgaagaagagtccgcactccgcctccgcgaggatacgctcaccgagcgggagcgagccctcgaggaggccgaggccgcagcacagaggctagcggagagcgcgtccctccgcgaagctgcgcaagaggaacaagcgcgtcgcaatctggaaagtgcccgcgccgagagggccgcactgaaccagcgggccgctgaactcgaggcgcaggcaaggaagctggatgcaagggcgcgtagcggcggggcggccacgggcgacagcgacttagccgcccgcctcgcagctgccgaacacaccatcgcggatctgcagggcgcgctggattcgtccaccggggaggtcgaggcccttcgcctggcaggcgagatagggcccagcatgcttcgcgacgccgtgtcccgtttagaccgcgccgggcggcaggcgagtctctggggcgggcggactgtgaagtacgccgccaaccaagggggcctcgcccagcgcctctcggagatggccgggactctccagcggctccccgaggagctcgaggggacgattaagtcatcctcgagggacctcgcccgaggagcggtggagctcgtactggcgagttaccaggccagggaccccgacttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggcgacccgggtgcatcggagtgagcccccaggcccccgccaatcctcagttttttcttcttttctttcttccaaggccttcgggcctcctttttgtatagattaacttaatctgcaatcaaaataaagaaatttatgtgtcaatttcattttgctatgtgtatgagatgaggatgatctgtgccgtggtccttttatgtcttaacttgattaagggctcgtgcccaggtcccagtcctcaaaaggcgcgggtcggggctagtgcctggggagatccacgtgtcgagactggccaggccgggagcgtggtgaccgagggttatgggtgacccgattgtgggtttttgccgattcccccccggagttcaccacgccccggggcacggctcggttctgggccccttttgacgattttagccgacccgagcccccgagggcaggattgagcacaagtgacctatttcaagtcaagattcttcaaaaggaaacaacagcacagatacagcctttaggaaatcgaaaatgcttttattgaaatacagatagaagaaaaaatatgcatatgtggtagcccccggccaaccctgcacgcctgaagggggtgcggggttggcccgagcccgaaacctgacacccgaactccattaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgtgcccggacgtggcgctgatggtagcgccgcaggctctgctggtagcgtgcggctcggagggccgcgcgccgccttcgctcttccaagtagtcgaggtcatctctgcgaagctgatcttgatcaacctcgcagtacatggtggcccgaggggacttcagggtgagctcggatgggagaaccgcctccgcgccgtagacgaggaagaaaggcgtttccccggttgctcggcttggtgtggttcggtttgcccagagcactgctggcaactcctcgatccacgaatcgccgtgcttcttgaggatgttgaaggtcttggttttaaggcctttgaggatttccgcattggcgcgctccacttggccattgcttctggggtgggcgggtgaggcgaagcagagtttaatgcccatgtcttcgcagtagtcaccgaaaagctcactagtgaattgggtgccgttatccgtaataatacggttaggcaccccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaacggccatgaaagtggtatgatctgcagtgcctgggccggctgatggatttgcttggcatggaactgacacgctctgcatcgccggaccaggtcgaccgcatcattgagagctgttggccaatagaaaccttgacgaaaggctttgccaaccaaggtgcgcgaggcggagtgggctccgcattcgccttcatggatatcagcaagaagctcgacgccttgttcccgaggaatgcacttcaggaggattccgttagccgcgcgccgatagagggtcccttctatcagcacgtagcgtttggagatgcgctggacgcgttcacttccttcgcggtcctcgggtagagtcttatctgtgaggtatgcttggatctcaacgatccaagcaatcaatctaagggagctgggagcgctcccctcgggtcccgaggcctggactccgacgggcctcgggggccggtcaggcgcgtccgtctcccctaaggggtcaggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgctgtacttggcgtacgtaagcatccatctgcgggtcagagcaccggtattccttacagacctggttaacctagctgggagtcgcctaacaccaggaggcggcggatccccagtccagctgccaccctgagtcccgcaaggagtccctcgtactctgccatattattggtcgcccgaaagtcaaggcgaaccaggtatctaaggacgtctccgctcggcgaggtcaatatgacccccgcaccggcgccctgaagagacagggagccgtcgaactgcttcacccagtgggcggtgtgaggcagctgcgaggggcccgagctggcctcggggactgagacgggctcgggagccggggtccactctgccacaaaatcggcgagggcctggctcttgatagcgtgacgtggttcaaagtgcaaatcgaactcagaaagttcaattgtccatttcaccacccgtcctgtaccctctcgattatgcaagatttgggcgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcgatggggccgatcctcttcgccaggggccgcatccctggggcgctcttcgtccaagcggcctcgcggggcgcacttgtcttctgtgctgacgacctcggggtcggaggacgacaggtgcggccttcccacagtggcctcagggccgtcctgggggtcgggggctcctggcgtcgtcggacaagcgggcaaagggtcaaccccggtcatcgggagccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggagcctctcctccctgctctctcccgggccaagccaacacagggtggggattcgcggaatgagggttgtcctcatcgcgctccacaactaacgccgcactaactacctgcggggtcgccgctaagtagagtagcaagggttcacctggctccggggcgaccagaactaggggagagctaagatacgccttcaactgagcgagggcacgttcagcttcctccgtccaggtaaacggcccgaagcgtttgaggagcttaaataagggtagcgccttctctcccagcctcgatatgaaccgacttagggcggccatgcaaccggtgacgcattgcacatccctaagcttgctgggggggcgcatccgttctatagctcgtatcttctcggggttggcctcaatgcctcgggcagagaccaagaacccgagaagcttgcccgcaggtacaccgaacacgcacttatcggggttcagctttatgcaggtggagcggagactctcgaaagtttccgccagatctgaaagtaaagtttctcggtcgcgggtcttcacaaccaagtcatcgacataagcctcaacattacgtcctatttggctacccaaagaaattcgagtagtacgttgaaaagtaggacctgcattctttaacccgaatggcattgtcgtataacaataagttcctatgggggtaatgaacgtagttttttcctcatcctccctagccatgcgaatctgatggtaaccagagtatgcatctagaaaacacaaaaggtcgcaccccgctgtggagtcgacaatctgatctatgcgaggaagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaagcttgacgttccggggcctgccggcgcactttctgccggaccggctttgcgcccggccgcacggcgagacggtgctcaatcacctccctggggaccccgggcatatccgccggtctccatgcgaagacgtcagcgtttgctcgcaggaaggagacgagcgcgtcttcctatttgccatccagaagaccaccgattcgtgtggtcttggacgggccgtcgcccagggcaacctccttgaccgggacctcgtcgcacgtgactatccgctgcctcggggcggcggggacggaggtgccaagcctctcgtcgccaccctcgggcttggacgcagcggcgaggtggtccgcgcgctgctccatacaagcgagcgcgactttgaggtcgctatggacagagatggggccaccggggcccggcatcttcatctggaggtagacgtaatggaccgccgccatgaacttcaccaacgcgggcctccctaggaccgcgttgtagggcagactgaggtccgccacatcaaagttcacccgttccgtgcggaagttggcgcatccaccgaaggtgaccgggaggtcgatatgacctagcggccaagtgtgccccggcgtcacaccgataatcggctgggacggccggagcaccatccccgaggccttgatggcgtcaaaggctgcgggggaaaggatgttgagggctgctcccccatcaatgaggacacgccccagcttcacgttgcaaacagtgggggaaaccaccattgcgacctgtcctccccgggcaatgcacggtgggtggtcggtctggtcgaaggtgagggcaacctccgaccaccgcgcccggcgcatcgcctcatgagtaggggccgcggccagaagctctcgcttcatcgccttgaggctccggcgagaaacgtgagcacacgctcccccatcgacagtggcaatggtggccccaggctcttggaaacccaggtcatcatcgccgtcatcgatgtcctcggcgggggccttctgtttggcctctcttcgccgattgccggaaggaaccgccggggacttgccctctcggcgctcctgcctcctctcctcctcccacttcctcgtccgctcagccaaacttttgactgcacggcagtccgcgaggtcgtgaagggaggtgttgtggacggtgcaccacttgccggttgggcgctccctgctgggagcgctggcctcctttttgtcgctcgcaggcctcccctttcgggtggcccgtgaagcaccctcgacggcgaggacatgaccctcgtcgtcggaatgggctgaccttttcttcctcctcctgtcacgccgccctgtccgagcagcggatccgggggcggccgaagctgccacaccggaaccggaggggttccaggtccatgactcctccttacgagccactcggtccgcgagctgaaaaagctccgcggtagtctggggctccttggaggcgatcttttcgagcatgcggttgtgccgcacaccccccctaaacgcgtagatcaccgcgtgtgcagggatgcatggtatggtgttgcggacttgacagaaccgctgaatgtatgagcgaagtgactcatcatcccttcgctgtactgcgtgcaagtccgcttcctcacctggacgcggatatgtgccttgaaagttcatggtgaactgttggcacaagtcctcccaagagtggacggacgcgggtggcaagttcattagccaaccccgcgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcaccacaaaggctctacagccgacaccaccaaccgggggcacggagggctgatccccgcgtccgtgttgaggtgacactccggacgaggaggcgccctccgttgcgtgggcagcacgtcggccattacgccggcgctcgatactgatgcgggcatccggctccccacgcagatcttcccgggtcggaggcgctgacgaaggagtggcggccgaatggcgaacagcggccgccgctcgccgcgccctccgtcttgacgacgcggagccggtggtagcagtaccagaggtcttggtggcggaggaccgcccaccagcatttaggcgctgccgcgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggaggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagacccccctacctggcgcgccagatgacggagcgtggggctcctcaccgggagaccacgcaggcccccctttgccggttcggccgggggccctgggtgagattctaagctcctagtctgtggaaagttcgcgagaatggaaaaagcacaagacacgggcgatgtatacaggttcgggccgctgagaagcgtaatagcctactcctgtgttctggtggatctgtgtatgaagaagctacaaagagctggagagccagagagctcttattctaaaaaccctcttctcttttttttttctctcgtgggatctcctctctagatcctccccccttccaaccccccctcttaagtgggcaaggtcctccttttatatctcaaggggataccacatgcaccacttctccctctctctctttttgggtgggggcccatcctatctatagtaaaacttggcttgccttctcttggaagctgaaacactgcctgtttttgagtgtggccacgcgtcctcgttcgtctgacctcggagatcaccctgtcatctcttcataaatgggcggagatttgcaacggctgctgcccgagtgacccttctgatgggacggcccatatctacctccactccgccggaagcaggtgcaacgtgggaacacggttgtcttccggcgacataaccagtgtcagaccagtcacagaccggtcacctttgtccaccacgtgtcagtttagcaatctgcatgttcgcccttcttcatacaacgttttgcttataatggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgcctcctaacccgcaatctgaccgatctgtgaccggtcacagaccggataaacgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgaccctcccgagggggttaggccacgtgggtgatcgtgtctgcctcaagtctctaagtcatgatactcccggtcccatgttaccgacaccgcccctgactaaattagtgtcatcaaatcaataattgaatgtattttcataataaatttatcttgggttgaaaatgttactttttttctataaacttaatcaaacttaaagctgtttgattttgatcaaagttaaaacgtcttataacttgaaacgaatgaagtatttcataagcttctctacgtgcaccatgtttttttttagggagtgcatcatgtttactctaattttgtagatcatatactatttcatctcaaaataataggataagtctccgaaatctcaaatcccaccgcattatatatttattactcgcgttcatcctcatgagcgcaaaaccctaattatccccccccccccccacctttcaaatttgttcgcagtcttaattaacatgttctctctaaccactggaagagaactcgatcggtcaggtaccagagccgcaatctgttcttttaatgacgctagaggtgcaccttttcagcaatatttcgtaacgtcactgaccgtgatgtttaacccaactatacatgtgctaattattggaattacgaaaatgagtaattggtgtgacgaataatcagcgttgactggtctatttaattaatgctctggctctacaaattgaattagacttagcgctcatatagtcgtatggagtactccctctttttgtaaaaagaaataatctaattccaaatatataatctgaacatgttcagatttatctttagaattaattttttttatagagggagtatgttatttttggatttgcttaattaaagcacaagctactattattttcgacaaaatcccagctcaaattatatttttcatatcattaattttacggttgagcctatagtttgttcgtgttaaattaactcatttttcaagtattttaacatcgtgtgtgactgtacaattaatcaactattaatgcacatgtacagaagtggcatactggcatatgtagatctcgatccctccccacgcccttgtatatcatgcattaattaattatatcatgcaaaagcattaaaattctagatctgacagaggttcaataataattttttaatgctttgtatggttttatggaaaacaaatactagccggtggataggacattaatatgcatgggtaaataaagatggaggaaaaaatcaaagtatagttccctagctactcggatcctactataatgatatggaattttaattaagaatattaattattagctgagtaatatataccactcgtcctaatatttaatggttgccaagctaattgaattgctggagctgaattgattagctggtaatattttctatagataggacgttgttaaattctgccatttgggctaagacatagtacattcaagcacaattaatggtttagccagaaaacacaacagaattgtaaacatctgtaaaattatatatacgtgatgggtttaccggcctgtcggaaaccattgttaatttgttagtaaataaatccctttatctcctcaaaagtatcatttcagtactagtaaatttattcatgaaattacttactaattcctaatgtgcacgatatacgaattctgctatagttaattaattaggtcgatcgatccaacatgaaatctcctttttgcttcattaatagaaatagtatatttatttatggtatcattgttttcttataattttcagatattatttcgcgtttatttatatttaggctagaagggctaaattttcagatattttctctaccaaaataaaaaaaaactgtatttcaataagtctagtacttccctgcaaataatggacatcattttagagtgtcttataatccaggattttgattgagtaaccccaagcgaataatgccaatactttatagtgttgacaatcttgttaccaaaataatcatgttagctccaacccagtagtggtcttgccgtggtgactggtaattgcctcgctagaagatgggctagctagcaacataatgcccatacctgtacggcgtctacaaatacatttacgtactctattcgtccaaataattttatcttttatatagaaatagactattcccagatataatattaatttataagttacggagagagtgcatttgttggcatatggtctacactctctctgcattgccatacaagctatgccaggcaagcactgaacaattaactcatggtgttgttcggcagacggacgcgcgctgcggccgcaacggtactgttcaagctgactgtggtgcagccatgcacaaacttaggctgtgttcgggaggcgaggttgggaaccttgcctcctgacacggaaaacgaagcacgtgattatagtgagactaattaagtattagcctaaaaaacttgaaaaatggatcaatatgatttttttaaagcaactttcatatagaaaactttttaaaaaaatgcatcgtttagcagtttgaaaagcgtgcatgcggaaaacgagagaagtgagctgggaaagaggggtaaagaacacagccttaatagcccttatgggtgtctttaggccatgttcaccctcaactttcaactttccatcacatcacatcacatctaaaactttcctacacacataaacttttaacttttttttcaaactaccaactttccctaaacttttaactttttttcaggaattaaacacatccaatatactaaaactctatatttaaataatactactatatgatattattgagtttattggatcttgatatactttagtgattatctttctataagaatgtgatgatagtatctaacacaattatgttattgtaaaaatacttataaagaaaatatagattttatgttttcaaactaaatattttgagagttaggatggtcagagttttaaaattttacttatctaaaattaacagtggcatacatttatcaataggcggagtaccgataatataattactttgagagaacagaatgtacattaattaagtagcattagtaataaccattttaatttgccggcaccaacctcttaattactgtaaagtgagagtagtttaattggttaggtttcttgtggtggaatcagcccattcgagttaggacctggacttagacatcgatgctcgtatttatggctaaacctgttagccgtcgacgataagacaccatatggtgatttcatcaatctgaagatataccgatccaatctcttaaaggtgttcatagatataagatatgcaattgttcattaatagagatgaatgagcatctgctttatattctctccgtcccattataagtgaagctataagttttcgtgcccaactttgatcgtctgtcttgtttgaaatttttttataattagtatttttgttgttattagatgataaaatatgaatagtattttatacgtgacttatgtttttaatttttttttaaaaaaaataaataagacggacgattaatgttggacacggaaaatcatggatgcacttaaaatgagagggatatagtactatatttttttaaaaaaaaactcttaattaccaacgcacgactttctcgcaccaggccaattgacccttccttacccacatatacatgcagatgcggtcatatctcatagactcatactacgtaccctctcagtaacggaaaggtgtttgtcttctggctaactgctacagtgttacttatatacgtatctctcaacttgtgaaagtctgaagctgtcgctgtgccgtcgctgctagttaaaaaaggcttgccttggactttttccccctcctcccatgatcccatccacaccacacgcagcaacgcatccacacgctggatgctgctgctgctgctactcctgctgccgtgatcgatgatgacgcggacgccacgcgcgcgaggcgcgatcgatcgaattcgccgtcgactttgaccgccgacgtggcggcgacgcgcgcgttcatctagccacatagctaagctagcttacttcatttcatttcaagatataagacgttttgactttaaatttaattaaatttgtaaaaaaaaaatagcaatatttttaactaaagataaatttattgtgaaaatatatttaattattgatttgataaaactaatttagtattataaatattattatatttgtctataaattttatcaaacttaaaataatttgactttaactaaaatcaaaatatcttataatctgaaacaggggagaactacctagcaaccttgccttacttccaatggcgcgcgacacgcgcacgtcgacaaaaacctaccccttctggtgggtgtacccgatcattccaatgcatattaatacctctcttgctcagcgccgcgagaccagtaaaccctagcaaggttatttcttcattttttgtactttggattatttctgctttgcttgccatggccgatgatgatggctaccgatgccagcagcggcggcggcggcggctggtgcacaggatggtggcgtgcttcgggatgttgtcgcggcggcggcggacggtgaggctggtgctgtggggaggcgaggtgcgggcggcgaggcacgggaagatggccgggcaggtgatgctcgacttcacggacagcgtcgtgtgccgcgccgacgggttctgcatcggccgcccggcgccggtgctggcgatcgaggaccgcctcgtcgccgggaggacctacctcgtgctccccgtcgaccgcctcccgcagggctacgacgccgtcacggtcgcctcgctggccg

SEQ ID NO: 45692 - DNA, 2391 bp, Oryza sativa
gtcgtggcggcggtaagccccggacggctgtcgccggtggtggcgaggctgctcggcctggaccgaggagcaagctagctaagctgatcgatcgatcagaaagccttgtaattaattaagctcaaaatttccgttcttgattgccgcttgatttgttcatttgatcagattgctagctgctcctcttgtttaatttggcagcaactaattcattttgatctgaacaaatttagcgatgaatttgaattcggttattattggagagtacaggtatagttttaggagtttgcttgggatcgatgtatgatccgtgtaattgaattgaaaaaaaatataaatgtgaattaatatgcaccgtcaattaattgtcacattatcaggaattcatctatgtgcaattaagctaggtacatcgatcaccgacgcgcttggcgttgttacgtcataccaggtactccgtagtccgtacgtgcgtaattagttagcagatttgcattattgtactgacccgatctatctacattacgattttgttcgaaacagcaaaatttaatgagaactgcgtgctgtccatttcaagttttcaactcgaatttttttttaaaaaaaaaagagagagagagaaaaactgttacgctgcttggattattggaccggtcaatgtaatctccattggggagttaggagatgtgggttggtggtttttatgttgttccctcagttttaattgctaatttatgcatatcaccacgtgatcggttcgattaattcggcgtggacataagtttggttaagttgttttttcgcacgtgattgaattaattcagttgcccaaaatagtacggctagctagatggactggtagagtcgtagagaccgaggggagctgtcaattggtgtttgattaattagccggtggttgctaaatagctaattgtttactcaatcagcatgtagctaagtcatgcaggacgttctgatctagttatatttgttggttaatttataagttctccttcatttagaaatgaagctactagtgcacatgcggttcatgcacatgtgtgtgaatcatgaatccgcttcaatgtaacacgtgccacaaagcccccgtgcagctatgaagagagcatatattatcatatactccttccatccctaaatatttagcgccgttaacttttttaaacatgtttgaccgttcgtattattcaaaaaatttaagtatttattaattttttttcctatcatttgattcattgttaaatatacttttatgtatatatatatatatatttacatatttcataaaagttttttttaataaaataaacggttaaacatgtttaaaaaagtcaatggcgtcaaacatttagggacggagggagtatatacgtgctaaaacccatgtccctgtgtgtgtgaatcagcgaagcgtatagagtattaattttcatatacttctaaaaacaaataacaacatcgcactattgtttcctcgaacttttcttcttttgataccaagtcaacgtaaggtagtaattaacgcgggattattcgtgtgtgtgaacggtgtcacagacgatgaaccaggacacgcagatcaaaggacaggataaaccgccgatcgcgggccgcagccttgggtttgtgaaaggaaaaagtataatttgactcccttaactatggcacgagtatgattcataacctccaaccacaaaaccgggtatatcgactcctccaactatcaaaaccggtgcaaaatatatctgagatggttttggaagcggttttggcttacgtggcgcttacgtggcagtgttgacccggtctccgtcctacgtgtcgttgacatgtcacatatgtggcattttagaataaaaaaaacaaaaatacgtgggaccaacatgtgattcacacttaaaaaaaatagtgggacccaccgacatgtgggccccacatgtcatcatcttcatcctttcttcttcctctctcctcttctctctccttttccccttcctcttcctttttctacggcctcctaactcccttcgttctcctttctctcggcccaagcgcgccgccgcacacctgctgcgccgcaccggtttatgcctgaccgccgagcttcggagctgcccgcctcacctcctatccacgacgccgccgaaaaccacttcggtcctgacgcagccgcctgtcctagagcaccgccatgcacagggttcgacttcccactgtcgtcgcatccgggaccccgccggtaacgacccctcccaaatctcagcttgaggaggaagatgctaaccgtccaaccaccttaagaccaaacgattaaacaaaaacagattaatttaggagaacttttatggtacaatgtactaccagtat

SEQ ID NO: 45693 - DNA, 22417 bp, Oryza sativa
  unsure (1)..(22417): unsure at all n locations
tagtcaacttgccacataacaaaaccaaccttctatactaccggaggacctaatttaacccggttgtgctacttggggtcaaaatttctagtgttatggttgagggatgtgattcaaactcgacataaagatcatcaagtgaacttattccttgatcattccataggaatccgaccttttcctagacgaagaaaatggctcgcctaatatctaaaactcccagaactaaaatgcagagggagtacctaaacaaactgatgtccatcgatggttttcaatttaaaagctaataacgcactggtaagagcaggtacaataaacttccccttgccggttgaaagggtcaattaggcctagagggggagtgaataggctaatttaaaactttatgcggaagctaaaactgaaataaggtcggaaagtctgatccacagtcagactatctgaaaatatcagatagtctgatattggatcagactgagcacaacaagtagatctatcacacaaacaagagtaaagcacaaacagcgactagatctatagcggcacaattaagcaaagctaaaaggaggatgaagggagatcaccaatgatgaagttcacgaagttgttcccggagttcaaatccttgaggggattctactctccgttgaggagctcactaagagccgggtctttgctaaccctttccttaagaggttgcactaagcactcctccttccactaaggggtatctctttccttgcggaggcgagatccggccttcacaaacttctcctggccaatcacacgtagattagtggctcgggagtgacacctagccgtctaggagtcctcaacctccaagagtaacaaacaccacacaactcttggtcaaaccctagtgctcaagatcgagtgaaacacacactaggccctcaaacaccaaatccacaaccaccaagatccaccacacaaagaacaaggagggatttgagagagggagaaagagctcaaagatccaaagcaccttagcatcaagctcaacccaaagtgaatgagaatgaaatgagttgggtaaccctagaaaagggttaggtggggggtatttatagaccccccaaaaatgtggctgttggaggggaatctttcagcccatgtcggatagtccgatacaagatcggattgtccgatattttaaacctccaaggcaacaagaaacagagaacgaagttccatgaaattttggactttccgagacatcggactatctgatgttaaatcggagtatctgatattttagaagcaaaaacttcatcctcaaacagagactcaagttctatgaaatttcggagtctctgtatcatcggactatctgatccgacatcggatactccgatacttagaaaaactcactcgataggattttttcaaatcaagacagagagtgaagttctgtgaaaaatcggatagtctgatgttgctcaagtaaaactgcaataactttttactccgaactccgatttcgaagatcttggactctatggaaagctagtatcatgggctatcaaacccaacataaaacatggtccaaaacctttaagagatgttgaaaaacttgcaaagaaacccggtgtaagtgttgtgacaagtgaaacaactcgggattgaaattttgacttaggtttttcaactcacacaaagatgaagcattttgagcactaatattctaccaataatatgcatgtggtatccctcttaatagtacgacattcctacgacacaatgtaaggtaaaagatacaatataccatttgatcattccacattgcatcgtgatgtcgcattcatggggtatgcatctcattacaacatgtcgaggacataacaaccttcacatttgcttgaataaaagtgttagttctctctaatcgcattgtaatcaatcatcaaaatcattaggggcctagatgcactttcaccggtgatagggatcccacgtactccctccgtcccaaaaagagtcgaactctggaggggggagtttgtcccacaaaaaatcgagtcttgcgcagaaaactagaaacgtcgtctcggtggtggatgggcccacgctctctctctctctccagtctccaccacccgagccttatcccctcccacgcatctttctcgttctctccgtctctctcgcgcgagttcgcacaactcctccagaatccccatcgcatccaccacccagttcccctcctcactccacccatctctcccgctcctccccacaccttcttccccgctccatgccgctcctcctcactcccgtctctcccgcttctccgcgtccacctgcttgcggcggcggcggatagatccgttccgaggcggcggcgaccacgacggcgggtggaggcggctcggatgcttcggagatgtgatgcacaaggcggaggcgattgatggatgcagtgctgttggcggatttgatgcagatttaatttcttttttgttcttgattcttctgtgttttttttgttcttctatgttcttgttcttcctagttcatgcaggtgaattcaaagcatttcgtttggttgtagagatgttatcttttcctttggcaagtgtaaaaattgattggttcttgctcgtgaattcagagcacttattcttctctttttttttcttttcagattggagagatatctcttctttctttctgtagtataaaaatccaaattttctagcctttttgtatacggcagatgcctcctgtatgtactggagtactactaatcgatggataaaaaaacgaacaaaacaacaaacactgataagggtattttggtattttcacattcgtcctaaacttgcatcaggaatccaggagtagactctttaggacggagtgagtaggctgcattgctgagctagagggaaaaatgatggagagttagcgcaagcgggcgactatttatagtcgctgagctacacacgcatttcaagaaaacggggcccactagcagagcggagaggagctggtcggcagtcaacacaaccacagactgacgataaatatattgataaactactactcatcttaactactgtggtagtagctatctattgtacattttacctacaaagttaactcttcatgacatggtaaaagtttatagccagcaacgggctacactattaaacttgctctaatacagtttgaaattgtgttgttattgttgctattaatactctcttcgttttttaatatacgacgttattaattttttaacatatgactattcgtcttattaaaaaaaatttacaaatacataagatataaataatggtgaaagtacttagtgataaaacaactcacagcaaataaatgataattatgtagtttttttaataaggcaaatagttaaacgagtgccaaaaagtcaacgccatttgttagaagatgtatagtagtataaagtataacatggataaatttgtagatggccaaaaggcccgcccggcctggctcggccccggcacggcccagcagccatcggaccggcacggcctgatcggcacttcgtgccggcccatgggctgcacctcccgcctaggcacggctcaccagttgtcgggccgtgccggcccgaaggcacgggtggcggtcttttttaaaataagcctattttcctccctcctcgttggactgttacatatgtatagctaaaataagtctatttttcatccctcctctttgggctaacatgtatagataaaataagtctattttcctttcctcctctttgggttgacatatgtatagataaaataagtctattttatatccctattctttcgtccatggcatataatatatctatttttactcccctatttttttttggtgtatcaggcctggctgccgacccatcgtgtcgtgccaggccggtccaacgtgctggtggaggggcccaggcacggcccggtggtcaagccgagccggcatggaccagacctccgtcgggccgtgctatgcttgggccaggccaaaatgccgtgccatgggccgggctgtcgggcctcggtccttttagccatctatagataaattctctaaaaaagaagaccttacagaagctgcagtctccagaccacatagatatatttacgtgccggccacgatcacatgacaatattccgggcaaactgtggagacaggtaaggaaagcaagaaaaaaaaactcgcaagtacactacgacacggttcaagggaaatgtctcgagcactcactgaacagcagacaacgtcactcgagcaacaaggacgggtctctgctatgtacatcacgaccgcactcctaaaccatatatatcgattaatgctcctgagaaccactgcccatcacttggccacctcaaccccgatcctctctgcaacctgcgtagtttgaaataaccattagatagagagtacactgtacagaagatcattctactggaacctatcggagattcggagttgtggatgaaagggaacaccgaattacagaaaggatgctaaagaaagggacataaaactcccacatgattctagagcttcgatttaaacttcaaacgataaatctcccacatgattctagggctttgaattgaacctcaaatgcagcaggttcttctaaacaatgacaagttgacagctagtagtgtttaatgcgctactctcatgccagacatcactgtgccagtaatgcatgaaagatctgttgtaccttcattaacagtcgtcaaggcaacccctgacaacacaatgcacagttgcacacatagccagtaaacgaacctcacatagtcaaagactttgatgatgcaatttgattattaaataaatgtaagagcaactaacataaatctcctgaatgattgctacaaaccatgcagatggcatagtgttattaaattatttacaagttgtaaagaggatggcaactctgccaggaaacaatttgcaagagaagaaaatgactaatgttggggggtgtacagaagaaatacctccttgaaagagtgaacatcacttccccatagccaggcatcgcagcctgcatctctagctccccatatatcattctacgatcatcgccgacatgcacggcctcttcaggtttgacacctaaagactcacatgccttcagaaatattgttgggtttggcttttctgcagcaacctgttgtagattattaatgggaataagagaattatatataaaactgacttcaacagaatagataagagtatatgacacgagcatggtatgcatggaaaagcatataatgctgaagaaatgacaatataagtcgacatacctcagcagagaccgcaaccgcatcaaaccagtgatcacacttcagaacatgtaacagaggccgtagacgggtatcaaaattggagacaacagcagttttgacacctgcctttcttaaagctttaaatacgttttcagcatcaggatcacaaagcttccaagcctatcaagcaaaaaggattctcattaggcccacaaaatggaagctgaactattttcatacgttgaaggcacagttaatcttaccttctctgtcatatagtactgatatagttcctcaaagtactgcaaatctgaacagccagtagaagaagtgactatatgctgccaaaagggtctaccatcatccacataccttaaccaagttggaaatatacgaagtgagatcaatcttaaagctgtctaactaccgtcaacagaaaatacgcagtagtgcagtacatggaacataacaaacaaaggaaacatcagtcaaattggaattcaactgaaaagaaaacatcatgaacaacagcatgttcttgatctaagcacaagaatgttgaattccccactgtctatacaatttttgaaccaaatatacaacatcccattgtttgtttatccaaaaagggcatttcaggaggcaacagaatggtagttatccacaattttttttatttggtagaaattcagtgtacatcattgttaaggtgcataccatcatatcctttttgtcgttatctgcaaaatctagggatgctaataagaaacaagtaacagctgaactgaaagtagttactactaattaagtgatggggcgcttgctgtccaataagaatgattgtgaattacaatgaatatgtgctgacccttcaacatgttaaggaagaaggttacataggaaagagaactcgaactacatacacagagtcaatgaatacccagtttaaatcttttatcatgattcattatttgtagatagaaagacagtgagttcacacagatcccttaaccttataagctgacatgtgtaaaatgatgtttgtgcttgtgctctggcaaagcatgtaattgccaatttatgcaggtttacgtgaatgaagctgcttccagcttagaaaaattctaaacatttcacaatgacttcaaaagatgcttccagcgtaggttttcatgacattaaaagtcagcagaacaatagtcaataccagcaagttcaacttattgttactcaatcaaggtacagattgcatcaatataataatcaatttgtatgcaatatatataccgcattcaacagaataagatttaaacagattacagttcataaacagcagcaattacacaagtatcagatcagatgatgagatgaatgaattggcactttggcagtcaataatttcgcgtgtatataccacagattcgcacctgagccgtgatccgccccacggttgctcatacgcacgccggtatctcgcaaggatctcatcttcggagtacttcactccatacttctcaccaatgctcttatacacctaaacaaaaggggaaaaaaaccacggttcaaagctcaaacggtcagagatcaattcatcgcaggagcgacatcgcactgcaaactctgcaccccaacaattccggctgaactccattgatcagaccccgagacccacacatcgcagtgcgcactgaggagacgagggccaggagctaactgaccttagcggtgggctgcgcggggacgacgagggtgccgacggcgtcgacgaggagggcgcggtgggtgacgtcgccgtagacggacttgcggtagtcgtagtactcccgcgccgccgagagctcccacctcgccccggccccgccctccctctccgcctccgcctacgccgccgtccccagccaccgcagcccgccacccttgcgcgcccccgcggcggccgcggccgcggcagtcgcggaccgcagcgtcgccgtcgccgccgccgccatctcgatcacggtgggggatgacgccggctggctccgtcgatggtggtggaaggctctctctctctctctctctctctctctccggagagccgccggggaatgcggggctccggttgtcgtgcgcggtggtggcggagatggggggagagggtggcggccgtgtgctgcactgttgctgctttcgtttcctttcttcttggagatggacttctgttggtatcggaccttctagaacacattcctttaattttttaggaagcctgaaagggtaaaaagaaaaaaaaagtgagtttgtatgaagacagccaagataagtttaatttatcaaaataggaggactccctcaattccataaaacacagactaatatgatatctaaattagtaacattgcaatatggtatatcatatattagatcatttttatagaacggaagaagcatatgtttttataaaagctacgaattctaactgtctgaatatcaagctgtgaaataaaattttgttatcggtatttataaaagcatcaccaatagtctccttattctatccacaatcctatttttttaaggattttggtgaaaaaaatagctccaacagatcttatatttgatttttttttaagtcccttccatgcatcctttgctctcttcatttgagggagagcgacggggcgtttgccgtccccaatctctcattccgcgtgtttttttttctcagggggagtgctaggagagcacgctagagggaggaaaacaggaaaaactgttagagtccactttatttttttaggattttggtaaaaaaaggctccaaccggtctcatatctgatttttttttttgaaatcccttccccgcatccttcgctctcttcatttgagggagaaggacagcgcgtttgccatctccaatctgtcattccgcgtgttttttctgggggggggggggggcaggagagcgtgtgaaagggaggaaaacgtgaaaatttattagtttagcagaagagtccacttctaatttagggataaaatttaggctttatcttggcgggatcagttttttggctatctattttcagattaggaaacccaaaaacaacttttttgggagattatacgtaatctcttggtgatgtgatgctaaacctctccgcttttggccttgcaaaattctaaggttaattgctcggtaaattggttaactttaaaatattaaattttactttttaaaatgaaaaataatcaaattccactggcagtcaacggtttttaatttttcttttgaaaaccaagaaataaatatcaataatgccttatttaaatgtggtttggttttgtgaaaatatgtgtgtggtcatattctaagaaaaataaacatgtgtgtgaataataaagagacattgcagcacaatttctagattactccattggaatttggaggatggcaggaaagaaggataatgatagttgcatgctgcatggaattgagttatggttaggattggtttggacatttgctttcctatggcccagtggcccactatgttataatgatagaccacgtcattggttccataggatagcttctagccaggatcatttcttctgataaattttcatatatagtcaccgtatgattgataagtttccatatattgttcatacctaactctattggacgtatgcctaatattgtttaattataagaaaaatatcatttgaaatggtctaagcaacgtttgcaacatattttgggacaaataagatgttaaaaataaagttatgttggaacggcagggatatatgttttttttagaaataaaaaattcaattatgccatgagtctagcaaccttgaagtttgaggcgtcttggtcaaaagtgagcaaaataactttgaagtcacgaatatattgctatagataagaagaaagtagttcatatgagtactatatttgtattagaaacccgtaaaccgaaaacatgtgcgatggtattgacgcttccgatatgattcttaaattaataaggtattgttggaccaaactactatcaaatttgtttagcattgttcgcttgcaaccatgtgtggccattaaaccaatctcgcattattccctttcaaaacaaagggagaacacaaaagcactcacatcaaaaatggttctgtgagacattacgttgttgctcatcatactagaatgtgtcatatctagttaaagtttcttatattttggaacgaatagagtgctatgtttagatcagtgccaaaatatattatatagttataggagacaaatatatgattaaatattgaaattttcggtagggcttaaattaatttgagtaaattaagtttatgattatattttagtatcaaagtttcactttggatcacctttcatcttatcttttcactttgaacaaagttactttgactttgttttattttggatcacctaaaacaacttttctcaagcacatcaattacaattactttaagcacatcgacacccataaaccggcatgtcttcacaacttacacataagtattcattgcaagattagaaagtagatgtggctagacaagtaatttggggtaatccaaagtacaacaaaggtaatctatctaatctaaaataaaaatattactagttagagagtagtccaaagtgaattttgataataaagagaaacacctaagcgtcttccggttaactccgaaaggttgtgagctagccaacatgggttcggagcctcaccccttctatttatttgatattaggttcttccctaatattcaccttttttatttttgataataaaagatggatttaaagtgcaattacatttaattttctgtatcttttggtctgctaccactctaccagtaccatattaggttattccttaatattcgtgttttttaattttgataataataaatgaaataaagtgcaattaaatttaattttccgtccccttctccctcctctctgcccgctcgagctcgccgccgcctccccttcttcggtcacattgtcgacgaggcgtggcccgcccagttcatggtggtgaagagatctccgacgtcgagctccatgtggcagagggcgacgggatcggcggcgcttgagctctctggcgtggatccgacatcatgcttgctggatctagcagagctcgagcgccaaacaggtccacagatctggcatcatgctcgtcggatctagccgagctgccgctgtcgtcggcatcttcccggagatggcgtcgatatgttcagagctgttgtcatcaatgcgaatcgagttggcttcctccttggctaccgccgccgggctccctctcctccctccctggcagcgtgggccacagcgaggtgtgggctggctatggcgacgacaacctctagctcgttgtctcgtcggtagcctccagttcctcctttttctcctctacaacttcccggaccatacaaatcgtcttctctctctcctagaaccaccattcaaccactgttttctctgcatgaacctctgtcaccctgtgagaccactccaaacctttagcgtggtatctgaatctaagtgtaacttaaaaccacgggtgtgagacaccgcattgtaggtgtgtttggttgggtggatgaactcggatgggagatggccacccgatttttttgtggtgtttggttggaggtcagggtggatggggcagcccaaaatagggaatattccctcaatatactggatgagtgcatccggccgatttggctggatgaagccatccagttttggtctgggtgatgtgtcatgttctgattggctgtggttggtttgattttctgttaagcaagctccaaatgactttttctcctaaaccgttttatctaatttatgatttgattacaccattatatttgttacaattaaatctttaaaacaagatctcggatgattatatcttgataaaaaaattatatgataaatgggtctcactaacttttggttgttttcatccatgctatatctctccaaccaaacaagaaattagatcgccatatccatacaaaccaaataaaaaaaataaatcgtcatattcaataaaatatggatggctatatgctatccatacgtgaccgtaaacatagaatggtcttatgggacggagggaccagggagtactcctcgggggtcaggtcatcggcggggtgcgtggattgcgccacttgtagaccgggccccacatgccagacgcatcgatgcttcgctttgtttacgcggcgcgcctctctttttccttagccaccaaggctcagaaaccgcctacaaaacggcgcccggcgtcccacggatcaagcgaccccctaaaaaaccaaccgaaaaagaaaaaaaaaagaagcagagaaaaaagctctcgcggcatggattcgcacgtaggcaagttattcgattcggtgggctcgatcttccgcggcagcgacaccctcccctggtgcgaccgcgacatcatcgctgtaagcttccccaccccatcctcctccccctcctcctcatgaacccttggctccgccctccgggttgatccgtgtttggctctagtatggccatttcttttcccccgcttcgtgagtggatgtttcgttgtggctgcgaattttctgtggaatgtacgcgctctcgcgaattggaggttttaggtgttcggtgaccgctaaatccctagctattgctgtgtttgtgctaccatctgctccgagtttgcgtttgttttagctattgtcgctcggtgatcaaacattttgatatcatgtgctattgtcgacatctgcggttgaatcacaaaattagcccccattttaccctcgagctaccgtggtcgtaggcctaaacgaactatatgttcagttgcaagctgctatatgcctatattcgcttgcctcgcgtatcatgttctctgtcctaatctatgtcatgccatgtgcactttttgtcttgttgaccagggttgtgagaacgaggttgcggaggctgcgaatgaagaacagaagaatgagagccttatgaggctttcgtgggcgcttgttcactccagacagcctgaggatgtgaaccgcggcattggaatgcttcaaggtaatgaagccacatacatcctttaattttttttagcatttggaatttgttaatcaattcaaaagctgaatgaatagagtagtagtttactgtttctaacatatgaatgtttaccccatcactttctgaaaatttatacgaccatgataatatgtgtctccccatgtgaactatttatatattatttttggtcatgaaaacatttatcagttctccagaatgcaacttgcttgaccacgaattatctataatgtgtctgtagggccgatattattatggtataatgaaagtactttggggacaaatctacacataatttttgtgtatctaatctaaatatttaaaagacatttctgctcaaagtctcgatgtatgtccaaatgaagatgttttcatgaccaaagggagtatataagtcagatattgttaacctggaatacaaatctatctggaaatcatgattttaattctgacgctgtttcagacttatatatttaagtttcaacagatgagccacacattgtctaacaatttatctagggggacccctttttaatcgaatcaaatagcttttaacatatgttataagtgtcctcccacatgattacccattctgacgctcctattaaacttcctgtatgcactcttctgaacaaactttattaatagtgccgttaatatggcactctaatgctgaatcaaaatgtcacttcattacattgtgtcacctataaagtgatattccaatccattgtccacattttcttgtatgtcaaccatttttcaattttctttaacacttttttgatcggttggcaatcagatattgtatctgaccttcctgctttcacttgtggttgggggggactcatgtttttctcttggcacctggcagcttctttggacaggtctaccagtccactgcagacaagggagaagctctacttactggctgttggacactacagaactggtgattatacaaggagtcggcagcttttggaaagatgcttagaggtttgattactgaatatatttctaatcattttatttgctgtttccatgagcccatggtcgctggtaccattattgttgtatggatatgagatctatagatactgttgtaaatggtcatggtggtaacctcagcttgcaagacaattaactgattttaattgattatcataatattgcatttttatcaacgaagcatctgttagtttaaaaatgacaaagtagaacaagtgtatgacctgccatcatgttcactcaagacttgaagctgctataagagaaacaggctgctttgtagaattacgctgtttagattggattggtgccaatttttgcttaacataatgtgtttgtctctttaatcagatagacatctgagatatcttatttttgtacgtttagattctaacttttttgagattatcctgaatttgatgttaatgaatgcacatttatcaccttttgcagattcaacctgactggaggcaagctctcactttacaaaggcttgttgaggacaaaaccagaagaggtagggtatattatttaacatccaagccttcttcagactggaaaatgaatttgcactcaattttcatttcatactgttagtataattgtcaaatatattggttaggggaactgtagttatcagcagggcacgcatgaaagttgatattaacaaagggtatcttagttatgtctgcacttcacattataaagaaagaagtatcggagcagctcagcaccctcttgtgtcctttggagatcggaacaaagaaattctagaagatctgtgtaggaaataatctaattccaatgaattttagtaaaatatttccgtactaatctaattcgtaggagtacaatggtttttgcaactcggatcgattgaaggatgggcattactgactgctttttaaatgcagacggtatgattggcatggctattgtcactggtgccttcggacttgtgggacttgttgctggtggaatcatcgctgccgcttcttcttcatcctcatcatctaggaagaaatgaggaacccatatcaagtgaataagatgtcaagatgggcaagaaatcgatgtaaatatgcgcatcttgctgtcatacttgttgcaaccgtatactcacgtctccatttttcagtccttttaccatgagttcaaacaggagacatcacatgcctgcatgttaaacatcatggaagatgaggaggctcctgttatgagttgcaatcaggatttacgtaaccttgtggttatcatggttatcatgtgcagtaattttctcagtttttgaaaccacggtaaacctcgcggtggccgcacggttaccacgataaccatcttaccgtggggtggttgtaaccccgctcaaaatggtttggtaaacctggttgcaatccttcagtacttgaactgatggctactaccttaaattgtggagtaaaattttaattaactagataatgtctcgtgctttgttacaggatatatgttaaatattatagaaatgataaaatgatttgaattgaaatattgtgaaaatgatttgagaacgatgatttagcatgtgtatattgagttttagaatgaaataaattgtagatgtaattactatatgcatacttacatgttgagttttaggtgattacggattatgtatgttgaccttagtgggttgatgtatgttgagttttaggagtttagtgggttataatggtaggtatagatgagaggcatcttttagtttcctcccgaacggtagaaatttaaccgtaagatgacatatagatggtgaactgaatgaacattggtgacaaccgtcagttcaagtgagagaggggatcgggagagatggtttcattttgttcttttttctttgtccacaaaagttatcttgtcattttagaaagagaaccttggtaaacaagaaaaatatgaaattaatgatcctagttaacatggaaaaaataactgcaaaaagactaaaacagattaaagattacgagtcctcattgtttcatgtgaatacaagagttggagttgagagtggagacatgtttttcacggttggttgtattttgattttttttatctatttatgatgtataaatacattaatcatgttgggtttttgaagaattacgcttttgtcgtggcaaattttttagcatgtaatcattgatgaccgatagtgtcagaagtatctagtttggatttaaattgacagcaacatgcatataattagtttttttttctaattcaaacatttgttaaaaacaaccgttaacctccgccggtcatatattagtcacaagtatttataaccttggtttggagtcgatctaaataaaatagttaaaattattttaataatgtactatttcaacaccatatctatatctatacctaattaaaaaatacataagacttctctgaggattttcgttcgtcttagtccgtcgtccgcatcatgcgcacctcctctccacttcatctgccgttcgcccgtgttaacgcgcattcgctctgaagatcccacaaccaatcccaatcattataaatctaaaaaaactaaatcctagtccaattggtatcatcataaatccaatcagaaatcgcaaaataaatcacacaagaaataggaggagaggcggaaatcacacaggagatgagagatgagaggagagggagtggcaagcgggaggctgccgctgctccttgccgcttcgccaccgtggagatcccgagctcaggggccagatcccaatccgccgtgccgggggatgattgagagggagagggaggaggaaggtggcgacgatgaggccgagaaggtggtgtggcttatgaaacttctgtatattttttttcacattggtttatattagtttcaacatcacgcaatactattaaggaggactgatgtacttttatctcaacaaattaaaactatagtgggagccgggaggtctccaaagactcagagaggtagggaaaaaaagtaagagagcatctctgagactcttaccagttttattgtttggagggcatgtttgattactcgtatttccctagcctggctaatctcctttatataagtgagtgtggtatggataagagcatttttaagagcctcttaaatagactctccgagccaaattttggcaattcaaaaaaataaatttcactccaatagccaaatgacttgccaaactccgtccctcatgaggagctgtacgcggtgaggcgagccgaggtggaggagatacggcggccggaggtggagaagaaggagagcgaagaggttgacaggtggggtccacgtcactttccacgcgggcatgccatgatggctcaccacgtaggcaaaataggcaaatagttaagaaatcacctctctccaatgataaattattaagagagaatttattctataccactgagtttgttcgagttcaacgatttaccattgatattgtctctttctacgatatacaggcgacattatcaatgttctacaatacgccattgggctggatattcttttcaagaatacccaaaatacccttatggacatataaagttaacaattgatttatcccattagaagttttcaaaaaaataaaaactttgatgtggcctccttacacaacatgaaagttcgtataaaagtttcaagttttttaatttatatttttaaaaaaaagatgtaacttatctgttatatgctatacaaaacacttttttatttatgttttgaatataaatcatctttcatacactacataagatatttttgtgctattatctctcgtataagcaaattttctctcgtatactacataatttttttttctaacaataaatataccagaaaaaaaacttgaaacatataaacaaactttcacgttgtgtaacgaggccacataaaaatgttcatattttttttggaacttctaattagataaatcaattattaaccttgtatgtccataagggtattttaggtatttttttgaaaagaatgcccaacctaatggcgtattgtagaacaattgataaagtcgccggtatattatagaaagagaatgtcgatggcaaattgttgaactcgaacaaattcagtggcatagaatatattctctcaattattaaatacaaacctcatacgggtatttggataagtgaaaaatctaaaagtggcaaatagttaaattccccgcatctttccgctgcctagcagttggaggagagaggagaaggcggtggcggtaacagagaagggaggcggtgccggcaactgagaaggaaggcggcgccggcaatggcaaggaaggctgatggaaggagagggcggcgtgatgctgcggttggggtctgttagtcatcggtggatctggtgcgttgaagctttatgaagggagtcagcatccggcaaggaagacggcgccgacgacagtgaagagaggaagatgatggcggcgggaaggacaacaccctcaagcttccagatctgcattgtcctctcctacgtcctaaatcgggtgccaagcaaatgagggaaggcggtgacgggacgcgttgacccccctggctagcctcgccgaatccgctcgttcccgcgttagcatgactccgagcaagcgatgccttttggtagagcgagtgataggggcagcggcagcagggccttccttcaccgtgctagggatgagtggtgagctaccggatttcgattcaacttagagtatctcttttacagtttcttattcgaatttcctttttcagagttttggttgtttcttccacggctcaagattgtttgtgttctctagattgaattttcactgaaaaactttgaacgctaggagaccaggagaggattcacactcttccgtagtggatcagagatgagaggaggagcatgtcgtcccatctactccatgccatcccctctcacaatagatggagcatgtcttacatggcttgggaggacgagctccagaaatatattatatatgttcttctttcttatctctctttaatcgattcggttttaacatggcaattgatctgttggcactagtatcgatcaatttgtatcttttttttttgtctaatatctatcaatttttatccctttttatctgatatctgagttagtttcactttctgtttcttgtctcgcttgaggggacgtcacagactcctcttccattgctcactgtctcgctaggttgcctgccgaacaaggctctcttttgtcaactttctctgtcttttattcccgttacaactcacagcctctttgttagcctctttcttaaaagacaagaaaaggatgggagtacatatgtataggagatccgtttggattgcgatctgtgaccgagttgtacttgtacgtggccacggaaactggtaccggtaccgagcttcaacctatataatctgaacgtgcatacctcaatccgtttcaaaattgaatctaaccatatgatatgacataacgtagcctagattgatttatttcagacggagaaagtatatactcctatattacacaattgactacaggaagatcaatctagttgtacttgtacagtcttcggttctatcctctatgggccttcctagctccggcggcccggcccacaacgcgagccttggacctgctcgcacatggacctcctccctcttcgcccgccgcgccggcgacccctccgccgccatcgccggcttccagcgccgcctctacggaggccaccggcgccccgatgtccctctcgccggcggcagtctcgccgatagctacgccgagtgagaaaccccctccgaaaattatatgttagcgaatttatttgattgatcgatctatctgtttatatgtggcattgatgtgatgatcaggccttgatgagattagggcctttatatattaattaatctgtttctgtggcatcgatgccttttcttttttctttttaattattatgttatttgcaggcgtagggttgagattcccaaaagtttcgtcatactagaagatattctgcaacacaccctgtctaatatgcacagtatccaggaaagcatactgttctggcagtccaatgctctggtatttttacgccgcaaaccctttcttttcctagactcccagtatttagatatgattcttgcatttatctatctgccatttacctatacttggaattgtttctcttttcttttcagagaacaaattcgcagaaagcgtattttatgatctttcaaagaggtccaagggcctttgttgcaacaacatgtcaaacgctggctaaacttcagaacaaagggagtccagtccagggccttttggactctgcatcttctatgttctcaacaaaacttgccatcctaacaaggatgcaacactgcttggcttcttttcttgctgaggtttgtttactaaaataccaatattaaaaagcttttttcaaagtcctggtctcttcccaaaaactgaggcatggtcagcttcaaagccagctgttggtatggcatatatgaacttaaattctacctttgcttttttccataggtttacaatgaaactgacaaacgcagaagtgtattaattagaagatcagaacaatcgctgcatagtctcttcgttgctctgaataacatcttctccaatttggaggtagaacttagaaatgctggtgaggtatgaaatgtttttttctttttaacttaattcgagattctaggtgtaaatctttctttgttgttttctaatatggtctcggtttttcttttccagcagggggctgtattagcgaatcatgataataactcattcgaactcttccaaagattgccagaagctgatgttcagagttcagctgctataagtttgatctatgaaaaccttcagaagttagatatttttctttcctctcgggtttgcaactccccccctactacactttcacacgtgatttttttttcacttgtcagcctcgcagttcccagattactgttacctgtattttaattgggacattaaggctgtgttcatttggattaatatgattatttcaagcaactttcctatagttttttttgttgcaaaaagtatattatttaacagtttgagaagcgtgtgtacggaaaataagaaagccaaagttggtaagggggagaaatgaacgcaccctaaggattcaatgttgtacccaagtttttttggctactagtttgtgcttttagtcgaaactcaaaaaagtatttttaggcatatgcaagtaaaccaaaaactgttccatacatgaatggtttcaaatgagaaatcagtgctactgctaattattctaaagtaccaaaaacatttttgggtgattacggaaaatctcccacttgaggcatcaaaatcaactaattaatcatgtggataattgacaaagtgttaaatcttgtacatcaatatcagatttagtagtctagcaatcctttttacataattcacctatttattttattttttatgttagaaaactatatgtgggtcttgtactcttgttcatctcacaaaagtagatcttccggtgcagttcttagaagatatctatatgttgcttataatttcattatgccaagaaatgtgttgcttatttatctgaattctgaagcaagtaattttatgcaatgatagctttcaagccataaaaagccgagaaaaatgaccaaatattggttaccctacacatttggagcattgggcctctctgcatttaccctatggcttttacgccacagtagcttgatgggaagttctgacattgacaactggcttcatggtgctaaaaagttgctggtttggtgttgggatgagaatgttcagaaaccagtaagatactctatctatattctattttttttatttattttgtgcacaatggtagtgcaaattactccctttgtttttaaatattcaaactttcgaaggtttacatggatcttgtccaaaaatcaagtgtttgtgaccggagagagtggttggttggattcgcagtcagttactcccttcgtttttttgataaatgacgatcaaacgtttgtccaaaaatcaatagcgccgtgtattaaaaaacggagggagtaactgattgtgnatccaactactctctccggtaaccaatacttgatgttttttggacaagatctggtcaaaccttgaaaccttttaaaatagtaattagttttaaaacataagattgatttgtgtagatttgtcttcaaaagtattttcacaatcacagttctaaatttctaaaaataaattgtgtctaagtcacacctcgaagaccatgaaagaaaatgtcaatgtcatgcactttttactgaaagaaaaaaaaagatcattctctagttatctcaaacggttcatttaattttcatgtgtaaccactaaattttggaagtgttgctacaacaagctcgtccaagtttccatatatttatccactatcaagatgaacataatgatctgtctagttgttcgaatttggaaattagtactttctgttgtgtcactgaccgcacgcatgacacgttttttctattatggatctttaggtcagttctataaggtatctcaccaatacactccatcaaagcaaaggtgtaacaggaaaacaatatatccaattccctgaagatacattaagcaaatgcaggaacatatcgtcttctctctgcgaaaggtaatacctggtttacatttgagtttctgattgaaaataaaataataaaatgttcccttaaggggttatgagaaatccctatgcaggggcggatccaggatcaaaaaaattgggggggactcaattacacagtttcttcaacctccagccatctaaggacctttagattaccattcatggtgaaaaaattaaa

SEQ ID NO: 45694 - DNA, 16830 bp, Oryza sativa
  unsure (1)..(16830): unsure at all n locations
aataatgtcactatctaatcactaattaggatggcattcaattgcaataccatctgccggagaataattatgatatgtacacgttatttagctattccgaattactctattttgggtgatcctcgaacaattgttctctctatcgtgctcaattgaaaatgtgagtatgtttgatcattcagctatattctatgcatattaagtgcaggtatgagatggaaccaggatctcctgaagaattagcatgtctcatgattaatcaggttattttccttccttgtgtacatatatttgcatttaataaattcaggtcgcttttttctcaccaactttgaaatttcagactaagaagtttttacgggattttaaagagtaagttaaactattcatgtctgacaaatatatattggtaaaaacacacagaaaactcttatctagtataagtattcaccagctgagtttgttggattgttcttgcacagggtaatgccggaattagaacatgttcttagggtacagcaggttactcttgcatttggtcgatggcttcttctgccggtacttctaaagccagcaagggttgtccatgtacgtttattccaatgtttaccttcttctcaatatcacttgcctaagtagtgtattatctccgtcccaaaataaactaacctagacgacgatgtaacatatcatagtctagctatctatatttattgtattaggatgtattatattatctttgagatttgtttattttgagacaggcctcagtatgttctactctattatctgtgtgcctggcatctgttgtgaaaggagtacaagtgttaccaggcttaacatataactgttgacctctggttatctatacaacagggtcaggttacacagagaagagatagaattgcacatcttaagcgatgtcagcttctctctggagtacaggaaatgcttgcagagtttcagtactgtatggacaagggaatggtaatttatctatatctaaaattagtctattaagatccagaatttatattataactacgattattccctgaggatctactttatttcctttacagaaggaagaggcacaatgttcgcttggactattattgtacagcatttatagattttacagaggtgttgagtcgagttcaaaagaaacaggcgagtggatatagtaagtcgcaagtgatcttgactaaatatttaaaatattcctttctatccttgattgcctaggaacccttactatcctggattcaaatgttttttattgcagtatgaaggaacacattttctgtctggcagaccctcaattgggcgtggcaatcaagcgggacattctttcgagtctacggaattataaatgcttatcaccaccatcgagtttgtatggattttagtcgagcatatatttatggtaactattaggaattaataagatcgttattccccttttaatttttggcttctcatatgaaattacattgacgactaacgtgtctaaaccggtgaaaaagaacagcccctaagggtcacttcattacaaaaaatttctatagaagattttttaaaaaagtcaaataaatcaattgtcgataagtctgtcttctatctattcttcttcgaactttctgtcaaatcaaacccccgtcaatcctccaggacccaaacaactcacttttcgcccatgaaccatttgtgtcaatggattggtttgatcaaaaacttgagataagggatatgtaccaaagaaggtctcgtaagtagttattaataaaatcgaggttgaagttggagttaccaaagtttgtggagtcggttttgattgacgtatcaatactctataatgggtgtcccaatattggtgttgttcgggctatgcagcggaaaaagagattatgtattctcgctggaatcaatcacacattctgcccctaaagcgccagattcagacagaacaagagggaaagacccggccgactcgcccagggctcgaggacgagccatacgagagtgagtcgaattctgtttacgttctcggtttggtttgggcccctctcgatcttttgcgtataaggagttacgtcaactccaaaaggattataaggtttaaccggtaaagcttatgagagaagttcgaagctgggacaagattttatcgtctcgttcgagaacttctttatgcaagaaatgggctacccgtgtcgaccagtaccctttttactcagtgtagtacccactcggagaacgtgagagtatgttcccctgccctcttctagactttatacacttgtaaaaatatattcgacagtggtggatcatagctcaaagaacctattccagtgaacttgactaccattggaaatgtcggtgccgtatttctttttcttgtttggatagcttttgagaattctcttaccgaggaaggcacaaaccttttgaagtagtggaattgccaaccctatcttacttttgttttgggaatgctgattcattttccccttttctatactactcattccattctctttgtcttcaatgagaaggagaacttcgtatttggtaccaccacactagatctagtctactcatatttgttcgacgaggtcgtcccgatcagtcccagcgcacgcaccctgtagttgtcggcctttagaactttttgaaagagatggatgtctgggatcgatttcaactcagagattgcctactggccacgaggcttatgaggcctgcggaggaggtggagggaaacgtatgagatgagggatttggacttgctacacttaccagatgtgaggtagttaaatgctttccttccattgcagatatccatattgctatagtgtctataaattatcatatagaaagaagctaaggggattctacaagatgttctgaagtgtcgatatacgacgaacaggaatctattctacaagatgtttgaatgtgtgagtatccttgtgtggatcagcccgaaggctgtcgattttaaaaggtgaagacaaggaagagccattcttcatacataggagcgagtggtcgaaatggaaagcggacaaccggaattcagtacaactatagggttcggttcctctcatgtttacgctaggggatgattctactcgttcatcgacttcccccgcatggagcagcatagatctaaatttaggaggattatccagatcgtagtactctaaagcacaattcttcttggaggagggttggtttgcccaggtgactgatcctgccataatatactcccgccaattctattgcaccggcaaccgaagttgaacatacatacgacgatcttcatgtgtgaagggacgggaggaaagaaagggcggtagatgataatgcgaaagggcgccgcgtctgggcgggcgggctaaatggataagcgaagaacatgttagagacttgaacttcatcggacaagaaggcgctggttgtggtttgattcccagagctagatgggatatgccactggatatttttccagaaggaaattgtcctgcgaaagcgaagcgacgttggctccatactgggaataaaaaagtatggaactttctttgattgcaaaatcatgaaaatggctcagttcgaggggagtcgtaacaggtataccacgcacaccccctttccaagggtagtagtagataggttgagctaactctttcgctataatcttctatctcgcattgctacgtgctcgaaacaaccaattcgctcgtatagctaatgcaacctatagagtttggagagtgctgctattctttccaaatggtctctgagtgcggtctgtcaattcctgttgtagacatctgaggagaggtggaagaagagtagacttactacttttgcaaatcaaagaaagaatttaaacagacatcgtactcgagcgggacactgcagtctacttcttggttttccaaaggtccggaggagcggaagagtttctagtcgagaagggtcgggcattagcaaatccttcaatcccagattcgagggctaaaccactacttgaatgaacaaagcaagcaacagttttgtttttcaaccgagaagaaaggcgggcaagcgggcgccacactcccctataaccttcttgcactccactccggtatatctttactctacactcctctacaagatagagatctacgtttagctgtggaagggatcacggagatatgtgctctaacgactcaacccttttttgaccagggaacgggagaattcccactaccgctggcaggccagccgggccgtgagcgcggtgggaacgggcttcccaaaaaaagagccccggcccgggtcagcatagaatggggggagggatccttcacaaaaggcgaaatggatatgaaaaaaagattgattgaactttccgacggactcatgggatgagtaaaagattgaatgggattcgtttgggcaacggaatcaagtgctggtccccttttctctcttattgaattaactaattcatttacttttgacttttgttggatttttggatatttttttggtgttgatttggcattattcaacaagaataaaagaaaaatttcgataaattcctttttttaattatgagaaccaatcctactacttctcatcccatcagacgaagacgaacttgcatttgttgaataaagaaaagaagagttcgatgtaggaggagcgagcctcccccagagctttcggcagccatactttcttcacaaaactttatgataaagatggactctctttcaccgcaacttgcccgccctaacagatggaattgattcacgatcagcctccttcggacccggtagctacagcccataagcaaaacaagatttggtctcgtacgcttgctaagcaagtttcctctctttttaatttttaactgatagccctctcgttacttgaaaggaaatggaatgcatcttcggtgcctaagcttgagtgagcgcatcgcaactgtgccgatttctttcttttgttgccgtacttggtaggctccttgtccccttgatttttcaaggaactcatttttttactggctccctttcctccctatgctcccccggcgcaggcccaccacgcttcgcgcctgcggcgttttcgccagacggcacggcgtcggctttcataaagcaaccgaattaaatcctcctttattttgaattctgtttcaaaataagaaagaatcatttcttgttccataactctgtgtacactccgtgttgataatttgagacctaatggacacatcatacataagaacccgttgtcgagattccatcaatatcttgcttggcagcttcataaacttcgtcgtcctcagatcagaaggagttttgtcaaatgaaatgctggacaatctacatgagtgaaaggatgtagcattagactctttcgagcagaaggagaagacggacctttatgtatgactctggtaccggcatgataccaaattatgggctttgtgtaaatggcttcatgctggtatggggtattaccctattttactcaaaatactgtgacttgtagctcagtccaaaagcctgctgcttatggtactgctagtctgttatgtacaagtatcttaccgacgaaaaatgagagataacatgctttagtctggttcctataggccgtggtcaatgaaaacttataatcggggacagataaactggaaaaacagcaatagctatcgatactatattaaaccaaaagcaaatgaactcaaggggcacaaatgagagtgagacattgtattgtgtctatgttgcgattggacaaaaatgctcgactgtggcacaattagttcaataatgcgatgggcgaatgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaataactcagttcattcttgaatttcggcttgtagctttgctacgcaacctcgcattcgaaattagtacttacttggaaagcagggacagtagtatatggtagtcagctttgaattgttctctgtgtagaatgcctattggtttttcacgaaacagtactatatgtggtcagtacataggtatcaagaaagagggctagctctgtttgaatagttaccagccaagaaaagactactcaaaaatctgctacttcgtttccaagcaagcaaagcgccgctacttatttctttctcactcactacttttttctattttcttttgtctatcgaaacagcctaggattcaatttgatttatcctagtggtgacagcttatgcttcatttccttcgaattcttctttcgatatgcctttgttgaaggtcgttcgagcttttcctgggagtatggcatgggttacatacttcagcgccgtagcgcctggtatgagcctcgtggagaagcaatggctagtccacttgatctcaaacctcagatagcgacacaagaagacatcaaaaccatagtagcattgcgaatgataagaagaaaaaaggatgagtttgggattgcagccatgcttcgctttgatgaacgaaagaaagagtctggactcactagaactctctctctggttgcagttctctactagctttcccaaacttcactagcaaaagacttgaagaaggaagcattatgaaggggagtactcttcttctactgaagtcagatattgcactagaaatggaatagaggaggaagaggtgactgctaggtaggcagtagtagcgcatgctggaaagctagtcaagggagctttgattggttaggtcaactattcagaaacaatatcatcgattgagataaattgacctataagaatgtatgtattttttttcataaaaagatcttttaccacctaagaaggtgtgggtacttttttgccggcatacatactcccaactactttcctgaatctcattttttggtagtacgaagggggaattggcccaaaaattggataggggtaaagacgcagctggggggcggcggcttattcaagtgccgcaagctctgatagtgagacaacaaaggaaagaatcttcaggctattcgcttccctctttcagtgtagccggtccattcgagggctattggacccttctccacgaatttgttcgcgaacacgtttgtacctacgtcgggatacatgatcgctagaagagggttatacaaaagagagggacctgagtaattcctttacaggtcatcgctgagaaagcatcatgcatccacataaaccatacagtgaggccttttctttatgaaagttggctagtgaccctatgagtctgttctttcaagcatcaagttttttcttctaatttctactatttcttccaggatcaaaaatattttatttggttgagctttgtcaacagattggcagtgaaatagaaacttttctatggtgaaatattagagaataactatataaaataaaaaatatctctttgagatttcctcgctggcgctcgctcaatccgttcaccagggttcctttcctttcctttacggtcgagctacttctcgttcatcatcaagtggtttcaaaaagaattggaaaagggatgacgcaagagcagcggaaggtgacttagcaacatcagtcatttcttatagaaaggaaggaaatgatctctcttctgtctagacgaaagatctcatttttgctaccgctccccctcttatgagtctctgtcagccgttgtttagtagctttcaacgcgagttcagtcattctcttatatactgaaaagtacgaactgacttaaagcacgaacatgaaggagaattcgaaacatcttgaatcttctcagagagcttgagtgtgaaatgagtgggccggccaaagaagaccactatggaagtgaaaggggagggcaagagcagttcgaaggtcaatgaaatgggttcagttcccttgtcaaataggggccccgacccaagtgatagctctcttggcgaagaatgaatagtagggacagcaggtaaagcagttgggacggcctgtgaagctttcgcccttgcttgtcttgtcccaaagctaactctttcttttaggcatgcaggaaaagaaaggttggaaaagggggaactaagaaaagtgaaaggccaggcttgtagctaagaaatatacttaataacacgacccccttactaagtttgcctcacagttttgttatgataaatcactcgtgggtttgagatatttcataagtagtggccaactaccacacctaattggtgttatgattggttaagatgaatgagaatacaaccaaataaaggttgttaatccaccttcaatagggaaagaatgacaggatataataatattgcggagtccctaaatcgcagggaagcactaagaaacaacatgccatttgaagcactcggatgcccaaccacagctatcacaatcactcgaatccggtgaagaaaagtaccttcatagcgtaggagggagagattgttttcatttcgattttatggcctggcagaaatgcgtgtccctatctagtgacatcgttgagagggaggcagtgttcagcttctcatggggatagaaaaggagattgcgtactccttctaagacatgaactcggaaaagagattgaatggcaagtgaactaattcctgaaagtcgtcgtgattggatcaatcagacttccccacaggaaatgccaaggggcgccctttatcatcgcccatttcttccttgtctgctgctgccttaagtgcgtaaagtaggctcaacttctttggtttctaaatatcttgtagtagtcgaaggtagtccagtccgcttgttagattgaattgaatcttatataacctacgtagctaaagagaaaatcataatagtctaagtggacctctcaaaggtataaataagtatacattagtcttactggttcggtctttttctttttctttttatagcctgcttgtttggtttgctagttcctggaaagataacccttgctttgattgaaggaagtgagcggacaatactgttcctccggtccgtggttcgacctcccgtagtggtccttgcttttctttttgaaagctccgtcaaaagcaaatgcttcgctcttcttttacaagaaaggtactatctccatatttgtgttgatatatgttgatgacatcattgttgctagttcttgtgaaaaagcaacttcggcattacttcaagatttgaaagaagaatttgcccttaaggatcttggtgcgttgcactatttcttgggcatagaagttaataaagttcatgatggaattatcttgactcaagagaagtatgctactgatctgttaaaacgtgttggcatgcatggctgcaaggagatcaatacaccgttatcaacaacagataaattattgatgaaagaaggtgaacccgtgacattttgtacccaaaacaaacgcgctaccaagctgcgctacatcccttttccaaattgttgtacagtgtcattgtacaaaacccctgtcttgttttccacatcataattttatcctccatctatatacaactttcttgtcatttcttctttttggttcctggctggatccggcctgggatagtggcgcccattcctaaccagttctgaaaaggttcgctcatgctggaggtactaaccacttagtgatcggtccgctagttcacgcaaatccgaagaagttatcacggacgagccacatgcctacttctttttgttgtggaaaaaggtctttccaccgagatcctaaagtgcattcatttcctatttatagagcagcctgtaccacgtattcctccctagttttgaagcagggcgagactactttagctaggagcctcttttccttctgcccagctccccgaaaacaannnnnnnnnnnnnnnnnnnnnnnnnnnnnnnnnnnnnnnnnnnnnnnnnnnnnnnnnnnnagattttgactctgattgggccgaacagtggtagaacctggtgaaccaggcctactactaaacattgattctctctcctaaccactcttaaatatgttaaatacactccatcgatcaaaaactacaagcaagggagtcagctcttattgccgtaaaggaaaaataaccccttgattcctttcataaagatgaagggacagaggtgactaattccccatctcatttggggcggaaaacgaatcgacatctcgatgtgatacagccctttccattttcgttgggaaagaacggcgaagtccatccgaaccctccaatgaagaaataagaggagagcaaagcgccaatggcgcgcgaagcgcatgcggaaggggcacggagaaataaagaagtgtggaggagaagcagccgagctcattcccttcgcttcctgggctcaaagcagtgctttgtttcctggccaaatcaaggatttggggctgattgcaaaagatatctgaatatcaagatagatccatccatctatccagatatctaaaaaagaatcgattttgatttcataaaacctttgattcaaagaactgcgcttagcccccccactcatgaaacgcatcagcattcgcaagaaagagaaagaactcggttcaaagaatcgcttcggtctaaaacgagtcttccaagatcatgtctatgtgaagagcttgaaccaagcgttcacacgcatacgccctctgaagatcggcgagaaaaacaaatcgtattctatagaatatggtagtggtaattatataactgctttgaggaggaagagggaaattgtcaaggaaaatgccactggaggtacatgtatgcatccacttccaaattcggatgatccaacacaaaaagtatgatatttctattctctagctctcgtcatatagaaaaggtatctagctcgtccctctagcgctcgtaaaagaaatcctggcaaagggaaagccagtagagtatgccttggtttaagagagagatcccttttgattctaatccgcaatgacagtttcccttgctttgattgaattgacgaatggtaactactaccaggctttccctcgaggaactaatccactgagagtggtgcgttcccgtctgtgatatagacagagacaatcttatccttctctactctcgtaacaaaaactaattcatcgatgagtttataatagttaatacttatttagtcatgtattaataagatatcaggaccgtgctcagttttcggacgaaataaacatatcttgcttttctcattgtttgcttcttattgaatcgcctctctcaccgccatctccaaaaacttttttggcggtttgggagttggcttctgttgacgtgacaagttgatcgtggttgactatatgagttacatgtaggatccacatgtcatcctagctaatatcaccttctttggggttaggattcgaaggaaaggacggctctttgcgattaggattcgttgactcgtcgttccaacctcgaaaagtagagtgtcattactgtcgagaatgctaacttgagcgctcgcattgccggtgcacacttccggcccacatggcccagcacgcgcgcgtttcttctttttttttcgcagtttgctatcgccgtttcttctctttcttttttcgctttcttttttctgtgatttttctccttttcttttttcgattactttttaaatatttttccatgattttttcttaatcttccaacaacacgtatttttcaaatgttttgtgttgaaagcttttaaatcttaacttaaacattttaaatttggagttgaaagctttcaaatcttgagttaaaaattttcaaatcgtaagttgaaagttttgaaatttttcgaatctcgagtcgaaagttttcaaatttttcaaatctggacttagaaagatttcgaatatcgattctcaagttaaaagttttcgaatctcgagttgaaagttttcaaatctgagttgaaagttttcaaaatttgactttaaaatttgaaacttaaatcgaaagttttcaaatctaacttaaaaaattttcaatctgttagtaaaaaaatatccaaaaatatcttcagaatcttacctaattactatcattagtgttggcatgtttggtacagctccaactcctaaatttagctccaggagttgggtctgaagtggagttgtggagctgcctaaacccagctccacaactctagtttattttgtgagagagctccacccaactccactcccagttttggtggagctgagactgtttggctgagctccagctcccggaggggtggagctggagttgtagctgtgccaaacagccccgcgctagcggcgcgtacgcgctagctaagagcccccattactgtagccatccaatggatcagctcatttttacactacaaatacgaggcataacaacgatcaagtgcatgcacaccagtaaattaagtacaacacccccagtgctgtcagtcactagctagctagagcctagagctgacgacaacgcgccgcacggtccgctttaatttggctctccgcaacgatcgacacgacggtcaccagcgacgtcgcgggccggcggcctcgtcgtcgatcggcctcgaattgtgagtggaagcccaactacgtcgatctcctgaattaggtggggccgtcctcccagctctgctcctgcaacttttctatgccaaccgcgcccctcgatcgccagtcgtcagggacgcggctcgtcggcatcggcgtcgatgactacggcgtctcgcgtgcgcggcgcccgtggtcctacctaccgacttagctagttaacttggtcaacctgtcacattagcggaaaccgcctcccaaaccgttgaggccttgttcagttatgtccggattcaatccgagccgggaataacaagtatagtaaaaaatttatgtatatacaataagagaccgggatttattctgggtcaggaacaaatttacttatgatagggataataagagaccgggaatcaatccactggttaagaggtgttgaactaattcgaatgttttgttgtccctatcatgtaaattggtttccggcccggaataaattccggtctctcattgtatctattataaattttttattatacttgtcattccagtccggattaaatccgggtgtaaccgaataaggcttgaaggagttggtttccatcagttttcagagatgagggaaggaggtgttacacctaattttgcggtttgagactttgaggggatacattattttcgggagcaagacatgaggagctcaaatcagttcctttccgaacacagcacacccctccttgacatgggccggcccaaggcccagcacctgtatctggttacggtatactaagtctgcagttaagtaattaattaattatggtatgtgatacttttctcaatacgtaataatgttcactttgatgttattttcatccatactatttttagataaagttaccaaaaattttaactaccttaagtttattgccaaattttagcaagtaattatgaaatcttgccaaattttggcaaccttgccaaaattttgacaacttagctaaaatttggtaatgccaaaacttgataaggttaaaaatggtagcaaagtgaacaagcccgaaatggtgtgttaaccacttcggttaattaatttcagtactcagttcattaaattaattaaagaaaggccgaatccctagaggtggggaacgggtgggcccgcgcaaacgccacgaggaagaaagagagagaaaaggttagcaactttcacgggacaaaaaccagcagactagtcagatatacatatactcctcctcaacaaaacaaaacaaaaaacgcgagaagagagagagagaagcttttaattcgaattctctctctcatcacggcttcttctgcttctccttctcctcccccctcatccctcctccgccggtagccgccggccgggagcgagcagcgagcgagaccggagcccgccggagccggtctcgctcccccctcctcccttgttcgcgccacccccgaggtacatcccgccgatctctctctttctctctctcgttggtctgctctgtgattttttttttttttgccaaggctgttctttatttggcacagagattgttttttttttccttctttgcgggtgtccggttcgagtccacggggtttgactctgccggaaatggttcgaatgcggcggccggagggcggaggaggggttttggggggcgttcttggtgggttggtttgcgccgagtctttgttaatttgttagggttcttgatctgatgcggcttctcgttgccgggatgcgcttgcctcatggctgaattcaaacaggccggtctctctctccctccctctctcccgtcagccgtgtgctttgaccgagtaagtttttgaacttcgattggttgagctgggggttcttgactttttcttactccacgaatgttcctttttgcacaatggggctactaatgaatggaaagctagagatggtgtgcctaatggtgatgtgccgtcattgtgttagctcggatttgtactgcgaatttgcgagctcacatgctcagctgatgatgtgttgatccagggagtatatataattggttggtagagtacttgctagattgtgctcacgggtctcatttcaaagttcagtatgaaatcttggttgtaaagtagtactagtgttttgttaatcgttagggagtacttctcctgcatttttcttaattttttccctttaaaaactgtaggtggatttgttattagtaaagctgatttgtgccaaatagaaattctgttttatccgcagtaaggtactgtaaacagtacttgcaggcactagggtttattggcaaggttttctatgttacattttaataaatgccacctttttcttcgtcaaaagaagccacggttataaagaaaaagtgaagcattaattgatgtaaatgcacgaactacaaatttccacaaatataaaccttttaataaaatccacaaatgaaagaaaaatgcagttcacacaccaatctctttctcaaaatttacacttttcttataacaggtatgctaaattttcttaatacaaagcatatacaaaacatcacaagcactatagacattcatgacatatctgttgcataggacaatatgcagtatgaagacctggctggtcaaaacttccgatgcacatgtgaggccctatccatgtgctttcttgatttctgctcctttatggccctatctccttcaaagcccttaaacacttcaacagtgtccaatcatactatgagactgtatggatatgggcatatggctatacttttgatgaggcaatgattttttttgttaataatagtgttaataggaagtgttgaattggttttttaaaaggaagtatttaagcattgaatttgtcatttattttgactcactaataacacagatagttctctttcctagcaggaccccttacaatatctagtgtatttatggcctcagttacttatattgatgactccggttctgaggtaattgatcctccaaagactgaggtgctggatgttaccgaacttgctggtgatcctgttccgcattcaccaaaaccaaatgtggtagtttctagcagtgtgcgtgaactgcttgaatgtccagtctgcctgagcgcaatgtatcctcccattcatcaggtgcacatataccacttattgaatcttttttgcacttaaaaaggatattttcttgtatggaagtcacttgggaaacaaaatgcgtgtttcatttaattgcattgcttttactatcttgaatcctgctatcatatttgtagtctggcctgatctatttgaacttatctagatgatttcctggtttaaaacggtcgttctgagctgctttttcacatatgttctgttccactaccaaattgttacccatgtatttaagcaccaaaaaagaagttagctaagatagtatgtacaatatgcacattgttgtactatgttgtaagttgtaaccccaactctttttctgctaatgcagtgctctaatggtcatacattgtgctctggatgcaaaccaagggttcacaatcgctgtccaacttgtaggcatgaactgggtaatattagatgtcttgctctcgagaaggtggctgcgtcgcttgaacttccatgcaagtaccagaacttcgggtgtgtaggcatttatccttactactgcaagctgaagcatgagtcacagtgccaatataggccttatagctgtccatatgctggatctgaatgcacagttgctggtgacattccatacttggtgaatcacttgaaagatgaccacaaggttgacatgcataatggctgcaccttcaaccatcgctatgtcaagtcgaatcctcatgaagttgagaatgccacctggatgcttacggtatcccctcgttaactccaccatgttagttattgtgaagtatatcactgatgtttacttatgcaaagattggttcacttgtctgctaagatagtccatatttctgtactgagttttatgagcctttctgtaaaaataaacattggttcacttgtacagtatgattgcactctgtacttttcatgtcaactgaggatgctgatcatgcagcatagttattggtctaaaataatctctcacctatgaa

SEQ ID NO: 45695 - DNA, 1778 bp, Oryza sativa
  unsure (1)..(1778): unsure at all n locations
cctgtgtacatcgccttcctgaggttcatgggtgatgacttggaagcaaagaactacagctacagcctggaggtaggaggcactggccgcaaaatgatcgggcaaggggttccccggagcatcagagacagccatcggaaggtccgggatagctatgatgggcttatcatccaacggaacatggccttgttcttctctggtggagaaaggaaggagctcaaattgcgggtcactgggagaatttggaaggaacagtgaaaataaaatgtgaaatgatctgttcatcgttcttaacccttgcatgaacctatgtatcatcacagtgcgagaattatagccattcataggcagtgactctaaaatgaagacttgtaatgttattagcttgttttagctaccatcttctgttagattggtgcctgtggatgactagatgacagtcatgtagaccagagtggcactattgtagaattcctggcaaacttctctttgccttgaactgcttgttgagttgccattctgtggtatagggaaatctaatggcaattcatgagatgaatgtgttgaactctttttcatgtttccagcatatttctagcttctttgttcattctttcagcatatctctagcttgtttgttcattctttcagcatatttctagctatgttaaggcatgatctgaaagttcttaagaatcggatatgctgtaacaaatcatggtgaaatgtcatgtagcatgtaccatttccttttatcttaaatgctgcttttgaattggagggtgaataccagaatgattttgtaagctttttccgaataaagtttcaacttggtgtgcaagattaaatcggggttgagcacccagagtaaatattagtagaagataaaatgaagtgctgattttttttcttaaagaaaaaacaagagttgaagcgctagaatcaataatttgatctgcatcatgtccggagtagtactgtttgtacgctataggagcaataatgttgtgcccgtacgttactgccttcccttcaattgtctgcacctctgcacccgtcgtactactgtgtcgtggacgtggcaccttatctgaaggatttcacaaaatttgctcatggaagtaagggttaagggagtagtttgctttgatgcccagatcaactctaccaaaatttggtattgttaactcaataagtgtttttgatttttttttctttgccccatttttgcaagaggaagtttctagaataaccaaattttgttaatagaggctgttttgggcaatatttggattggctttggtagagtttgttttagcaacaaaccaaaacaaacgctaaaatcacacaagtgacgccaatttgggctcacatgcatcatcgtgattcatatgtcagcgttgcaatagcctgctaattacagtcgtgaatcatgtacatcatatttgatgagagaaacaataagtatggttcattgtacactaatttcgttaggtttaaatcctattaggttttgtacacactagaaatcggatagacacatgtacaatctctactgttctagttatcttgaatgatacctcatctatgccttcgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45696 - DNA, 726 bp, Oryza sativa
cctgtaagctatcatcaacaccttttgtcgtggatgcgcaagcaatagagtagaaatacccagttactgctgcaacaacatattttcctgcaatatctggtcgaccacgcaaagtatagcgggacatgacttcagtgttgaacaaggcccataagtgccatgccttgccccagtccttggcattaagtgtggcatttttgtaagagaccaatatttctggataaagaaaaaaagtatatttacatcaaaacgggcaggcagacaaaaagtaaaataactattttttcaagtctcaatactttggtaggcaatcttgcccacccacccctcaagagggaaataaactgaagttattcagaccttgaatagaatcatcgtctaacccaggtgataatgctctcttccagctagcaagtgtcaaatagacgcgagcaataagtggtactccagcatttgatgtggcaacctggcttgctaatgttccagaataactatttgttgcggtagcaagctgcacagacaaatcctataccacaaaaccaaaaaggaagtataaaaaaccacttaaatgcagaataattctgcaacttggggtcaaagacgaaggacaataacaagctcacctgtagcctgcaaaacgcgtcccttcgtttaagctcatctccaacagcatactggtacttcagggatgccatgactacttgaggatgtccatgatacagcgtc

SEQ ID NO: 45697 - DNA, 1403 bp, Oryza sativa
  unsure (1)..(1403): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggtaatactttcgcatccattgattctcctgtataagctctcatccactatactgcctttgccaaaggcaaataaaccacctcggacgtcagggtgtcctgtagcatttcatattgttttgttgccacggcatataggcctaaaatgctgtccctgatcaagcacagcagtgccactgagaatggattcatctgtgttcactttaaaaagaccagctgctggtggggtcacaactcaccgcttgctttcctgatgcaaatttttcagccttctgttggtcgtgagttgtttgctgcgggctttgcaagttgctgggcccaaatgaatgaaacatcccaggagcaacttgtgagaagtctcaagactgcattctcatctcagaacatacctccagaaattcttgccacactgctgaacttggtaaattactaaatttaccattagattttttaatcatttttacactttgtcatcttgcttctaatcggtcctttgcgtaagtaggcagagtttatggaacatgatgagaagccgcttccaattgatacaagactgctcggtgcacttgctgaaaaggttagttttactttatgcatcttcggcaaattttcgtgttcccatgtaatctctgtttctgttgaaacctttgaacttttttcagtgtcgagcatttgcaaaagcactgcattataaagaaatggagtttgaagctgtatgttccaagaagatgggtgcaaatcctgttactgttgttgaatctcttattcatattaacaaccaattacaccagcatgaggttggtttctatgtcatacaaagctaagaagagttatgtgtcgtggcttgttaatcctcttgttatttatgcaggcagctattgggatattgacttactcacaacaacatttagaagttcaattgaaggagtcctggtacagttgccacgaacctatgatcccctgctctatattttgttggattaaatacattctttttacattttgtaaaactatcaaacacttttgaaaaatttaactgtaatgatatatgtaaattttgtggaaacatggatcactctagacttcatctaagatcttgcttcaatgcttgctttaattttgtgcaatcaggtacgaaaaattgcaca

SEQ ID NO: 45698 - DNA, 1586 bp, Oryza sativa
cccttatattatgggacggagggagttgtcattttcggctttctttttgcatatgcagtgaaagtagctaaatgagatgcattcttctgtcaggtcgaatgaggtgtctagcagccttggcccgttgggaagatttaagtgcattatgcagggagcaatggactggctcagaaccatctgcccgactagaaatggctccgatggttgtggatatatcttgttatcaatttactgtgtatctttaacttgtagttctgctaatttaagttctaatttccttttcttttttttttctaggctgccaatgctgcttggcatatgggtgagtgggcccacagggctgaaatgtttctcgtctggatgatggggatgaaaacaagctccggatattgggtacacaacagctagtggtacggaaccagcaatggtgcttctttagggctgttctttcagttcgttgcaaaaaggtatgcttgcatatttgttgatttctttttccatttcttcttgaaaatttggtcatgcttttggttacttggcatttgttttgcagtatgaagaagctcgtgtatatgttgagagagctcggcggtgtttggctacagaacttgcagcattggtataacattatagtcaaatatattctttacataatctccattattcgaattttcatattatggagacatttgtttttgttcatgtttagggatttgccattggtttttgggtattgtggggtggggccctaaatactagtagctcttactgtcataggcagtgggctgagttgtccaggccctaggggtagggatctgttctagaaggaaatttcggtgatcttttctgagacctagaacaaatatttggaaaacagacataatagtattcacgggtcaggtgctggttgagaatgctgtagaatggacattgaattgttagctgataggatgtaaaggctaaaaagatgaacttctgatttttaacagactgtatagatcgtttcgatggttggatgaatcatacaaccactgatcaaggggataaatggtgacaaagtaaatttgaatgtgaagcaattaggtgtaaaccttggaactcaatatttataagataatataacagttgaaatatctctcatgtgactggtttgaataaattggttaagtaattttctttagttctttttttacttagaaagcaaaggtgaatgtttatagtactgatgactaatatcccctcttagagttcagtaattgtaacagaacatccttgttttccctttcgtgatcctattcttgtgaccaggtacttgagagttatgagcgtgcttataataatatggtgcgggttcaacagctttctgagctggaagaggtatatcctcatttcggttactttctaaagaaacttattgtcttgctaaccaaatatatgacctggacttcaggtgattgattactgcactcttccaatggaaagtaccaatagctgacagccggagggaacttatccgtaatatgtggaatgagcgtattaaaggaacaaaacggaatgttgaggtcatattatgcttcttttaactg

SEQ ID NO: 45699 - DNA, 745 bp, Oryza sativa
aaatttggtttatcaacattttgggaataaatggtttacatttgctatctgcgtcgacattttaactatttgtactagccttcatattgttttttgatatgttattactggaaccatgtgaaataaatctgtgaaacttgaggcctatgaagtcaacaagacaatttaatctgatttcaaaattatttaagttatgattgggccatcgatagtaaaaaagatagtttgatttttcagtgctattagcctttgtagtcatattttccttttgttataaggacatattttgaaataaaaaaaatggatctttgcttccagatgcaccacttgtgacaattgagtattttgttcctcaattgattgttataacatctaaacaaagaccaagaaaactgacaattcatggaagtgatggcaacgattatgcattcttgctgaaaggccatgaagatttacggcaggatgagcgtgtaatgcaggtttgtatatatatgacaatcttttcttgatctgattctgtgagttcttttgatcaccatagaacctggaatgatgagcatatttttgtattctgtacccatcaattgctttgaactccattctcctatgtggagggggcagctctttcgtttttcagtacccttgtgctgctttaccatatgaatagtaatgtttacgaatcgtcattttctttatctttgattatacacaattaaggaagactagtaatcaggacttgatcaat

SEQ ID NO: 45700 - DNA, 1910 bp, Oryza sativa
acttgagtatgctggttgtaagaacaagtctgaactgacccattttggataaacgtttctagaaccgttgccgagaaacctttgtttgcatctggttctgtcaggctttccaaacccttatcacatgaactcttcctcaacaactgcattactaaatgcagttttatgcttcatctgctgtacctacctccttacatatttggtgacatgttattatcaaacattcattaacttgtattattttttcaggcatttgtgcatgacccattaatcaattggcgtctgttcaatttcaatgaagtccctcaagttacaaactatggaaatgctcacagtcacacagttgtcaatagcgaagaagctgctaatcgggagctcatgcaaccaccccggggagctcgggagagagaactgctacaggtctgccttctctttctcaaccttgactgttcagctagtcattatagtattaacgacgtaccgaaatattaagcgttttttatgctcatgcaggcggtcaatcaactcggtgatgctaacgaggttttgaatgagcgtgccgtagctgtgatggcacgaatgagtcataagctcacagggcgcgatttctcttccggatcatcgttgtcgggggcgggaagctccacccaacatggtaacgagcatctggcttcaggagacactcgagaggtggaacctggtttatccgtgaaggttcaggttcagaggcttatacttcaagcgacttcgcatgaaaacttgtgccaaaactacgtcgggtatggttccgcaatttatttaccacgccccatgtttgtcgtactgccagaaaaaaaaatagttgaccactgattttgtcaagttactcacagtttgcttgtttctgctatgttccacaggtggtgcccgttttggtgagccttccgtaagcagtgccatgtacatattgtaaataacgtgtacatatagatagatatcttgtaaagagtgttgtatttgggcagtgtacatgtaccagaatttcatttgttaatgaaagccgtcattggcatcttcgtgttattggaattgccaattttttttggtgggttgcatgaggtcaaagctaagcaagagttccacactaatggccgctcggcacacctatgatttttatcgtgggtgtgcccactgcccacacaattctaaaacctaaaccaaaaatcttaagcgaaaaatacaattaagccttgatttataaaaaataatatgccttgtttttttaaaaaccctaactgatttctttcatttgtgtattctttctggctcaaaagaccacatattcgatggctactcaacaaggcagtgcatacacaaccatcaaatctttcagtttaattttgtacaggtctcggtatatataggttttagggtgtagtgttaccttcttaacttctcagtcgaagtgaaaggaactgttgattcgttgaagcctcagagtattagtataatactcgctccgtccaagaatataagaatttttagagttggatatggttattaagaaagtaggtagaagtgagtagtggagggttgtgattagttgggaggagaatataggtggagaagtagttatattttgggacaaatcctaacggctagaaattgttatattttgacacggagggagtagcagactattgattcgttgaagcctggacggtcagagtattagtataatagcatgatacaagccagttataaacacatatggatgagaggatcgagtattagtataatagcaggatacaagtcagctataaacacatatggatgagataagaaaagagagagaaagaaagcgggttatagattcgtagccacttgcaggactccaaaataatatgtttatatgagaggtgggaccatgt

SEQ ID NO: 45701 - DNA, 13668 bp, Oryza sativa
accgggactaccaatccgggactaaagatcgctatctttggtacaccaaccgggacgaaagatcgatctttagtcccggttggggttactaaccgggactaaagatggctcagccgtcccggttggtattaacaaccaggactaaagatcgagctgaccttttttttttttgcatggccctgttgccgcatggtttatatatatatatatataaaccatgcatatatatgtttcagtacatatatgcatatatatatatatatatattatattatatttatatatgtttcaatacatatgtacatgcataatatatatgtatttatacatatatatgttatgcaaatgcatatgtatatatatatatatatatatatgaccaaaatatatttacattatagaaaatgtgtacacatgcatatagaaacatatgtagtcatgtattaattacaatccattatatgtcctagctagctacgatttcgacgtagtagtagtcgctagctcagaagctaaggacctatgaattgtatttccgtcgtagtagaattcacccttgggatcaaggatttgttcgttgatgaatcccatgagttgttcttgaaccgccgcgataaattccttgtgcgtggtcaggttatccctcatgcgaataaactatatgaatgtatgaaattgattagtaattaaacaagaaatcaacacgtaatgaaattttgaatttatttgtacgtacattgagctctcttatggtgatgatttggtctgcaaggcagtggcaatactcgcacacgtaatagccgcacaagttagttcccttcttttgctttgcgcactacaaataaatgacaaacaacgagagatctaattaatatacacttgtatgtatttgaatcggagaaatataaatgtagagcatgtgtactcacaggaaatttgaaattccgcctaagtctttctctccatttgccgcggaccaaatgatggaaccgataccaagccttacatggagtttaaagatatgattcgtagtagcaattaacataacaagattttcttaattaacagagaaacttatgacggtacctgtctataagttcgaaaaccttgtcaaacgtagactattttttatccattaagtcatatacgttgacggtccaggccgacaggtcgaagagtaaaagcacccagtggaatctgcaatgtgcgtgggatgcattacatatgaaacacttagcaagttcgtacgggaatgaaatttggtataggaagacaataaaattaaactaactctgtgttgtacggcaacagtatgaacgtcttgtaatgctgtgccttcaggagatggacgagattgtcctctgtggcttgcggatattggtcgagcattgtgacgtttactttatgagggtcgatgaatccaatatcgaaaaccccccgccatcgggccctttgaatctccattctacaacgataaaagggagtatattattttctatagtctacttatatacaaggacctaattaattaaaggagacgtagtaagaaatctaactgaacgatatacttacaaaatccagcaactcataatagagacgtcgagggcgtccagctggtatagttcgtagattcccttgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccgggatcagtaataaattcttctatcgtcatttctttaccggtcaccaacggctcgatctcctggtttggttgctctccaagctgagggactgatttggactttccagaagatgctttcttcagcgttcgctcatagtccgatagcttaatggcctccttggcaggtgcagacatacccctgaagaagttcatgacactcgggtctatatgaatcttcttttctggacttcgaggcttgaattgtctcttgacttctgatgccacgtaagcgtcaagctcctcttgcgtgcaatcgtaccccgggtccttgttcttggcggtgtcaactttcgccttcttcgttgcccttgtgtgggcaggcagtggagcttggggggtccttgactttgaaggtgccagaagaggagcttgcggaggagtcggtgtaggagaccaaggaggagtcgatgcaggagcctgaggaggagtcggtgcaagagcctgaggtggagacggtgctggagcatgagaaggagtcggtgcaggagcctgaggtggagacggtgctggagcatgaggaggagacggtgcaggatcctgaggaggagatggcagagccggaggagatggtgcacgagacgccgcttgtcgcccagggaggatgatgtaccgccgccatagaataatggcatggcttgtgtctcgtagatgcgtctcaccttctcctccagggtaatccagctcgagatcctcgtacgcgccttcgaccaactcaacttcgaccttggaatatcctgctggaatcggcctgcagtggtaagtacctgaagggtccgttgggatggccatgcccgacgccaccttcatgtggtgagaggttatttattagtaatcaacatatataagcagcaactagcggaatggtcaaatctaaaatatataaactacgagcttacctttattgataagttcttgaaaggaatatgcagctcacatggtgtccgctgagtgatgtcatcaatggggcaggtggattcgtcctgggtttgcatggcgtccatgctcttcttcgttagctgcccgtcaacttctcctggatcgtctcgtcaaatcttgtatcgtagtactttgcaaacagggcatgcttctaggttctcatactcctcaccgcgatataggatacaatcattcggacatgcgtgaatcttctgaacttccagtcctagcgggcagacaatcttcttagcctcgtacattgtctcgggcaatttgtttccctccggaagaatgttcttgacgagtttcaataaatcgccaaatgccttgtcactaaccccattttttgccttccattgcaagaactccagagtggtatccaactttttgtgcccctgctcgcaacttgggtacaacgaagttctgtggtcctctaacatcttgtccaatttataggctcccttttcactttcgcagttctccttggcgtcctgcaacatctgaccaagatcatccgtaacgtcgttaccatcagcatccatttcctcctcgcctgtttgatttcctttaaatccaacgtactgagcaaagtccgaaatattgtcgtcttccacttcatcttcttccatttcaacaccttgctctccatgggatgtccaacaattatagcttggcatgaaccccgactcaaacaagtggaaatgaatagtcctggttgtagaatactccttctgattcttacacttattgcatggacaacaaataaaacccctttgcctgttagcttcggccactctcaaaaaatagtgcacgctgtcaataaactcttgggaccgccggttagcgtacatccattgccgatccatctacatgagtcaaaaaaaaatcgtacaaaaataattattcttacaataatgacagtcatacaataattataagataattacaaactgtttcaacagtcatacaataatgacatatctttattcatataaaaatcataaaatattacaccaaataattcttatttactatttctaaagttttaaactaattttaatatgttttacttcttttaattttcattttagtttgttttctagtattcaagattaactttcactatagttttccttctcaactattttataaaaccttctttagcaaatcaactaaatttctatatattctttcttccccacacaaattttctccctcatcaacttacaactaaattttggagacaaaaaagtgtgcaaaacatagctgcaaatgtaatatgacaaaaaaaaacattggaggatgaagttgcaaaccttttaggaacctccgatttgtatgtaatcaccaaaataaattcactagaaattttggcatgacctcccctcttttttgaagaaattttgaagcttgctcgggcagctggaggaggaagaagacatatatatataggggtgggactttagtcccggttggtgttagatcccgggggactaaagatcaaatatgcccgttaccttttttaaccgggactaaagatcatctttagccccgatttttattgcatccgggactattgtggaattcggccgaccgacgaaagatgagtttctccaccagtgtatgagccaccagccggtagtagctaacaccttctacctcttgcggcagctcgtctcctagccgcggggccgcaccggcgccgcctcccttctggcgccccttcgtgtttgccacgagaagtgagccagccagccaccgtgaacagaacgatgccctgcttgttgtccgcacgaaaaaaaccttaaatctataaagatattagtttttggtgaggtacaaccactgcatcgctcctctcgccacgcaatcacggtactgttgccctgttcatgtgcttgctcgccgttcgatgaacatagctatgagtgtttctagccgtccaacgtacggatggagacatcgcttctggtcgcgtattaggttccagtcagccatcaggtctcttccctgtttatcgtactagtgttgctttcctgttaatctcgcgacacatgtatgtgagcggtcgtgcaagcatgcagaaggaggaacggcgatttcctgggacgacgctctgcaactaggcatgagaagtttcgatcaaagttctataatctgttcacctgcaattgctactcattttgtggcaaactgcttgaatcggcttgcctacaatggctccgtgaagtggaatgtgttgaatgtggctgctcttgtttggttgcatggccaatgggtggataaaatgcctgttgttcgttcattctttccttttctaactgtgacacgcgttggcatcttaatggctggctggctttcctaatagggatggcagccttctcttctctcttgattggatggtttgtatttgctgtatactgcatgaaggatatagtgtgctgactgttttaaagaacatttgcactaaatcctgtgatgaattatggaacgaaccaagaactcactgaaatgattcattctcatgattatcatggaataaatcacaccttgtattgaacttggaagaaaacacatgttacctacgccacaaatgcgctacatgttatgatgtcctctgtttttttttgtgatcctagatctaagttggtggcatcctgcaaacggtggattccttgttcttattagagtttttatttatccattgccatcgccgttctgttaatctgtcgatcgtacgcaaaacgatggcggttgctcactacaagaaaaatactctgtatagacatttttctagtactgtagaggcacttatcaaatacctttacaacaatgtagaggcattttaaaaaatgtctaataagtgtcttatggtgaattgtctctacagacgaagagacattttataaaatgtctataagatggtagaggcattttttagagacactaaattgtaccgcaaacatataaaaccagtccaaaaaagagaataaaatagtttccttgcttttgataagtcttgaactcatgatcttttggttaaatcattctaatctttgatacactaaccaactcaactccatgtcattacttgtatacttgttcctttagttacttatatttaatcctttagtacacattatcattctaaaaagtgtctctacatagtttaaaatgtctcaacaaaatgcctttatatattagacgcattttatagtgccgaaagaatgcctctacgagataaaatctaacaaaatgatataaaaatgtctctagagtaaaagttttctaggcaatttttaaagtgcctctataaagtgtctctacactataaaacttctgattttagaagcaatttataaaatgcctctacaaaagtgcctctatacgaggtttttgttgtagtggctgcaccatgttcacaaattcacgaccacatggcgcggtgaaaatcaccggccagccatcgtgagagttcgtaaggtgacacggttgctttacgactttgtcacgagtgtgtggatcgcccagcaaataatgagctagaccaatcataaagccaataactcctcctgctcccacctaacctaacgcgacacaagaaaaaagcacgcaacgggagggagacatgcggatacgataccggaccggctgccatgccaactcctttgcctttgcgagcaacaataatctcgctgaatttggaagaagccggcccactcccgcgaaaaaagaaaaaaaaaacagagcaatgaaagcaagaggagccgatcacggccctgaagtctgaatcgaactcgcgacgaccggcggggcaaagtccaaaatccacacgagcgcgaacccgcatcccgttcggccacgtctccctcccgcgaaatctgggccgtctgctttgtcacttctcccaccctttatcgtcataattaatatttgtgatgaataaattgactttgcaaataatttaattaatgaattggtttaaagatgtgtggatgttggtgtgagtgtgtgtgactaattggggtcatgttgtgatatctgtgctcaggaacggttgtcttgtctgattgtgtgcaggtgacttgaggtcaaccttggtcaatggtgaggaccataactatgcttagggaggaccagaggtttagtgcagtcaggataccatgtgagaaggtgactagagtcaagattcttgtatgtcaacttcggtcaacaatggggatcgggactacactcagggaggagttgaggtccagatagttaaggataccagatgacgaagttgaatactagatggcacatggtggatggaccccgtgtggaagagatcttcacaacgggcttcacgatgtgtgtgcagcgtcggtgtttacaaagaaaattggaagaagaattagagactatggttgctacagtagtatgcagtatgcacgtatgtgttgcacatgtgtactgcatgtggttgtcgacatggtccaggaagcatatgcatgtatgtgtggtgcatggcatccacatgtgtgttgatctgcggaaaggctagttagcgcgcgccggcggcacgcgccctccttcacgctcttttttttttcttttttttttttactttttttcctcactttttttctaatttttttttatctttttagcatgttttgagtttgaaagtttttaaattttgagttgaaaattttcaaatctggatttaaaagttttcgaatctcgatttgaaaattttcaaacttttcaaatctggatttgaaagttttcgaatctcgatttgaaatcgaatctcgagttaaaagttttcaaatctcgagttgaaagttttcaaatctcaaattgaaagtttttaaattttttcaaatctggacttgaaagtttttgaatctcgattctcgagttgaaagttttcaaatctcaagtagaaagttttcaaatttggatttgaaagttttcgaatctcgagttgaaagttttcaaatcttaaattgaaagttttcaatttttttcaaatctggacttgaaagtttttgaatctcgattctcgagtttgaaagtttttaaatctgagttgaaagttttcaaatctcaagttgaaagttttcaaatcttagttgaaagtttttaaaatttgactttaaaatttaaaacttaaatcgaaaattttcaaatctaacttcaaaaattttcaatatgttggtaaaaagatctcccaaaaaaatctccagaatattttcttaattactaccattagtgttaagtatattaactaatatacgtaattaagactaaaagggaggaagtgctcgccaggtccttttcccggcgcgcacgcgcgcgctagcactccccgttgatctgattggttggtttggcacccaagctggtctacacgggtagatggggctcgttggttggctgcatgccgagtgggctggcccaggaagcagcagcgggcggtgaaggcctacgcgcgaggagatcgagtcccacttggtgtgattatctgtagccggggcggctgcaggttttggaaattgtattttgctttggaaatcgagggatgagtcctattggaaatacgagctctacttctactctgagtaggagttttttaagtataaatagatgagaggttgaggctagaagcatatcagctttttgggagagaaaagttagggtttgctttgagctttaattctagttcaagagtttgatcctagtaggtttgtttggtcttgttcgatcctacattatcatcaccttccgtggcttccgccctccccgccttgctcgcctaatccgaagcccaaactctcctcgtccgaagcccaaactctcctcgtccgaagcccaaactctcctcgctcgaaaacttgccgcctcatcacgccggagagcatcatcaccgcatctcccaccgcagcagccatgaacgggatcggtgagcactcgcctctcccctatttcactttttgtcgcgctctggctgttttttttgggtgtttccgtgattggggtttatggcttactgtttgcggcggcgggtttcttatgcagagctctcatcaggggacaaggctaaactcgtggagacgctcaaggtataacctcttcctctcttgctgtgatgatcacttcaattggagcgatcgtgcaatgatgttttgttgattcggtgatgtgcttgtgcagaacaagctgcaggcattggcggagcaacatgttgacatgctcgagagcctggcgcccgcggtcaggaagcgcgtcgatgtgctcatggagattcaggtaaagacaaaactgctaagactagagagagcttcgatttgtggcatattttcgttcatcctactgtttattatgcaaacccattgtggcatacatagtgacaatatcgtcaatgaaacgagtttttgcatggtttaattccctctattccagaggctttcttatacatattttagtattgttatgttcgtgaggataaaacggttggattagatattttatcctttattatctgtagttgcttctatactcttaagaaattacaaattatgctctcgtatgccagcgatatccattgatttcgtaaatagatttttttaccttagccttttaatgttatttagttgattgtgtatatttactacaaactttattccacatatttaaaagtttctaaaacatgttaaatgtttcagagccaacatgatgaactagaagcgaagttcttcgagtaaaaagctgctctagaagctaaatatcagtagctttatggaccattgttctcaaaggtaacacatactttttgttgcaatgtaacacaatctggccttacctcacttatctttcctttcaaaaagagttgcatgttttgtgtacatgcaactcttctctaagaaacatatcttgaattatattcctgagttttcaatatgatgtgttgttctggtgaccttttttgtgcttgcaaatttccagcgttctaaaattgtgagtggtgttcttgaagtagagggcgagaccgaagaaagaggtgatatatcattcttgttcatacaataggtgttctgggcatgtctggggttattgatagattgggtacccttttagttttttctataatcttgtcacgatgctttcatgcagaggaaaagggtgttccagatttctggctcaatgcaatgaagaagaatgagattcttgctgaggaggtgagaggcttttctagtttgtaaatttccactttccaaagttatcaatgtttatgctgtcattagaacttgagcttatttatttgttaagtgtgccgatttgcttagtgccgatgatttttgtaatgaatatttttttccttttccactgccatagatccatgagagcgatgagtaagctctgaagtaccttaaggacatcaaatggtgcggaattgatgatccaaagggttttaagtttgaattcttcttcgatacaaatcccttcttaaaaaatcaagtgctgactaaaacataccacatgatcgatgaagatgataacccatcctagagaaagcaattgggtatatatcattttgttcctgcaaatttgtgtttttgttaggatgaaaaaaaatctctcttgcatttcctatttgaaatattccttgactgctttattttttaggactgaaattgaatggcatctaggatattgtttgacacaacaggtgctaacaaaggagagttcagagagcactaaacctataacaaagactgaagaatgtgagagcttctttaacttcttcagcccccctcaagttccagatgatgacgcaaaaaatgacgaatataccgtaagttgaacaagtatttattctatatacattgattcctgaaacattatgcctaaacttatgtcctttttggttgctgcttcttaactggctgaagaattgcataaccaaatggaacgagattatgacatcgcgtaagctattatgctccatttcattcttaaccaattagaattggttttttatttttggaaaggagaagcgattaatattgtgttattatgcatgatgtatactgaaatacacaattctttaaattatttatgaacagcatacttcctgcatatattatctacttataaattagcttgcccatgttgccagatctactcttagggacaagattataccacacgctgtttcttggttcactagagaggctgttcaagacgaggattatggggcttcttgggtggatgatgaagaagaggatgacgacgatgatgaatatagtgatgaagaagcataaggcattcaagtgtcgtttgttctactggggtattagaaatttagatgcttttatctccattgttattcctctattttgaacggaaggctagcagagttgatggacagcagcatgagcgacctgcggagtgcaagcagcagcagtttttcttttcctttttttatcttagttctccgaagtcagatggagtgaaggatatgtaactactaaaagttgatttttcaacttttctatgtgcttttttttattttctcccattgttgccatatactagaagtacaagcgcaacgcgacgccgtgcatgctaacatctacattgggttagtaagaggcatatcaaaagcaacaacatcaaatcaacgccaagatgaaggaatcctgaaaaagaagtcccaaattttcatgcttcaccaatcacacacaacaacacaaacacagggaggcaccttacccaccggaagtccaccatgccggcgacgcctccttcctcgagcagctccactcctcctatgtcgtgccctgtcccgctaccttagttgctatatggccacaaccttgtgcagcatccagcctcagttccggccgccagcaacggagcagcgccgctgcaagcttcagcgtggcaacggcagccaatgtcactgccaactccggtggtttcctcatctggctggcactctaccttgtaccctctccccgctccattcccaaaggcggccggtggggagaaaggagcagcgtggctacattcactatgaaaggctttgagcaataaacaggattaaccgaattcggtcttgccttttcctaataacaattcattccttgagttttgactaaccaaattttgattgaatgcgcacccgtagacaggaatcaattatatagccaatttatttactatggcactgtaactaaacactttctctgaaagtttcctgcatgcttggaaccaagaatatatatatatatatatatatatatatatatatatatatatatatatatatatatatatatatatatagctgttagagaaacattgatcccaattgttgtaagtagaagtacatcactgaaacacatgttcaacagaacaatttccaagacaagctcatccctgaatcaaaacttacaatgacactcatggtaaaacgagcctgatacaatcacataaaacaaaatcaattgcgcaggataaacattgaaacaggtatgaacatgaactacgagaatcaatcaaaacattgaagataaaatattttcttccttcataacataatttgtgcaattgtcaagaatcaagcaatcgtatcacaagataattcagatattcctcaaatatgattcttaatgagcttacaaagttacaacttacaaatcaacaataatgaatggagtaaccatcacctcggttttgtcgataggcaatataattggccaggtgtagaagtcatgctgccttctcttgatcaaatcctgaaaaaagttgttcccttgcatcagaaagcaacttttctgcaaacccccgtgatttctctagcccaagtaattttgggtatatcgtcttgtcactcgccaagtccttccccgctgtcttgccaagctcgtcagaagacatggtcacatcaagtatatcatcaacaatcctatcgacatcgcatacatgcgcaaacgttcaatctgctcataagagcgacctcccaagattgccccaataaccattgatgcctcaagaatttgatgcctattcttttttctaattaaaatgtttctaatccaaccaacacactgtcatttcttcagtaaaattgtgcttaagcagctgtgagctttgagtctaaatgatatctcgagttaaatcttgttacttattttcaagtattataccacaagagggagaggcaaaagcctcacctcatggtcgcaatcgaccatctactgcctgttgccaggacgcgagctgcacgatccctgcaaaaaaaaaacttggaatagagcggtcgatgagtcaaagggggagttctttggtttgggggaaattttggaatagacctggttgttgatggagctgacggcatcgtggtccctccaagcgaagtcgtcggtggggaggacgacccgccgagctcctacaggaaggcgcggcacaacgtggactgcggaagggccaagcagacagtcagtacgcgtgctcgtcggcgtccctgtaggacttgcacgaagctggcgaggtggtgctccatgttcagctcaagctcgttgtcgccgctgccgaccacccgccggatcagcggctcctcctcctggttggacactccacgcactgccggagacaccggaactcaccctccaccgcagaaggcttgatccggtggggggagggcgaacgaagcggaggcaggatccgcgacgaggagggcagccaccggtggtgtgacgatacggtggccgggcgggaggaggtggggaatgggaagcgattgggggtaggtgtggttgtttttcaa

SEQ ID NO: 45702 - DNA, 1453 bp, Oryza sativa
gcacagcgcaaatcccccccaccccgcgcaaggtttcgagaggtctcgtcggagatggaggcgttcggcgggttcttcgtggacgagaagccggcgcgggtggagaacatcttcctcgagttcctcaggcggtaaggccggagccgtctccttccattccatttctagggtttaagcggggttccggttcgtctgacgcgtgaggtgggggattattttattttatttttgttgaaacttggatctgtaggttcaaggaggcggatgcggcggaggcgttctacgagacggagctggaggcgatgcggtcgcgggagtccaccaccatgtacgtcgacttcgcccacgtcatgcgattcaacgacgtcctccagaaggccatctccgaggagtatctcaggtgagatttgatttgatttgaaattttttttttggtggggagttcagattgggaaattttgggatctgtccctggatttgctcggatttgttcagagaactcggttgatgtgtacttagcacaaatagaatttttttcctagaaaaaatacaaattaatttgctcatctgtgacgacaatttggaactgactgcttatgtggatttcattgcatcaggttcgagccgtacctccggaatgcgtgcaagaggtttgtgatggagcagaggactggcgagaaccgtgcaccaatcatctctgatgatagccctaacaaggacattaacattgccttctacaacataccaatgctgaagaggtccgcacttgctcctccaggtgtaacagtttttttttccctgtaaaattaactctggaaataacagttatctgacggcaaatgaacgaattctgcaaatgtcctgaaattcactacaaaagtgtgatatatacatatattcaagggtggggctcattgcccctggaatttcatgttagtacgtttcccacatttggtagaaaattatgtctcactttttatcttgcatttctaatttgtcataggttttatgctaaattgtatgatggttgccataacaattgacttaaattgttgttgtaataggttgagggagcttggaacagcagagattggtaagctcacggctgtaatgggggtggttacacggacaagtgaggtccggcctgagttactgcaaggcaccttcaagtgccttgactgtggaaatgttgtaaagaatgttgagcagcagttcaagtatactgaggttgtaactgtgaaccttatgttctacttttttctctcatgcaatgtgtctaatgaaaggtttctgctccttaacttcagccaataatatgtgtcaatgcaacatgccaaaatcgatcaaaatgggcccttctccgacaagagagcaagttcacagattggcagcgggtcaggatgcaggagacatcaaaagaaatacctgctggttcactaccacgctccctgga

SEQ ID NO: 45703 - DNA, 7925 bp, Oryza sativa
  unsure (1)..(7925): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattaaagttacctaccacataatcatccgatgctaggtgttcggatggatttgtgttgcttcgttattagattctaggtctacgcttcggtgcaaattgttgaaaattcaggcatgtcctctaagagtttgaccacaaacttttctaaaacatcaacatgtatcttttgtgttacagaaaacattcaaacctttatcatcagagggtgcgtgtacaagtacaacttaattacaaaaaaaacattcaaacctttattcagagtagtagaagcagaagccggcattaaagagggagaccataaattggtctgcaatttgcaaagtccttttcaaatagctgaaccttttttatttttaatattgccaaattgatgaatgttgacaaacctggtttgatttggagggaattttcacatatttatatagtagaaatttaaaagttcctggatgtccaattgccaatccccaaaccaaacagaggccgtgtttagtttctcctccaaaaatttttttgacgtatacgaacacacatttgaagtattaaacgtagactaataacaaaacaaattacagattccgcctgtaaactgcgagacgaatttattaagcctaattaatccgttattagcaaatatttactgtagcaccatattatcaaatcatggtgtaattaggctcaaaagattcgtctcgcaatttacatgtaaactgtgcaattaattttttttcgtccacatttaatgttccatgcatgtgttcaaacattttatgtgccggattttttcggaagtttgaagaaaactaaacacagtcagaacctgaaaagtacaattgctgaatgttctcaaatacctgaagaaaaaaaattcctcctttttctataaagcaaaagcttcacagagtccaggggcgcacctacagcaccaagtgtaaccagagcttacacaaaaaaaaggcaccacctttgctcggtgctcgtgggggagagagagagagagagacagatggcgacgcggatggctgcggcggtggcggccatggtggcggctgtggcgatctcgctggcggcgggcggggcggcgcagtcgtcgccgagcacgccgagctgcgcgtcgaagctggtgccgtgcgcgcagtacatgaacgggacggacacgccgccggcggcgtgctgcgacccgctcaaggaggcggtgaagaacgagctcaagtgcctctgcgacctctacgcctcgccggagatcttcaaggccttcaacatcaacatctccgacgccctccgcctctccacgcggtgcggcatcagccagaccaccagcatgtgccccggtaaccaacttattttaccctcctcctcctccttctatcccttgttcttttaacagcaaaagagagagagagagagagagaatatgttgtttttgatagaaattatcaccgtggcatcgatcatgagttgttaatttttgtaatattggtatccaaaaactcacccaaatagcatgatttgactgttcctacactgaataaatatgaggccttgttcttgctaatgcattgtttgcctggttgatggaatgatggtttgcacatcgaagtcactgcactgtggttgaagaaataaatccggttaggatgttttaaacaaacggccgcataaactgttcttactgccatgtataatgtcatatttctagtgacaagtcgatgtaattaacacaaatttgtccggcgaaaaaaaaaggtaattactacaaatttgggaaagtaaaggaatgtttttgcctttttgttgcataagtcaataagtggcgtagggaagttggctttgcatttctgtctctatcagggcaaaacgaaacaaagaaaaaacatttaggtgtgaatataagaccaagctccatgatttgggtcgaccagaagtttgtaggcatccagattcctgttttttgcttccccagtcctgtcctgtaataatcgtagtttaatctgaagacgcaacgatgtcagattataccagttcgccttgggtataatactagttgaatgattagtctcagcctaccgttggatatagtattgtagccatttcacatttgggatgatgtttataaatcaactaggaaaatagctaatttctttgacctgatgaaatggaaccatgaaacttaatctagatttgtttagcactgttttgttgtgctggtaacttttaccaaacatcattacaaaattcatttttttttggaagtcacaccagttcgctactatatctgttgtatttggcaaccgtccttttccttagataattttaatacatatatttgtatggttttctgataagtgtcctacaataatattttgcagggaattcccctacgaactctcctccaggtaatatatactttctgaagatagtatgcatggctatttaaacttaagattttcttagcttgttatatgtgcgatacctcactacctgaaactttttgtctggtccgataatttttaatgctatgaatttcaactggaagcagcagcattttgataaagtcatatcagatagatctgtaggaagaaatccctcaacttgagtttgatgtgaacttggaccccaattaaatagatgaatgaattaatatgtatggttagacatgtattagacatggtcccaaggattactgtggactactgttaagcacaatgatttgaaggttcatcactgctgtatgatactacctgtttagaaaatgtttatggtgctaaaaccatagcagttaagacagataataaatgctgcataaagtaggagttagtttggtctgaacaaatttatttaaagatgttacattttaagtcggcaaatcaaccaaataacatgggtgatcaggctaactagcatcattgaaagaggctagaaatggttaacacggacagtttgtgttgacctgggcatctggcatgctattagtaacagtctatcagactgccttacagagttatatttatgcatcctactgctgttagtcagtttatttagcgatgatatttttgcattttacgctcacactagccatgaagtagatgtatcaaattcttcaaaattccagacttgctatggatactcgtgcgttcaatgttcagggatagcaaacactgggtcttttttttatagagctaatgtggggtctaagtgtctacaattaagaagtagtgtagccattttatttgaatacaatgcattatattacttcggtaggaatacatgtagcattagcaaagtaaaggataacaaagatcccattctgcctctttttctcacatgtaaaatagttaaaattaaaagtttattcgaattgattacgcatgtaacatcacgataacactttacagagtacttttttttaacctcaattcttaattctattgtttgcagcctctccatcaggtggcaaaaacgctggtcatcgcactatgtcagttggtcttccaggattgatgagcttgttcctagcgttgtggtctgtattggcataagaattttggttccatatcagagatgttatcgcttatgccacagtagaggatttacatgtgacggtgtttgttgattggctgtatcatcattctgtacttggatcagaattcgttttgctgtgtatcaatgtcgcaagtcagaagacttacattgtgttgtacttagacctgtgctgatcaaagcgtaatggatgaattgtttatcttctactcctgctcaacatattttctcgatgtgattgtccaacacaaatagtttgccaatactagcttcaattgcctgtgatttgatcttcctaaaaagttgccttgcgattttgagtggatttcttcctctctgttttttttcctttttgaaaaagaggatttcaattttcagccaagcactgacgacgaaacctacagcctcatccgatggctatgtgcggaaaatacgccatttggcgtattagtaaaaaaaatataatttgtgattaaaacttttacagttatgttcgtagcgacttaaatgacaatcttgtaaaagaaactatgatgaaaaaaactcaaaaacaacttcaaaattaagttaaaaaatttaaatgttggcattggcatatgctgattgggccaaaagatgagagccctagccatcctagttgggctcgttgtgatccgttggatcaagaatacgcggcccacaccgaggagagtaaagcccagagggatagttttccctataagccctcatacaatattgtatttccgtttacaccctgcgaatatttttcgcatccacgttggacttgtcttaaccgttcgatgaaccgtaggcggccaagatagatccaggagagaatggcgaaaggaattttctcataaaggtccctcacagaattgaattttacattcactttcactaaaccccatccccttcctctcgcccatgctcctccggtgagcagcggcggcggcgacggcgaggtctagactctggagacgtgtggctgtcgaaatgaatcaactgagtgcctccgcaatgctctcccgcgcagcctctctccgccgcgccgcggcggcggccttctccaccgccgcggcgaggccggagaccgggctgtacggcttcgatgtgctgcgcacggccaagggcttccgccgcttcgtcgacgacgccatcgagaggtaaggggtggagatactgaaccgcaacctactcatctggaagctggagccatccattggctgctgagattttactgaaacgcgcaggtcggacgagctcgtggcctacatcgggcagctgccgccgtccgcggagattgtccgcgccatggatgagatatcgaacactgtagcctacttcctcttctgctaatgatttttttgcggaattagtacttgagttggtattgagggagtgatgtgcgttttatacttgatgatttggttaggtctgctcagttattgattcggcagagctgtgcaggaatacgcacccagataagtgagtgtacactggttactggttgcttcttatgaaaatcatactctggagcaatgtgttttagttttgagtggccaattacatgtgtattctgtgccagggaatttatggatgaggcagataaggcatcaatgaggatttatgaacatcttcaagtaagctcgataacatggatgttgcataccgaaatagttggtttgaggaaaaaatgagggagagaacttagtgaaatgaccaagtcagaaccattaaatttcctttttccctgtgattctatgcagtatctgaataccaatactactttgtacaatgcaatacttaaagctgagagcgaaggtgtcatgctcacagaggaagctcgaagggcagccaccaccttgcgtgttgactttgagaaagggggaattcatcttcctaaaggttggcctactagagttatactggtgcttcttgttttccacttgagtgttgctaaaagtataatttcttccatggcagataaactcgaacatgttaatcatctgaaccttgagattgcccagctgggtcgaaagtaggtacatgaattgtataatagacagtggctgtcattgtactattttttgttgaacttttcatattagctttgcattccttgttccagttgcatgtctgccagactgcaacttactatcagcaagcgatctcattatttggtgacatttgcttgttggtaagatatatatgttcaacatatatggtgttgagttcatattaacccttgggagatgcttctgttctgaaaatatatcattatttagcttgtttgactgcatagagtctatagggatgtgtgtcaagctgtcttactgcctgctaatttgctgtatagctgttctgttacaatgcttaaaaatagcgggatcatattacctactaaataattcttagtagtcctcacatcatcatattactaatgtataaatggtttagtttatgcacagactgctagtgctaagtatgaggctaaggtgtatatcgatctgttcaatgatgcacttgttcaatttatttcccatctcttttccattatcattagaaatgcgagaaatgatattgaatctccttgcacacacacaatatgcatgtggcttataagtgtattcgtaaatggtctctcattcaaatggcattctgatcgctataaggatatctattaattttactttttttttccatttaactgcacagttccattgtggctttcctgtttctttgcctgtccagtacatttccctaccgcccctttcttttcactgaattgattctgtgaattgtaattaatgccatgcctgttgatttgaggttctaaaatgtataaatttgcttgttgctagtgaacttactcattttttctgtgccaggttcagtgaaaatgttatgaacaaaccaggttttgtggatatatatccagcttcgcgcattccaagaaatatgcaacgccattttaaatccattcaccgtattaaaccttggggcgatgaggaacaaagaaatcaaatggacactacaaagcaaaagggtctaaggatagtcactgattcaggaactctatcaacagcactgagatgggtctcagatgaggaagtatgttccctttattccactcaccaaccattaattatcaatgtattatatgttatcaacctaacatttccaaactttccaaagatcaggaaacaggtatacctggtaggaaactctgaacctcgtgaaaacattacagttcttggcaagcttataaatgcacgtgacgagcttgcgaaggtaatttttttcatgttattgtagggcatttatttgaaggaaatagatgctataatgccattgtttttaaatttgatttgtttatgatttactacactccatggtgtactgtcaactagatatggtctgtaatacagagaagatgagggttaagctatggttaggtttactaaaatagcatgtttaacatgcattcttgtatgcatcaatacctgataaattgcttgaaggatatggtcatgtggtatcttgactcaaaaggtttcaaccatgtaattgaggagataaatttgagttggcattatgtggaaaatattcccagccaatggaagaccagtttgttgatttagttgagaagttattggatgcagtttatttgtgttataccaatgtgcttgatcttgactattgcagaatcaaaccttcctttccaaaggccttggatgacctatataggcctcattgcgtctatcctttagcaaaatatctaagctagatgtgacatgttaaactttcttatctcacatcattggatccagtgagagttatcagtggcctgccctcttcctttgcagtaaaatgtgctgcagcctgcagtatacatttttgtaaatgattttgcttggatcttacctgttgggaccaattagacccaaaattttgttggtatttgtgctttggatatatagtgcaagttgtatttcttaatctaattgagttgttatttggatcacatgttataagttga

SEQ ID NO: 45704 - DNA, 4076 bp, Oryza sativa
ccattgtcccagtgcctaaagggcttaaacgtgctggtggaatcattatttggtgccacatttcatcaaattcctatgggggacggcgagtcatggcatccagatgtgatgaagttgtctctccatcatcctgatgaggtactattgtgttaagcttagtttattagttctatataaaaaaatagtaaactactgcatcttacccaatctaactctacaaaagcatgtaactacatgcttgaacttttgttattacggatacatttctaatacgctaacattagggggcatgacaatcactatgtttcctttctcgaaatgagcatgccagattatcaatcacactactttgtttttgttactaaaatcaaaatcagcaaacaccagaaataacttttgaatgatagccaagtagacaaagaacaaaattggcattccatggttactgattagtaatacataataatgatggagagttggccttgtccgattggtcatgtactcgtatcctattagcgcatagtgtaaataccgtaaacttgaacaactagaagtatgatgacaggaatctgttacgaaattatttatcaccaatgccatttaactatgtaagatatcataaaatgttatgctattcagagcaaaaaaaatatttcaaaactagtagacccaaaggtattttcttaataaaatgtatatttggattacaattatcagtccatctctttataacgcatatatgaccaattgaattcttctaaggggtagtctaatcaaggatcttggttgctactactatcacgcacccactgttgagagcatcttcttaatttatattttactggcagcaaagtaaccaaaggaaaacatgtttaatgagcagggcaatttaggatttatgtatcttgatctgtactccagaaagggtaaatatccagggtgtgctcactttgctatcagaggggggcgacgattgcaagactcaaattaccagcttccagtatgttctcttgtatatttttatttcatgaataacaagggaattggcatttccaaacattaatgttgaactactttttaggattgttttgtatttccgtagtactttggatgttttaaaaaatgtggaatgcagaattttgcagcctttttagcccaaatatttggaactaaacaaggcctaaggcttgtgtgccttatttagatttattctctttgttccacatagatgaagaacttttgacagcatttaaatgatccttacaaggataatatctaagattcacgccaccgattcacttcattctgatgcttttcagatcgttgctctagtttgcaatttttcaagttcgagcaaaataatggcaaggcttaaccattgggatgttgaaactctgtttcatgagtttggccatgcccttcattctctactctcaagaacggtattttgctgtccttttttataatatttaggtctctccaatgactccaggattgcttatctgccagcataatgatatttgcaggagtatcaacatttctctggtactagagttgctcttgatgtggctgaaatgccatcaaacctctttgagtacgtatgacttgttgctaaaaataaaactttatccattaacactcccgcagggtatctaattctggcttatctaaaatacagcagcatttgttatttaccttctttatcgtagttgagttcaattcacattgcaggttttatgcatgggattatcgtgtcttgaggaaatttgctgtagatgaaacaactggtgatccaataccagaaaagttggtaaaggcacttaatgcttctcggaacatgtttccagcaacggagctgcagcgtcaggtttgtttttctttgtacttcttatttctcacccttaacaattggatttgaccttgtatgtcccaatgtgctgtttcttcactttgtgttattgtgcctccgttccccagattttctattctataatggacttgactttgtttggggagcaaggatccaagccaatggacacaatttctactgtagctgatttgaggagaaagcatacaagttggaaatgtgtagaaggcacacactggcatactagatttactcatctgataaattatggcgctggtaagctttctatagttcaagaaaatttcaagcttcagttttcataaagtataactgctattctttatttcaacattattgcaggctactatagttatctttatgctagatgttttgccacaactatatggcaagaagtatgccaaggtgatccattatcccgcagcacgggtagtgcacttagggacaaatttttgaagcatggtggagctaaggatccttctgccctgttaaaggatttcgtaggtgattccattattataaactctggaggaggaataatccctgacattagctccttgtgtaaagaagtcggtttgtgaaataccattgggagtggagattgggatcattatttttgacattgagatgggttaaagggtcaaagactcatgatatcatgagtcaggagcttgatctgccacagggctgcaggatctagttgaaggtcaagctgaaaaaaataatagtagattcttgacaaagaactgatgaattggttctcaatacaggattgcaggttagattagttgggtggatcctgtttgaccattgctgaatcttcgattttaacttgctgctgctgctgctgcaagggtggtttagttccctgtcagatgatttttcgcatttactccgattgttcggaactgttgttccaaagctacaaagtggctgtgcctgtaatattgacccaggttaatcttcatagcccatcacatgtaatagttctctaaagtgattataagagtgagagatgtgcccatatgatcttttttgcattcttagttggtctcatggatagaaagcatgtttgaggatcatgctcattattgcaaatctcccttcatagcgtaatctaagccatctgaatttagattgaagctgaataggcgagcttctggccgccgaagacgtacaagccggcgatgatggacaagatgaatacaagccagcaattatcaggtaaagaatcagatggcactgccgccaatgcttccttcagggtccaggaaacaactgagcaacatcgtcaacgcctcctccagcacaatatcgaagtaattgaaatttcagtttgcacggttaagtagatgttattgcgataaccgctcgattttcatcgaattttgctaaaattcttacgaattccactgagaattttgactgtgccccggtcaataaattcaataacctgcacctcaagatcagcagctgcgaaacacatcacccagatagtgaccatcacagttaccgggtgaccaggattcgggatgggcagacaggaaagaatcaggtcagcatccatgtcggaatagatctcctcaacttgatttttgcgaaatgtgaatcatgcatactctctccgtcctaaaaaaacgaatctaggatgggacgtgacacattctaatacaataaatctggacaaaggtatgtccaaattcatagtattatgatatatcacatccagtattatgttggtttttttatgggacgaagggagtatgatattgcaactattaactggaggaatgagcagaaattgttcaggttttctatctgcttttgttgctgtaagtctgtaaccaaactaactagtacggagcactgcggtttcaactttacaactgagcatccactgaatttgcagagactgaaccttcagctcaataatcaccattttttttctattcggttcctggatgatctttaacctttctagtattctacagtccaagaatgttgaacatgaatcatcctcatatgagttattttcccctttttgttgattcttcaatttgtggtgcgaaataaaaaggctgaaagaaatatctaacagaaactatccaattatggcatggctagctttcaaccacagaagatatgaaagggaaaaaaaataaaaaaggagaacatgaaacagaaacagagg

SEQ ID NO: 45705 - DNA, 17116 bp, Oryza sativa
acccgccgccgcagccgtagtacgccgccgagtgctcgtgcggcaccgacctgcacttctccatcgtcacagcgaccacgccgccactgacgatttgattccggtgaggtcgcaggcttcttgatgagttcttgatcttgagagggatgaggagaagctgggtagtaatggagcttagctgagctgctagcttggaggagaggcagtgctataattgaggtgagggaggggaaagagatgggttttctgcttgatttattaggccataattatgcatgatgcaccttgggttgtatgggtattctaaagttgaccctgtctgttcttttttctgaccagaaaggatgaacccttgctttttgatcataccaatggcattatctaaaagagtgacataaaaaactgtcacacaacttaattaatttgagagtatcattaagtgtttgactgctcatgtgtatgttttcttagagaaaaaaggagcgtttctgggtactctcccgaatcataaacatttgatgtttaggataagatttactttaacttttaaaactttgactattaattttgtatttaatcaagtttgcaaagtctaataagcatttgagaaactattgccaataaaaaaattgtaaaggtttaaacaaatcttattataaacgttaaatatctattaacttattaaaggaatagaaaaatgagcctccacgttcgctctcacggcttagaaatttttatattaatcggggtaaaagaaaaaacagagtatatatagaaatacaatttaaaaacagctaaaattcggaattataaataaggaatatagaaaaagagacaggagtccataccggtttataatttagaactaattgaaattcggaattaaaaaaataagaaaactaaaactagaggtcaaagtccctatagaaatacaatttaaaaataattaaaattagaattaaaaataaggaatattgacagaagattctataacccatatagaatataatttagaaaagaatgaaatgcggaattaaaaaataaagaatattaaaagataagtttagagttgtcagggttatggataccacacatacctaactgtagttgactaaatctcggcaggacccaccacataccatgtcttatacggaaactaacttcggatatggagagagttccggataaggaaagacaaccagagttctacatagaaacgacaagggctcctcggattgtatctatattggtttccctaattctacttagacaaggggacacctatgggtataaatacaagctcccctatgaggagaggatcgacacccaacagaatcaacacccaacacaatcgacatagaagccacaacatagaagcctacatatgccaagatacgccgccggatatcaacttcaaggataagcacggctagtcccctacagtgtctccggatactgtcaggagagacgaaagcgctatctctgatctcgccgggcacggattcgaggaggaaggctaccctgttgtcgactacgagtcagctcgtcagaccgccatgtcgacaacagttagataggctaccccaaatattgtactggtgttattatcatgaataagagcaataccggtttcggccaacaggatgtagggttattacctgacaattcaggggaccgaacctgtataaaaatccctgtctccatctcttttaccccagtctcgcgtatatcctagtaccaacgatccccatgccatgcaaatactgtagtcgagacatcaaacgtcgacagtggcgcgccaggtaggggaattttggtgcttcaggatttcgacgagatgggttcaagagatggattctccaacaataagctactcaacgacttcggctatggggagatctaacctgaccggagcatgcccccgacaagatcggaatcaacgccgttaacttgtcgatccggcgagatcgaccaatctacgagatgtcgccgccggggataacgcgagatgtcgccgccggggataacgacggtttgatgtttcccaccgggaagcctcggccaggtcaaccaacgactacatcgaatccgattttcaacagcggacaatgatggacttcggagaaatcaactgctcgtcagctcggatcaatctcacaacacgcgacgtgatcaggcaaccgcgacgactacaaggcctgacatcgcgtggcatgagtcaaaaatactgtaccgtgaccaacacccataaatacagtacacgtacacgtctctatgagcacctgtacgtgtgcgaataaatatatgttggtatatacagagccatgatacgttggttaattaaggtaattagtaggttaattaattttattaacctattaatttcgtagatatgtccggcatatatctacacaggtatttaatattttatctgtaatttatcgtatctattcagatcatacagcattgtcagatccatgatttattatgtttacctagagcatattttttatacaatatctattgtgcaagtgtccccgatgttaaatcgactacgctttaacgttgggggctcgctctattttcttctgtatgaatcatgcttgcttacggtttacataatgcctgatatttacatctgctcgttatgtcctaataatactagaagattcatgcagttttttcagtgcatacccgatattctctgctatatatcttgtcttctagaaaatatttttcaggaacaattgagcactcgagtaggttatggtcgagtacaccgcattatcgagaacgatctcgacgaatgcagagtcgtcgcgcccaacctaccaacaaagatcgacgacctatctcatagcaccggccatggctggactactcgagaaaaggttgttaacggataattctcgtgaatgtcgtcggcttgatcacccgacatgattgcgaacggacatccggatatgctataagttgggtgcgtgagtcatgctggccacatgagacgcacttgtaataaaccaactctagcacctccattggtgttcgagagataattctacacgtttgctggtcctcgaaccagtgcgtagcaatctctcgcaccgcaacctccattggtgttcgagagataattctacacgttcgctggtcctcgaactagtccgtagcaatctctcgcaccgcaacctccattggtgttcgagagataattctacactttcgctggtcctcgaaccagtccgtagcaatctctcgcaccgcaacctcagatggttgaggtacgactacagcaataacgcagcggtcctcgtaccacgacttcaaatgatcgagggacacctactcactagttctcaaccagtcaatcgtagcgatctctcgtacaattacttttagtggttgagttacgactactacccggttcttgaccagaggtgtagcgattctcccattacctctacttcaacaagtgttttacccagagatcccttaccacaaagacacctagtgttgaaacctttcctaatgtccttttacgccatcttgacaaagcctctgaggaacctaagggaacttcggctggggacgcccagagcggataaggctatgtcggatccttcagagacgaaagatcttgtaagatctggtcgtgtaagagttctcgccgtgcgtattaaccaagccgtgtaatcggaaatggattttccaacttcacggctgggggctaggatcagtgcttgttcaaccgaggcaggtcaaaggtccaagagccttatcctccgagaacgattctccgatgacaaggctggggactagggaaagtgtataactcaacaaactgactgatcgaagtcggtaaaaaagtagacgctcatatacaaaacattggtatgtaaatttaattcattttcagttttctatacattctataacatgtcaccctttgagcattcgctcgggagctatttctatctaatatttttttctgagtattgattccaggaaaattctattcgacattgtcgaagacttcatggctctatggttctacaccaagatcgactaaggcgagtacgacaaatgttgacaaggctctgtcgcagactctgcgccttctcgagaacggttggtggatatcgacaaggaatacggaatgaagagatggtgtacccgccgagataaaatttattgacatcaatccaaattctcgattacagcaagacgggagacttagtcgcatgctctgtactttcttggttgacgtcggagattgactcagacaaaccctttaggtgcccgcacgaggctgataaaggaagtctaacgttatctctgaactcaccgagaacggtcacaagagctcgataacagttcctccaaggtctacggttgagaatatgaactcgctcatttgcattgaagtcggggggctactatcagggttatggataccacatacctaactgtagttgactaaatctcggcatgacccaccacataccatgtcttatacggaaactgacttcggatatggagggagttccggataaggaaagacaaccagagttctacatggaaacaacaaggactactcggattgtatccatattggtttccctagttctacttagacaaggggacacctatgggtataaatacaagctcccctaggaggagaggatcgacacccaacaggatcaacacccaacacaatcgacatagaagccacaacatagaagcctacatacgccaagacacaccgccggatatcgacttcagggataagcacggctagtcccctacggtgtttccggatactgtcaggagagacgaaagagctatctctgatctcgccgggcacggattcgaggagaaaggctaccctgttgtcgactacgagtcagatcgtcagaccgccatgtcgacaacagttagataggctaccccaaatattgtactagtgtgattatcatgaataagagcaataccagcttcggccaacaggatgtaggattattacctgacaattcaggagcccgaacctgtataaaaatccctgtctccatctcttttacctcagtctcgcgtatatcctagtaccaacgatccctatgccatgcaaatactatagtcgagacatcaaacgtcaacaagagtccatatagaaatacaattagaaaaacacaaaaattcggaattaaaaaataggaatattgaaagaagagtctagagttcatatagaaatttagaataaatttaaattcaaaattaagaaaaaaaaaagtacagtttagagtccatatagaaatataatttagaaataattaaaattaaaaattaaaaataagcaatattaaaataagagtcagactatataagaatataatttattttggaattaaaaaaaggaatattgaaaaaaacttaaagtctatataggaatataatttataaaaatagaaattcagaataaaaaaagaatattggaagaataatatagggttcatataggaatttaaactaattcaaagtcagaattaaaaaattaaaagtagaatttagagtccatatagaaatacaatttataaataactaaacttcaaatcaaattttaaataataagcatgattgggagagaagagtctagagtccatataagaatataatttagaaataagtaaattcgatattagaaaataataaattactattaatacaatacaaaattcaaaattgtgttgctatttttaatataccttaataataaaatataaaaatatttaagctattatatgagaaaaaataacgatactaactgcgtaattacgcgggcctccatgctagtttataataagagagtatattacaggttctgttcattgtgacgtaaaaataatagacacattgattcattgacaaagcgcgcaacctgtaactcatgtatatcttttatcgtagtgtccctcgtgtttagcctacatttaacattctatgaccaaggcaaaaacaaaaggtgaaaaaaaaaaaaccaacccaatgaccattacacaactacaaaagtgtttaaaagaaaatgacaaaataaggagagaataaaaatatccccccaaaaaaggggctccttttctgcttttgcaaaatttgaataaccaaaaacctagtgtgtctttatgtgaaatcactggagtttaataggctttttatcaaggaatgtggggaagggaatgatggaggcgctgtatggagtgggggctgcactcacccgtccgtgtgacccacgtgtgctgtttgttggacgcgacaattaagccatcttttcctcgtcgcccaaattttttcctctcctcctctaattgcgttgctttgcaaattaatctgcatttgtttttctgcatctccttcccctaggccagatcctctgctgccattatattgccatcgatccgtgggtgatccatctgttgctgctggaaatctgtgatgaacacatttctcagttgactcacagattggaaaccgtaggttgcacataattgggagatgcaatagtgaaatgtatcggttttagtgactcataagaagaaagttcagggttagtaaaaccggctataaccgttttggtgtgatccgatcgaatttgatatagctcgagcgataaccaacggttgtgggtcgaataccaattctccatcgtttttgtgaaccctaggaagaatcttgtactctacctatagaatcttaataataaagcatgttaaattgatcaggaagcaaaggtagcctcacagtgagtaagctttgctgcagtgtcttattccacagtacccaaagctaaaaatgagcatctatatggtcaatcagaaagcaagcaatgagatcatagctatctacaccgtcaactgggtgatcagacgatgatacatacgcacaccacggacaggttcaatgcacaggttgtatcagatcaaccagacaaaaaagaaggaagaaaaagaaggcgaatggccaaagccatgaatcgtgtaggtagtggcgctctagacacctcgcactctctgctccggccaaacggccccattgtctcgtttgtggggaataaaccaaacggcgtatttacaaacgaaaaataatttatatgtaaaacttttatatatgtattcttaacgatttaaaagtaagtgctaaaaaaataaacttcgataaaaaaaacctcaaaatcaacttcaaatttaatgttaaaaatttaaatcttagttgataaacaaaagtgtaagcgaaaagataagactgccaatggatcaaataatcctttcaatcgaccaaaccaatcaatctctgggcctttcgctttctcctagtagtacaaccctacttatcatcaccagcagcagcatgatgctaccgcatgatggcacgatgcccttggtcgtcacctacttggccttttctccgatccctcgtgccgctgaagtggaaagagagatacaatgggtagtagaatcatttatatagtaattacgcgacgttttatatagtaaatttgacttgcgctaagtagcattttgttcagactaaagtttgttttttttatgacactgaagattagcttttttttttacggaaggagtattgtgtaacaatagtcaattgctaaagataaatgtttggttttgatgagtttctggcagcgtaggttatatatattcttccaaaatcctcacctcttcaaacgttttaagattctcattcaggctatgagaatcggtagctacataaatcaaaatataagctaatagttaaaatttgatagatcttttttttatatatactcaccggttactcgttagtcaccagctcgccttagcttacatgtgagctgatctggttaatttcactggctaattaattacacgtagacgtaggagctcatcgaaaggaataatcagttcgctgttgctgcttggatggtactacgacgtcggcgtggttgggttgtcgcctccgttgagctttccacgtcgacggcggcttctcaatagatttgggagcatcccctgcactgcatttgatgagtggaataatactgtgctgtccggtcttattttaaatttaagatgatcgacatgtttctcatcatctagattatttactttgctttgcataagcatgtttggtttgatcaattgtgttgtgagatccatgaacatttcgcagagcatttgagcgtcatggagtatgtacggacttttagtaaagcagtgataaactgtagtacaattcggtagacatctagtactagtacagtaatcctacttcgcactctctctatcccgaaaaaacgaatctaaaattagatatagcatattatagtacaacaaatctgtacaaatattgatttttatgggagaaaggaagtatcagaggccatcgtttcatttatttatggaataaacgaaacggcatatttgcaaatgaaaaataatttataaataaatttttatatacgtgttcttagcgatctataatttaatattaaaaatttaaattttaacttataagaataagcataagttaaaagatgagactgatcactgagtgattatccagtgacagtgagcacaccacttccactgtcagtatatcgctggcacatcaaatgatcttccatcttatggccatccatccatatggacaggcaggaggacgcttgaggcacatcaacccggtctgcctctgcctgcaggtggatgtaaacgcacgggcccgatcgataccgacgaatagtagacagcagcacagtgagtctgttcgcgaatcgtacgtgattccccctaactgctagtggacgccacggcaaacagggcgtgcagctttcgtgtccccggagtcgccgtcaccggcctcgcgcctgtccgccggatgggtgtcatgtcccgtcccgtccacgccgcatatccaccattccattccaccgtgatcccccacgctcgaatcgctcgtcgcaataggcgacacccaccggtgcatgcagtccagtccaccacctaagctacactgcactttaccgccaccgcccatcacattctgatcggatcagctcccctttccgttaacatatttggcaccggcagatctggtctccgatggaaaaagaaggggcgaaacttcatggaaagctaggcaaaaagcacaaagcaggagaacatgagagttgggtctcctttgtgcggcttcgctgttgaggccgtgggcaataatactagtactactctgcagtctttggtccaacgatcgttcaattcggttcacagtatgtttctgtatgagcagtctggtttcatattgggaatggggatatcattattaccagaaatgcaccagattgaaacatttttatttgaccaaacagaaacacttccacataacttgttagtagatcgctttacatggttaagttcgagacatgaccatgtatgcaggatcgaaaattcagtaagttcagacttgcataatgtaagaaatttaggatgcggtaactgtataaaaacctcaccctctcttaacatgttaaggaatggcgtaaacactgaatcagatcagttcagaattctgtaacatgttaagcaactgctgaccgaaatggaagcacggcatatcagcttgcttgcatggaaacaggcagaatcagatcaatcaatcatatagcaaagaaactgcaagacttgagcgcaaacaagtggaattttcaccatgagttatgttatattatcatcatacgggaccagatgtatcatagctagcagaagagagcccgaaacatcttcggatcaagcaaccaactgcaacattgcttaatgcataacatgcttaaaggtagttttgttacatccgcacatagtgaagtaacacagacaggtagctggtttatcatttttcaggcattacagattggtatcagcctcatttcttcccgctcttcttcagaccagagcctcccagtgcacccttctgtcctgccttggccttaagctccttcagtgcctgtttgcaagaaatgcatgcaattgatgtcagcaaactaaaacaccagctacaatgaaaaaaaaaaacagaagactggtaagtttggtaaatggtctcaccttttcctcatctttcttcttctgcagatacgcgagatcactctacagaaagcaacaaaatcagaactacaagtctgcaactaaccattcaagttccttatatcatcattgcttcaatcaaatatgcactagttttccagataaagcgctacttacaataccacacattattaacaattcataaactacaattacatccatccaaatcactttgttaaaccaaatctatactggccacatcatctcaacttggacaaacagcaaattcaaaatgcttatctgattttgcgctgcttgattctaataaagccaggcagcgacatgttattcccaggaaaaaaaataaagcaccactatttttctttttctagcaatgcagttccccttcaagagatgtagattatgtttcacaagaaagctggtggaactggagtatcaagcaatagtaaatactagtagtacttgttatcaattatcaatagtcaaatcaagccaaaggctcatacactgaacacatgctcatttcttcaaagcctttaaggtcttagttcagttgaaaattaagatgaccataagcatagactaatgatccattcaagacaacttaaacccatagaagtatatcaagacaaattaagtttaattagatagaagaaatttaggacgagtgagatcatattctttgtattcccatcggacaagtaagaccatacgctcactgtgactggggacatcacccaaaaataacagctagcacaattttagaaggtgagataagttgatgctacactgctaccgaatgcaaattttccaaacatcatcaaccaggtcagttttgcaaggtgagaaaaggtgaaagcatcaagcacacaattccagaccatgaacaaatgatttccatacatgatagcatcaaacatattataaggttagcatcaaacatattataaggttgctcatttcatgttgacaaagtagttagaagaaagtaatttgccctagaaactaggacttcatgaacagaacaagcttttaacacaatcattatccaataataagttaataaccccctaacacaacatatccaaggaatgtaagtaaatatgatggcatatcagccaatccctccgccacggggatttaaggggattgattccacttccacacctactcaatcccccctccagtcccttcctcgtggggattaaccgaacggatccctaactgaggacaaggccacaagtcaatacgcagatttaaaggacaaacagcatcgcgcatgataattctacaaattcaccttcaactaaccaactaaaggataaaaccactatgaactaccccagacacgaaccgatctacaacacggtggcctgcacagtcaaaacacaagcgcggatcgctaacccctaacccgaaacgatcaatcggtagacggaaccacgaatcgggagcaaaggtcacacagcacagcagcatacctcgtcgtactccttcttctcggccttgggcgccttgaggggcttggccttccctcctgcaaatcaaacccacccccacaaaacaaatcatcagaaccccgcacgaatcgatcggcaacgagggtcagcgagatctcgcaggaaccaatcgcgattggaaggaactcaccttgcttcgacatggctgaccggatcggcgagggcgagtcgagaaaccctagctcgcgcgccgcgacgacgaggaggagatggaagaagggaaaggcgaggaaatgggagacgcgagaggcagaggcgtatatagctagcctagcctagtgtagtggttggtcgcggctgcgaatgggaatctcatgattgtggctgtattgggctgggccttggtttgttggcccattaagttctctagaccatcttgtattgggcctcctggtccgttggccacatgtgacgctgtacttctaatacatatctggctttcatcgatcaaacgaatacgtacatacagtaccaatcatcgtatacattcgtatggacgtaagtagtactaccttcatatcaggttataagacgttttgattttggtcaaagtcaaactactctaagtttaactaaatttataaaaaaaaagtagtaatatttttaacccaagactaatatataataaaaaattattcaattataaatttaatgaaactatgcaaatattactacttttttctatagagttagttaaactcatcttgtaacctgaaatggagagagagtactggataagtacatgtacgtccggtcgaatcatccatctatgatctatctataatccatctagagtttagataaggaaaaaaaaaagaaaaggttaaaaagaagcattggtagcttgccatccaaccgagtgatgcgagtgacacgcggagcagattgctgcacagcctgcaaaaatgggtgcagaaagcgagatggatggtatagggtggcgtggacggcggcggcgctgcatgagagtatagatcggttttgggagatagcgcttcttgtccgtagtacggcaggtggcacggacgacggacacggtgggcgccgcgcccctagcttgcttgcttgctgcacccgtcgccaaccgttttctcctcctcgctctctccatgtgatctccgatgcctcgttgcgccgcatcgatggatcgatcgcccgctgtgtatatatgtgcaggtccatccatgagaggttgatcagagagcttgagatctgtcaacatcaggagcgagctctcactgccattgccaattggcaattgaaaatcatcgtaaaccgccatctccatcatcatctcgcgcatggtgagattactgctgctactcctctgcctgcatatgtgttcaatctctgttgcaatgtagtgttgatatatgaatatgaatgttgcagtcgctgctgccgttgttgctgcggcccgtggtgcgcgccgcggcgagcgtggcgaggcggccggcgtctgcggtggcgacggtgctgcaccgcgccggcgcgctcccgaggaaccgggggctggagcgcctcgtcagggacgacatgctcgtcgggggtgaccacaacttcatcgcgcatttcgtcgtcggcttcatgcgctgcctgtgttagctggagtacatagctaggcggctaagctagattagatgcatagcaccggtattgatgaattgatatctgatctgcatttgcgatttgggctccatttttggggggatacgacgttctccgtggctttgataattaaaacagctagtgtagcatgcatttgcagcgatttgagcaccatttctttgcaccctgatatctgttcatgtccaacatatgtcgactgccaatcactcagtagtactccctctttccctaaatgtttgacgccattgacttttttaaacatgtttgactgttcgttttattcaaaaacttttgtgaaatgtgtaaaactatatgtataaataaaagtatattttacaataaatcaaatgataggaaaagaattaataattacttaaattttttgaataagacaaatatttaaacatttttaaaaaaattaacggcgtcaaatatttaaggatagaggaagtagtagaaaggagcagtttaacgatactgtcactgtgggcgcccactttacagcggcacgagctgctggttctgcatagtaagtcgtacaggataaacaaaacaaaacaatacttcttgtgagacgtaaataaaaagaaactgtggtgcattgtaatggtagtacatgtgtttaactagtagtaaagcaatagagaagcaacccttccccgcatatcaatgagttgggaagagccggatgtatccaggtctgtgcctgtacaagaattcagaatcatgaaaaagttagggaaaaggataaagagaattactgtaactttttttcagcaactctttcacagaaaatcatgcatataattctctggagcactcaattaatcaatgaattcaattcaatgttacaatgtagtaaatccctgttaattgaatttagtaacaaactgaaaacccctatcaactgtatcgtgctaatcctccaaccagtgtcctatctagacaaacacctggtacagagaaaatgttatataacaagaaaaacctacatatagattgaaaagaaaaagaaaaaggagaactcatgcacaaatcattccaatcacatatcaagaaagaacaaaggtagagtgacttgcaagttgcagcgaagaaactgtcagaacggcttaattctgaacttgtgcacaggctcaggacaatctagtgcaacctcaggccttcctcagagctctgactcgagcagcaagctcatcaaagtcaggcattttcgggtgcacatgtacagttttgggacagtccggctgcagtgaggtagaccgggcaggaaacttcacatcttcatcgcggcagacggattcccctggcagtgagattgctcttcctggaggatgcatggagcccttttgctcagattgttcttctgctttgttggttggagctggattgatttccgcatctaaacctttcttgctgtagtgcctcagaagcttatccatcattctctcctcctcatcaactccactgcgcgcatcagtattgcggcttttgtgtctcctatggccatttccagttctgggtaaaagattaccaaagtcaattgcagcctcatcctcttctgatttatggcgctgcatgaatccatcgtagtcctcggtgtacaaagctccatttctcctgcctgagtgccttggccggctactaggagttctctgaacattctctccattaacatcatccattcctttgcctccatgaggttgtctagacccatctctccgggcactgccatcattaacagcattctgcctgcttgtgtgtcttctgtgactactgggtgttcggcttgaaaccttttcattggcaggcgcctcatcatagacagcagcaggtgcaggtggcttggcatatttacttctaacagaaacaggtcgaagaggatctttgtcagacaggtgatctgtttgttcagggatagcacgtttgctgtagtcactagcagctcgctctgcaggatcatcattcactgtttccatgttgagttttggtttgatgtaaggaggtcgcacataagctgccctctctggcactggctgtctatcttgcactggattccccttatctgctaaatgatgtggtctagcattcaagcaaccagtgttctcttccttttcagaacatttcttgccggtagatccatccagcttagaataaggaggcatcctgtttttagtgttaccattcaaaggattcactgattgaagcccctgcttatctaggccaagggttctgagacctgaatctgcatgatcagcagcacaaggaatatgtgatctgtggtggtgaccaaggttgctctcgttctccttctcaagatcattgtctttcttaggcttgacatttagtgcaaatgtcttcttgctttctgcttcaggaactttcaatgaaccaaattccttcttaggcaggccattgaggtctagctccaccgcttccattagttccttttcgcaagggcgaacatcttttttgttagctttctgaacttctttttgaatgttccttcttttcatctctgaatcggacactggtttctccacatgccccttaccatcagatttatccgcatgctgtctcctggtgttttcacgtaaccggtcaatgccatcagcaacaggatgaacatccttttgttgttttaaggacgcttccaatttattcttgtggccaagagtagcagcttcagattttcttcctgatggagcagcatcatcccccttcttgctggacaaaggcactgccagttctacctgtttctttgagtcctttgcaggcaaatcctaagggaaaacaacccaagatgccaagtaagaaacatcaaccaatagattgtgtaaattcattcgaacaagtttgtgtaagcatatagtacatgtttggtttctggagtggcccatagtttgatcttaaatgctttgatatcaaaatcaaccaatagttcttcagacacactttgcatggcttgtatcttttcctcattagtgaacactttattgtccagcttctgaacaaactgcaagtactaggattatagatcatgttaagtggtacaccactaatcaattcaatgacagcaaattcgtggcagtagcacacctcaaggctaacaaaaggctcaagaaaatgtccatatctctctgtgaaaatatgcctaaggtcacacagttctggcaaatctggaaaccgagcagcagcaaaaattagagtcgacacagcttcccgagtttcctgggggcaatccctgtcaggaaaaggcaaagatataactgacaactgttgtcatcaagataaatggaaatccattttgtttattcctcttcctaacattatacaagtagtaatgtttaattgaccaagcaaagttctcaaacaatttttttaattctctttaaaagatgatgctttggttaacactaaactaaatcatccaaacaataataaaattgtatatgtttccggatgctattgttctgttggcttgattacttaaccaattaaacaatgtaggatgcattaatgactctatcgaggtatcaacaaacttgtggtttttaggtagacagtttcagcatcacaatgattgctagtggttgacaaaagaaataggaaatcaaagcagatcgttagttacccctgtttctgtaggctgttgagctgtttaccaatgtactcacagaactgctcgatcatatcatagcaagaagcatggttcatctcaattatcagcccatccatctgcattccaagagagaggaaagtagatacaaaatacaacatcagcaattcagtcaccgcatgtttcctctaccacaaaaatga

SEQ ID NO: 45706 - DNA, 12555 bp, Oryza sativa
ttctccgattccccttgaacccaaaatccttcaacagcagaacaatgcaatgcagcggttaagaatgagttaaccgacataaatttacccgtccaaatgcatgtgtgtcgaggccattggtgaggaggtcggctatgtccttcttcatgaatcgaatcatcgcctgcttcttccgccgtatgagagccagccgcgtacgaatgcatttgaatgcgtgcttgctgcatccattgttcaagaaccgaaacgattggtcaaaccttctccatgaactcaaaacaatatttttcaaggtggaatcaaacaaatccatcgcaagcccaagaatttgtaacccaaattcgcgcaatccaagaaaataatctatcaaccaatccggaccgaacgcgtaagctgacgaactcgagaacctaggagaaaacaagaagcaagaaccactcgagaacctaggagaaaacaagaagcaagaacccggaaacccaagaacgcacccggcgaaaagttcgcccctccatgcggggaggattcaagaaccaagaaccccaaaagtagagcctcaaataaccagattggaccataagaactcagctgagctcgaaccctcgtaccctactaccctaggaacccaagaaccaaaaagaacaagcagaaaagaagcaatttctcaccatttgttgtagaacttggagttgagcaggctgccaaacatcttcccccactcctcccctcctcccagcttcttcttcttcttcttcttcttcttctcccttccgcctcgcttcacccaacaggcgaagcttccaatggcattaaatcatcaggaggacgaggaggagaagatgagagggagcaatgggggaggggaaggaggcggttgtgggggaggaggaagtggaggtggtggtggacagaatcgatgtgagctgttgcaacagaaggcgaaaaccaggtatggcttggccagctagggcgatcacgagccgtccgatcggaaattgacggtgaggattggttgcagcggaaagagggaggattcgtaacaaaccaggcgaaagtttaccgcacaaagcaaccaaccgaatttcgaatttgaagccctaatctttggggaaattacccgttgcagccgatattttgcttcaggtcacaaaagatgagaaaaatactgctgctttttttgttaatcttgaaggtgaacacgttgattaaattgcatcttaattactatcatgattaatcttcaatatacttagtattttgttattcggaagaggtaaactgagaacactgacattttgaagcatttgatacgaaacagtttcaagttggaagttgacaaaaaaatatatactccccacgtttcaggatataagacgttttcactttgattaaagtcaaactgttttaagcctgatcaaatttatagaaaaaagtagtaacattttcaacctaagacaaatctattatgaaaatttatttaattattaatttgatgaaactaatttagtattataaatattactatatttgtttataaacttagttaaatttaaaatagtttgactttgatcaaagtcgaaacgtcttgtaacggatggagtatttctcacgtgaaagtcaactactgaacattctctctcgcgaacctttgcaagaaacattcctgtctcgtcaaatctctgctagtacaggttgcagttaaaaccttttggactaattaattagcttaacatgataactacagttagctctagtagtaaaactcaacttgtgtaaataaattaactaacagcaacagttcatccccaccgcaacactcaagtggataggattacttaacctcacgcgtgacacagccaatcgattagctcgcataagtggttttcacggactactaattactcatacattgtcaggtgttacccacggcatgatgttgcatccttttccattccatttggcagatcaagctacacgccatgaaagctcacggacagcaagacacagcatggcttctattgcaatactccttgttaagaacagcttggcagagacacaagtttgatcagcttccagcgaatcagttgatatcttctactattaattaagtttagctgtggactaatctgttcggtttactcgcctaaccttgtttgttctgtgaatctctctcgcatgaacaggcaagtgcaggaggaaaaggaaggcataaaagttcagagcatctttcttatgaatctcactgccgctacagctattgtacatactccagaaagcgagatgtccagatgtactaaaactatgcagaagagatcattttttgtataattcagtacagtttgtggccggctttgactgttttattcagactagattaggagactttttaaaactgttgactaacagttatgcttgcaaactggtgtcagccatgaagaacacccacagaagaagaagatttctcgactgcaaatacagaaatgagacgacaaacagtagtacgtgcaaggagattaggagaagagtgagttcgtggcccaagtgtcaggcaggatcttcgtctcttcgaggccaaatgcaaccgacaggaaaaaaaaacaataaaaaaaaaacgttgacacctcccatgactggcactggcacctccagaactctagcagcgagtacaaatggcacagggtgagatggaattcccgagagtttaatagtatagccaagtactaactccaatttttctatagctaatctaatagctcatttatacaatagttacatattacgctattaatatctggtcccacctgtcatatacacactacgttttggagtccgtactgcagctgactacaaatctatagccagctgtccttctctctcctcatttattttcttgaaatatgtttgcagctggtttatagcatgctactttacctgctcttaggaagcgggtggcttccaacggtcagaatgggcaaaaaggttgggttggggaagatgagtgcgggcagaggctccggcacggggacgtgcgtgagatcgaggcatcgtcacgagctaccagcctttttctggtttgtattgtacagctactacgctagaaatgctccaaaagtctatgaaccgttggatgtatgggttgctgaggtgcgacgatgcataggaattgacaattttgttgccgattgacgcagggatgctgaaccgtaggtacatatgtacagcattcagtattttattttgtactacatctgtcaaagtatatagctgtcattctaaattgtttagtgtagattaaggtttaaggagaaacagatgatagtgtccttcattaaatggtgtatggttagttatgaaagggtggttaaagataaaataggaataaacgtggggtgatcgatggaacatgtggtaggtattctaaagtgacaactattttaaaacgaaatttgaatcctcgagagatagttattttgggacgatcgtagtactcttttcaattcaaatcaacttttatatatgagatcacgtataataaaatttgatccattttgagatgagggggaatacattgaaagcaacacatcgttatgcgtttataatacactcagtacgtgcaaaaaatggacgccattctccgacacaacaggtcaaatggctcatttagtttgaagccctatcaaaatattgtagtgtcaggcattaccaaatttgatactagttaggctaaagatgatataaattgaaatgccactaaagtactattttgaagctaccaaaatatagatagggtacaaatcatcaccaatctaaacatgtctaaaatgaactggcttacattttatcgaaatcttatacccatccatcgtataatatagcaaattaaagctaaatgggacgttacaacgaatctagacactcatccgtattacgcgacggacggagggagtataaaattttaggctttactcgctgatggctgagctgggccgaacggcaagagccggcccactgcccatgggcaacgcaatgcgtttgcagtgtgttgctagtgctgcccaaaacctctccaactaccagtctgagcttcagaaactgaaagtctgaaacctaccagctgctgatcaattcctgctctgcttcctcatcatctttttatccatccaatgcgcggacagctaccagtctttgcatcaactgaaaaaaagaaaagcattgctacttcacttctgctcgcatttcaattctgaattatcctgatccaaacggcagcggtaaaagcgaactaggagcgatcgatcgatggggagcgatgttatccaggccaagctggtgggtatgtcttaccctgaattttctgattgtttggttctttgatccttgtcagtttatctgggcatttccaatattttggtaggtacttctgggtgacttgggagccgggaagacgagcatcgtggttcgatttgccaaaggattgtactacgattgccaggcaattaaacaatacctgcttaattgttgtttaaattctcatcaagttcagtttcggactgaagattttatgcttttcaggagtcgacgatcggggcagcgttcttctcgcaggtgctgatcatggacgaggccaccgtgaagcttgacatctgggacaccgccggccaagaacgctaccacagccttgcgcccatgtactaccgcggcgcggccgccgctgtcgtcgtctacgacatctccagcacggtaattatcaaaataactagcaagtgatcttcagatgctagctgattacgcacctgctggctcatcagcagaaatggtagatttgctcatttgcagctaagcaattagtataatcacatcggtagattttcagcaactgattaagtgatatgcatatctgtgtgtcatacaggattcttacattcgagcaaggaagtgggtcgacgaactccagagacaaggtatgcctgagtgcctgacaatagtactactgccgtttcagtatcattcatatgggtctgtagcaaattagaagcaaaagtgttagttcaaattgtgattttctcttagtcttactacctgtgtaaacacagggaatccacatttggtgatggcattagtgggcaacaaggtcgacctggaagaaaagaggcaggttggaacgcaggtaaaaatgcaattcagactttcagtatctctgtatctgaagacaaaattcagaaacttttgtagggcgtctccaaaattctcatcgtctctgcttattgaaaacgcaggaggcgatggaatacgcagagcgaaacggcctcttcttcatagagacctcggccaagacgtcgcagaacgtcaccgagctcttctacgaactaggcaagcactaccgaaacaactctgtcggattcaactctctgatgcatcgtcgcctgataataacatctacgtgttgttgccagctgataggctggtcaaagtgcgacctcaccgcccttccgggatggttctccacgacggccggcgccgccgcgacgacggcggcggctggccatggcggctctgttgctccggctgatgcgcctctaccgactcccgaaatacgccatccttaatcgaaaacgtcttttactgaacccgccttggactttaaatgtccctggtagataaggcaatggatatatgctgatgaggcacgtgctgacgtgtctatgtatacagtaaactcgtacgtgtacgcgattacgcaacagcaagtcggtgcggcccaccaggccgccactccgagtccgacacgacccatcatatcgcgttcgcgagcccaagttcgagtcggacccggacaccgacagaccgacctagtccgagccctacaaatctcgcgccgccgccgctgctctgctttcttcttccaacctatttccctttcccgccgctgctctcaccgcgaaccctacgcgccgccgccgccgccgccgcggctgcgcacgtcgagcagcccgcgatggagaacgcctgcgaggccggcctgccgctgtcggtggccgtgtcggtgccgccggtgatggttgacggggagacggttccgaaggaggtggaggagtgcgaggacgaggaggaggaggaggagtacgccggggatgcgccgccgccgtggaaggtgatgggttcggatgatgagggcgagacggaggccggcgaggaggaggagattgccgaggccgacggcgaggaagaggcggcggacgtggaggaggtcgagtacgagttctacgacagcgacggcagcgaggacgagggcgacggcgaggaggttgacccggcggtggcgagcgccgcgcagttcgtgccggaagggcagtttcttgggtcggcgcagttcgccgcctacggctgcgccgccggcttcatgcgggtcgccgccgtcgaggcggacccggccgacggccaagagatcctcgtgctctaccgctacaccctcctcaagagggcatggagcgatccggcgggcgtggagctgtccatgtgggcgaaggtgtcgaagatacaccgcctccggttcatcgtcccggcctccggcgacccggcgagctcgctgccattcgccgggctatctctgtccccgctgatctaccacaacgactacgtcgaggagctcgagacgctgtggtccaagctggcggcgcaggtgcgcgtcccgccggtagccacgcgcgtccaggtgatcgtcgacgtgggcatcctcagggcgggggacaacacgccggagcgcagggagtacatgcgcgccgagctggaggccaagaaggagatgccatggccggggaagctcctcggcatggagctgcacgtgccggagccggtggtggcggcggcggcgtcgtgcaagagggacagcagcgaggaggtgttcgacgacgcgccagcgccgccggcgaagcggaggaaggtgttcgacgccggggaggagtgccccgtctgcctggacgagctcgaggacggcgtcgtggcgtggcctgggtgctctgtcgcccatgtcttccatggccaatgcttggagacaactctcaaggggagccagatgtgccctatctgcaggcgtgatcttggcctgaaaaccttgcaggagtagactgatgttgcagacttgcatttgaaacagaatgaatgaatgaattgtaggttgtagtagcagattgattgttctgcagttgtagccttcaattcgatcgatttcttgtgtgaatctggagcattcttcagagttcatacacatggttcactgtaaaatttgttccatggattatactatatatgttgtttctgttctgttcgatgctaagtataagcaatccattgtaataagagattcttggctatttgtatactgtatcatgcatgcattcaattatgactctccacttatggcttatagcaaatcaagtaacaatgtcagaagcattacttgaaattttgatttgttctttgtgtccacttagaattgaaacatatagaataagatgccaatatgcaatttcagtattcagatctccgacaaatatgtcgttaaaattcagaagtcattgtttgagccgtacttttcttatgttcaagaaagcgccatcatttagctgaaaacgccgtccacagaatcaacttggatcattagcagtttagcagcatctaaagggagaggatatttatcctctgaggggatgtctcctcgtataactccctctctctcaaatttaatatttggttatgaaaaagaaaatctaaagtcatttagcaatgtagagtgtagtaacattatcttgagagtttaaaacactttcccgcgctaccataccactcaacatttattttacataccataccactgacatccaagagaaatatcggatgttccatatcggtcacgtttctctctcgctcatttgtagaaatggtgataaaggatggcggctcccagttgtcctcctcgagacgataacaccacctctagtcctcgggacgatgatgccgcttctcctagggcacccctccccagcctttccttgcacaccttcttcctcctggcaatgccccctccctccctccctttcccctctttggcttatcaatttgttttagtcctttggccaaatctagctaaccccaacattgaggtacgagatctagttaagaaccgtcctagacagaatgagggtggcgggtagatagctccttgttggggctttccacaagcatcgcctccatcgcggtgtccctcacttctgtagggggagggggagaaggtgaagaagcaggcgacggtgatgaaggagaggccagcagaggcaataagcggatgagcatgcatcattgattggcataatagctcattggactcacggaggcgtacgtggagtttatggtgccattataagcgccatatcacagagtatgttgcccacaatatcttcttaatatcgcaattggttttgtttggattttgcatgtattagttacaatattttcagaatgttgccgtcaattttcatgttgcatgcacttttttttattgcaagagtatttatgaatgttgcatctatttgaaattactaatttttaccacctccattccaagatattgctatttaggatatgattttacttatcctagggcaatgaatctggacaccagccagattcgttgccaagaatagaaattgacctattctagcaatattttgagacgaatatagtatcaagttaacttgaatcatttctttaattaaccaagtgacgaaatatattgcctgttttggctaggatcgggcagtactgatccctaatcgcatccgtatttatttattatggataaggcatcataatggtaatggatgtgctgactacattgtatatatattctttaaggaataatcaactatttgccacttgtacaagtggttctaaaagatttgccagacccacatgtcatacacacataagggtctacatgttatagatagcgagcgacaaattcttaattaacacatcttaaaaaggccccatgaatccgaatccactttgtgtccgaaccgaaaaggaaagcgagtgcgcgctcgaattaagccacccgccctagctagctcctgtagagatcgagatcgagcgagctcgccgccggatcgctacccgcggcggcggaggaggaggcgcccgccatctcggtggtggactacgagctgaccgacgacgacgagagcggcgacgaggccgacgagccgacgaaggcgagggacggcgaggcgccggcggccagaggcgagctgccgctggtcccggcgccgttcgtcccggaaggggagttcctcggcccggcgcggttcgccaccgccgggtgcgccgccggcttcatgcgtgtcgccgtcgtcgagggcgacggcggcggcggcggccaggagatcgtggtgctctaccgctacacccgctactcggggacgtggagcgggcgaaagggcgtggaggtgtcgaggaggacgaagctgaaccgcctccggttcgtcgtctcccccgccgccggcatggcgagctcgctggcgtgggccggctcgtcgctggcgccgctgatctacccctacttcttcaggcgggagctcctggagctttggtcgagcctgatcatggcggcgccggcgagcatcgtcccgccgggagccacgcgcgtggaggtgctcgtcgccgtcggcatcctccggccgttggacaagaggccggaccggatggagtacatgcggcgcgagctgtaggccgaggcgccggcggcgtggtcgtggccggggcaccacgtcggcctggacctcaacctgccggagccggtgctgtgcgacaggggcgccaccgccggcgaagtgttgtcggaggaggagggcgacggggcgccgccgccggcgaaaagaggaggagggcggtggctggggtcgccggagaggagtgtcccgtttgcttcttccagcttgagaccgacctcgtcgcgtggcccgggtgctccgtgcgccatgtcttccatggcgagtgcttggagttcactctcgagaggagtgacaagtgctaggaaggacctggttataaaaaatttgaagggaaactgttttaaacactcaggtggacatattaaatggttataaaaaattttttaaaaaattgacatgataggttaatatgtaatatatcatctcacaaacatgcaagttcaaattcgacttctacaagctgtaacaaaaataacaaatttgactgtgaatatacatatactagttagagttaaatttgttatttttgttatagcttgtagaagtcaaatttgaattttcatgtttatgaaatgatatattacatattaacctatcttacaattttttttggaattttttcataatcatttaggtggcatgcaagaaatgggtggacatccacccgagatattaaaatccatctccaaaatttgcaggcttgagttctggagccattgatcattgatgctgctgtctcaaaatatagtaacctaaaactaagggtgcgctcgtttcagtaggtgtggtggactgattagccacacgtaaaacgagaaatgagattagcatatgattaattaagtattaatatatattttttatgaataaatttgttggatttttttaaacaacttctttatagaaagttttcgcacgaaatataccatttagcagtttgaaaaacatgctaacagaaaacgagtagaatttaatcctataagctgaaaagagcgcaacctaaatgagacacatataatagtacaatgaatctgaaccgaggtatgtctaaattcatacgagggggccaaacgacaatgaacatataaaaacattactatatgttagtattatgccaggaatctaagcttgcaatggtaaaataaaggataacaacatattatatatgtttaatttggttgcttggggggaaaacatttgcccttatatttgacctataagcgtaatcgaatgttctctttttattcattattggacaattaagtactactctctccggtttagtggaacaaacatgtatacaaaatatccaatgaaattctcaaatgcttttacaaattttgtccatcaatttaccaacaaataatggagctcaacaaagtgagtttttaaataaaggaatatcactacaactttgatctatatgaagtttagtttacgttcatttgaatggatcaagaaacagagtcctcggctcggcaaagtccttatcatgagacaagagtcctcagcttggcagtgttctcaacacaacaaccattcagaaacacggaggagggggaggcaatctcatccattcgatctaatgcagacaaatatgtgtcgttggattttaagaatgaaaaatgagtaaaaacagttggtgcattgtagggtagaagatacaattaagaaaacaggtaaaatgaaaaatggatgtgatacaaagaactatataaacttacaatcagtatatgaacaaagaatatctacgcacaatcaatatctgtctatagtttaagctctacacatgcaaggcgtaagggggttttcccagaggtcgtagtgtgggaatgtggactcagggaggccagttcgtgtctggtgagtgatcatcacatcctccacgaaagttgcccatggcatgtagggatcgccgaagaacttggacatgaggcccttgtctggcttgatagacttgagccgatgccgacccatgtagcggcggaaaccgatgatcagcttggcgaaattgccaccgtgggtcatgacgaacacgtccgatttcaggcaaaccaggaagtccaatgcagcaaggctggtcacatgcttcttgaagtgttctatctcgtctttgcttgcaagatcttcttttgtaacctataattaacgaaaaaacagagagaggagagaacagatcaattgtctgaacagattttatgctggtcagaactatctcgactatctcgactacattcaaaactatatgcaactagtatattttcccatgggttgcaacagttctcaaacaatgatagaagacacatggcataagttctagccctgcataattactcataaataaaagataaccgttctctaattcaatgaatcacatgcatgattcacaaaagaattaaatgcaacatcaaatgtttctacaaagagcacgctcgtgtttacgcagatccatctataaaagatccggtcaagtaatgagtgtgtagagacatgacactactaacatttataagtcgtagtaaagattttgcaatatgtctacattaaaggaaacacggaatgcaataaattgaaccttctagtaaagacctaaagtactgaaatgttttcccggtaaaaaaactttgaagcacttaccaaattggggaacatattccttagcggagccattctattgcttccaccataaacttgaccggatgcaacatatatctgagtttcctttgtatatcccattgcacgttaaataatacctattttcccaggc

SEQ ID NO: 45707 - DNA, 7488 bp, Oryza sativa
attgcccgttcggttcctcatccttgttgctagcttctcagccatttcttcgatttcaggtaaaaacttcaaggcatggtaattaactctgcatctgagccggttaatctccattggaacattatcatacctgaaattgcaggcttaggttacactcaatcacatcaattgatgtgaacgaaattgtaaggcatatacttaggggaggaaccgggagcaatattcactttacaacaaaagactctgatgtcaaggacagtaacagcgctaaaaagttatacaaccaatctcaagatgtatggatgaggtgcagtcatgatgataagacattaccccagcctatcaacaaatggcttgatagacattatctttttatctttgatcctcggaagtacattgtcaatgtagaactgcgccgatgcatactttggaatatttttcacagttcgcctgttataatcagcatcaaaaataaaataagttacattcatggaagactatgttccagtgttaatcaattatagatatagcacatatagtaactgctaactatgggtgaaaacacagcagatagtgatgaccaaaatagaaacatattataatcattcaacatcatgacaagaggggaaaaaaggaagaataaataaggaaaaaaatgcccataagcagtacctgtcctagtgatacaattttcctttgcccttgcacttttcggttgtataagactgttggcatcctatagtaaaataagctaattttgaccctataatacatgctaacccctacatggtttgaagtagatgcctctatagtggcatcacatatgtggacaatgcaatgtgtgaatgaaagacaactacaaaccgcaaacaagcagcggcaatcaccttgtttgcttgtctccagaattcatatgttctaggagtgtgtgcacacatcaatcttattgattgataaaagaaaagatagaaggaataagtgaaaaggaagcaactaactttatactggtgaaaagttcatctttttctgtgaaccattcaggaatatctcgaacaatgcgtacatcatccttcaagtaatttatgaaataatctacatcaaagatatcttcaaatttcctgcataaaaggacgaaagctctcaagtactaaaggacttgtacctaaaagacatgatagacacaaaagggtgtatgcaagcaggagttgatacagaaaaagaataccataattcatcacttacgtttgatctttccagatttgatcctgcttcagcacaggtaaaataagtgtggcattcattatcttagcaattgcaacagcattacatatctgcaaatacatcgagtatcgcagttaactactgattacacaacacagcttcagcaagctaataatgtgaggaaagaacatccgtacggctattcgctgctggtttaatccaccctcggcatgaataaaaatatacccagaggtttcattctctggtacaagatctgcacagcagaagagagaaaaatatctttattcatcaggatctaaccatggtttcaactttcaaaggaatgttgtaataattcctgtaagctacaaattgacaaacataaacaggcacaagcatacacagtgaaatgctgaagtgttaagcgcctcttataagagcagtcacaggacatcataaatgaaagcttaggtcttgtgggtacgagaggcttagtaaggattaaagtagtcattttttgcatcaacagagagaaatagataggtacattgcatgcaatcacagaacaggaggtacatcgttctgggtgcctaattcgcctgcgctcttataaacaatcttggtggatagttgctaaaatcatcagtttaacattagagaaataagttattcattgttcatttctccttacagacactggaaaatcatttgggccaactaaactacatctagcggtccaactagtacgtatattcagattatctttgagtaagtatttgcagggaggcagggacaaatgacaattagatgctgctcttgcctgagatctcatcactacggcgctcggcgcagggcttccaagatgccgctgcagcatgcggattctcccagagagattcccgctcgttcacctgcagagtagcaccaagccatccaaaacaatattgaaagcgaattgcgtacagatagatatccaagatacataaatacattatgagatcaacgtcactttaccctggggcagtggagccgaatcccgtccttgcggcacagatagggcgcgttctacgttccaacaacgacatgatagtaagcaaagaagttggatgagatcttgatcgaacagcaatagaaatgaagcaatcgaggaggaatcaagagctcacgatgcgtgaccagacggaaggagcggagacgagagcggcgacgaagaggcaggcgacgacggcgaccaggatccggtaggacgccgaggcggtcggcgacctgggatcctcgagcgcgaggagtgaccggagcggggaggggaggtggtacttctggtggtggagtggagcggacgagcggggcgccccgtccttgccgtccccgcctccgccgccgcgcggggaggaggaggaggccacgaagggggaggacgaggcggaggactccgcgtcgcgcttggccggcgagctcgacgcgcgcgtcgccgccgccgccgccgtggcgtgccgtagctccgccatgccgctgtcggcggtgacgggagtgtcgttggattggctccgctgcgcttcttgggccagattttctggttgcggccttacgggccaacatgccttttcgcaattccagtgaaatttggttcggatttcgcagaaacccgattttttttcttttttttttgaaccaggtcgaacctcaagcacaaaccactcgtgtttttttttgtcaactttaaaaaaactgaattttaattttttttaatcaaattcatctggatttcatgggttctgttgtgatgtgttcgctgagtcgttgggtacgcactcactcacaatagacttgtataatcggcattactaaatagcatttgataggaatttagggccaaaatcttgcttggatttggttcccgattttatgctaagactccttctccagctctgacgaccctaatgaactctggtgattagtagtggcccccaatttagggtttagggatgggggtgggggcaaggagagagaggagagttccctaggctaagaggaatgtccatgggaggcggcaaaccattggttggtgacaggacaagtgagcagtgaggccaacaaagccacgaggtcagcagcgaggcagtgggccaatgttggcgtcaatagcaaagcagagtgagtggctacaagccaggggcgtcccaacggcttgaggagaaggggaaaggaggtctagagggagagggagaaggcggaccgagggtgggtagtgacactgtggagcgatgaaggcaggagcatcgagcaagtcgcaatggggtattggggtgggaataagaagggagcagaggagggggttagggtttgagggttactacatgaatctcaaagcgatccaacagtttaaaattcatagagcatttgtagggtgtgttttttttgtcaaatggcaaatatacggtcacttcatcatttataatctttttgatgatctatacaatggtatggatgtgaaaggaacattttgattatatgctgctatggctaattttatattcaagcgagtgttgtatcacatggtttcgtgtgaaactccatattttgaatggctttcacattgtacttactgctaagcattgatcaccggtcgcttaatacacatgaggatcaggttatcacaatttagaaggggctggctaactaaggtcaaaacaggaactacgatttgcgtatttgctacaaggcctacaatgtctgattccagagttttttcctcacgatcaggactctttcatcaccggaccagagagcgtcttttttgggtttcacatcagatgaccagtcgtcccatcttaccgctggcaaaagcttcttgatgtggttgatgacagcaaccttgtctctgataatggcatacccctgaggcctcatgatgcggtccatctcaatcagcagatcctccacactgcacccttgtttctctatctcagaaaaaagaagccaggcgtgaacgagatcataggtgcgtgggtatgttgagaatgactcacaccttcaattaagaaaacagaaaataaagaaattatgccacaattgaggtagcaaatagtagttggtaccatcaaatactgcaatacaacaacaataagaaattgttttctgtgatcatggcaaagtcaatcaggcatatggaaggcattttagtagaaataggaagtaacaatagaaagtagacactgaaattaagcaatgctggagcactgggcccagatagaagataggccaaggttttaagttttatgcaatactagtaaatagagcatcttggtcacataagttaatgacaagagcaccacatgtcatttggagggatttctcatggcgagaacttcaggtgcaatcatgatgacttgataacatctctagcgacatgttttaatgtggtaactgaactataactactattaaaaccgtgtgataaatagctaccacccttcaattgttgcattactatggaaatccacaaaatcgtatgcaaattatgtctagataaaatgtaatcccctacatgaatggaagatacataatggcgctttgttaacaaagatatggtatttctaaggctggctgctaaagaacagcttgacaataggtttcatttgtcaacaataatcaaattactggtctctttcttcaatactcaacatacttcaatactttttgatattttgattgcattccaggcattaaaactattggatttgtctgccacagacaatgaaaacgtaataattttagctatgcaaagtcaacactgaaacaactggactgaactaaatctaaaggatttaggacaaaaggtttgcaaacatatcataccaattatggatggtccccaataaaccacgatcatagatgatcttcagttttccagattctgtggaaggaactacattcatcacccagacatcctttttcctcagggatgctgcaaatccaccaagatttgcattcatatccataacatttctaaatgaatccttttgtatctcagatttcatgagtttccagtactgaataactctaaaatgccaaatctcctgcaaggagtacttcaaagtcaggtactaaagaagctatcagaaaggatgtgagcacatattgcatgaaaaaatatcattggtttgttgcatagctcacactgtcatcagaaaaattgtttgaactgattccgagctcttcaagacgagggggtggtgctgtaagcctttgcggccagggaagcagattactgcccttaaccttgtggactcctggagaagtgcacacgacaagatcagaacaaggctaaattggctagaaaaacatatgtttgatagcagataaatcaaggatatgacaacgactggagttgacaattccttttaacagaaaataggtaactaacaattgcttgattaaatttccagcaccaagataacacacatatttgaaccaaacaaaattacaacagtagttctcaagctagacagcagaattctatacttcagtaaatgcaataacagacaattggttactggaaaagtactgagtgattctaggtaaagataacgaggtaaagcatttaatacatactataccaagctatactaaaaattacaaataacgagtttgaggtattctcgagagatgtccccaattaagcatgcacaattcagcttatcatctgctcttcaatcaccagtatatagccaactatgatctggtaccgccgctatgaccaggaacatgaaagagaagtgtaatctgttgaggccataaatggctggataagcaaagcctacagcgtatagcgattagcaagcatgatccaggtttaagcctattggttggcaactgggcagcccgcagcccaagtattaaaggttcggcagtggattattctcttgatataaatggttgaccgtggtacccttctaaattatcactaatgatttgaatctccaacattaagtgtgtcatgtgatgagcaaacttttgtggaaagccgatgatatagcattcaagcaaaattccataagaaagtaaggggtagtatagtagtacactatacttttcactattcattcaatcttgaggtaaatcagggaaataaacttactttccgagtaaggagttacacatgctttcatgggcacattccaagcagcatccggatcatcatcacggtcacacatatttggaagtgttcctggctctctcttcatatagcactcattagtcaatggtttgatccatatcactgtctgatcctccttagatgcaatctgccaacacattcttcgagcaagatcactcatctttctccatatgttccggttgatgggatccatagcataagcttctggcgatgaatatacgaaatacccgccaggcctcaaaaccctatcgacttccagcaacaagatcccatccctctgcagccagtcaatccgacaacgagagcagtgcgcaagctcaaatgagtggctggggtatggcagcctccttgtgcccagcacaccgagggttgacggaattcctctctcaagggcaaactgaatttggttctcgtgcacatcgttaggagcaagagacattgcaattatatcaagaggaagaaggtaggctccgaagcttgcaaccccacaaccaacatccagcacattcctgatgttccctccattgtttagcttaccattcggaaaattcagcatctgcaccacacatccacaccaaacaacaatgatgtcatcggattcaaaggtaacaaaacatggtaattagctgttagatcatcctgaacctgagcaaggtgcacaatgtacttgtcagcaccagtgtggaagtgggtacccccaccggggaagttgatcttgtcaccattcaccaccatccaccgctgatcggacttctcagaggcaaggtgggtgtgtggtatgttagccttccacacctcgtcccggctcctcggccacctgatgggcacctgaacattgaaacatcacaccaacatttaccaaataaacaacaaacaatgcacagcacaacaagtgatggattcatcgatcatatcatgtatggtctccatggtcggatcggatgtatgttgtctcacccggtagccggcgggtggcgggatgaggcagttgaggcggcggtgcgcgggtgggcagtggcgctcgtagtgctgcatgagggagaggttgagcctgaggcggagctggttgtggaggccacggtccaggc

SEQ ID NO: 45708 - DNA, 1884 bp, Oryza sativa
gatccatgcactgaatggatatactccctccgatagattttagatagacaacatctgttgacattagtagtaatatgaggtgttccttaaatctaaaatctcttatgctttatggcgattacgcaacaattttgatcgtctgcttttatgatcaatggttcacactaaatattatagtaccatttttgtgaacagtgctttatataaaatattatacgtctcattatctcatgcgtgcatgtgaaacttgattcaattatataaataaaaatgtgtagcgacgattagtcactaattcttaataatattctaaacctagtccaatagagatatcattgttgcattatcgtatccgccgaagagtttattcgaaaataagattgaaccatgaatctctatacaatccaaaggttggggatttaattagtagtatgtgatgtatttacaattatgtataagatattacacaagaaaataatttgttagttttgtaaaaataaaatccatagtccaatctttacacaacaatggcaacaaaacactcaagaaaggcaataggcataggagtgggcagaaaaagactaaaccgaaaagatcaagactgagaccgaaaagactgagatcgagaaattcggtccagacaatgaaagaccgaatttcagttcggccaattcagttagtctcctcggttaaccaaatagaccgaataacaaaaaaaaagtctaaatgcaacctacaatccactgagttcaatatgattaaactatagttttcacatccctacttcttctaggcatgcaacctaataagagtctttattcatacgtgcttacgaattttttttgtgatttttgtgttgaaaatttctattatttctttgcatatatgaactattgttgaatttcggtcaggaccgagaccgagaccgaatttatcggtcctgatatttttgttttgaaattcgatttaactttttaaagactgaaagattgaagttcaagaccgattttcggtcagaaccggatgtcccctccctaaataggcatcattacccataacaaattcacacaacacgggtcgtgccatagacacgaaacgctagccaccacgccaagcgcccaaccccaactccaactccaacccgtcgtgctcaccgagaaaggcgaaattgaaaaccaccccaacccgagaaaattgcatatctaccatcgcataagattggcttcgcagaaataccatcacttaaatcggcttcgctagaataccactcccaactagaacggcttcgccaaaatgccattttggacaaaaatgaccctgcatctatctcttccacctccggcacgagcaaacgacaatggtgcgcggcgcggtagcggcaggtgagatgaggagcgaacgacggtggtcttctccggcgagttcgtccgcctcacctagcctcgcggcccccaacgccttcagtctccgcgacacgccgcctccgtcgccgacgagttcgacgaatcatccccattgccagtgagttcatctgttgcctcgacacaccacccccatcctcaacgagttcttccgccgcacctcaacgcgtcacccctatcgctggtgagttcgtccgctccgcttccgtcaccgatgagtttggccccatcaacgttgatgacgtcggctatggcctcctcttagcgcggcaggcatgatgaaaaggtggggacgacgaggagggcagcgcccccatcgtcgccgacaaggtggcactggtggctgccgacgagctcctccaacattggcattggaggaagggagaagaaccagggttatttttgtccaaaatgtcattttggcaaagccgttctagttgggagtggtattctagcgaagccg

SEQ ID NO: 45709 - DNA, 5917 bp, Oryza sativa
gccgccgccgccgggcacctccctgtacgcctcctaccgccaccacgcctaccctcctcacccgccgccgccgcccgcgtacgtcggcgcgtactacgaccacgcggcggagccactgccgccgcgcgacgagctccgcacgctcttcatcgcgggcctccccggcgacgccaaggcccgcgaggtctacaacctcttccgcgacttccccggctatgtctcctcccacctccgcacctccggcaaatcctcgcaggtttccccactcttctctcctcaccccccaacccttcaatctcccctgtgctagggtaattgggtttgcaaacttgtacgtattccttctctcgaacagtatggtgagtagcacaaaccctgactgtttctgcgttgcaggcatatgcgttcgctgtctttgcagatcaaccttctgccttagctgcaatgagtgccacaaacgtaagagctcgcttcagcattatcaggtttctagtagtattaggttatgcttttctgacaaaccattactcctaacgaggttatctacatcagaagttacagctataaataatctgtttagagttctcaatggttgccatttctgtggattgtttcttgctgcagggaaggatatttgaccttgagaataattgcacactgcatgtagatcttgcgaaatctaattcaagatcaaagcgctccagaacaggtgggcgattagcctgcaccttgcaatctttgttcctactgccacatattgtggttattgtgtatcagtattgttgattgcacccttttacttcaacagatgatgttccgtcttattcctctgagaaaaaagctagaaatccgaggggatttcctgattcaggtatcattcaagttgacaggagctagtacctgcaatttttttgaacagttcgttgtatacaccatgttgatctatccactaggacctgttccatcgtagtcacatgagcaatagcagaccattccaaatccacagtttccacatccatcagattgatgaaaatggtttccctctctactaagggatacagttgatcctgagttcctataactttttcctagaattttctgtgttcatatcctaaccatgacttcatatccactcacgttgatgaacattcttgcaaaacactcaccttgcacatctttggcacactttgcgccctatcaggtgctggaagcaatattcacatgtctggaatgggtaattcttcacacagcttgaatggttatccttctgcacaaaggttatggcgcactacttgagcacagtttaattatgtgttttttaggaaaatcagcttaagatgtccagcagctggtgttagaaaagagatatccaatactattgctgatattactcctagaaatattttaattctaatcaagatcattttcaacttgcagttacacgaactttgagcctgctgctttcagcaaggtgagttttgtttgtgcatcttgatatatttgtccttgtctagcatcagtgttggtttatttctatacaaatatgttgtttgataaatgtttgcagtatctgagatggaaaattggaaactacgaacaattgcagcaaagcttaatattattaccatcttatgacatatatcacatttgcaaagctgtttgaatggttttagttaattccatttgtatatggaaaaaagagggctagcacatttataatattattgtaccacaagtcagttctgctttcagagttttactactagtacattatcttcaaggtagaattctattaatcttgtatagtaggtaaatctattaacttagtcacaacaatggtagtttaactagtattataaagtgcgattgagttacaaaagactaaagcgaatgacttcaatggcgtaactggtactgcaaagtatagccacagggattgggggctgccctcatgatccatgaccttgatgaggcatctcaaatcatgggtcactaccagggcacacctgcttccactctccatgagagcacctgatggttggccactggatctttgtgcgtgtgggttgttgcccttggagagactgctgcctattgctggtggttggccattaatttgttgcttgttgccagtcccaccattgccaccattgcagctcatctgcttgacgatgaggagcagcagcagacgcatgagatggttatggagaggggagcatgagaggaggttgaggagatgactaggtgtgtgcagctgtggaggaaggggaggcagtggaggctactttgtgaattgtggacgcatgttgacttgtaagttggagttgcggggctagaagatagtgtgctatgtgagatgttgggttcaagtgggatattgggctgaaccaggtcatctatcttctcatctcctttctctctgatttatgtgtgctttatgtggctgggctgtaatattctgagggatcgccttcccttcttctttcattcttattttacaaacttggtttggttgcatatagcaactaattgtgcaattgaataaatggctcggattcattgggatcattatgaacaaggcattcgatcttgactcatggagtgagccatattatacagctgatcttattggatggaaaactaaatgaagtaacccatggttttactttacataaataaaaagatcagaaaacagcacaattgatttctgttgttgctaaatatcaaatatctatattttggtaggcttattggagagtatgtaatgcttactcccttttgcatgtccatttacctgcaggacccagcagcgtttgcccctcaaaacaatcctccttgccctacactctttgttgctaaccttggtccaacttgctctgagcaagagctaatagatgttttctcaaggtatttccaatataacaattcatgatgtgagataaataaataaacatattttttttacaagtttcttctcatggttagttgcgcgggattcataaaggtgaagatgcaaaacaagtttggagctccagttgcatttgtggatttcaaggtatatcaagtaaactattctgctgcttattattaattgtctaggtctctagctattatgttggtctattgtggagagctatctgccttttgaaatctgtggtaaatcttcagataatggatgcccatttcacttttcgttaaaaaggaaaacatcgggtagaagtcaaaacaaagtaaacaagaaaataaacgctcttgatttcatcagtggtgagataacatgaaactatgatgatacacttacagagacagacagtctgtaaagttgattcttttctgtaggttaaatctagtttatattcttttgtttcatgtgtttcagatatcaaaaaaatgatttcttgataaattttactagttaaccctaatatttgtggtgtgaccacgggaatctgttgcgaacattattaacaaagtcatatctgtattttttttctatgtaagtgttttttgtatccataaattctatagaccagacaaccaactgctgcatacacaggcatcagtaaagatagtcgaattaggggttcttgtttgttgccacatttaacatgcaatggagatatgtgttttgaaagatactattgtttctgtacttgcattttcctatagagtggatccttaagcattttcattaccgatgatttcaatatgtttgaatttattttcaaagttaatcccaaactggagttgctgcctgcaggatatggacagttcaactgaagccataaaccgtctccaaggagttattttgtattcatcaactggcgaggggatgcgtttagagtatcctacatttagggattatttaaatttcctgctattatatctctcttcaaattcttcttgcagggtgtatttggagcttatagcagaagctaaatgcgatctctacttcctgaccatgcctttttaacttattgatatagctccttaacatctatcagatatgccaaatctcggatgggcctgcgtaagcaggataagcgccaatagatatgatagacgaggctgcagttgtttctcatacagcgcaactggcagtggagcatgatgtttcctgactggtcttccaagtgctgtttagtctgatgacacaatgttttgttcagtgaaatgttttgctcatgatgttaggttatggtgcatcggtggtctttcagttccataacattttgtaattgggtttggtaacttaagctgtacctgtgtagttgtcttaccttctggttcttttcaaccctatactttctaggctgttcattagctactgttgaagtcagcatacccatgtaatcatgttcaaacttcaaacaatcaaactagttgtaacttttgaaagatcaaatggttcggtgccaaattaactgtacttggtcattaatgacaacatggtgcctggtccaattgggggttatcattgggaaaccttaatgagtgtaccatgggtggtgactgtccaatatttaaggacatcattatgacattatgtgtttgatacggatggtttggttgtatggatgatgtatgccctcatcaggccgacggccgtagagactcctgcaggcaggtgttgatgcttcttctcactgttgtctgcgtttcaagtacataatgaaagggtatatctacctttctggtacgtttatccaatgctagctcatttgctaatctgatttgccttagactattagactaaccaacgaaatgcagagctcaaatgacacctctgcctttcaggtgcactgtcttctttacgctagtacattatagtatataacagctgtgactgggaagcaaagtagttgctcatattgattgatttgttcggcatataggggatattttgggtgcgtgtaacaatgtgaaacagaaagcgaacctaaaaaggcatgcactggagctgcttctcttatcctttactgtaaacgctgaaacatcatcttggtgcattttggctatttgcaggatgacctaccatccgaatacaaagtgctatatctaacagtgatggttctgctcagctgtactgtatctttctttctcgagatagtgtcataacttgcagttgctcgagaggtgataccctttatcaacaaggaaagctatgggcactgaggtttagaactctttaccagttttaagttgaaagttctgcgagagcatggtcggttgtcaattatttgtgctcgcttgcacacccaccatcaacttgagtaaaattccagaggtcatcaattcattagtggggagggtagaaatataaattcagaatacctctattttgatggatcgtagtactgatccgtcttcaattcatgagggggatgtgccccagctagtacagagcttcaataaagagttgaaatgtacagtaactttctgatgtccagcagcaactgcaacgtgctggtgatgtgcgagtgcgacagtatgagtagtgggaacaatgtggtatactagtacttcaattatggtttgcagtgatcagtctcattgtttgcttcattttagcatgctgttactgctctaactcaactgtttcttgtaaaatttagcactgtagatagggcttgcaacgaaaacttaatttttatagggaaattaaaaaaattgagggaaaacgaacactgaatcactgattcgccctgacagctatgttttgcagcttactggctgtttagcacctgttggaatctgtttgtacttggctgtgaacttgtagacagtaattatatacttttgtaccgtatttagtctgagaaggtccagcattcgtcaaatggaagcatctcagatgtttgccttttgccttccaggtgagctagctcaagctttaatccatcctctgaagccaacc

SEQ ID NO: 45710 - DNA, 18455 bp, Oryza sativa
ttacattagcatttttgtttgcaggcaccgcgtggcaaacattcttgggaagccaccttaaactatgctcgtcaatgtcaagagaccaagaccatgctttcaccttcagacttcagatgtaatcaacacttgccaaactgctgctaatgatgctttgatagtacaaagattctgtctgaataatttacaacaggtactgtatactaattaccaatgctacaacattctaggttagagtaaactaacaacaaaacaaatctttaggtgcttcctgtctgttgctctctcttaagcttatcttacaattgtttcattctagattgttcagataaactaatgtcaatgctacaagaatccatgcaaagaaataagtgaccccaaaagaaaaataaatcaaatgcttcatttcatcaggatggcatggcatctgagtgcacattggcatcttgtgttctctgcatcttgcattgcccgaggcttcacttaaactctttattaaaggcgatggatgcagagatggatatagatggatggcttggacatgtcaggtccgtgacttaaattccaagcgtattctgataacatctccccatctaacaacatttaaggcacatgatttggagatttttgtcaaacatttttggcaccaaatctgataatagctcacaactttcttgctgactttaggtgatatcataagcccttttctctgattgacttgagatatataattgtcctattacgtccatctttttggctactaatttgtagattcatcttgagcagcaatgcaaatgcaaccaccctaagccttcctagcccagtggttagcggttgcccggccaatctgaagctgatttgtacagcaaaagcatgcgagatggtacgttccatgtctgatgaggtgaagtgctgccttgctcgcttcttcagataatgacctcgtttaatgaggcgatctgacagtgactcgcgtagggagggcactaaatagcatgacggtgcactaccgctccttcagaaaatgactttgtttagattcatgaacattcttctattatttctattctgttccaatcttatgttttttctttgctgcaaccaaacactaatttcttttctttgggggaaattgggaatccatatcgcttccattgtgttttttctattcttgtctttcaaaaacgcccatgattcagaaagaactctactttctgaaaagaattctgttgcaaccctgtttttcctatgttacaaccgaacatctgtttgtgatttttttttctttaagaaaattcggaatccatataactattcctgtattattcatgtgttgtggccaagcatctcttttgaggttttcctatgtttttctcttttgaagattcatgtggcagtcttgtcattggcaggactagaaactggccggcggaggggcgtcggtcggatgtggcggaagccatgtgccgccgatgtttagatggtggacttagattgggcgacgaaccacggcggtaggggttccgagtgaaagcttagcccaatcctttgggctaacagtgactacgccttcgggcgtggtaaccctcctgaaggcattgttgaggtacccctccctcggcgaggagcactgggtgaaaactagtccagttctttggacggatgacgattgcgtctttcgccgttgcgaccctcgtgagggcgttgtttttgtgttttcgtgtcgtggtgatgttgttggctcggtggcgatcggtctcgcatagcgatggccggttcggtgcttggcttcctctctgtagcgtgtgtttggacggttggcacatggttcaaccgttcagggcgtgtgttctagtgcacatccttgtaaaacttttcttgtaaccttttttcttctatcttaattatattgaatgatctccttcagtcattccggcaaaagaaagatttctactttacggaggaggtttaagatacgatttttaggcggcaattaatctgctgttgcgtcctgtagcgatgatgctgctgcactggtttcccctttgattgtttggcattgattaagtttagctgcttggtcgtgtgactcatcacattgtgcaaccgtggcccgaaaggacgacagaaagcgatggcttgtcttggcttcatccactttttccattgaactaactatagtaccagcgatctccacagtaataatatcatacgaccaaactgacttgcctgtattatactactaacatttggttgacttggggcttggaaccgcggtaagatcgttgacattaaagattagcaaaagctaagctacaaactgtaacaactttccatcttttgatacacaaaagaaatactgaaaacttaacttatctgtaagtttacatttttaaatcgaaataaatacccccatatgttttatttaaccacaaaaatctgaaatagtttaattagcaggcaggcagcttagttcaggccccatttttgtccgattgagatgcatattttacattagtttcattagcacgtttgtcatcaaacagtaaaatggtcacatttcatgcaaaaaaaaattcctatatagaagttgatctaaactatcagataaatttattttttaagtttgctataagtaaaactcaactaattttatgctaatgactttcttattttatttttctaactttattttttatttttaagtagaatcgaataccacctcagcctgattaatcggagataatgagtctacgaatttgccaaacccaggagaagagaagaaaagaagagggagaagaaaagaaaagaagagaaaacgcagcagagtcacgtacgaaaacgaagagcggccaccgcaaatcccggcgggattaattcgcccttttacctacccaccccaacccaacccatcttcttcttcctcctctcctcctccacctcttctctcccttcctccacttcacccatctctccccacctccacctccatatctatccacttctcactctctcacactctcactagctaggagcactccactccaatttactactagtatctctctctctccaactaccgccattgccttcttggcaagctcggttttcttgcggagatgaaggggctcagtgggccgaagctgctggtggtccacccgtcgtcgaacaagccgctgggtggcgccgcgtcaccggcgatggcggtccttggctcccgccgccggatgtgggtggtgctgttcttggccgggttcgcctgcgtgtcgctcggcacgatgctgtgcgccgcgcgcgaccacccgccgccgcccgtcgccgcgaggaggctggcggcggcggaggcgcaggcggcgacgctcgcagtgtcggcgcggggtggcggtgcgggtggaggtgggggtgggttgccggggtacgtgttcgacgcgctggtgcagtacgcgtcggcgggggggaactcgacggcgagcatgccgggcggcgacgtgcgcgccatcgcggcggtggtgaagcggcgggcgccgtgcaacttcctggtgttcgggctcggcggggagacgccgctgtggcgggcgctcaaccacggcggccgcaccgtgttcctcgacgagaaccagtactacgtgtcccacctggagggacggcacccgggcctcgaggcctacgacgtcgtctacaccaccaccgtccgcgagttccccgacctcctcgacgccgcccgcgccgcccgctccgccgagtgccgccccgtccagaacctcctttactccgactgccgcctcgctatcaacgacctccccaaccagctctacgacgtcgcctgggacatcatcctcgtcgacggccctcgcgggtaacaaccaaacagatctaatccttcttcttcttcttgcaatcgattctcctcaccgataatgatgcaggtacacggcggcgtcgccggggaggatgtcggcgatattcacggcgggggtgatggcgaggtcgagggcggagaagggggcggagacggacgtgctggtgcacgactacgagagggaggtggagagggcgtgctcgagggagttcctctgcgaggagaatcgcgtggaggaaaccagcaccaggtcgctcgcccacttcgtcgtccccggcggccgcgacctccgccgggaaaccttctgcgccggcggcggcggcagcggcgcctcgacatagatttttctccctttttttactcacttggtagtttttttttttactcccatcttttgatggctaatgatgatgtcggtggccatggcccaatgagtgagagtgaacataagaacaagagaaagctgaaagcctgtaaaaaaatcggcgagatgcgaagcagcacataaaaatgtgtccatggcgttcatcttcgcttctctttctgtctcttttcttcacgttgagccacaaaaatacaaggtccagctgaaaacacaaagggccacaaaaacatttggtacacaacacaagaaaacataaactccgatttatcgacatctgctgcaactagtgggatgatagtaaaggtgagtgcgagagtggcgatatgaatggcgctgcatgcagctgctgccatatttggtgagggcgctggggcctcgctgccgtgccgtccatggtggccatgactggctgtggctggctggatggatggatgactggccagccacagtgccactcctcccaactgacgccctgtgttgggtgggagcagcgagacagcatggtgacacactgccacagtgccacgccccgtcggctgttgcctcgtcgcctctgctgctgctgcagcagcggttgcagcctgacgcgacgcgcacgttgccgggcgccgctgcggctgcggcgagggtcgcaactggctcggtggatgggactgcgtggatttggctgcaacgaggcaacgacgagggggatgttgttaacttgtttggcctgtgtgattaaccttgtcataatccataactgagttctgattgattgtcgtgttctgttctgtgtaacaaagttaggcagaaagctgtgttgcatgtctgaaatttttaggcttcaaaacaagatagcatttattatactgtgtgatgtgttggcattggatgctgcctcccaatgccaagtacccatatcctcgattgctctgagctcgagtcgatggttccacacttccacatgtactactgtaccgctcgatggcatactggtggcacccatggcgccaatgatacggtacaaaggtatgcgcactgttttgatggcttcacgccctgctttatttcttgttttgtacccctagaaccgtagaaaagcctagtagatgcatgatctcataaattgcccggcactaccttatatccatactttgtgtgtgcataattatgtttaactactacgaacattatacacaaaatagcggtgtcaacctgcacgccgccgcaggtgttagtcctgcctctgagaataccacgtgaatttccaaatgcaagttatgcaaaggtggtgaggatcaagaagaatacccattgattgaaacagtcaacatgtgaagttacaaaagctagtaggcaaccatcacaaaaatatttgccatgttttcacgaatctgacaagcacaattggaaatacatcgagcagggcatgcatgtagcgtcacgaaaaacttcgataaagagcagactgcaaataacctactcctaaatttaaaccacacgagcgacgaagctaaacaaacgtggcgtagattgattaccgcctcctcatgccccttccaccacggccccgcatcgctcctccgccacggccagccatcgcgctagcagccgcatcaccttgcgcactttcagactacagcaaagaagataacccggtcagacgaagtgatgcctattgtagcagcgatatgcatacggcaacttgcaccaaattgtgaggatggaaatgaatgactggctgaaacatctttttcactgtggcatcacaaaaggtgaataataccacaaattgtaagttcattaactagaagagattcaggtatttaaatttgtcattcgcttacagagcatactttacagtattgcctaaaaccatatgtacacaccctgaggtatgattcacttagacgtctaaaatgacgttactaaacaattattagtgaaaaagtagaagaatgaaccccatcacaaaaggatggcatggctatctttttttccttgttcaagttacaagcggaaacaatgtcatgttcctagaacaagcacacggtgtggcgcaattggcaaaggggaaaatagataatactggccaacggagaatttagatgcatttggcagagaagcgaaggatggtcaggttttattatgacagatgagaagaatcgatagtactttctttaccttgggatttttaactgtctcatccacgctgagaataaggcaagcagcttcagttgcagcatttatagcattgatctggaaatatttattttataccatcaacataacaatagggatatttaaagagttactgaaaaggagaagcaccattaccttcacaacagcaggttcccagacaaagttagcaaaggaatcagcaattccaccagtgttgatgtccacaccaaaattagcaccttcacctgttaacagtgaaccgagaataagagaagttcaccatatgagttcatataatgttacagttccacattggcttgaatgaattgaaacttttcaacagaaactaactattgaacctaagatacaggtaactaaccagatgcatgtttctgtcggagcttattgagtacatcagttgcatcaaatccagcattgtcacaaagttgtcttggaataacctgtagaagagttaatttcaactgagcaaatttgtatacttgcaaagctttgatctataagatttgaaacaacattgagcaaaagtgtaaaaccaacataagcttagtgccgttttagtgctagtcaaaaactgcagtgcttgatgaacataacctcaaaagacacaatagaacttcccattgaaaccaacggtagctcaccacaaggactggctgaacattaatgtttgttttaatgctacaagctactagagattatgccttgtcgatcacatcagggctgaaaactgaacctaatatttattaatccaacactctccaaaagaagaggacatattctatagtgaactcagggtctggttagcaacgccaaatacccaacattaacataacaacataagtgcaatttagttacagttacagttacagcatggaaggcattattcatagttaaattccccaacaatcacatcacacaaacaaagctcaattgttattctgattgcacaagtgataacaaagccttaaggaaccagcaattgcaaaaaaataaaaaaagttggattaaacaaagtactccatactatgaataaacaatggggaagaatgaagccaaggatgtacctcgagggctttagcaaatgagtttacgaagaattgagacttcccagctatggtacgtgcatgctgtctgaggtacttgcttatttccatctaatacccaaaaaaaattacagattagtacattaatatacgtggaaaattgcactgcttagtttaagctggtcatgcatacatcaatagcaccaccaccaggtacaactgttgagttcttaagagctcttctaacaatcatgatggcatcgtggaggctcctttctgcttcctcgatgaactgataacattaacagcagcattagtatatcatgattagttggaaaacttagcaaatcatatatagctgtagagcacctgatctgcaccaccacgaaggactatggttgctgtttgaccagaagggcaaccactaaatatattgaaccgttcattgcccacttgcctttcctcgaaaacttcgcaagtaccaagtaccttttcagcagaaaggaccatcatacattagtgtgcttatttgttgccaaaatagctaaccgatgcaaacatgtgtactatgactcaaaacatgaaaatttgaaaacatgattacctcatcaatgacattattcactgatgtctgaacggtaccacctgttgctgctgcaacacgttgtaaatcctcttctgcaacacggccagcacagaaaatgtcccggtctgcaaaatactggataaaagaaagtttttgagcttaggctacagtgctacacaaaaactaattgagagaacaggatgagttgcaacgagaatgcatacctgtgttgcaagatcaccaattgccaaccgagaaaggactatctttgccccacttttgacacatttatccaacttgtcataaatgatattccattcagcatcgacgattgattggtattgtaaagggtcagacaatctaaataaatgagactacagtaagaaataggggaagaacagagagtgcatgcaaatatgaatacagatcaagataacactacaagtgcttggattgtgctagtacctgatttctgcattttctttctcagatttcaattctagttctatgttcagcaaaagaatctttggactcaagaacttctttggctgttgctcaaatccagcataggaaaatgtcttcttgaaggcaacaccgttaacaaggaaggaatctctcatggtgcctccaggaacctaataagtacaaaatttagacatcctgattcataatgaaatttagatgctaaacatctattgaatggaaactggtttttgatcagtacaaatgtactatagtcatcatgcactcgatgatttaacacaaagctgtgtaccaatatcttgagaaattaccttttttattccaagaaggttaagtctgtcatcattgctaatggcaagaacagcatccacaaccatagatgcaaaaaattctttctcgccacctatcaactttgatgagagtgttgttgcagcacacttggctagcaattccttcttttcctcaaggcttttcccttcaatgctagtggccaagtctttgaccttttcaattgcctgatgattatttcatgtgagttagaaaggaatggagcaagtgggagggtgtatagagaggagaagaaaggcaagcatcctaaccaaatggccagcagtcctataactgcgaattagactatgcggatgtactccgtcctcaatgtaaggttttgcttctttcaggaactcagcagcaagaagcaccactgtggtagttccatcaccaacctgaaggaaacaagaggggtaagatacagcttactttcaagtgtatgttacaggctgcaagtatacaactaaaactggtggcagatgataaaacaagattaaattgataatcactatgaatacacaagcatcagcctaaacactaattatgccacacagcagcttatgaaagagcatcatcttgatccaatgcaacacgagcaaatcacaagcctttcatgacctaattaacagaattgtcttttttcccgtgggtcaggtcattgtatgaaatgagatgcgaaatttgaacataagtaatctgtttgatctaaaaacactaaggctatccaaacacatttttcatgaatccaaacatcacatatcagtaaaccacgggtaacaggggcaaagcaacgtgatccggaaggaacaagcagcacatccacggatcaccagataacttcatttcactcgtttaagtacttaacaaatcactcacacacacacacaaaaaaataacagatcatcgattcagatctctaccctatgcatcttgtggcacggcatattcactgaagcattgttccaaatcgcgcaaaacagtcttatgtagtaggacagctgcacactccaacgaggttctactgccaagcgcgcgcgcgccgccggggggggggggggggggctcgccagggttttacctcggagtcctgggacttggcgatgtccacgaggatcttggcggcggggtggatgatttcgaggaggcgcatgatggtggcgccgtcgttggagatggtggtgccgcccttgtcgtggtggatgagcttgtccatgccgcgtggccccagcgtggtgcgcaccgtgtccgccaccaccgtgcacgcgttgatgttgctcaccacctgccgcgcccctgcgacgtgtccgtcccctccttcagcaggatgatctgcggttgctgcaaaatccccccacaaaaaaccccaaaccacaaatcacgccagtgattcaaaacctcgcggggaggggagcagaggtcgcgtcaatggagactgggatagtggtgcttaccatcatggacgccatggcgaggagctcgcggtttcggggggatttggtggcggggagatggagatctgaggtggcggcggagggggagggggagggggaggagagcagcgagggtttttctcgatcgctcgttttgagagggcggcggcggcgcggggaaggcgagagttctaggaggccccccgggtgccgaatgaccttgcccttggaatgtttgcttgcatcctagccgtccatccttggaacgctataaagtagtacggagtagcagcttggacagtttctacaaaaccccttgataggctcggttattttctgttcaccgtttgccttgtttgtttttttaactggaacatgaataccccgtcgtgttgctgctggaaactaagttgtatagtatgtacaataagctatattatattttgtaagccaaaataaaatgacttcctatgttttatataattaacacatgactgcaaatataatgcaaggtgaacatatttttgatacttatgaattttgaataaaaacagctgaggttgtatggttttatgagagaagaatgaagagattatttgtaccatagatttattatttaaagactacaaataattggaattatgtggcttcatgagagaatagagaaattagcattaactatacttagtggggatgaacaatacaaatatagacaaaaaactgggattgtatggtttcacgagagaataaagaagagactagttgtagcatagatctatcatccaaaggctaaaaataattgggatgatgtggtttcataagagaagagagaaatagcattaactacacacttagtggggatgaactatataaatatacaagattaagtattagcctttttgttgaaaaatagattaatatgattttttaaatcaacttttgtgtagattttttttgcaaaaaatgcactgtttaataatttggtaaacgtgcacgcggaaaacgagggaagtgagttgggaacctgcaggaacgaacgcatccttagtcagatgtgtcctatatgagagaaaattctatttatgggcggataaaaaaaatgaggagctgaacaaactatataaaattataaccctcttctaaaagcatgtttaataggctaacatggaccggcgatagcgtgaccacgtcgatctcattgctatgttggaggagacaatggtagagagagaacgcgagctgacaatagaattatcgcccggttgcagcacactgtacaatgaaaaaagagaaacgagtcttatggagatcatagagattgattcatgcttggaacaactataaaggatgcaataattagtaggatctatatcaattaaaaaatatatcagttttcatatttacaacaccagcatagttttataaatctataattgaataagttttcataatatatttatatgaggttaaaaatattactaatttttttcaataaaattagtcaatcttaggagtagtttaactttaaccaaagttaaaacatcttataacctgaaacggagggagtaccattgttatatggacaatctatactaacaagctataaatgacgtagatgtgttacaactagcaagttgacaacatttataaatccgctctaatggatgtatgaaaaataaaattaataaggtgtaatggggacacccgtagttaccacgtcggcaatagaggctcagagacccattcgtatggcagatccacgtagttacccgtagttaccacgtcgtcccatggcagatccaacaccattcgtatgaatggctaccatatttttttctttcacaattcgaaaagataatccacgtattcacgaacccgtccaatccacgctcgccgcgcccggcaatcgcgtggcgcgtgtgacgagttcggagttcggttaatgtcaacgacgagttgggcagccacgcagcagcgagagcagcgtcgcgtggattccagccaaacccctcctcctctggtctccagtggcgtaacgacgagattcgtcctcctctcctccgagtaaaagaaggagaccccctttgcttcgctgttaccgcacagtgaggccacgtcgtagggtttttgcttgcttctcccggctgcaaagcggagccgcggcgcggcccggggacgaggagggaggggagccatggagatcgggcagcatccggcgagcggctactccaaggagcaccagaagacctaccaggagtggttcgccttcgccgactcaggtccgatcccaatcccaatcaccctggctgcttcgccccctttgatccctgttccccttccgctgtttggtggtatctgatgattgatggtttgttcgtgattcgttcggttaatcggcggcgcgcgcagatggcgacgggcgcatcacggggcccgacgccatcaagttcttcgccatgtccaagctcccccgcgccgacctcaagcaggtgccaagtctactgtttccccaatcctcttatttattactgtagagttgtgtgtactgacttcgtgaaatccgcgtcgcctctcaaggtttgggcaatcgcggactccaagcggcaggggtacttaggtttcagcgaattcgtcacggcaatgcaggttttcctccccttttcgatgccttggttgtactccgtgctgccatcagaagtgtatggctttattaattagtgatgggtttgtcgcaattgatagcttgtctctctggcgcaagcgggggatgagatcactcaagacagccttaagcgcgatggttgttattactagccaccaagtactaagcttctttgatgagtttgtatttactagtactaattatagtttacactgatttctgacagacttgggcagcctgaatcctccaacgatggatggtttggatgctctacttgtggtaagtctactatgcgtctatgcctcagtcagattcattaagttgtgctgcacaacacaaccggataatagtgtgatgattaattgctttacagaaatcaaagcatcatgctaagagagttgatccagatatcgatggtaaggaatgcacccttcaataggaaatcatgctgggaaaattagctatgtcataggacaaacaatttatatttgtgcaatcatgcaggatttcctcaggctcaatctcctgcaacgagccaatggttcagctcaaagtcctcaaagaaggtaatgttcgtgttatttatttttctttccttttgtgttctgaacaatagatacctacatgaaccttgaagctcttgcaaaattttggtgagttcaatttgcattacattcatattttgataacatgttgcaattttaaaaaggaaagtaaggcaagtaaggagtttgctgctgagttatttgagcggtgaagacatcaagttaagctttgacatgcaatttattgaactacgaagcaacagtacagaaaccttgattcaatgtcttaagatgaagtcgtgttgtttaaagatttaccccttatgtttttttttcacaggactgcgtcctctaaaactttgtctttaataatgttcacaaagaggcaattattaaggcctttgccctatacaaaccattgatgccagatgataaactgataaagaagttcctttctttaatgagacacatatcacttatgctgactttgtttgtggtgttctatatgtgcagatacccctgaatgctgttacttctgtcattgatgggttaaaaaaactatacatcgaaaaattaaagcctttggaagttacatacaaattcaatgattttgtatctccattactggtacatacttatatattctcattatctggtttcttattagctataaacatctaatttcttttgtttctctgttccttgttgttttccctgcttatggtatggtttaaagtaaattacttgcatgaataacaatatctatttcttcccttttgcagacaaatagtgattttgatgcaaagccaatggttatgcttttaggtcaatattctacagggaaaacaacttttataaaacatctgctcagaacaagctatccaggtttttatttagtattttctatatttatttttctgtagttttccagattaatttaggtagcatgtgcttgacagttgatatgcacttgcaggtgcccatattggaccagagccaacaactgacagatttgttgttgtcatggtaaactctagtctgcgcaattcttgcaaatgatttgttaaggaagtttgctacaacaactattggaagagctatcttgcatttttaaaatgaataagacgctatttcaatttctatatttcaatgctgataattggtttcacatgctttacgtttgaggctttgagccagtccaaagtggtagaatatttgtcagtcttttactttcctttttctttttagtttccatggctaataagagttagaacaagtagctcagtctttgccttcttttacttcaataatggtatttttatgtcggatgtatggattttgccattcattgaccctttgttaatgatagcttctaaaaaatgtcggctatctactctattgaatgctagcatggtgacactgttcaggcaccatcttatcaaaatttcctctgaattggttagctgaccatttgttcagtttctgttgtggttactacttttagggtttgttggctagtatagaagaagcataacacacccatcactatttagcataattttttcttagcttttgaacaaattcatttttagcttttactacaatggattgatgtgagcgagtgcaatgtaaacaatttgaatttccacttgcctagctggtgtgttgatgggtatattctatctgtacttctctattactacttactccagttaactttcttctccctatactagtcaggaccagatgaaaggactattcctgggaataccatagctgtgcaagcagacatgcctttcagtggtcttacaacatttggaactgcttttttatccaagttcgaatgctctcagatgccacatccagtaagatttaattttgatgcatgtagagggcatgtggtaatctagagactaattcctaatttggatgttgaagctactagagcatatcacctttgtcgacacacctggtgttctctcaggcgagaagcaacggacgcaacgtagctatgatttcactggtgtcacatcatggtttgcggccaagtgtgatcttattcttcttctgtttgatccacataagcttgatatcagtgatgagttcaaacgtgtcattggatctttacgcggacatgatgacaaaatacgtgtagtgctaaacaaggcagaccaagttgacactcagcaggtagagtatttcatagccatctcttctcacgacgcttgtttttgcatattgctttgttttgacataaatctgttttccttattggcgtgcagcttatgagagtctatggtgcattgatgtggtctcttgggaaagtattgaatacccctgaggttgcacgtgtttatattgggtaatttctcatgcccctgtcctcactgcttcgctcctacattatttttgcacagagtactttacaaactacaacttacaataccataaaaccataggttgaacattgctagaaatactgtagataaatttcatttaccttaggttagcacagaaattcacagcagtattagtgggttctcaaataattgcgtaatttggatctggtgcttgtactgatctttgaggccgcctcggcatattaaagcactaaactagtttcctgttttactcacagatcatttaatgacaaaccagtaaatgaatcagctgttggtccaattggaaaggaactatttgagagagagcaagatgatctactttctgatctgaaagatataccgaagaaagcttgtgaccgtcgagtaagttgttacagtaccttctattgtttggcttatttgagtcctggatttcacaaattaatctcattccatatttgcagatcaatgaatttgttaaacgtgcaagagcagccaagattcatgcccatataattggtcatttgaagaaggagatgcctgcgatgatgggcaaagccaaagctcagcagcgacttatagacaatttggagaatgagttcgcaaaggtatcttagctctgtaagcctgtaatttctactacatccgtttcaggttataagactttctagcattacccacatttagatatatattaatgaatctagatatatatgtgtgcctagattcattaacatctatatgaatgtgggcaatgctagaaaatcctataatctgaaacggaggaagtagtcattttggggccgttgtagtcttgtagactttacaaatggtagatttgtagtgagtatccaccctttgttcgtttagaacacgtggtagattctctgcctatcttgtcctcgtgctgtaatacttgcctaaccagttaattagtagttgtagtaatagctaattctggtttgtcgacgtatcgcattatgaagtattcatgcagttcacctgcatggttcatttcagttatgtaattccatgcttgattactatccgtggtctggtggaacaggtccaaagggaacaacatcttccagctggagatttcccttatgtggagcatttcagagatgtcctgggtgggtatagcattgacaagtttgagaaaatcaagcccaagatggtgcaggcggtggatgatatgcttgggatacgacattccagaactcctcaagaacttcaggaaacccatacgagtgaatgaacacctttaaattatgaccatggttttcaactttttatcatgatgagagactagtcatattcggagggaatagggatgcgctgcattccatagttttgcaactgtcagaaatctgggattgctgaggtttaggtcttgtaactcttgtagggcgtttattgtggcatactttaccttgttgtataactgcatgcataagaatctgagagccattgctcaattcttttcaacgaagatgtgaactgttggaaggcaatgtaaaacgggaagcgctgtatgaaagaatatgacgcacatcgtcttttgttttttaagaattgagtatatattcgttgtggggaacagcctgatgatgggccccgggaattaacgctcgagcaacgttggaccattctgacatcgcgtttcctgattagcacaatgtttcgttttatttggaaattgaattgaatgtttctactgttattaattgcagacagtacaccaaacgaccaaatctatctgcaaacaattaaccaagaccaactggagaatttacagatgaatcactgtgttacacctgtaaactgtggctcctttgagaattgagttacaacaagagtttggagatgaacttgtagttcatctatatcatcttaattaaacaataatatttattcaggaatgcagttcagagactgcttaacacacacacacacaaaaaaaaaacctaaacctgaggcttgtactggaacaaggtcattagcaaggtgtcctctagactcccggaccgacactacccttggaagtcaaacgcagctggcacaaacaaacggagcctcggtgacgccggtaaaccgcaccaatcattgttaaaccaaaaaacgtgaacaacaaaccaaaaagaaactaaaaaaccgctaaaaagacgcaaaagagagagaaaaaaaatgaaagaagaaaagaaacgacgcggactcgctgacgacccgcggcccggtccaacccaacccccaccgcctctctcgccgaccccgtccactccgccgaattcccccccaaacccaaacccaacgcgacctcacctcacccgcacgacgacggcacgacgcgacgcgttgcccgagctgacggcttgacgacgcctccgtccccgtccggcaccaacccatcccaacccaacgctccccttttccactgaccaattgatagcccaacctcacctctcctctcctcctcccccctcctctcctcctcgcctccgcaccagcagtttcgtgcaccgcacttcacccacctacctcccccaacctccccatcaaaaactagt

SEQ ID NO: 45711 - DNA, 4601 bp, Oryza sativa
caatgttcatagcttggagctgtttgatgaggtgcagaaggtccagtggatgggtgcggtgtctgtgggtatactcgcacatactggaacagcagaccagccacgacttagtgaagaggacaagcagaatatgcctcttccagttcaaggccctgcctgcaactcttctgggcacctagccgggtggcacacatttaactcattgccttttgccgggaaaactgccactgttgttggagaggcagcaccggttctaccaaggggtttggagtgggctggttttgtgttgaactctaggattctttggaaagaggcggagggaaaacctgattgggtgaaggatctggatgctgtgggtgagaacggcgaggaaatcgagaacccccttattttgttgaatgatccatcctccgttgagccattggggaactgtgggaagaagatcctcttgtggtggctccgtgttgaagcgcgagctgacagcaaatttcctcaggggtgagatttattttggaatttttcattacatttttcactggttactttaaactcgccattatgttgatgcaaaatattgaaatgctctatgcacctttgttcggtacttcaaacaacttgtgtagccacaatctaagtcatagagtctagagaatcccttccataagttagttatgctgaccagactttctagttaggcactcaactcagtattttctggggagaattggacaagccaaccatccaatattttttttcgaataagagcaaccatctaataattagttattcagcaactgagactttgattcagtttgaatctagtaatggtactgccactaatatggttgcactgagttgagtctggtgctagatcgaacggtgtgaattactcataaatctccttgttagtaattcacattaaattaaatagtccattgtctagtctcttagttgtttgacttcttgtttaagagctccattctgcacttgggatctgggattgggaactttgcagacccaagatggcatcctgcaagatgtcaaatttaactctgtttttgtaaaatgacctttattttgttcttttttccttctataattacttgcagtggttgtccttttttttttttggtatttccaatcagaaatgcgtctgtttttgtttattttaatgccactgtgttacatttactgctgtagcagcagcactagaattttgcatttccaatttaaccaaagtgctcaagtataaactttggctgcaacaaacgcttttgcaagtagcattcatgtgtacccaacacttgttggatagccaccactcctctgatacgtaatagaggcagtgtaggattaggtatttaacaactgtgaccccttcaactgacatgctgccatgtggtagtggcatgaaagatgccaaaccatcaataattaactaattatcattatcaacattttgttttgaaatttggacacaaagttttcattgcattcatgttggagtcaatttcatggttgaccactgtcatcggtcacatggtaaagaaagtttgtgtccttgtatcagaaatatgttctccaaagccatggatatggagcttcatcgagagaaacttagctttagagaattagagttataaaggatgtttccataaactgcaaatttcatttaaatcaactaaaacaattgattgaatattaggttcttctaaccaaacacaataacacctggaatcatcaagaatggctgactatttaattgtttgttaatgtttcttcccttatcttttatccttaagttcatgagtttttatgtttgctaagctgcaatgaaatgtgttctgcaggtgggtaattgagccacctttggacatagttgttcccgccaagcgcaccccatggcctgaaactaccgctgagctttcggctgaattagtagattccaaacaagatcaggagggtaggcggttgtcaagaaccgacagatcatctcggtcccgaagcaccacaaagcggaaggagaactgaagcaaaataaacacatcttgtaatgtatatcttacatctgcacaaactacaataggaaccatgtctggttaatctggtgggtattatgtttattttttttcctgatgttttgctaatgtggcagcgcttcatactcgtatgtcttctgtagaagactgtttttttattggtagctgtattatctatgttgtaatatacagtgcaatcttgaatcaaggaaatggaagctggatcctggatatcatatacgctccctgaagtagggtttcgtgctcgttttatgtgcttctgtgttggtgatctctgttactattcttgctgttggcagtggaatggtggaaaattcactttaatatagcgtttcgacaacggttctactaagtattgccgcttcattccaatcgatttggttgtgtattaacccttttgttaacagcgccaagctaataatcagtgcgcagaaagaaccttaagtatatatgatacaatttctttcgtacaaactatctcaagtttatactcactccgtttcaaaataaatcaaattaatacaagtgagatatcttaaaataaatcaaattaatacaagtgagatatcttagtaagaggcacgtttagattcgtattagagaatacattgctaccatactttttttctttttgtgtaacaaatctttggcctaaatgcttgatgggactattaaagattcctcgctcaattgacaattcaatgatgtatcgaataccagaaaatcttggagacatctgggacagaaaatacatgtaccaatatttaaagcactcattttctgggtacaacattatcagattagatcagaattgaggcgttttggtcccactgaattagtgatttgaatgcatcacagcatactgctgctactcctatcctatgcatttgatgcatgagcactgtcgttacttttttcttttggaaccaacactgtcactatcttatatttggatgatggaatggaagcatcgtggtccctttattcgattgcatcggtcattttttctgcccatgctgtttctgcctccatgttgttagtccatatctaaacgaggttattacaatttcgtataggctttataccataatctccttgtcttattgaaataaaaataggatgctctactgccaattttggagatggagttcgttttgttgcaaaccggcacattaacacattataaacaaaatggccctacacagtacaggcccactaattggcccaactgacctactatctacagatgggccctacacgggcctcaatgatgtgatgtgcaggcccatcagaaattgggccgcgaaattggcaagcggccaagcgggtgcgtgagcagaagaagaacccgcacccggcgccacgtgtcagtctggttcgggtcggataaatcccgcgtctcccctgctcgcccgcttcctctctccttcctccactcccgcaaaaaccctagctagggccgcctcctcgccgcccaccgcctccacgccgccgcctccctcctcccgacgagccggtgaggaatcccccatcccttcccgcctctaggctcgtgaggccaccgccctacctggtgctgattccgattcagtttggtaggttttcttcaagcgcgagattattctccaagggaggtaaggtgtcgggtcggctggcgatgggggcggagctgcggcgcgacgacatggaggtggcggaggaggacatcagcgactcccaggcgttccggttcgtcgagcacgtgctccagtccgtgcggatggtatgggattgagctccttgctcctctgctcagtttttatgtggggggatgggggtaccatgatcagctttcgaatcagtcgtacgatggctcagacattagttttttgatagctccatgggtagaatttagagttgtgttcggtctcaagtggttagtcctgctttggattgcattcccttgtaaattagcattccgaagctccgtttttttgttttattttgtcctttgattttgatacctgatagttcaatctgtggagggatgccggtagacaagttgatatagtaaaactagttcaccttttccaagttgtttctatggacgacaattcgacagaccatattgccatatacaaagcaaaaaaaataaaataaaactgtaatgtgacacgcagctttcatcttctatgttatttgccatgtattgaagtcagacgacggagctagcagtgtgtgcccatatgttaaatactaagagctctctttgtgtaagtttgcagtctgagcaacgaatgcattcacttataatgctaattctaggatagcattttttttctcaaaccaaaatcatacctctttgtgttgtttcacaatccaaataaaaaatacggccactcatgctatggataatacatttcttcagacaaaatgggggcgtgcagtgagttacctagtactgctttcaagttcgaaatccaagggtgttttgaagatgtgatgaaatgcggcagatgcatgaaccatgcggagttaggaaatacaaaggtgactgttgcc

SEQ ID NO: 45712 - DNA, 1915 bp, Oryza sativa
cttttagcattcaaaattgtcccaaaatataacttctcccgctgcattctcttctctaccaatcacaaccttccaccattcaaattctccgcctatcgcctcctcttctcaaccaatcacaaccttccccatttatttccacctactttcttaatacccgtgactaactccaaaaatccttatattctgggacagaagtagtaattattttagtttccatagcaaacatgcagcaaatttgtcgctttcttgcttaactgagaataactagagactcactttattggtcaggccctttttggaggaaatgcttgtgctgaaaagcttgatggtttaatggttgttttttgtgagcacctcaagtcatgtaaagaacatggtcgcttaccccaggtgaaacagatagtcaatacttacgttttaaagactttcttaaagtatagcaagttcgataatatgattatggatgttaaaccaggtaataatggctaaaaactgtttagtgtagaaacacgcgagtatcagttgcatctatctgttatgtgtacgttttttctaatatcttatacttgttgcccagtacgtggcgttgcgttggtcctgtacatattgttggcagacttataagtcacttattactcctgcttactgtcctgctctagactttataggatgagatataacttctgtgatgcatttctgaaggagttttgtttctgggatccagaggtgtttcatgtcttgtaattattgaatgaagttcatgaatcatgagataattctcctaaaactggtattttgatgctaaaatgaaattatttgacacctaaagtatgttgtccttactatataaagaaaagaatcctattgggcctgagttgaaaataaataaatgtgattttttgcaccaatatatccttccttttttttctccacaaggaagattcaatagtgtctacactttgaacacactaattgtgaaattaactgataattgcatatatactccggaatttggtcactggcacctttccgtattaaattaactttagaagacaaacaaataagaatataataggtctgctgtgcaatattaattgtaatattttgcgcacttcattacaaatgcaacatagatgtggtggctgcagactcacaaccagtaccatttctttctgaagtatatacagataaatgaactattttaccctgtattgttgtctgttggttcttcatagtttggtttgaactggacaggagtttgacattctgaagactatctttcgagcatctgtgctaagggtgcacaaatccaaatttgcacaggttaagattaaccttttttttgtgttaactagattcactataattttgtgagtgcaccatgtgctattcagcattatatatttattccatcgctctctgcttcgttcttgttatctgattcttctgctgtaaatttgcagtttatcatgttttatgcctgctcactggatcctgaaatctgtggccttgaattcgctctcttcctctctgatatctttattaaaaaggaagaggattcaatttctaggtatttttttcccatatcatgcatacagctaacgtgcataccttgtatttctttgtcttgtgaacttgtgatcatagctggcattgggtgctgagtgattacttagaacaagcttcaccttttgcatgtttggtgaggtggtcatttttgtggctgaaattttagttgcaaccagatctttggagcacaaaattagctttttgatccacctgtcatagggcacacctttttgccgaaaaattctcgcttagtttggcagaaagtgtatatttattggcctgggctcctgccaactttggttgtaactgtttatcgaggggattgctgtagactgtatatttg

SEQ ID NO: 45713 - DNA, 28409 bp, Oryza sativa
ccatttgatccttatctgctaaaagaatccgacaggtgtgcatcactaatatccaataaactcttttggtagcaattctccagtgctgcttaccttttttttttgtgctttatgtgggttaaaatagtctctctagcaaaccttaaatgcattttaaaaaagagtcttgttgaatatataattgtgagctgtccacattattacatattatacatttatactaatgctctgttctgtctgattgccctgcagatatatgcgtccaaattttgagtactggtccatggtcaagacgacatacaacaattataacagtgatgttgatgatgagctagtggacctcgatgcacctgaaatgaatgtcggcagtttagatgatcatgttgagatagatctcaacagtgatgatgacttggaatactccatgaacaagatgtccataacgccgaaccgctctttctttcatcaaattatggcaaatagtgacactggccttaccatgcctgcgaggatcagaccatcaataagccccccatcataatgggtccaaagatcatcgccgccgccaacttgttgttcacttcacaaaagaaacagccgtatgctgggagtgcattaggatccagcttgtataagagtacaagtatcggatagaattggagctttacttcatagctggtagaagggtcgaacgacccatcttttgcgatgtatccagcccaaataggttagttgttgggatgaaatgtgaagtacagatgtgttattaaaaacgaagcgggagtggttgtgactatagactagcaggtagccctctggtatgtaaaagacaggcctgttttgatgtagaacgatttaccaatattttttatatcggaacagcagctgtctaactttgatactagatttggttggtcggtgctgtttcctgaatatgcgttgacacttgacgaattcctatatcgtccattcgtctgtgaagtgtcaacttgttcaatactgtttaaatttcaccatacaaatatctcaagtgccgagttgttcaatactccctccatactcgtaaaagaagttgtttagaacagcgacacggtcttagatcaaaacacaactttgacttcttatttctataaaaatatttattaaaaagtgatatatgtatacttttatgaaagtatttttcaagataaatctatacatataatttttacatttttaaactcaacaactttagagttatttatgatttatattctcaatgtttgatttaaacattgtcctaaacgacttcttttatgagtatggagtagtactctttaatttcaccatacaaataaacgtgtcaacttgttcaataggactgtttaattttaccatacaaataggcaacgcagtttgtcctgtcaagtgtcacaactggttcaatactgtttaattgcaccatacaaatactaggcaacaaggtctgttcacgtaatctcaaagttctcagctcagccagtgaatctgaccatcaccttattcaattgataaaggcctatatataatgctctggtttttttttttgaacagaaaaaacagcacagtagtgctttttcattgaatatagaaggagaaaatacaacccctaggggtaaaacaaaaagatctttagactatacactatacagagtgcgggatgagctcgcactctgcaaatataatgctctggtttttacgtacaagacagcatcacgctttattctcgacacttgtactcgctgcaaatgtgacgagcttatttatacagatcgacgcattcctgaacctgtgaagcgtgaaccattcagaccctgcaaagccaccatcacacggacacggagagcgagtcagctagcgaaacacataagaaagcacgaaaatacaatatagatgcatataaaagcgtactggttgtagtcgatgacgatcctgccggcgtcgaggttgccgatggcggcgaaggcctccctggagaggtcgagggtggaggtgcaacccggcgacgggcagcggtcgacgatcttgacggtgaccgtgccgccgttgcaggggttgggcacggcgttggtgcccctgacgcaacgcaccgtgtacatcctcccgcacgcccgcccgccgtcccacagcccgtcgctcgccgccgcgatcatcgtcccctggtcctggaacccgtagcacgccgacgctgcaccgcaacagcacaagttactacagaaaatatgttccagaaatggaatagtagaagactgtccaaatgtccaatggccccattcttttctccttaagatgtataaattttatctcggtttctattgacacgtttttcaaaccgctaaacggtaagttccttacaaaaactaaactattaaatagatctatttttaagtttgtaataattgaaactcaattattcatgcgctaatagatttatcgtttgtgtgcgctaatatcatctttatcttaatctatctcaaacagacaaacaccaccacatgtttggtttatgttattttcatctttactaattttagcattatcaaaattttacaagcagaaaccaaacacattattattaccatcataagttcatggccctagcaaattttagtaatttgggcactctgcaatccgaaaactctcatcagagaatttggcgagagcttttctcctatcaaaatttggtattattggcaagttctttttttccgacaacaaaccaaacacatcattcagaattaaggagcagtttggagatgtacgggtgtaaacggtgtagaaggtggcggtcccttcgatggcctgcgacgccgagacgaggcccaggagcagagctgcagcgagcaggatgccaactctagccatggccgccgctagatcagacacaggttctcgtgtaggattggatgagcaagaagctgaagtgatgagttatccattgctagctacgaggttgatttatagaacagctgctagcctggtacgtactctgggccgtggaaaatcgtgcctgatgcatggaaagttcagacttgcattccgtccagtccgtaggcaacaaacttggaaaatttttagtcctgtgttgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaacatctgcccctagaggcacccggaccccccttatatataagaaggagtccggattacaaaagataatctatgtccctaacggaatacagtcgtgaccgactaagtcttaaggtgtttccttgatatacaagttaggaaacaaacccaggatacatataagatattctatctatattcggtatcctatattcagtccaaatatcatcgccgtgtagatatgggatatccataatctccacagtagcccccgagacctttgcagtcaatcatcgtagccttctcaaagataataatccgagtgcttcaaacttttcatgccaaggcctgccgagtagcgaagacaaagactgtaaagggcgaaaagataaaaatatggtgcatcgaatagatgcacctaattaggtgtagcccccaactatgtgattagttaacgaactaaacatatagttgagagaccaaataatagcacaatcgtgcatcatatgacaaaagcacacacggcgcctaaataggcatgctagccgaccgctttttagccataatgaaaagagtccgagtggtttacactctaaaaggttcacgaatgaacacactggacaggcatccgaatataaaactctaaagattacccaccaagtattataaaaattatggtaatgaataagtctaatagcctaggctatgactatttaccataatgaaaataggtatataacataccaaggaagtgactatgataaaaacaagtcattccaaataacccagacagcttttgtagcctaataaagctaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgcttttaaaagtattgggctgaagtactgttcaggcctaggcccatttgcacctccgatacccttaacaagaaatcccgagatccaagcgacgcttcgtcttccccgccggaactctcaccattttccccactccttgctacagtgtagaactgcgccggcgaactagggttcaccactccactcaaatccaccttcgaaaagtgcatcaaaatccttcccgtgatccaccgccttaatccctcatttctccctagccatccctcgaatcaaatcagcgcattcggataaaatcgatggcggaagagaaggaaagcttcgaaggccaatgggcgccgtccgacgtaacggaagagaacctgaaggagatggtggcgcacggcgttctcccagccaaggagatcatcgggtggcggccagcgtgcggtgaggcttttccgacccctgatacacatgagatcgtagtcttctcgcatttcttctatggcggcttcgctcttccgacctcgagatttttccgcgggatattaagcttctatggaatcagcttgcatcacctaaacccaaattccatagtccacattgccaatttcatccatgtatgtgaagccttcttaggaattaaaccccacttcgccctgttccgccgaatcttctttctcaaaccccaaccaaacaagagtaagccatgtgtagtcggaggggccggatttcagctgaggggaactctgagccagaaatacttctcaatgcccttcaagacttcaaacaaaggatggcatgcgaactggttttatgttcagaatcctgagcctgctcttcccgaatactcttgtcttcccccggtgtaccaagacacttggaactctcttccaatcggagatgaagctgcccaagccttggaattgttggatcgcatgttaaaactcaaagaacgaggcttgcaaggagagcagatcactcggcacttcatcaaatgccgactggcgccaattaaagaaagatcccgtacagcttttgagtttgacggcaagcatgatcctaatcgcgaagaaccagactctctggatttcaaaatcatgaaggagagaatgtataaaatcttctcaaatgccattgtcgtcagctactcacaccagctgccagttgtgccatataatgcattcaatccgcctccgcaggtatgtatctgaaatcttcaacttatgaccaaaatagtatcttgtcttcatgttgagttaactaaccatggaggcatctcattcaggaatacgtattgatgaaatctgatcccccaattgctcagcgccgatctcctcgccagcacaccattcagggaagtggagggccgacaaacaggtcagacccacaacctcaaacctccaaaccggctggtcagacaggtcctcgtaagagaaagctggtgcttaatgacgacgagggcgatgacagcaacaaatctggggacaagggcacgcccaacaaactcccaaagcataccatgcccaggaaaaaactggctggctgtcaaatgccaaagattagaacatcttccaggtataaacttctcggtaccatctccctttgatatgcttctctcatagaaattatgctgaatatcgaaaggacactttgcaggaaaccgtccgacatagatccaactggaaaagatcctgatccggctgtgacagagccaaatttatccaaagatgctaagccgtctgccgaaaaccagccgactgccgaaagccagccgactgccgaaagccagccgactggcgcccatgcttcggatgacaaagccgatccgagtgaccagccgcaactggagaccagtcggcaacagctgaaactgcaacaacacaagagcccccgactggaaaccagtcggatgtaggtcccgatgaagaaatccctgaagttgaagtgcaaacgacaacttcccaaggaccagaggccggtaaagactcaatgattaggtctctaaataaagaacaaggaccacctcatgttcagccaggaacatcctcaggtaacacatcttctcaagtgatgccgatttaaataacttcagcttactcgtccaatgtcttggaaatacatcaggaacactaggcgatgacgaagaaacaattcctcgcataaaggcggctgatgactcccgtcctcctatcttgctcaaatggtgggacgagaactcgcaagttgccggcatcgttataaatcgtcaaaaagaagatgaggaagtgtgccagctgaagaaagcacttggagaagccacttgcattgtgaatgtaaatcttccgggtgactgcctttaataactttgttctctctttagcagaactgaatcatgatccatcatgcagagaatccatcttcgcaatgaggccaagactacaactttggaaaagctggttcctcatttgggaactcttgaagcagttagggaccagctgcatgaggccaaggagtatgctaaaaagacagagaaggagttaagggaccgaattgcccagctccaggattcaaacttcgagctaagtggttcatcaaaaggtaaccttccagatctattccattgatttatgctgtcataactgtatcctcaaatatttggatttcaaacagcacaagctaccaggatggcacaaatggagaaacagattgaagccttgaaaagagacaaagtagaactagctgtgcaaagggactcagccttaaaggaggttgaaggtactgccagctgacaatttgaactttcctctctttaatgcagcaaattcttattataaatgtgttttgtagaccgtaaaatcaaatctcaagctcagtttgatgtcctggttggtaagatcaagaagcttgaaggagcaagagacgaagtcgccaatgtcgctacaccacttgtccaagctatgttccttaatgacagtggtccgagtgcacttgacgcaaccgaaatctttgacaagctgagagtagcaccggatgtatacttcaagaatatcaagaaagctggaagtatgggagctagtatggcattggcgatgaccaaatccttgtacccgaggattgaaattgacgccattgatggctttgcagacgggacaagcgaagaagctgctcttgatcttatcagtaatgctcaaagtgcggctgacaagattgcaagtgatgttgtagaacaattccgcaacaacgaccttcagccgagcaataataactctgatgatgaaaggactgattctgactgagtgtagatgtagcaaatggaggcttaatttgtacaatactggtgtatttatgctgtgcttgatagttctaaccaagtctttgatttcttaaaagcttttatcaagctttgttgagcctaaaacccaaagaagctattaaaaactttcagtcctcgcagactaagtagaaaaaatcaaacaaggcaatgatagaccaagtaagcaaattaaattgataaaaaatcacactccattattatgatgatagcccccgactgacaacggcaagaagaaaacttgatgttgacagtcaagatagggaagtacaatgataaacttaagcgtagaaacgacgaagatgttcaatgttccaagagttgtcgacaagagtaccgtcttcgcgcttgagtcgataagaacctggccgggtgacttcagagataataaatggcccttcccatagaggagataacttgtgccgatctcgtgtagtttgaattttcctcaaaaccaggtcaccgactaaaagggcacgagatcgaacattgcgattatgatagcgccgcaacccttgtaaatatcgagccgaccgaatcaaagctgcttcgcgggcttcttccaatcggtgcaagtcatccactcggtcttcttcgtagcgttcttcacgaaaattacgaaagcgcaaagactcaaattcgacttcactcggcaacattgcttctgccccatagacaaggaaaaaaggtgactggcctgtggcccgactgggtgtagttcgcaaagaccaaagtaccgatggcagttgttgcacccatttgccggcatagggttttagccggtcaaagacacgcgctttaatcccttgaagtatcatgccattagctcgctccacctgtccattgctcatggggtgtgccactgaggcgtagcaaatcttaattccgaagtcctcacaaaagtctttaaaaactccgccagtgaattgtgtgccattatcagtgattatccgattgggcactccaaatctatgcacaatgttgatgaagaagtctcgagcattatctgctgtgattgtgacaaccggtttggcctcaatccacttggagaatttgtcaatggccacaaagagatgcgtgtaaccgccaactgcctttttgaacgggccaaccatgtcgagcccccaaaccgcaaacggccaagacagcgggatagtttgcaactcttgagctggtagatgaatttgtctggcgaaaaattggcaaccttcacatgtgcgcacaattttgtcggcgtcggacactgcagtaggccagaaaaaaccctgccggtaagctttgccgacaatggtgcgtgcagcagcatggtttccgcatatcccagaatgtatgtctttcagcaattgtctcccttcctctaaagatacgcagcgttgcagaattcctgaagggcttttcttgtataactcagattcatgcataacataaagtttgctccgccttgaaatccgctcggcttcatcttcatcttgagggagctcttgagaagttaaaaatcgtatgaagggctctcgccagtcggcttcaaccatagctacgtcatgagtgtccgcatcttgagtagtatctttatgaggtacggtcggtgtataaaggtgttcgacgaaaacatctgagggcgccgcctcgcgcttggatccaaaattggcaagtctgtcggcggcttcattgttgtgtcgaagaacgtgactgagctcgagtccctcgaacttgtcttccaatttgcgcacctcttgtcgatatgccatcatattgtcgtcaatgcaggaccactctttcataacttggttgacaaccaactgtgaatcgcctcgaacaatcagacgctttatccctagggaaattgcaatccgtagtccatgaaggagggcctcatactcggcaacgttgtgggacgccgaaaaatgtatccaaagcacatagctcaatctttctccagttggggaaatcaaaaccactcctgctccagtgcccgaaagtcgtttggatccgtcaaaatgcatggtccagtgctccatgttctccgcgggggtatcctcctggcactcggtccattcggcgacaaaatcagctaacgcttgggacttgattgaaattcggggcttgaatgatatgtccaaagacatcaactccaaagcccacttagcaatacgtccgtttgcttcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaataaatcggtcgctggactttttggacatggccttcttcctcgcgctcaacgaccaagactgtgctcacaacctgggaggtagctgatacgtacagcaacaacggctcctgcgggtgtggtgaggctaagactggtggctcggtgagaagtttcttgaaatcttcgaaggccttctgtgcttcgggtctccactggaagttatctgttttcttcagcagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatgcccctatgagacaccataaagccaagcagcttccctgacggtactccgaaggtgcacttttcagggttcaatttcatcctgaaagcgcggatgctcacgaaggtttcttctagatccgagatcaaatcatccttttgcttggtcttgacgactacatcatccacataggcttcaacgttgcggccgatctgcgttgagaagcatctttggatcatacgttgataagttgctcctgcgttttttagtccgaacggcatggtgacatagcaataagctccaaagggcgtaatgaatgaagtcttcaagcagtcggattccttcagtcggatctgatgataccctgagtagcaatccagaaaactgagaagctcacagtcggcggttgagtcaactacctggtcaatgcgaggcaacccaaaaggatctttgggacaagacttgttgaggtcggtataatcaacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactctttgaaatcttggtagcgggcacttctccttcgctcgccgtggctgcagccagtcggatatcctctcgggcggacgccatctcgcgggtttgagccatgtcgcaactctccttgttgcatgtgacggcttgcttgatgtcactccgtagggataggactcctcggggaccagacatcttcatcatcatgtaagtgtagtgcgggacggccatgaacttggctaacgccgggcgtccgagtatggcatggtatgctgtctcgaaatcggcgacttcgaagctgatgttctctgtgcgaaagttttcccgagtaccaaaagtgaccgggagggtgatctggccgagtggagttgcggatagtcctggaattactccgtgaaaaggcgcattgcttggttttagctcggagcgaggaatctgcatatcatccaaggtcttggcgaagaggatattgagtgcactgccaccgtcgatgagagttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccagggggccgccgaagatatggttgagctccttgcggtgatcttgaaaacctgccggggtgtcgccgtcatccttcttcctcgacgtgctttgttcttcgtcagagttctttcgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtccttatgattgttacttccacctcctcccgtagccggcgtacccttgttttgcttccaactgggacccgactgctttgatgcggtgacggcgtcttcagctttggcgtactcgttggctttttcaaacatgagcttgactgtcctgggaggcttacgcccaaacttgccgactagttcttcgtggcgaatccctttggtgaacgcggcgatgatgacgtcgtcggtgatgtcggagatcttgttacgttgttcagaaaatcgccggatgtaatctcgatgggattctccggacttctgaatgacgttgtagagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtctcctcctgctgcgcggattgcgagaccgtagacggtaagccacgattcggggttagtggtgccgtcatacttctctattccagtcggtttgaagccggctggccaatccactcgacgcaggtcgtcggtgaaggctgctactccgtcaaggtcgtcgtcgtggcggtccggcgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcgccggtgatgctgaggcttggatgacggtagtcatgagatcggaagtggggaactcggctgccagtcggcgtgtggacgctttcggagttaactgggaccgaagccgcaatcatggtcttcgtctggttcaagatgttgacgacgtggtcggatcgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgctgacgtcgatcctcagcctccttcgcggtccgctcacggtcctgctgctcacgccgtagccgttcttgttcttgtgcttgatgctcctcctccagtcggcaacgttcttcggtctcccgggcttggcgttgctcctccgtctcattattggccatgaaaacgccaaagtagagaggggtgtagttgtcatctaggcttccgtcgaagtcgtcgaagtcgttgtagcgagaactaaattcgtcgtactccacgatgtcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaagacgctgtcgtggtggagacggccgctaaatcgtcggggagcttcatcaggactggtgggtaagccccatcatcttgatctggtgtcgttggagaagatgcgatctcggccgagtggtttgaagccgactcggttgagatggtcttgaagtagctttcagccgcgttcgggaatccaaacgggaccgaaatccggttctctcccgactggtctgattccgagtcgaggagagaaatcttgccgaagttgttggtgacgaagtcgaggctgccgaaccgaaacgtctgcccgggcgggaagacgaggtcgtcgatgccggagatggaacccattgcactgatcggcgaaaagcttgacgctacccctacctggcgcgccaactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaacatctgcccctagaggcacccggaccccccttatatataagaaggagtccggattacaaaagataatctatgtccctaacggaatacagtcgtgaccgactaagtctcaaggtatttccttgatatacaagttaggaaacaaacccaggatacacataagatattctatctatattcggtatcctatattcagtccaaatatcatcgccgtgtagatatgggatatccataatctccacatgtgtgtcttaaggttaatcttgagagagatagaaagagactttaccggcagaacatactacaaccatttgttttagtcagaagagaaaaatgaaccgcacaacattgtgcatctggaaatagccaaatttccagtccagaagctcaatacgccgccataatgttgacaaactagcgcctatctatataccgacctattataggcaatttgcgtaattttttgaactgttggaaaaaaataaagggttgaatccactggaaaattcagcaagttcgctatcctcatctggaagctgatctgtaaccaggaaaaatattatttcttcagttacgttcatcggtttatgcaatggaaaaatgtgccaagtttcttcaacattgtgcctgatttcttcaaaaatgtattaattactaattagtagcagagctactgggatgaacacgaagaaaatgcggatgaggagcaaaccggatgaacatccatgacgccatggactcctctacgctatagcgattagcgatgacgaggacaccgtgtgggcgcttcgcaacttgccggagatcctacggagttcgccgccgcgtgttcttgcgtcaacatcgccggagaacgcagcggccatcacggcagcgccagacgcgcccggcgcaagggaaaaacaaagtacagcaacgaacggaccgatcaacttcgagtcccagcgaacggtgcagattgggccgaacatcaataggagggacaaaatggtccgctgcttctcgccttctcgtgggttcaattgggctgtgacgggatgaattcataccgtggactcgatttgcaccgggttttcaaagatagggaagacgttacaccgagtattgtgattgagggggcgattcaatcaggattaagagtcaagggaaacaaaatagacttattcatttttagagaatctctggttgttgtttttttcataggaaacagtagtggttttgaagcaggaattcgttcacttcataaatcatttctttttattgaatttcgattctgtatgtacatatgagccaagtccacctaagcagtgaaccatgagacctacgactctcagatgatcatttcttcatctagagcctgcaaaattgcaaaaacaacacctagtgagtgaaaaataaacattgtatattttatacattacacacgactgacacgagtatttatatgtatatatgcagagtatggtacgtactgttggtagtcgatgaggaccttgccggcgacggggttggcgatggcggcgaaggcctccctggagaggtcgatggtagcggtgctgccggggcagcggtcgacgatcttgacggtgatggcgccgccgcggcacgggttgggcacggcgttggttgcccgacgcaccgcaccgtgaacatcgtcccgcagatcttgccgccggcccacagcccgtcgctagccgccgcgatcatcctcccgttgtcctggtttccgtagcacgccgacgctgccaaaaattaagcaagatgtcggcaaaacgaatgttagatctcacgaaaattataggtgaatttggagcttcggaaatgcgaaatgtgaagatgtattcgaggtaaagcttaagactgaagtggtgtacggttgtaagtggtgtagaaggtcgcggtgccttggatggcttgcgacactgacacgaggccgaggagcagagcggcagcgagcaggaatgcgatctttgccattgactacttgtggtgttttgatttgacaaaggcaagattattgcaggttgcaacttcagttcttgtcaggacgaaaaatctttgacggtaacaaatttgttccaatacggacagtcggacagaagaatttataggagaataagagatactaaatctgtctctggagtagtaaataaagggagttaagaggtaccaaattaaatccgaccttacgctaatgtggatatatacatcactttatcttatcctgggagacatattaaaatgtgtgatttgtttagagaaaaaaacaaaaaagtggaaaaattgtcctggtgtggatagaggatcagcatgataaagagactaaacttactacgttgatttagcaacataatgacgagtcttataatttctcatacgatcgaatataagactgacatttgttaatgataaaatgtacataaaattttatatatctgtttctaccgatttgtaagttaatatatgttgaaaaataaactacgataaaaacatcaaaatcaacttaaaattaagttttaaaatgtaaatcttatctacgacttataagaggagcaaacgatgaagccgttaaactctcggacagttctacttttttccaacatggacggctctatctcctcaatgttgcatttgttacaattctaaagactactaaaattgactacacattacgtaagattcgttgaaattgagtagtcccatttgggagctttttttagtttgaaagactgacaggtgttacattttagtgagcacaataataataaaaaattttctcatcaatactcgatcataatccttgaatattcccaactatttttatgtactatatccaaatacaatctccgggtcattaaatcgttgtaaaatgcctaagcagaaggtacaccataaatgcacacctatctctcccttccccaatcgcacacaactccaaaaaaaaacatataattgtttacgctgtaaattatattatattatattgtaaaatttaaaatatttgcatatgcaattttgctaatccatacaatataataaaagtgagataaaaataattgatgacctacttaaaaaaggaaatagaagaaacataaaaaaccttacatctaaaagaaacgagatgtagcaatcacacatgaaaaaagtgtctggaataaggtaacaaaaaagagattatctaaaaaattgccgcaatttttttatgggaaaaaactttcaaatctctaaagtacaattgtaatatagttccatataactatactataactataatataattttatataagtattaaaataatatatgtaactttatttatatctaatttatatagagattataatatagttacaatgtctaccattgtagttacactataactataattaatatagctacatttaaaagttttttgccaaattataaaaaaaactcgcgacattttttagcaatttccaaaaaagaatatggcataccatatttttaacagaaatatagaagtttgaattattcaataatcatttacataatactttggagcacttgagatctcaaagctaagccacctttcatctcgcttgatgcattttctctgaatagaactccagctgggcggctgcagtccaggcatgagtccacgaaggatgcctttcattagcttgtcacagtcttctaccgacagagatttgctctcctcgtcagacagcctcggcagccggccggcggcgagctccaccgcgacgtccgtgagacggccgacgctctccacacagacctcgtcggcgaagcagcatctccactcgaacacgcgcagcttgggcgcgcgcacgacgagtaccgggtgaagagggcacggaaccgcgggagcaggtggtaggcggcagggctggacgacgacatgggctcggtcgggcagcggcacgacacgcggatctccctcagctcgtcggcgaggacggcgatcccggccttggtggtggcgctcattaggtgacgtcggtgatgcggaggcgcttgagccgcggcatggtgtcggacgtgatgtcgatgctggccgggagcgtgcagtcgacgatgtgcagctcctccagcgaagggaagacgacggtagagaggaaatcgctcgggcgcagcaccgtcaggccgtccaacgcaagccaccggagggaggtgacgccggggccacgcacgcgtggcggcctcaccgcgtaccagtacaggcctagctcaagctcggtggtcgccggcggcagctcgagcgaccacacgccggcgtcctcgtcagggagtcccctcttgcactggacgtgcagctctagcctcgacgcgttggccagcgcgacgaactcgttcgcgtaccggcactcgaacgggacgtccttccggtaaccaatgtggagcgtctcgatggtgtcgtgcaggccaccgtcgtcgtgacagcgttggcgaagcatgcgctccatgctctgcacgcgcggttcgctcgactcgcctagagatgcaaggttgccaagtaccgacatacgaaaccgaacgtttggaagccgggtgtggagatgttgccacctccgtgaaaccgcggcagtgcgcacggcgtcgtgataggggcacatggataggatgtgcaggaggatgtcatcggggagcttgctgatcagatcctcctgtttctcagtgactttcttaggctccgcttgtggctttgacacttttccatttcttttgttctgcctcttctttccagccatgatgggcgagtcctaatttacctcctcacgctggagtacgtgaaagaccaacaactgcacaccttatttatagggtgcacgtctattgttttccgaatacatgttgtacttactagtacctattttaccaaaaccgaactggattcggtacagagctctcaggctctcaccccggcacgtacactaaacggaaaagaactccagcgcggacacggactacaccatgtccaagttgcacgctgcacatggcctaattaaccagccatgcaagtccacaggccagtaattaaggtcaaacgagtgatggtcgattttaaacaagaaggaaaaataccggtttttgggtgccagtaccggtgtttgaagcagctatgcgcgtcacgactctcatgacgtgccagggcgccgcgacagcgaagaaaaaggctattgggcgatcgcgcgcgagcgagggacgagcgatcggtcagatttgctatttctattttccacgtgaaacgtgttggctgttcccttgccgtcatcagcccttctcaacgaatgaacaagtatatgtgaccttgctttatggtcggctcgatcattattcatgccttgttcgcagtgtctgagatggaaagtgaataggtctattttgtctccctcatctcttgctcttggttaaatcgcatccctcaaccacaaaaccgcttataacacctcccacaatttaaaaaacagtgcaaattgacaccttaggtggtttggaaagtaattttgctaacgtggtaggtcgacttagtttaagtgtactgacgtggtagcctagtcatcaaagaagtgaaaagagaagtggatcctacatataaatgacaatgataaaagaaaaaggtaggacccacttatcaacctccttctccttcttcctctcttctatttctctcgcgttgccgcgacgacgagcatgaattgtgaccacgggagaggatcttggcaatgcagcggtagttcccctccctagcaccaacgaggttcccaacgggataagacaccggcgtcgtctgcggcggcaaagttgcaaaggaagagaagcggcgagcaactacgcgtggggaggcgatcgagtagcgccatgggtggaggatggcgagcttgatgtccttggtgcggaatacaatctcgctgtggacccgactgacatctgggtcgtcaatgacgactgaggagagatcatgcatgtcacgtcagtaaaactgctttcaaaaccatccaaggagtccatttgcactggttttaaaaaattatgggaggtgttatacccggttttgtggttggggatgtgactcaatcaaggacaaaagatgagggatgcaaatagacttataccgatgaaaaacgaaagagcccattttgttacctgttttgggctagatttgttccatttttattgtcttcgcaagggaaaagtacaccaaaggtccctcaacttgtcatcaagttacaaaatcgtcccgaccacaaaactagatatcggccgtcccttaactaatcaaaatcggtcacagtaggccctttggtggtgttgaccccggttttgtcctacgtggcgactgagtcagcgtgggacccacgagtcaggatgccacgtcatctatctccttcctcctctctctcactctcctcttctctgggcaagccggccggcggctggagaggaggtcaccgggtgaggcgggagaggaggagagcagcgccgcgacggcggctggctgcggccgttccatggaggccacatcccgcgtcagcaacaccaacaaccacccggcggcgacgacgaaccttctcgttggcggcgacgacgcggccgtccacggggagacagccgttgctcgcccctgctgccgccagcttctcctccgcctcccgcgcccaggacggcgacagccgcagcgcacgcatcaggcggtcgcagcgtttccatctcaatgtttcagttccagacaaacactgcgatggcgagcacagcggcagcaacaacaagtgagcagttcccaccggcggccatggggcccgtcgccgctgcgccgttgctggaagaaccgtcgtactgggcagtgacaacctcgaaacagctgacgatgcatacgacgagcagcacgagcgcaatgaccggcttggaagaagagcgctccatcttgttctgctttcgcttgcatgttcaaagttcagaactcagagcagagacgatacacttgagcattttgctcaaaatggcaggatttatatagaattgcttgatggaattatctgtgaatgttgacatggtaaacatagtacatatgcacaatacaagtttgtccttttctctcgatcgtgttctgctcgccaggttgagttggggttgatctgaacggctggtttgctgttgcatactcgtctgaaaagttcaacaagcagatgaggtgctggctttgattttattgctggtgttccttcctttctgcctgtaccccaaccaccccgctctcctcgaggcgcagcagccgttcgcctaaaaggaaaccagtactaacctcaggatggtgatggccgcgacagcctgatgcgtgcgctgcggctgtcgccatcccggcgcgggaggcggaggagaagctgtcggctgccgggggcgagcaacggctgtctccccgtggacagccgcgtcgtcgacgtacgccgacgagaaggagagcatcccctcattcgccgtcgctgcggggtggttgttggtgttgctggcgcgggatgtggcctccatggaacggccgcctccccactgcggccgccgccggcagccgtcgtagcgccgctctcctcctctcccgcctcgccccggtggcctcctccccagccgccgaacagtttgcctagcgccgctctcctcctctcccgcctcgccccggcggcctcctccccagccgccgaacagtttgcctagagaagaggagaagagaagaagagaagagagagagagagtgtgtgaggaggaagggaaagagatggcatagcatcctgacatgtagggtccacgtaggtcccaggtcccacgctgactcagccgtcacgtaggataaaaccggagtcaaaaccaccgaagagtgaccggttttgattaattaagggacggccgatatgtggttttgcggttccgggacgattttttaactccatgacaagttgagggaccttgggtgtactttttcctcttcgcaatggggctaggctttttcgtttttggagtggcccaggaaggtccaaaaccaagtgatggctaacctgttagtaataagtccactttgactcccttaaacgtggcccgaatctaatccataaccctaaaccgtaaaaccggatatctcgactccccgaactattgaaaccggtgcaatttgactcccttgatggttttggagagtggtttcgctaacatggcgctgatgtagcaatgttgacctagtatgtgggttgacgtggcgcttaggtggcatttgaattaaaaacgtatacgtgggacccgtttgtcattcacacattaaaaattgtggggcccactgacatgtgggccccacatgtcatcccctccctctcttcttcctcccttcttcctcccttccctctttctttctctttctcttctctctccttcggccggccgcggggggcacaggacaggctgtagcggcggcgggcgagggccagagcggcggcgacggtgggctggatcaactactgtgtaccgcgtcgagctcaccttccacgacgaccacgtcgtgacctgcctcgccacgacggcgcgcggtggtcaccgcccaacgccccagcgctgtccgtggcgcgcaccacgcaggccaacggcgtgtggttgtagagctcaggggcgtgttccgcatcgtggccagctcggtgcccatcacgagggaggagtcgcgccgtcgcgcgtccacaactacagcgtcaccgacgacgactgcctcgtccacctcaacctcggcttcaagttcgaggcgtgtcacgccccgaactagtcccgaccggaactagcccgtgacactccaatttagcctgttaatcgataccagtcccaggaaacagtgctggtatcacagggagacagaatatcacagcaacagaggtctctttattatagagtagaagtacagtcatgttgggctgcggacagatcccgagctcacaactgcattacaaaagggaaacggaagccaggacttggaccaaacatcacaggcgcgacttgggaactaggccgaaaccctaaaactcatcgtagccggcttgctcctggaagaactcctcatcagcatgatccgcttcatcttcttcagcaactggggggggatatttatatagagcaagggtgagtacgggggatactcagcaagccaggggaaataagtgtttgatgcaggcttcaagggaaggctgttgtttttgcaattgattttatttgaactcttttatgaaaacaactaagtgagtgcttctcaaacgacacggatgagacagtgcgtctcgtccggtcggagtatgtgcaatgtgtcaatctttaggatttaaacaaggttggcacccggccaacagctttttcaacggccacccgggccaacaacttttcaaacggccacccgggccaacaacttttcaaacggccatccgggcctagctgatcccatcagctgtagatttttcaaacaccgaacccccttttcacacagcaacttcacaagcagtagtcaaaccaaactacgctaggaatcacctcacatccgcccatgaccgtgggcacggctgttcgaacagtttgttaacctctgcagagggggtacactttacccacacgacattactaacccgggtcacccagcccgtggggatcagccacgtcgggagacctccaagctttcatgacaaggcatttcgaaagccgacacaggtttaccatatgccgacgagaggggtcccagaccatactgtgccaggaagcccaggggtcctccccgacaccaccccggcgaatccacatgtctctcggcatcaaggctcccccgattagcaattcactcagccaggggcgtcccattccacccatgtggtcgtacttgtcttatgttcggatgaaattccaaggaaacggtccttaagtgcaagagcggaaaaccgtacacccggtacgttccccggtccgcggttttggaaattcatttagttcgcaagcaccgacccaggtgtcgggttttccaagtctttttgtaaaactccaattttacccaagttgttactcagattttaagtttgaaggcgaccgtcgatacttgcacagagtgcaccagtatcgaggcgcaactgggtggttacaaggggacatggtatagcaattaacaaaggaaggatcaaatgcgacaaattaggtaggtccgccaatctgccatgcagacgggacaaacagattaagtgcgatcctatcaatgcataatattttgcaagcaacataattaaatttcaaatataggctcaagatgttcaaaggtggcttgccttgctcgagatctggagcttgatcctcgaaatcctcgcactgcgggtcttcgggctccgaaactatacgcgaaacggaacaactcaacaaacggcgaaaaataagccctattaatgacctctaagcgtgccattagatagatctcgagatttggggaattttggaagttgaacggagtcaaacggatttacggttgggaagatattgaacttctaagattattgaatttttgatctaaaggaaaaggatttaattaaatcctttttggaaaagaaaaagaaaagaagggagggagggaatatagacttttctcggacggctagggcgcggcccaagagaaatggagcggtccggccgagctaaatgggccggccggcccaaggcgacccaaactcgcgcgcacgcgggagggaggagagagagagccggtggaccgggctcaccacgcgcggtcccgggtgggacccgcttgtcagtggctcggctcaccgtgcggagggagcacgcgacgcacgcgcgcgggcagggaagggacgcggtgcatgcgcgcggtccgcggtggacgcaggtgcggcgggcccacgcgtagcctcacggctcgcggtggatcgcgcgcacgcggagggaccgaccggggtcggcccgacccggtctggctgagctggcgccgacgtggcgcctacgtgactgccacgcgggccggcgggaggtagacgacgacccggccgcgaatggacggcgggcggcggcggcgagcggcggagcgaaccacggcgatacgggcaacagcgagcacaccgggcggttgcacgtgacaaggggaggcgagccaacggctcggattcgccggaggttgctcgacggcggcggattgcggcggcggcaaccggcggcgggagaagagggaaacggcgacgaggtcacgagaggtcgattcccggcggtgagagcatctacgcggcttcgggaactcgacgctagcgtcggattgggcggaactacgccgagcgaggccggcgacgagcgggtgctacggagctcgggcggcgacggcggcgagcacacggcgagcgacggcaacggtcggggcggcgccggctaactacggggagtctactcaagctactaccgaaagctagggggaggagatggagcgaggaggaagaacggagagaggcactaccgtgcgggacggggcgcagtgacgagaggccgacggcgcgggagtgatctctccggcctcgggccgaggaagaggaagaagagggcgcgctcggagtccccttccgcgtccacgaacgcaccggctctcccggcgcttggcgatggacggcggaggcgaggcagagcacgggaacggcgacaacggtgaggaggcgaatgggagaggaaaggaagggagggggaagacgggtttaaaagggcggcaatgtcggtttgagaggggaaccgacatgggcggtcaagccggcgagctggcgttccggctagcgtccaaagcggcgacaggaggtgacgccggcgagaggggaaaaaggggagaaaaaaaggaaaaggagggagagaaagggggctcgcccctttgccgattcgggaaaaggaggagggagcggggcgactcggcagagggagaggggctctctgcctccgccccttggaggctagcgcgcgaagtggcgggggccgggcgatgaccacggcgatgacggcggggcggtttggagcggcgcgacgacacgggcgacgggcgcgggctggcgcggcagaaggtgactgcggcggcgaccgggcggtcggccactcggcacgcgcgcgcgggaaacaacgggcggcgcggctgggcagcgggacagggcgacgcggacggcgcaacacgcggctcgggcgggaaaccaccgggcgcgcgcgcgagcgacggcgcgcggggccggctttgcgagcggggagctcgcgcgagaggagggggcgctcagcgcggctctcgcacgcgcgagcagcgagcggggggggggggggaactccccggggaaagcgagagacatagagagagagagggagggagcgtcccgggagagagggggccggggaagagatgggccgagcggaattcggcccatcgaacctgggggaggcaaactagacttttgcggagggattcgatttggaaggaattggattcggaattgaactcgacgatagatcggggattgagatcttgagatggcacggacactagacaacaatcagagaaacaaatttcgcaattagggtttttaagagataatttttcccgctaggcgccacgacggaacgggcgctacaaggcgctcaccgacgacgtccatggcgtgctcggccagacttccttcatctaactactctactgatttcatttgatgatgatgattacccatttaccctgatgagttactgactgacatggacgaaaattttataggacaacttgtctcgaatgcatgcctccactaattgccaattggcagggcagataatctccccaacaaccaacacaatcatgatgcactgatacacggtctgaagctgcatggactggaccaccggcgactccttctccggagcggcgtagcgcctccgccttcgtgcgattccggcaaccgcggagtccttcgcctatactcgccgcatttcatgccctaggaggctgccgtctcggccccccatggccagaaccctccacgaccccaactccaggtcaggaggcgaaaagcggcgcccactccaactactcctcccgtggtcgcgccgttcgcccagtacgtagccgactcctcctccacattgcaatccgccgccaccggtctggcccccacccaccgccgctgcagcctatgccccccgcgggccgcggccggccgaaggggagagaagagaaagagaaagaaagagggaagggaggaagaggggaggaagaagagagggaggggatgacatatggggcccacatgtcagtgggccccacaatttttaatatgtgtgaatggcaaacgggtctcacatatgtttttaattcaaatgccacctaagcgtcacgtcaacccacatactaggtcaacattgccacatcaacgccatgtcagcgaaaccgccctccaaaaccatcaagggagtcaaattgcaccggtttcaatagttcgggggtcgagatatccggttttgcggtttagggtcacggattagattcgggccacttttaagggagtcaaagtggacttattccaacctgttagtagtaacaaggacacatgaggttcacgtgggttttttttcttttactttttctaattcttttaaacccatttgcaaaagtttatatacataaatttacttatgcaaagtttctatatacaaagtttatatgtacgatgcatacatatataatttttatgtactataattgagtagtctaaatgcacataaatagatggaataagttcacattgggtctctctatttgtcgtccaattcgattttcgtcccttgaccgcaaaaccgagtacaaaccgtctcccaacttacaaaaccgggcaaatgtggtcctatggcagtatggagggcggtattggcctacgtggcacattgaccatcctacgtggcgcgctgaccacgtttctcctctcttttttacagcgtcgcgcacggaccagtggtcctcgcggcggagcgggagcagcgttggatggcgggagcggccgccgcggcgctcgcggcggaggacggcggagcgcggcccattcgagcacgaagatggcggcgccgaggccgccgacgagcttgaggatgacctcgccgtcgtccttccagacgtaggaccgcagctcggcgaggaagtcgccgacctgcgtgaaggcgagcagcgcggcggcgccttggaagatggcggtgactacggcgggagcgggagcagcg

SEQ ID NO: 45714 - DNA, 11329 bp, Oryza sativa
tttattatttgtcgctgacatgtagggcccatgtgggccccgctattttaaaattattcttttgtgtgtagctgacaggtgggcccatagtttttattgttttttaaaatataattgccacgtaagcgccacgtcaataccacgtgggacagagacctagtcaaacaagccacgtgggcgccacgttaaccaaaaccaccttcaaaaccgctgagggatcacgtttgcccgattttcgtaagttgggggacgggtcgtacccggttttgcggttaagggacgaaaatcggactggatgataaatagagggacccaaagtgaacttattcctaaatagattgcattatgctcgtgggccaaaaacaaaggtactccgtaccagttagcgagtgggccaaaaggcaagccggcacatgggccaaaagacaagtcaatacgtgctgctcatggctcatgagatagaaaccgaaccgatgccaatcgggaaaaacagaggcagatcatgcggcatcgttctggaaaaggaaaacacacgtagcatccaagccggcctgaaagcgatcgcacgcggtgatgaggtggcgcgatcgatcgtgtactagacgcccgcaggtgaggtggctgcgttgcacggttgcgagtgccagcccttcctgccggtgctgttcacatgcagtgttaagtgctactccctccggagttgataatacttcgttttggataaggacacggtttttaaaaaacaactttgattattattttctattataatatgtataaaaatattaacaaatatattatcttaataaagtatttttaagactaatttatacatgtagtcaccaaatttgaaagataaatattttaaaaatggttcataatcaaagattctaaagtttgatcttacccttgtctaaaacaataagtattattagcctggagggagtaactcccagctaatgcaatgcgaactattcacatgcagtgggaaggtaattataacttactgtgcgtctgtgctcattagtaaaacggtaaaaacgagtattactcacccgtcccattttaatcgcagtcatgagtttccgtattcaatttttatttattgtccgtattatttaaaattattttatgattaatatttttattgttattagatgataaaatatgaatattactttatgtgcgacttatgttttttatttttttaaaaaaagtttaaataagacggtcgaataaagttagacacggaaactgattgatgcgtttaaaatgggacggaggaagtatatggcaagcaagcaagacactaatcatccaggtagcagagaactaacattgcaagtttccaacgtcttacagatgatagtttaaagcaacacaaattattttcgctcaatcacttgtcttttctgagtttccattggtagtatcaagcagtcctcttcccagggagcagacctgattgaaaatgagagataaattaggaaaacagaaaagggattgcaagtgtggataaactattcctggtattaaccgaagagagtaaagttaggaataccataataattgcatttccagagaattacagatagaataacatcgaacacgatttaccacaataataaccctatttattaaagtgcatgcacatatttcataagtatactccatcaaaagaaaggttgaggcgcacattatatatgtaaactagattaaaaggaaggtttaggtacacatttcatttgttgggtcctattttataaaacacatttttttataactttgataggaatgtaattattatgaaatagagggagtaatacctagtaaagaggtaggcacctctgccctcttcagcttctccacagagaatttggtagaagtacttgggatggtgatggtaccatcgtaccccttgaagtggtctgcggtcaactccagctcacaacggtacccagtaacctttcaatagagaaaaaccgataaacaaaacaggagtataatacaaacagcattagtgtactgtatgctggagaatggagatgaataggagtattaccttggtggcaacccacctacttcctggggcgaaattggtgggagtgtatcccttggactggagcatcattaccatggttctagaacttgtagtcaatgccttcccgtgtcctggcagcagagccaccgagcccaaggcagagcacaccttgcactatagtacacagcattcaacatacagatataaaagtagaaaacgattgtgtaaacaattgtactatgtattaatggggtgggaactaaaacacaaaacggagaagtagattagcacataattaattaagtactattagctattttttaacaattaatatgttttaaaaaatcaactttctatatattttttctttgcaaaaactcacaccgtttaaaagtttgagaagcatacgcgtagaaaatgagtaagttgatgttgagaaatggaagaaaacatcacaataactctcatatttggttcatggcctatttggttcactaccctaccagcacactaaatgaaagaattagcagtactaaaatatagataagatttttgacacttctaattatttggtaacttaaagtttatattggtcatgattggttcgctatcaacgtagagtcaaattgtgaaactatagtgaagaatattctaaattgctagcaaatttagtatgtgtattactatatagttgcatggcttcaaaccaaatggattgcatatactatttagcctaccagaatatttgtaggacacatttagtagggcgtttgatatcaaatccaaaacatccctaaataacacacaagaacagggcttttttggttaagaagcaaatttttgctaacaaaaatattagtagttgcataaccttggtaggttttagtactaacaaatttggttgtatataacttgaactaatgtgggcaaaaaatggttgcaaaccaaataatcgtttgacactgttaaaattgccaaaattttaattgggcaaaattagcttaaaaccaaacaagcccactatttagactaccaaaaccacacaagtgctatttagagtaccaaaaaattgaatgggtaaaatttggcactaaaccaaagcagtcctaaatgttgatagtactgtgaaggaacctctaggatgtatccaaatagaacatattcaaccaattgtctaacctcagtccaaactagtaccacctctatcattcaaagccaaacaattgccatatttactatttaaagttgccgtttttaaagatgattttaagttgccaaatcgtgactagcagtgcatgctatgttctcaagagaataaactccaacctggtggtggttaaatcaaaatctgaacctcaccttacggactactacgtgtcctgaatccgggcaggtggggtagcaagtatacctccactggttcttgattccgggcaggttggtgcacgaatctggcccaggcacaaggcacacgtctctggtggtaggctctccacaggtgtcacaagaaagctgcaaacacagagaacataaaaattccagataaacaggagataaacgaatcgagaattcgagggtatcaagccctacacgttaccttcaggtagtacgcggcagcaggaccgttgaaacctccacccactggctcctcaacgaaaagtccaaagaaagccatcgcgttgcgagagatgcttgaggtgagaatgagattgattcggagcttgagacgagacaggacgcagcgtagagaagaagacgagatgggaagaggagaggaaggggagcagttgggcgaccagggcgaggctacgggctaccaagtactgtactgggcttgtgttgtgtcagctttttctttttaccattcaccgcgcaatccccgcttggagccccagctgtcagtgcctcgtgtatttagataggaacactctagaacacgcagaaaaagtagagtaaacgtactagatgaaacacaaattcaaatttaaagtgctactcttatactaacttcagtagtctagtattacttgtggatgacgaggatttcatatatacgtggacgcatgcatgccatgcatgcgcatgcagcatgtacgtcatgcaaccatctaggcatctaggagtacatgtctcgattctgtgccggcgccggcacgctagctgcggtgtctggtgttcatgactcgcgttcgcgtactccgtcgcccccaatgccaggatcaggacatacgcgtgcccgcgcacacgcgcgacggcggcggcgagacatgcagctgacgctctaaggacacaacaatcacaacggagcgtgcgctgcggcgccgtcgcgacgacggcacggacaagggatgaacggcctaggctaggcagttggcgcggggccagttggcgccagacggtactatctccatgtcgcggatggacgtacgctagatcgagcgcatccacatagacaaggatgcgctgcggcgttcgagtcctgacgaggttgccatgggcgcgcgcgcggctcgacgtacctgcaaacaccacctcgcgacgcgaggcgttccctgactgcggacggcactacgtacagcagcggacgacgaggcgcacatagtaaccaaccaaactaaaccaatgcatccggcaccggcgagctccacctccagccatcacaataggcgtctcctaggagtgcagactgcgccgccagcaccaccacagagaccagccagaggcccggaggccggagcgcgtccactccgaccagctatgccatgttcgacgcctgcccctacccgagagggcccaaaggctgctcgccgtggctacatctagccaaggtcgccgacgagaaggcggtggaggtagccacgcgcagtgcacctaggagctgctcgtggggcctcgatccattccctggtggcctcccgccgcatcagctcggcgagctcaagctcccgcgagcagcaggcctccaacgagatccggctgctgcgcgcggtcgcgtccacgccaaccacagccacgccgcggcgtggaacggaccatgcatggtcgcgacatgccggctggcatggcatggccgacgttggcacgaaaccacgatcatggacaccggctggagtgcgtctgcgatgaccagctgcgctccatgcatgcatgtctccgacgcagcccttgccgaagcgcgcgcccacaggctgctcgccgtagcctctccacaatagtcgtgtcgacaaggcaagctagcatggagatggattcccggcaagcatgctccagagaagcggcgtgcgtgcatgcatgcatgcatgcaaccctgtatggagcttaagctggcgatcatttattcatttgcatatttgcatgcatcattggaccatccgtacgtgaccactatagcagcgcatgcaggctgcagcagataacaactggcatttctatttctcgcgcgactctcgtggaaggaaatcggtagtagcatgcgaaggtttcgcggcatacgccgatacgcgttgccgcgcacagcgcacacgcgcgagggcggcgaagatagcaaaggacaatcaagtaacgcgcagcgacaactccggcaacgacggtgaggacttggccgtgcgtgccgggcacgacgaattaatgactggaagacggtggttgctctcgctacgatctccatgcatggctgctgccagcaagctcagaggcgcgcctccaccgtcggttggatggtcacggaggccagatgcatgcgccgccgcgtctaccgagagtaacagattaagatcaatctggggtggtgtttgacgtctgctttatctcacggtgaggagaagcaaattaaaccagtcctgacacaagggcggtgaaaataccgcacactactgtattgtacaactttatggaccagatgttgcgagtcgacacgagacgggatgaagttgaagagggaggagacgagaggaggtgcaagtcatccccaaggctggcgcggcagggccagctgccacgctgaggtgcaccccatcgacaacgtgttgtccacatggaccacataggtggtggaggtgaaggtggacgacaaggcaaatcatacggcttgtgcggatgtcgacatggccggtgatgacgatcacaccatgcttaggttggagcagatcattaagctatttcacttacatatgggtcccacgtggtttttttctttgcttcttgtgccacatcacccaaaaccacctttaataccgcgttaggactacctttgcaatggttttggaagatgagggatgcgttatacccagttttatggtttaggaaagttattcaaactcgacgtcaagatgaggaacctaaagtgaacttattccttcttactacgcaagtagaacgggcatgggctcaatcctaggtagaggcagatatgcttgccggtagcttcacggcaagttgtgcaccgtagctgacaaggacgtaccaaaattattatcaacaaaaaaaaacccagatacaagagatcacccccaaaaccaagattacaagaacaaaacacccccaaaccccaaatcacaaggaaaaatactaatacgccacccaagaaaagagctaaagctagtgcatacatgcaaaaagtatgccgtcgcggctccactgaaaactccccgatgggattgagctcgaggactccctccatctccacggcggcgaagagcccgtagcgaggcatggtgagagatgaggcggcgcgcgttggagatggggagagaatggagttgaggaggaaaggagtgtaccagacaagaggagcttcgagaccaatctggggtggtgtttggtgtctgtctgggatggtgtttggcatctgctttatctcacggtgaggagaagcaaattaaacgagtcctgacacaggggctatgaaaataccacacactactgcattgtacaactttatggactagatgttgcgagtcgacatgagacaggacgaagttgaagagggaggaggcgagaggaggtgtaagtcatccccaaggccgtcgcagcattgccggagggcagcgtctgctgccacgcggaggtgcaccccatcgacaacgtgctacccccagaggtggtggaggtgaaggtggacgacaaggcaaaccatacagcttgtgtggatgtcgatatggccggtgacgacgatcacgccatgctcaggctggagaagatcattaagctatttcacttacatatgggtcccacgtggtttttgtttgcttcttgtgccacatgacccaaaaccaccttcaatactgccttaggactacatttccactggttttggaagatgagggatgcgttatacctggttttacggtttagggatgttattcaaactcgacgtcaagatgagggacctaaagtgaacttattccttcttactacgcaagtagaacgggcataggctcggtcctgggtagaggcaaatctgcttgctggtagcttcacggcaagttgtgcaccacagctggaacaagtacgtatcaaaatcattatcaaccaaaaagaaaccttagatgcaagagatcaccccaaaccagattacaagaacaaaacatccccaagccccaaatcacaaggaaaattactagtacgccgcccaagaaaagagctagagctagtgcatacctgcaaaaagtatgccgtcgcagctccattgaaaactcccttgatgggatcgagctcgtggactccctccatctccacggcggcgaagagcatgtagcgaggcatggtgagagatgaggcgacgcgcattggagatggggagagaatggaattgaggaggaaaggagcgcaccggacaagaggagctttgagatcaatctggggtggtgtttggcgtcagctttatctcacaatgaggagaagcaaattaaaccagtcctgacacaagggtggtgaaaataccacaaagtactgcattgtacaactttatggaccagattttgcgagacaggacaatgccgaagagggaggaggcgagaggaggtgtaagtcatctccaaggacgtcacggcatcgccggagggcagggccatctaccgcgcggaggtgcaccccatcgacaacgtgctgcctccagaggtggtggaggtgaagatggacaacaaggcaaaccatatgacttgtatgtttgtcgacatggccggtgacaacgatcacgccatgctcaggctggagcagataattaagctatttcacttacatatgggtcccacgtggtttttttttttgcttcttgtcccacgtcagcaccacgtcacccaaaaccactttcaatactgccttaggactacatttgcactggttttggaagatgagggatgcgttatacccggttttacggtttagggaagttattcaaactcgatgtcaagatgagggacctaaagtgtcgcggctccgttgaaaactcccctgatgggatcgagctcgaggactccctccatctccacggcggcgaagagcccgtagcgaggcatggtgagagatgaggcggcgcgtgttggagatggggagagaatggagttgaggaggaaaggagtgcaccggacaagaggagcttggagatcaatctgtggtggtgtttggcgtctgctttatctcacaatgaggagaagcaaattaaacaagtcctgacacaaggggtgaaaataccacaaattacttcattgtacaactttatggaccagatgttgcgagtcgacacgagacgggacgaaatcgaagagggagggggcgagaggaggtgtaagtcatctccaaggccgtcacggcatcgccggagggcagcgccatctgccgcacgaatgtgcaccacatcgacaacgtgctgccccaagaggtggtgggggtgaagttggatgacaaggcaaaccatacgacttgtgtgtttgtcgacatggccagtgacgacgatcacgccattctcagggtggtgcagatcattaagctatttcacttacatatggatcccacgtggttatttttgcttcttgtcccacgtcagcgccacgtcacccaaaaccactttcaatactgccttaggactatatttgcgctggttttggaagatgagggatgtgttatacccggatttacggtttagggaagttattcagactcaacgtcaagatgagggacctaaagtgaacttattccttcttaccacgcaagtagaacgggcatgggctctatcttgggtagaggcagatctgcttaccggtagcttcacggcaagttgtgcaccgcagctggaacaaggacgtaccaaaatcattatcaaccaaaaacaaacctcagatgcaagagatcacccccaaaccccagattacaagaacaaaacacccccaaaccccaaatcacaaggaaaaatactagtacgccacccaagaaaagagctagagctagtgcatacgtgtaaaaagtatgccgtcgcggctccgttgaaaactcccccgatgggatggacctcgaggactccctccatctacacggcggcgatgagcccgtagcgaggcatggtgagagatgaggcggcgcacgttggagatggggagagaatggagttgaggaggaaaggagcgcaccagacaagaggagctttgagataaatctggggtggtgtttcgcatctgctttatctcacggtgaggagaagcaaattaaaccagtcctgacacaagggcggcgaaaataccacacactactgcattgtacaatgttatggatcagatgttgcgagttgacacgagacgggacgaagtcgaagagggaggaggcgaggagcagttggcgagtcagggcggtctacctctaccgcgagtagtacgtactatgcatgggtcagctttatcccagctatacccatggttcgtgtgtactaccgtatatgcattttcttccttttagaacactctagaacacacacaaaaaagaaggtcgcaattcaaatttaaaatgctatagtacttggtgacgaccgcggttcatccatacgtgtgaaggaacacacgcatgcaagagctggcgaccatgcgaatttctgtttgcacatgcatgactggaccgtggaccgtacgtccgcgccgtggcgtaccggcgtacgtgggtgacccggagcacgtacggcgttgcaacagctagcagtggcatgtggcggcaccgccagcgcgcgctgcggtgtctcgatgactggcgtcatccgtcaccaaggcggtggccggcatgcatgcagctgcagggccatatacaccctccttcctgcgcacacggccacgacaacggcggcgattgctgcagtgcagcgagacatgcgcatgcacccgaatttcgacacagctatgtacgctccaaggacacaacaatcactcggggcatgcgcgcgctgccccaacaccacggcgccgtggacaagggatgaccgggccaggcactaggcagttggctacttggctggcgtgcgcggcgccgcgaccactgtcgcttactcgtttgcatgggcacggaagccagaccgagagcgcatccgcgtggatcaggatgcgtcgcgcgcggcgttcgagttccctgccgagggtttggtgccatgagcgttatctggccggaggagggaggggggaggccggcggcagcggcgacggtgcggggcggcggcggcggctcccctcccccctccctcccatatctggctggaggagggaggggggaggccggcggcggcggctcccggcgtgggccggcgatttttttttcgttccttccatttttcgcaggcgggccgttgccccaactgcgaaaatcgttgtggtgcaggtggacctatctcccgcttgggaaaattagttttagccgcctgcaaaaatgctttttctagtagtgttggcgctctcggacacggacaggcgtcgaacgtggcgtatctgatcggcgtggacgcgctctcgctgtttctgtgtggtggtgctggtggcatagtctgcatgcgctccgaggcggcgcctatcgtgagggctggagctcaccgcgccgcctctcctcctcgccgcttccgccccccgccgccaccgcccgccactgccgccggggagagtagaggtgaggggaggggagaggagaggggaggggagaggccggtgaggagaggtgaggggaggggaaaggaggagaggtgtggaggggaggagaggtgtgaggacttaaaaaaaattagggcccgcaaatctatttatatttaattctattttcgtaggcgga

SEQ ID NO: 45715 - DNA, 7193 bp, Oryza sativa
  unsure (1)..(7193): unsure at all n locations
cggaccaattaagtggcgcctgcaaaaaatcattttcgtaggcgccgcttaattggtccgcctgtgaaaatagattttcgcaggcatacatcaaatttcaccccaatttatatttttgtaggcggtcatttggctctaaatgttatgtccgcctgcgaaaataagacccccacgtcgggaaaaatactttttccggtagtgcaaatggctgctctccgtggctacttccagtcagccaaggtcgccgaggagcaggcggtggagatagccgcagtcctggcacctggtggcctcccgcggtcccgccgtgctcatcagctcggcgccgagctcaagctcccgcgtgcagcaggccgcgccagcgaggtccagctgctgtgcaagctgcatgaacaacgtgtccccggtattggcgcaccgccagcgccgccgaccagctggcccacggcgtggaacggaccatgcatcatcgtcgactttcctggcgccggcatgtatggcgcggccggcgttgtgacgaacccacgagcacggaaaccagcccgagcgcgtccacgccaaccagctgcgtgccatgcatgtccgatccacagcctgctcgattgccatagccgctccacgatagtcgtgtcacggcaagcatgctcccgagcgaagtggcgtacgtgcatgcatgcatgcattgatgcaaccgatcgatcgcggaggcgcggagcttgagctgaccaagcagacatgtagcagctagaaatggcatgtctaggtcccgtgagatctctcaaggaaggagccaattaatattgtggcggtgcgatgtggtatgtctcaatgaattccggactccgtcttcgcagcggcagcatgcaaaggtttcgcggcataagcgttgccgcgcacaagggccgctaagatatatatctaaggacaatcaagcggcgacgacggtgaggacttgtgggttgtgttcttacccagttttcctcgattttcaaaccgttaaacggtgtgttttttataaaaaagttttctatacagaagttgcttaaaaatcacattggttcattttttttaaaaataaactaatatttaattaatcacacgctaatggattgttctgtttttcgtgcgcactgtttcggttgggaacacgctggagcgaacacagccggtcgtgtgcgtgtggcagcgtcgaatggtcggcagacggtggctgctgccagcaatagcggcgagcatatgcctccaccgtaccgtcggttgcacggccacggaggctagaacgagcgcatccacgcggaccagatgtgccgccgccgcgttagaaccctgccgagagtgccatgggcggctcgatcggcgtgcgaaatccacctcgaggctttccgcttctatcattgactgggggcaccgcgccaccgcgccgcacgcctagctacttcaaacggcgccggggcaggagaacgcgcgagctggtcgcgtcctggactagcagtgagcgagcttggacggccgccagcagcagtggcgcgcgattgtctctgtagcagcgctgacgagagtcgagagggccgcgaccacgaccacgcgctctggagtttctcggcaaggcgccggcgagcgcaataggccgcctatcgatgagttcccacgttccacgccagctgccggcggcaagcgtcctgtggttgcggagagtacctccagcgccttctccttcacgaccatggaaaccgtcgaatgtttggagttggcacgcgcacgaactctagttctgagactcttcgtcgaacaggcgtgggcgctaatatgtgaaaaccacgattcaaacagctggactaaactgcaaaattttgaagtgtcgctactcgcaaggggggctcctagcgcgcgcttgcgccagaagatcaagtcgcgagcgcgtggagctgactaggagtcatttcccttttgctacgttcaacccgtgtaagtgcccccctcctactgatactaataatgtgattagagttaattgcatgattaacgctaataaatacagtactagctaacatgaagatttaaattttagattcggagtcgaaacttttgaaatttgaaactaaaagttttgaactttggacttgaaagttctagaataggaattgatttttttttaaaaaaaatttggagttgaaagttttcaattttggatttgaaagttttgaaaattcggatgaaagtttttaatttttagttgaaagtttttgaaaatttgaattgaaagttttaaaatttaggttgaaagttttaaataattgatttgaaagttttcaattttaagttgaaagttttcaaaatttgagttgaaagttttaaaattttagatgaaagttttcgaaaatttgagttgaaagtttcaaaatttaggttgaaagtttcaaaatttcgagttaaaattttcaaatttgagtttaaagttttaaaaaacgggttgaaagttttcagatatgagtactcatgttaatcacgacacctaatcaaaaattagaactaataatgaagaattatagcgttaattaagctgtagattgatttgcctcacttgcccgactgccccttcgcgttaattcctatctatactagcacatgcatgcatcggcgctttcaggaagaaaaaaattcctgcacatgcatgcgtcggcgctttcagaaagaaaaacaaaaaagtcaaaagtgtggttgggccttaggcctggctaatgatgggccaaaacagaaacgcgcgctacttatttatctagtgcgtctgcgcctgcgccgattagcaatttcgactcgcaagtcgcaacgacgtatcccatatccttccaataagcaattccgaatttccgataggcgatcaatcgggcaccggaggcgaacgcgatcgctccacctccacccgcgccaagccagcccacccaacctaatcttccttccacgtgcactttctttcctttccaagcatgagcccaacaagcaattcctcctttccaggccatgagcccaacaagcagatctttagcccgtccaaaaaatcatatacgaagtactcaaatatcaatgtacaaacttttcattaatatacaaacttcccattcaacttttttctatgtacaaactttctttgtagatactttgttctatatcgatatattttcctatatgtatatataccttctatgtagataattttttcatgtataaactttctatatacaaaatttctataaatatttaaacttttaaattttgatgatatagaaactttcacaagaaacatgccactttctaacaataaaaatttcagattcaattaaaaaaaacaacggtattcagcccaaagatgacccagatagactcaaagtgtgagcgcgcaacccatacgttggaaaaaaaggaaaccataaaacaggctcaaaaagagaaaacgaaggaaagatggttgatcgctcgcacgatgcgcgcgacccctcgcgtgatagccttttcgctgatcttttgtgatggctacgaatccttgatgggttctatggttttgggccgaagcctgcagccgattaccgccgcagcctaaaatgcggcctgacacagtgacactgagggtgtgaaaatatgcagttacaccctctgtttcatattataagccgtttgactttgtttagtcaaacttctttaagtttgattaagcttaaagaaaaatatactaacattttcaataccaaacaaacatattagtcgaacctaaagaactttgatttaaagaaaaagttaaatggcttataatatgaaacaaacgagtacaaattaggcctactatcatagtgcgtttcatatatactgtacatatacattgacaagcttcattgtcattgggtgatccatgagccctccagatggaatctgcatgtcaactgcttgctagagtattgaattattttccagctgacatcaaattatctcttggtctataatgatccgaaccctagttgacactggagctgaacttgtaatggttatatctattgtctggcttgattgatccatacatgtagatgtctcgtcaccacctttttcgacttcattacttagctcagaaggcttcttaggatcatctaataagatcacgcttccagaactcagcattgcggcgacatccggcatggtgggccgaactgttggatcttcctgggtgcagagcaatgccacttgggtgcaccgaattatctgatcaagttcatacacattccctaatgatggatctacaagctcatgcaaccttccgtccctccacatatgccaagcctgaaaaatatgtatatatatcctttaatataattcacacatatatttgaatatatttagcatcaaatgttgcaatttagatttataactagaaaattggtgcgccgttagcgcaccatccatatagcaaaccatattaatactatatatactatttattgttattcgtaaaagcgtaaaattttaaagagatattttagcagtttttaattttatgcctacaagtctgagtaaacattatatttgtaaatatttaaattacagaggaaaaaaatgatgtcaaatatatgttggttgatggtcgatttaattattattaataagataaggctaaaaggtgaagtcttatatgaaaattgtttgggactataataattagaggtttcttataatagcactaacagttgggattgtttttttaactgcttatgaaaaaaaagggaaatgattttgttctttttcttcttcccatatttttattttctttcggcctaagtataacattctaaattctcttcatttattttacttttacattattaaatcctcgatggttaaaaatcttatcatttgtatctctaccacgctctctctttttttcccaatatttgcttatattctcagtagtcgaaaatattgtcatgactcatgactacgagagggccacatagttcacacactatttgaagagccacatgtgaatggagagggacacgcctccatatcttcttttgtgagtagtacaccatttagatgtcacaattcgtagcctcatatgtataatttggaaaactatagctataccacctctcttagggcgttcgtagtgcaagaccctcctcaaagtatcacgtaggatgagctagcatatctcaaatttgtttatcctataatgcaaagtaactctagagatattcttgatttttcatgccgggccctcatatttcttactttagttcttatgtttttcaaatttatagaatagtccaatattacactaaataccctaaaaattagaaacaaatatacaatctcacatccctatcctttcccaattccctgcttccatatcctagaaaattggcgcaccatcggcacaccaacttatagctaggatatatttactcatttagaaaaattattgttgttgttgtctagagtttcaaatgcagtagatttagaagaacctatttaatgaattttgaaaagattgaggaacgattaacttatagtaataactgtatttatgtaaagatttaagcgttgtaaaagaattaatacataaagcaaaattatgtataaaaattatgtatagtacttgcctatttgctttcaaacctttgtttttctcttccattagacagagtaattaacacctattattaattggtaagattagatcattagtggaccgaaaactaaaggatatagtttttgacaagtctctctaagagaaatttcttctgctaatatactagtgtcacctactcctctctgtagtctcatatacgatactcccccatcttaaaaataatacaagctaatcataggtacaatcaaacatagttagagcaatattatcaacaaatagagtaatatggttaattagtgtatgcatggctaattaattcttctctaccgcatttagatagccatacttctctgctgtatattataattcaacttgaaaaaagttttgctaatgaaagattaacttgtttaagcgtctataagtaccttgaacaaatactttagaagacgtgtcttttgaattagtacaatttacagaatttgtcaacctatagaaaaattacgaaatttatgtaaggcataattttttaggctaatgactctaattgtcagcttaatatgcagagccagtctttgtattaaaagattactctttgtattaaaagttaaaaccagtcttaaaaagttaaagcatcaaaggtcttggaaatcaatatgtgactatgtgagtactgacatagtttgtgcgtataaatacacgtgaagaaccatgttatatcttaatttttctagagacttcggaagggttacatatccaacttcttcacaagggtcaggcaaggtgatttattgactcctgacttttcctaagagttcagtggacagaagaatgcagtttaattatgtataggggaggacacgtggcataatttcagagtagccctagaaaattttgtagagtgccacgtggcccaatggcagcctggatgctgcaccctgaaatcgttatttaagatgtgggactagtaactcagagaatcaggaacataaaaataatgagtgttcgcttacatcccgtacaagatcacctatagcatccctctgcttataaagtatggaattctttcgtccactaatgatcactagaaccaagacaccgaagctaaacacatccgtcttcactgaataaactcctcgagatgcatactccggagctttgaaaccactgaataaagaaagattaaaacagtcaagtcaacacaagtaaggaaacttatatttatgacatgtcagaaaactcatacctagtgcccacaacccttcttgtatgttcttctgcaacttctgaactcagtgaactggatgatccaaaatcggaaatctttgggttcatgttataatctaagaggatgttatctggtttcaaatccctatggacaatccataacatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45716 - DNA, 1443 bp, Oryza sativa
tctagacctgtggatccccctggcgttgccgccactgttccgcctccggccgcctctgccgcgtcccctgtgcgccggccgacgtcgccatcacctctcccggcaccggagcgccgtcctctttcccggccaggccacgacgtcgcccgaatttcgccggaacgccgtcgctcgcgctggcctctccttcctcctcgtcggcatctcctctggcagaccctttcgccatgcccgtgcgtcagccggcgctgccgtcccctccctcggcacggtgacgtagccctccacctcgtccacccctcggtttcgcccggaagccgttcttgtccgtcgccgcgaacctctccatccgcctcaccggagttgttcggccgcccgtccctcctcgcccgtgcaccggtcggccgcacctccaccaccttcggcatcgcagccgcgacgtcgtcctcggcatcgcttccccttcggccgaacaccgccggtgtccgtcgtcgtcttcaccgttcatccttgccggctcgtcgtctcgcggcgccgcctccgtcgtcggcatcgcagcggcgtgttccacgccatcctcgcctccgtgcagccgctgccggctgccctcgtcgcctcctcgccggccccggtcgtcgtcgtcgtcgtcctctcgtcgctcccggtcgtcgtggcgttcgtccctccgtcgagccgttctcgtccgtcctcggtgtttcgtcaaggtcgctgtagccgtcgtcgtcttcgtcctcggctccgcgtcgtcaagcctcgtgccggccgcgtctcgccttcgtccaaggatcgccgccgaagtcgtcccctcgccgttcgtcttcgtagttcccggccgtctccgccgcgcccgttcgtcgttgtcgttcccacgcctcgtcgcgtggtggtaaggatctctcctctcgctgccccgtcctcgtcctttcggtgtcgccccgtacccgttgtgcggttgtcgaccccggtatccgtgtaccggtgtcggtagtcgttcacgtgtgcgggtggtgaccgtgtagtgtccgtgttagtgtgcccgctcggtagccgcgtggtttccacgtgtgcagcccgtgtggtgtctagtagagtccgtttgtcggccactcgcctcggttgacacacgggatctgcttccgtcgacccgtggaccgtctctgtgtactcggtctaccgcggtcctttaggttgacatgtggggtccgcatgtcaacggcgcagccttcctgtcttttccaggctagcgtttacacatgttttatagttgcaaagcttaattataataatccgcaaatctccatataacagcattaaacttcggatgatcatatcttggtcatacgagctccgaatcgacccgttcaagtctcttaatgtttgttataacctaaagaactgtgtgctttctttttatgtgttgtt

SEQ ID NO: 45717 - DNA, 935 bp, Oryza sativa
ggaaccaagaatatatatatatatatatatatatagctgttagagaaacattgatcccaattgctgtaagtagaagtacatcactgaaacacatgttcaacagaacaatttccaagacaagctcatccctgaatcaaaacttacactgacactcatggtaaaacgagcctgatatagtcacataaaacaaattaattgcacgggataaacattgaaacaggtatgaacatgaactacgagaatcaatcaaaacattgaagataaaatatgttcttccttcataacataatgtgtgcaattgtcaagaatcaagcaatcgtatcacaagataattcagatattcctcaaatatgattcttaatgagcttacaaagttacaacttacaaatcaacaataatgaatggagtaaccatcacctcggttttgtcgataggcaatataattggccaggtgtagaagtcatgctgccttctcttgatcaaatcctgaaaaaagttgttcccttgcatcagaaagcaacttttctgcaaacccccgtgatttctccagcccaagtaatttcgggtatgtcgtcttgtcactcgccaagtcctcccctgctgtcttgccaacctcctcagaagacttggtcacatcaattatatcatcaacaatcctatcaacctcgcatacatgcgcaaccgttcaatctgctcataagagcaacctcccaagattgccccaatatccattgatgcctcaagaatttgatgcctattcttttttctaattaaaatgttactaatccaaccaagacaatgtaatctcttcagtaaaattgtgcttaagcagctgtgagatttgagcctaaatgatatctcgagttaaatcttgttacttattttcaagtattataccacaagagggagaagcaaaagcctcacctcatggagag

SEQ ID NO: 45718 - DNA, 763 bp, Oryza sativa
tggtattgcttgatcaaactggccagaagttggttttgggacagaacccccttctgtgttccaattgcaaaggcttcccaaaaatcaggggcggatccaacttgggacatgggggttcagttgaacccccaaacttttgggtgaacaaacaaactgttattccttgaattatttaagagaggtttaaggctatcaaattaaggaggaggagaagatctagaagagaagcgcaagcaaattccagtcccggtggggtgggagagagagagagagagaggaatcagaaagaggacgcaccaggatcccctcccctccgctgcgatggagatcgccgcccggccctcccctgttcagccgcgactcgtcttggcggcggcgcaaggaggcaaggagcggaggagacaacgagaggtactcgactactctgcccttatctcaatatttttacttacctctccttccatcctattttagtatagttttgtaaagttcacatccaacgtttaacattttatcttatttaaaaatttgagacggacggtcaaaagtttaacacggattttcacggctgcacttatttgggacaaggtagtattttaaaactagctagtgttatttctttatataactggtgacccatgtatcatcaatagttaggaaaaaattaaacgattgtgtcgataacaaattcctcgtaccaccagcaaccgctaactgccactctacgcaccgccatcactgctctttctccatgaaccaccat

SEQ ID NO: 45719 - DNA, 2583 bp, Oryza sativa
gccgcatcatggtagataggtagttaactgaacaaccatgaaaaatagagacaatccattgtgtgtcactgattttgtccctgctctacaatatgtcattgggtttgtcaagttctaatatggcatcgcattttgcttaacttctataatataccatcgtcatctagttagcctccgttagcattgtacaattttattatacagattgtaaaacttaaagaatttgagatgggcaatttctctgcctagtttataatatgatattttggaattttcggccaaattttggaaatttttgtcctagggatatttcaatcattagtacaaaattatacagtactaacagaatctaaatggacggcgatggtatattatagaatttaagcaaaatacaatgacatgctgtagaacttaacaaactcagtggcatattatagaacaaggacaaagtcagcggcacacaatggattctctctaaaactaatatagttaaattgtttcttttttatccaaaacaaaacatcttttacctaaatatgttcagagaacttcgaaagaagtaagaaaaagaggaggttagtcactagcccaaacacatgagggtggttgctgctcacaactatggtatggtatatactcacattaatcgataatacactagtattattaaaattgttctttgtagtgaatggtgtgaaactaaaaactttaaccttttatattcttctgttgttccatcttcttctttttttcttattcttatttatttttgataataatattgctacagaaaacactattacttgcacatgaatactaagcagctagctcatgtgtgtatgctccgtaatatatattacctatgtttttacatgaggaataataactattatttttgttaatgatattgtatttataaaaggtatctgactagttttttttaagagaaagatatttttgctaaatataatctagaatgctataaaggttaataatattaaacgatatagtcatataattttttttggataaactagtgatcaacacttgttatgaatccaatgatcataatgcactatatatattgttcaagtgagttgtgacattcactatttactagttacatgcgtatgcattacaatgagatctacatataaaaataagatttagtttatttctagtcttgtttttatgatgtattggattttttttacatttctttagaaataatattgtataacaactaaataatttattgttttataaataaattattttatcgtacccccatctataaaatcctacgtccgccactgccaaaaatcccttcttcacattagcaactctaccagtcaaactcgatttctgcaatataaacagaattgaattgccatcgaatttcagttcaatagtgccaccaaattcgtagtaaaaaaagatcatgaagcagtgtgtcatcgacataattatgacatacataatatgttaacagatggatgacccaaacataaagtaaaataaaatagagaaatgatggaacatgcatgaataagaagaacacatatagcctgatgcatggacgaaaatagagtatcagacaacaccgaatccaatcaaatgttgcatcaaagctggttggacaagcaaaatgaagtgacgcagacaccgaaataattatatgtttgttacgagaaactgatgcaggaaacggatgattcgttcatggtagtaaacactgcgaaatcgtataaatgctgcacaaaattgatcaagacgagggtaatattaataaatgcctaatcaaactgatccaataaaacatgctagaaatgccacgaactcatccccttctctacatttatactccatttccttcaacgaatgagaacccaaacaatcttaccgccaaagaaatcggccgagcaacataaccccccaaaatcccgcaacaagccataccgcacaaacctcggccttcgccgcgcgggccctcccgccgacaacattgctgaggttccagagcggcacgcgcctctccgacctggtggtgccgcccgctccggcgctcccagccacggccgacaccggcgagcggcggcggcccgcggcacagctcggcattggggcgaccggcggagtcggggaaaaacctagacctcgtccgactccgacgactactttgaccgcttgacgacgatgagggttagccctttttggaacctatctggtttgctcgtgaagggaaggaaccggatcctcggggaaatatcgattttgctatatctcactcgaaagattttttcttatttctcactcgattttctgacttaaatttacagtgtattttcaagttaccgtgtagtttatgatacttgcattgtaacttctatatgttcttttgtaatccttaaaactcatattggacttggttttttttcttaaaatatggtaattagtgtccattatggtatttcttaattgtttttttaccttttacagtggctattgggttttaatccaaagattaaaaatatgtatgataagatcgtaaaaatctttcgaaagatgcataggtactcccgg

SEQ ID NO: 45720 - DNA, 2829 bp, Oryza sativa
accaatcctagcgcctcccgccatctggcttcacgtggacggctcggatttcccctatggcggttgtagggtgcccgaaagtttggcgctctctccgacttttttctcgacgagtgtagcttcctaggaggaattctggaggagtaccggagctgtcggtacactctgctccgggtccggagaacttcttctgtaaagtaagcattcgtgtttctttcttatgttatttaattactttgtctatgtaagatatatttccatctttgtgggttcattgtttagtattcgtaccaagtgctctagtactaggattctggatagagaaggaagttcctgcgcaagtattagagtagtaattaataacttagaagtggtgtgtaggttggagattatctttgttctttgtgtatcccacggatttgtcagaggtaggtggcaagtggtgacaaccctgaatcccgtcctagtaatcctccacgttcaaatacatcatagagctatagccggaaccacgctggcagaccagcaggggtcggtgcccgaagcaatagataggaaattacctttaacttagcttagataattaaaacacatagaaagtcctctctagcctgcctagcatatctatagttgttgtccttggattgtcttagccttaggtagattacagaaaaacacacacgctagcctgggagatctgcttaactcctgtgcaggtcctaaatcttcctcttaggttcaaagtgtgccagttgatttgatcttgcaatcaacgagaaagaagcacaaagaaatcatggttaaatccaaagacgatagccgatcggctagtgccgatgacgtatcgttcaaactctgagccaatggtattggtaatagattggcaatgagtaataaaaataatataacgttaaatctactcgatcgtttgtagatattaacgatatataatcatcttcttaaaatatatttgaaccatgtgattgggacagatcgaacagcaagtcgagacagtataaatcacttatactcaaaagtactttaagatgaagattatatatacatttatagcatagccgatcaaatagatctaatatgtatcggctaatactccgataccactctatactaagatattgaaacaaacaagatatattagataataaacctaattctctttaatgcaataagatcttaacataaagggcagatttatcatgtcaatcaagcatacaaaggacaaaatagctaaatcaggtaagatcggctgaaacaccgatactatctctattgatgatcataaaagagctagatattagtagttataaatattacttaatagatcgaactcaaccaatgcagcattaagcataagaataaatacaagatctaagcaagatgatgaaaatctctaaaagatggtagatatgctatataatctagattaataacgaaatctaactctatcgaatgctcttcggtaacagatatcaatcgatcagaggttaaatcgtgaaactaatgaagattatgaagcatatatgataactcgacgatttatataaacaatattagagtatcataaagatggaagcactaatcccgagaacgcaagccgccatgacaagtttacctctttttgaagatcgaaatcgatgcagctcaacccaaaagcaagaactcgtcgaaaacaatgaaagtagaaaagggtgacaatgcgccgaaagtgttactgaattgttgttgttaattacatggttttggatcatatttatacccgagatacatgataagtccttgccggacatgactcttatctctaacaaactctaagatacaaacgaatctttacggcagactcttgccgaaacatatctctaaagaaactattcaaaatatcctaattagtagatacaattgtctatctgcgagcttatctctatcgtggcaatcctgatgtagcacgtcggtcgattccggaaacagtgtcatcactatctcaacgaaatcggctatattggctgtatcggctatctcctgtccgatccatctcagctgatgccatcttcagccgatgcccttgcagccgatacgcactctgtttcctaaatacgatccttcactgaatccactttgtttccgatgttgaacctggttcatggtttaccaaatttggtcgttaacacacccattccctgagttcgatatccgtttggggtcacccgaaggtgaagtgctgcagcggtattccgtgcgcttgtggatttatctatggtcgtaagaaataccaacactgggctgggtcggcttggctagattgggccgggaagggaaggaaaaaggagttgggcaccaaggaggtaaagtagactttttgtaaaaagtagggcacccttttacagactgtttgaaaattggttaaggaccttaaaaagactttgggttataccttttaccaaaacaaattttctttttctaaaaaataaaaaataatcataagtagataatttttatttatcaaacccttagggtttaattttaccttatttttggcaccggcaaataacagaacaaaatttggaagagccagcatgatgcaaatttttgtaagaattttttgagcaataaatttggattatgaaatttttatttactagaaaaatatctgtgtgttgcaacggatgaaggctattttaattttattattgttatatggtttagttaaggtgaaattcactgtgcgaattcacttggatatatattctttagaaaatcatgagctgcagtttaggagactagtcgtctcaagttagcatgcgagttttttaa

SEQ ID NO: 45721 - DNA, 1997 bp, Oryza sativa
  unsure (1)..(1997): unsure at all n locations
cttatacgactcctgtacttttaaaattgaacgaacctaaaaacatatttaattttttataatatttttatttatgaaattttcaaggtgttactttaggattgacatcgtatcctatgttactgtaaatttaatgtccactaacttctaaagcttaacatacaagtatgccacatcattacatactagcaattattatatagaacattttaaatatcatgcaaatatgacatattattcataatttttattgcatttttaaaacttaatatgcaagtaatgccaaatcattatctccacatcatttttacattatttaggcatatatgtttatcatttctataaggaaaaagtacaaattaccccccaaactattgcggtcaaccaaattacccctctaaacccaaaaactatacatcgttcaccctgaactttcaataccggacaaattacccccctcgacccaatccagaacggttttatcctatatggctacacgtggaagtcaagtcagcattccatttataaaaaaaaatgtgggagccacctatcatgctttctcttctctctcactcttcctctctcttctctcggcgcggggtttggcaggccggcctctaggtcgatggagaaggggcgccattgtccagcgggatcgagccccgttccccccgagaaggcggagtccagacggcggcggtctcatacggaggagaggtccctgtagccggcggcgggcgcccatcgtcggtgcgggatttgggtgggcgagaggcagcagctgcggaggagctggccagcgggggagttaggggcaccgtcggagcggcacggtggagggggcccgacaacgccagccgtgcaccttgtcgcagtgaagaggtggctgtatcccttggcggtggcaaaggattcccccgagtggcagaggagcggcgtggcagagagggcctgacgacggagatccatgcgtcgacggtcgccatcggaggtgcggacggcggatggccacagggccggatgtcggaggactgtggggctgggcgccaggcggtcggtggcctccatccggaagaacaaggccgcgaccgaccctcgcttgccgttgtcccactgccatctgccgttgtcctcgacgccccgagcgacctccgccgccatgccaccgccccaagctgtgtccgcccctgccgccgtcccgccgcccttgtcctccaacgccctcctcggtgccgcccactgccgccgcgtcctccttgcactccgccaccgcccgcacaccgccgagagggaggggggaagcgcgccgagcggccgcctcctcatcccctgccgccgctgctctgtgtccccccctccccccgccggccgctgacctgtgagagagagagaggaagagtgagacagagagtgagagagagagaagagagagaggaagagtgagagattgaggaagagtggaaggagtataataacgtgggtgcccatattttttcttataaataggaatgactgactggaactaccacgccatacgaccatgtagagccaaagaccaccgacggagttgagtacgaggaggggagtaatatcgtaccggtgttatatagttacggggtgcaagacatgttcggcttactgttgttcaggggcggtaatttgcatcgacccgcgactagttacgggaggtggcgggttaattacgtactgttttccctttgctatgatggtagctcccctcccgtgattgttaatgtaatgagcgcccgttgacctttctcgagccaagcgttatgacccattacgttcttatgttaaatatcttgtgatgccaaatgatgaaaagtattgtatgtcagtacttaaagaacatttgatgacgaagtncaagtcataataaaataaatgataattacataaatatttttgaataagacgaatggtcaaacgttagacaaaaaatcaacagggtcatacattaaaatatgggggatcca

SEQ ID NO: 45722 - DNA, 2525 bp, Oryza sativa
ccaccgcggattgagtcgagggggggtaattcgtccggtttatatagttcggggtgaagaatgttcggttctgttgttcggggggtaatttgatcgaccgcgatagttcgggggtgggggtaattcgtactttttcctttctatgatgtactccctccgtattttaatgtatgacgccgttgacttttcgaccaacgtttgaccattcgttttatttaatatttgtgtgcaaacatgaaaatatttatgtcatacttaaagaacatttgatgacgaatcaagtcataataaaataaatgataattacataaatatttttgaataagacgaatggtcaaacgttagacaaaaaatcaacagcgtcatacattaaaatatggagatagtatataatatgcattcagtcacatgtcccgtagcaaagcaaggcgcggagtatcgactggttctaaatatattcattacctcgtctagggagcttccaaaagcttgagcatccctttcctttatctcccgcttcagtaagcaccgatatgccttagtaattaatgtccccacctcaagaatcaaattcttttcgtgttcattttttgatatggccccacccatcctgccttatggggcgcactatttctctcaactccttttaaaagatcattaagaaattagaggggctcttcttcttctatcactaacaagacaaggtttctaccaccagctataggcacatttccataaccaatcgaagttgtatgcatctgtgtaactagctctgccatttggttggaactgcccaaagaaatctacggtatgcgttactatatataaaccgatttatagtcttgtttgtggcttgctgcttaatttcctgtaaccgtacatattttattatatgaatcaatatggtctgtcaaatttgtgtatactatatcattagctagctaggtggcattgtctgagatcttacttaagcaattaactagctagtgtacgaggtctcaaattaaacaattgcatgcatagccaatgaatgcaaaatgctgaacttcaatcaagccatgatctgcagttgctgtctctttctgttttttctaactattttaagctaatgatgctgatgccaactaaaaataacattgctacataaatcgtaatcaacggacgcatattttgattgggactggaaatacaggggatcatgtagttggtaagcatattgatattgatagaccggtagcgctacatgacttgtagcgtgctaggaaaccgctagcacgcctcacaggaggctctttggtattttctcttttttctcctcctgcttcctgagttatctgttgctcctcacatccctcatgcatgcacctgtcagagcattaaaaaagttacttttctctgaatccgtatgcatccatcgcctagtaagaaaaaaaaatacttgtttgcttcagtaaaaaaattactttcttgcttcatttaaaaaagatattttcccattaaagcaaatagtttttattggttacaacatttgtgatgtttttagtggttcctttgtaattatcattttgtaaatacttttcttttaatgaaattaaatggcagaatagctactttagtccctaaagtttctccgtaggatcagtttagtccctaaccttttaaatggttcaaagaaatccttaaactttatcataaggcctagaatagtcattgggtccaccaaaatcatcatatagatatgccatgtcatcattcatgcaaaatctatgatgaattgtccaatttactcttacttatatcatagaaaaataaatataagggtgaattagacataaccataggaaaaaaatactcatccttttttttcaccgttttgaggtatacttttgctcttacattttaccttttgtctttttattttgctatgatatatataagggtaaattggacaaattatatagattttgcataggaatatgacatggcatgtccatgtggcgattttggtgggaccaaggactatatcagcccacgtgacaaaattaaaggacttgtttgaacaatatgaaagattaaggactaaaatgatccagaagcgaaactttagggaccatattggctattctcccaaattaaatcacactacaagataaagccctggcagtgattaaattaaaaaaaatatttcttgcttcctgcattgcatgcatcaatcgcccaaaagttaaaaaaaaaagggtcaatgccagattaggtcccgttaacatttccatgtcttgtcgctcttaattagtttcatccatagcaaatttatttactgaggtttattgtaagtagtaatataattacttggatgtttctcaacaccatacatacgagtataataatttatttactgtagagagtacacaaaaacaagaaaaatagatatgtgtctcctgcacgcgagcatagatagcagcagtcgaaacgcatccgatgtaaggatggcgacaggtaccgctgcgcatggtctgcttgcttct

SEQ ID NO: 45723 - DNA, 12957 bp, Oryza sativa
agcgggcccgcaaaagaaaccgatgggacctactctgctggggtaatctctgtgagttttatcgcacccgcaacgatccaggttcacgcctctttgttctcgacgatgatggtggccggcatagaagccacttgcctgaaaattctaccatttctttcgcaccaaagctcccacgctattaggatgatcaacgatttaagtgcctttcttgaactgttcactgtgcgcgagattttgtaccaccaatcttctaccgttgcgcagtctttcccactcttgtagtcaaaggtccacccttgtccatctttgtatttccgcccagatcattttggacagtgtagggctgatacaggcacggtgcgacagagggtgcaaaaatgttgattagcttccaccctctcttctgtataatctgtcagccgtcatactctaatttcgattttcagccaagagaagaacttgcatttggacggagccaagcaattccaaatagtctggttgtaaattgttctgaccgctccaatgaattggagtctaagcgagcgaagatgtagtgcaacgttaaagtcgggaggcagtgatggcagtcgcggtgagggggttgggcgcggatttgcggcgccaaagaagaacagaggcagagggtatgacgacgaacatgggtgtgaaattgcggcaccggggcaggaccattacgttgtccatggagttctgcaccgaagggggggggggagggggtaggaggaatgccaatttgctgaattgcgacgatagaagtcttcgtcgcagcgtctcaaacacgatagcaagcagcgtggcatcgtcttgatgtcaacaaaagcaagtgatcgtaagcaagcaggccgctgtggtgccagtgcacagttcacgtgggcaggactacacattagccttggcgaacacctccaggagcccgtcggcgtccgatgggcctacatatgcagtggaggcatcggccttggatgacctcaggcggcaaaggagtgttgaacattgccttgtactccgcaagggcttgatcagtgagtttccctttcagttggaatgaagccaagctgctggcacaaattaagttgcgccttgatcgccaccggcactttcatttagccagtggcttcttggctagtcgcctgctcctacgcaccccgttgccttctatggcatcgtccccaatggcatgttttggatagggcacccgtggcataggcaggattgctagggccactggcttgaacaaggcgcatagggtctctccattgtcgtcatcatcctcagcattcctcagggccggttgctctggtgccatctgttctggtcccggcgtccatcggttgcattggagttcacgccggcgatggcgaggtgagctgctgtagcagcaactgctgggtgtcgtccccagcggtcggtggcgcttctcctgctccaggcaatgtgaaagctatcagctccggtccctccgggtcgtccacaaggaggccccgctcctgcctttcctaaagggcatcatcaacctcccacaacgatggaggcccttctagatcggtcttgatgcgcttaaagaccttgcgaaccgggatggttgctccggaccaggcttcactgcctagcatgtgtagtgagagctttcccatgatcgtagcaaggcggtcaacgaccatggaggggctgagggttcacaccgtgatagctgtagaatgttgcaaggctgagagcttaaggtggaaaaaacttgttaaattcgcgtgcatgtagatcttcatcggttggcaggctcttgtgcacgggagggaggaccagcagctcattggccaccgtcaccgctgtcatcatgacgtatgccgtggcggctgctttctccagcattcaacaccgcagcgagtacgtgtgctggagcgcaccgttgagcccctcgcatctatttgattcactgccacgccccacgtccttgcctctatcgtctttgtcgtcgtcgcggtatgaccggcgtcagggatggtcccatagcttgtcggggtggtcatcgttgtagcagcttcggcagctactgctctccttgcggcccttatccttgtttccacttcgcagcccattgtgctccttggggagacgcggcggctatgggtgatgggggaactcctcaaacacgcaggccagcgactgctcgccatcgatcaccccaaggtgccaggccaggaggcttctcttcattggctcgcacttgaccgggttgaggaggtcgacggtcaccgtggtgttgtcatggatttcgtcgtagtggaggagcaccggatacttgtcgccgtgttgccattgttctagcgatgtctctatcaccaagacggacttcgtcgagccatcccacacttttttggtgaagatgagccaaacgtgtttagggatcatgctcgggttcgccatccatgtccagagcttgatgaagcgcgtgtcgaccggctgcacgaggttcatatcaactgattccaaggcgcatcggcgggcaatgacttgtttgatgatgtctaggatccaagcatggcggggaactctatcgagcactaggcacacacaaaacatgagggctgtgtcgagcgcatccttgaggctcctccacttgatgaagtgtatctcgataccccaacgattgtcgtaccccttccagagtgcgtcggcggagtgtcgactatggaggaactttatgaggaaagcctttgggtggtgtttcgtcaccgccaccacatcaccgcgtaggtcgaactcatcctttagcacttactccacctacttggccgtcgtggtcgacagggccttctttgcccaggagaccatagcaatttcctcctactcacgacgctcctgctcaagggcgaaggaggaagggttgatgcattcatcatgcatgggccttgtagtggcatttcctagaagcgccatattcccggtcagggcacacggcgacggaggtggcaggcgctctgggtgggctggctaggccagctaagagcttttccagtgtggcggccaaagctgatgagggacggggtggaggtgtgggcggcggggcatggaggatttgtgtggcaaggagcaacggcgagggcacgcagtagtgcggcaatcgcaatcgcgaacccagtggactgagtgcctgcaggagaagcatcggaccgggtctctgcaggtggacgcacgatggtttttatctaggcagatgaagcacctaccctaggtcttctcttgaaaaggcacgaagcgaggacgtggggtgggcgttgagcttgaatggggatgtgaaggccgtgccgtcctccactgaccatgggcctttacctgagtccatctgtcgtttgtagcattaagaccaccgcgattggtctacgtgcggaggtgacgccttgtgctaggctgcgcgttcgtagcctcataggagggtgggtggatggcacccgtattctccctgaggatggcaaagtaattgctccggacgggcacagtaatgactgatttcaaacttggccatgctagagttttggtagggagcgggattggagacttagcacattgcgggttgacggccgctggatccagagtctctggcacctccacgacctatatgtgtgtactggaaaaaccattttaatcgtattattattagattttttttaaaaaaaagtatatgggatttttatttgaagatagtactgatatctaatttggaatccttctagcttagcatttatattttctaagatcttatcattggcagctagcttcttgcctaaagcatcattagttttagctgtgcaaagatgagatccttcgagaaaggctggttattgaagttaccactgttgttgttgttgcctccttggtaaaacggcgggcctggttccacccctgacctccttgtggatgatatccattgttcatgaacaccgcctcttcacgggtctcaagacagtctgtctcggaatgacccgagttgccgtagacctcgcacgtgatgtgtgcatccaaggccttaacggtgccttggggcatgttcttctcttggtcttcaaggcgattcatgaggaggtcaagcttagcagccagcatttctatctccttgacagtatgcatgccacactggcgggtctggagtcgttcttcgctctagcccatgtttgaaaccatcttctctatcagatcgacgacacctctgaccgttttggagaagaacgcccctccagctgcagcgtccaggtgatcccgggacaagggagtgagtccgttataaaaattctgcaggatcagccagtcgtccatcccatgatgaggataggcggccacgtactcctgtagcatttcccatgcttcaggaatcgactcgtcccttctttgctagaagcttaagattcttatgtgaagggcattagttttgcccttcgggaagaatttggagagaaatgccgtagagcatttgttccaggtatccaccgttgcatggttgtcgtagaaccactgcttcgccttccctagaagggaaatgccatagagcatttgttccaggtatccaacgatgcacggttagcgtagaaccactgcttcgccttccctagaagggaaaacggaaacagtctgatcctgacggcgtctgggctgacgcctttcattgcgtacgtgctgcagatctccaggaactgttgaagataagcacttggcattctcgttaggcttgccacagaatgggcttgcctgtgccatcgtaatgaggctggtgtttagatcgaaatcgccatcccccaagttgatttgcggcccaaccggcacgttgtcagtagagggtgcagtgaaatagcggagggtcttctcagccatattcttgaagctcggtgacactgggatggttgctttctttgtcgaaagagctttctgcagagggacaactcgcggcttcacactcctgaagaaagcatctgaattgtcttggaagtttttcgtcaaatcaaaaccagccatacacagcaaaagtgaaaaaaaaacaaggttagcctgcaaaggacagtgactatacagaggtaaatataaagttagtagcatatagtaatctctttattaatcttcccagcaagggcgccaaaaatgtttgttagtgtttcttaacgacattatagaaatataaatcccagcaatggcgcataaatattcctggtatattacggttagtgcgcagaaagatccgcaagcgcacggatataccattgtagcatttcaccccgaagtattccaaggtatcgtatttatttaatctcaatggaagattgataagagaagactatactaataattaataatttatatgttacctatataagtcacagtctaagcttgtgttaattaattcaagggtagagtgacacgaagaagaagaagtaagttactctcattaaataaatcctaggctaagtggagaaagaataagaaaagaattcatcctaatacttccagtatacaggtatctttaatttacactatctagtatacaatcatgtagccaataccccctaactaagccctcctggtatttcaagtgaccacccctgattgtcgagtcccttacgacaacccgtcatggccgtccaaccgaaaataatatggaggagtacccataccatgaaattaacttaggattatatactaacatggaggaatactcgtactgagctgtcaccatcagcggccaacctttgttgtcccgcagcatataacccaaaataatgatatttaataatctaagcaccatgcttaaattatcaaatactactctatatccgctaccatgacatagagcaatcatttgcatggtcattatacccacaccattgcatatctctggtaagctagctacacaattatatcgagataaatgtaaagtgaagtcggtacccaaataataagagtgaagtaaaataccaaaactgaataaagaagcatattccattaattgtgtaagtcttacaaaagagagagaagatactagagccatacccgaattctcctgaagactcgaggactaagaaaactattctatttcctactccactagcactagaatactaactaaacttgagagagagctttgatcttcttgttgagtctgtggagaagtgagtgaggtgagctccttttatagactgagtatgatggttattgcagatggaaaggtcggaaatgccctacagccgttgttggaagtgaatcctgaatgtccatgccaaacactagccttaacggctgtgatgggggtttggccgaaccgtgacctggcccaatctgcccaatttttggcaggcctcctccccgttgattcctcagtccagtgacgtggtgttttgggccttttgagattatttctctggatttgtaggcccatctatccacaaatctacctctcgacggctttcgattggttgttcgtttgttttccgtcgattctccttctctttatatagcaatctctgaaatcaaatagaatccaagtacaagtaaattattctaaaacaaatatacattgtaagcatatctagttctcctttattttgagtatattgacggttgaaattggtctataacgaccatcaacaggcgtcaagcggctgttgatttgtttagcgcttaaacattcttcgtaggcgacaacataacttagttggtcacccgcctttgaaaatagcctttgatcgtagacggagcagctggccgcatgcaaagaagatctactttggccacatgcgaaaatagttttcgtagcagtgattactgcatataaagtaagagtggttaaagcattttcctatgaaggatatttagttgataatatcacaataaaagatatacattgccaatatggcccatcacgatttgcacaagtacgttgggattttgtattattaatattgattttattgaagagatagattaggtttccaacatatgacgctaaatttgcaaagagaagcattgaatcaaatatcttgattttacgccattattttttaataaacaactaggtagattcctcgcactttgctgtgggaattactaagtaattttaaatatatatgtttttttcaataatcgagcaaggagtaagcttgatgttaattattagtaacaaataaaactgatttgtctggccatgtttggagagaaataaatttaataggctttgtaaaagattatacatgaaatttaggttgttggccaagatttatatcacaagaaacaaaagatagggaaaaaagaaataaaaagcaaggatttattagtagtaaacatgtaacaaactaaataatatctctgctttgatacgggatatatggatgaatgtatgttaactattataaaaatgatggatatatttgttgaaatattgcggaaatgatgagagaggtgatgattggatctatttgcattttgatttgtagaattaaataaattatggatgatattgcatgtttgcatgagcttttttgataagtagttattgctcgtggatgacgaggtggcatatttgcatattgagctttagacttagtgagctttaactttatagaaaatatagatatgaaaacacaaaacaaaccacatatgcgcttttccacactttccatggatttgatgtatgctacatttgttttaatcattttaatactttcttcaatgattttggtacgtgaaatacatagtttattgttgagaaaattatttagttcatactaattaaaaaagttataaatgacctatgtgattgcattacttgtaatatatggctttttaatattttcagtacatgattttgtcactaacatttgaacatatgcaacaaacagtagcccaagggacagataccatcatcgatcattgattacagtatgaagcgaacatgagccaatctggtgcaactatggagtggatgggaaatccaattgatgattcttttgagtctattccttcagctctttctcttcttcactggaggcctccgacgccgtagaaccaacaaattgatactgatattcatttggctggcctatgtgggagcagacctagttgctgtttatgcccttggtctcctctctcgatatgaatacaaatccaaaattggaagtgactccttgacagtcatctgggttccatttctccttgttcatcttggtgggcaagataccatcactgccttctctatcgaagacaacaatctatggctaagacacctattgaatctcgttgttcaggtcagtctagccttgtatgccttctgcaattcatttggtcagatcagtttgcagctagtagttcctgcaattttcatatttgttgctggtataatcaagtatggggagaggacatgggcactcaagtgcgggagcatagatggccttcaaagctcagctggtggttacaaagacaaagaacaggaagagcaaaaggataataaatatggaagctatcttagcaaggtattctatgctcatcaaatggtgctatatgctcgaggattatttgcgggggtcacggtctcacaacttggccaaaaagtaagaaaggaactaacacatggtataagaaggtgtgaaaaatatgtgaaagcaaagataatagagctggagcttagcatgatgtatgacatcctctacaccaaggcaatgatactccagacatggatcggttgcatactacggtgtatttcccacatcgctatggttgttgcatttgtgctattcctagtaaccccaaagcatggccatagaatggctgatgttgcaatcacctacacactatttgctggtgcccttcttatggaagcatgtgccattggtgtggtagtggcatctccactaacatgggcacgttggagaaggcacaattatgttaatttgcttgctattgggaagatcattggagcaaaggaggagaggtcagttgtgccaatttctttggggcaatttagcctagcaacatgtgctttacatgatgggtccacacccaggataatgtccaatgcgttgtatgcatttggcttggagaagatctatagagatgtacgtcatgtgaaacacgttgaggccactgagattgttggttgttttgtggattgtttcaataatagaccatccaataatgatcaggatgaggtaattatgggggtctctaaagaagggaatgtggatgtcaggttgaacttgttgagcatatctcagcgttttgaggtcggcatcattcaactgcatttgttcacagatatttatacaacttcagtactattacttgaaccaggcatctgggaagaaaagacaggcattgtatgggaatgtgtgatgctatcaaactatatgatgtacctcctgttagcacacccctccatgttgcctgttagcagtgattacgctgtgatggaacatttgaactatatggctaaattagtggacatgtacaaatatgctggtggcaagctggatcctcacgcaaggatggacttactgctcaaagctcttgagcaaatgacaagcaacacaaactctgacctcattgttgttgctagggaactcatttatattactagggtcagtggcacattattgaagttggtgaaggagacgtggatactcctcctcatctatgctgccagcaagagccgcggtgagctccacgcgcgtcggttggacaacggatcggagctcctcaccttcatctggctgctcttggttcatcatggcctcggcaatgtggcagagtttgggttaacactaggccgctatgtcacaagtgaagccccgccaagcttatctgaaattatcgacatcccgtgagtattgaacgttatgacttttgaggtgttttcagccgtctgatcatagcaaacggacaagatcgattgctacagtaaagtgtatccctgtcacgccctaaaaatcgactaaattaataatccatattttaaatcatttctagaaattattttaaaaagccttcaagttaaactctaataatctaggagaaattgtaacataaaactgagttagataaaatctcgataatactttgcttgtttatttattttctagatttttctgggaattatttgagcaaggaaagtatttttaaaagtttttaaaatcctctcctaagctgttggcaacatctctccccctcgtgtgcgtgctgtgcagcccaagccggcccaagccgagctgctcttccccttctcagcccagccgaaaatctaatttgcctccctcagcactgttcatcttctacctctagcagccgaactgagaccgaattggctcggtttttctcctccaaatccaaccttttctcttgtgttttcctaaaatttgttgaggggaaatatttcccttatctacctctttcgtttcccccaagaatcggtttatctctccaaactaacccgaagattttccggtttcgattcctctcgtttggagtcgatctctctcacccatgcctatataaagcatcccctagtcgtcctctttcgtttgccccaagtcccgagccccgccgtcgcttgtagcgcagccgccgcgacgccctagccgccgccgttgccatcgtcgttccagccgccccgcgccgtcgctgtggtggtcgtcgccggtcgccgtcgctatctccgggttcgcgaggagaagccgcgcaccgtccgccccttcgctgccgttgcaagcagccggagcgccgccgtcggcgaggtcgccatccgagccggccgccattgatgacgtcatgctgacgtcatcatctcctatttttcagttttttttaatagattaaaacttcggaaaatcataactaattaaccgtagctccgattcaagtggttcaagttgctaaattcatctaaaatctagatctacatgttaaaaatatccacatgtattgttcatgcttgtttttgtactgttttgttgattttgtttatttgctttagtttccgacgtttcgttggagggcgtttcagttgaggaaggtttagaggtttttgtggaagctcaagacaagtcacacagatcccaaacaaacctttgagcatgttgaacccgtttaaaactaatgttttatttcaacttatgcattattttcgaatgccatcgggtggtgagccttttcccatttaattatggccgaagatgactgtattttcctatgggttataatttgattagctagaaccttatatattggtttggttcagctaaatgctatatatgtataattgcttagccatgcttagaaacataagctcattaatgggatgaatcatactacattattacttatggttatacttaatggtagctcacgatggttaatcgtgttatgttaattaattaataattaaaacctgattaaaggtgggttgtgagcgcatggttttgatggtcgtgctcatgacaattaaggaccggttcacgagctactgttgtgaaacatttaccgtgccaaccacaagccagcgtgggcaacggctttaccttttgtatagcatggttcattatggggtgccagactgagaagcggcgagaagtccgtggggggtcgctggggagtccatgcctctggttgtagagggggtgattatgatccaggtatggtgcactgtggtgagttgtgttgtgcgaggggtattgtcacagttcctttccgaggtaccgtggtggtattgaggcgcatggtaacatgttgtggaactgtgtcttgtgggtacagtggtacatctctggccagagtaaaactattcgaatagccgtgcccgcggttatgggcgggtctaacaatgtttttcgtaattagtctcacattattcattgatggtaattgtgataattaatttgactcctggtttggaatggtatattcctggtatggaggtttgatttgtacaaccggggttggttgttcagatgaggttgggcatatgcaacacgggtgtgttgtatggtgtttacttaatactgattaattattcaactgttttactattctcttaaatatttattaaatgctgtttatgcaaatgagctatattatgccatcctttgttatcctatgcacttgcatatttgctgtgtggcttgttgagtatgtcatatgctcattcttgcaatattcattcattagaggaggtgtacttgagtgaaggtgatgatctggaggactaggcttggtccgggttaagttgcctgtggagtggagtcgccatagctgttccgtagtttgttttattttctgctgcgtagaattttattttttgagaggaactatccacctctgtaataatttgctattttgcgaatattaattagttgtttaagagtactctattatcaatttgttattgtgtgcctcggctgattcctggacgaggatttaacacacatgtaagcgtttggaattttggatagaagttccgggcgtgacaatccctgaccttattgattagattggatgttacttgtatatatgtattagcaattcttatcgattcttacttattttgtagttctattctacatacttatgtgttggcggatggcatgaggcccttcgactaaatctgccgaaacccgtggcgaaggctatgaagcaagaacggcacgaggcgaagagtcgtacgagtgccttgccaggtcagaggcgtcttaggcgaagggtgtaagccgaagactacctgccgaaggaagacgacttcgccatggcaagttcgcccccgcgagggccgaggaagcctttccggcccatcaagcctaagggctatagggccggcgatcgccagacggcccatcaggggcccatgagcccctataacattatgtacccctataaatgtcccttttgtaagggtaatcatgtaaatttccctgtaca

SEQ ID NO: 45724 - DNA, 1778 bp, Oryza sativa
gcaagagacgacccagccctctccgccacaagccgcacaggcgccggtgtacttcgccgggcagcatcaaccacctggccaagcgccacaatcagtggcggaaggggcttcggctctgtaggcgcaactcctagctttccttcagcaactcaaccaaccccactgcatttcaagtacaaccccatcggcccgcccggaggggaatacaagtcaaggtacgcttaattggttgccaccgattcagctgggcctgggagtttcgccgtggaatcaaggaccgcagttcgacttcgtcaacgctgctcaggcgccaaccgttcggcagcaagctccgactccaggcttcggaacaaaccaagcaccaattcaagctgccatgatgtggtcacagccaatttttgacccgtccatggcggctcagcaagtaccactagttggagccgggcagccgaacgccatggcccaacctcacgcacaagctgcgatttcgccacaccgtacccgcagcaaggtgcggtaaacagggtgggaggcgaaaaggggctaccgctgagtgggggaatcaagactcgtccaatcccaccctagttcaagttcccacccgtcccgcgctattcgggcgaaactgactcgaaggagttcctctccatctacgagtcagcgatcgaagcggctcatggtgacgaaaataccaaggcgaaggtaatacatctcgctctagacggcatcgcccgttcttggtatttcaatttaccagccaatagcatttactcatgggagcaattgcgcgatgtttttgtccttaactttcgaggcacctacgaggagccgaagacgcagcaacacttactcggcattcgccaaaggccgggggagtcgataagggagtacatgcgtcgcttctcgcaagcccggtgccaagttcaagacataaccgaggcgtcggttataaatgccgcatcggccggtttgctcgagggcgaactcacgagaaaaatcgccaacaaggaaccacagacgcttgagcacctacttcggatcattgacgggttcgcaaggggcgaggaggattccaagcgactgtcacgtcctgataaattcatcccgaaattaaaaatcattcgctaaaaggaataatagaattaattaaaattcggaaaaaaattggcaaacactaaaatacgtacaagaaaaattcaaatgtggcctggagaatttttgttaaattctctttggtctaaaaggagccctcaaattttacttgaattttcagagcaccaaaaatatttattaaacaacaacaacaattatcaaagtttactaaaaagaaaaactaaaaataaatccccctcctccctttgggccaagtttggcccaaagacccctctctctttctctctctcggcccgcggccaaagtcctctcttcctccctctattcctctccctctcctcctctccctccttctcttgggcctcctctccttcccctcggcccactccctcctcctccctctctcccccaggccgcctccccctcctctcctcctgggccggccgcccggcccaagacgagcggcaccctcccgcccgtgccgcgcacgtgcgcgcgctgatgacgcgtgcctgaccggtgggtcccacctgctcggtcgtctccttcctcccgcccggcatcctctctctctcttctctcccgtgaaacctagcgtcgattcctcccctaaatccacgcgattcaaaccgggaattccaaaattgattacggggaattaatcc

SEQ ID NO: 45725 - DNA, 2189 bp, Oryza sativa
tagcgttaacacatgttttatagttgcaaagcttaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttccagaagcgtggttcgcggtcgtcgccgaaggttcggaaggccgttctctcggagcaaggcaagtcacatcatccttgagcatattgaatcccagtttataaaattattttgatttaaattaatgcattatcgctttatttaaattcccgcgttatcactgttttatctagccatgcctatttacctttgttatgaccttatcattgttgttattgttactattaccttgttcaccctaggataaacaaaaccccaactagtgggtactctattcatggtcccactagtatgaatttaggtagatgcttcgctgattaattaggcaacattaggtggtttttataactttagactttgggaattctcatatcatttggacactatggaatggttggcttatggtggaattggacatacccctctcttcctctttcaaagcccctaaaacctgtttttcggtggggtttgggtgcatgccagttgtggaaagtagcaccccggccactataaggatgaagctcgggcctctgttgcaaagcactaccgtacttccacatgtctagtgggtaaggcttagtttgtggctcagtctggttataaacaaaagtacacggatggagatggacgaagtcgggggtcgatggacatatctaggacaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggtgcacggccttgattaataatactgtgtagctctaggatcgtctttttaaaattggctttgggcaactaagtgacttttaagtgcaaaacctaacccttatattattaccccttgtacccccttgcattagtcatgcatctgccggtgtggcttgctgagtactgtggttgtactcatttttgctcaatctttccccccccccccttcagtaagagaagctttggagatgaagtcctaggtggagtcctggcttataccccagttgagcgcctgtgaagatggagccgtaggcccgctagtccgctgctgtttattttttgattgtcaggccttaagtgcctttgtaataatgtaaatattatcgatataataaagatgtgtcttttatatcatgtttgtgtggtgtaccccggcttttcctgggacggggattaatacactagcgttcgggaaaatgtatttttctcagtcgtgacagcgacggcatgctatacaagctgagtacgacaaagcctccgtcgccgctgctcaagctcaagcacaagtgcaagttgccgaaccacctcccctctctgtccgccagtctcagccggcgatccaaggacagccaccaaggcaaagccaaacccccataacttggagaaagttcagaatagaccgtgcaggcaaggcggtgatggctgtcgaagaagtgcaagccctccgcaaggaggtcgacacccagcaagcgagcaactatcagcagccagcccgcaagaaggtccgaaaggacctctactgcgcctttcacggacgctcttcgcacagcacggagc

SEQ ID NO: 45726 - DNA, 13162 bp, Oryza sativa
cggcagaaaagatgcagacccgtatggtccacagcatcacttcggagggtgaaggagcgccgcaatatctgaaccagctaatttcttttgggccagaagacgcagaaggagttatgttcccacatcaagatcccctggtaatctgagctgaaatagctggtttcgaagtccgacgaatcctggtagacggagggagttcggccgatgttatcttcgccgaagcatatgccaagatggggttgcctacccaagcccttaccccagcaccagcatcgctccgcggtttcggcggggaaccagttcaagttctcggccaagcactcttgctgatagcctttggctcgggggagaacagacgtgaagagcaaatactgttcgacgtcattgacatcccgtacaactacaacgccatcttcggccgcgcaaccctgaacaagttcgaagccatttcccaccataattatctcaagctcaagatgcccggcccgacaggggtgattatagtcaaggaggttcagttttcggctgcttcaaaaggcgatctagccataattaacagagcagtgcacagtgttgagaccgaactgcatgaacggccgaagcacacgccaaagcctacccctcacggcaagataacaaaaatgcagattgatgatgccgaccccacaaagctcgtatcactgggggcgacatggaagaagaagttgagaatatcctagaggtgctcaaaaagaacatcgatatcttcgcctggagccctgacgaggtggggggcgtcccggcggatctcatcatgcatcacctagcagtcaagccggacattaagccaagaaaacaaaagttgcgcaagatgtctgccgatcgccaagaagcggcgaaggccgaagtacaaaaattactccgggcaggggttatccaagagattgaccatccagagtggttggcgaatccagtgctggtgcagaagtcaaatggcaaatggcgcatgtgtgtcgatttcacagacctgaacaaagcgtgtccgaaagacgatttccccttgccgcgaatcgaccagctcgtggattcaacagctggatgcgagctcatgagtttcctggatgcatattccggttaccaccagatccacatgaacccgctcgacatccccaaaacatccttcatcactccattcggcacattttgtcacctcaggatgcctttcggcttaaggaatgcaggagcaactttcgccagactggtgtacaaggtccttagcaagcagttggggcggaatgtggaagcttacgtcgatgacatcgtcgtaaaaagccgcaaggctttcgaccatgcgatcaacctgcaggagacgttcgacagcttgcacgcggcaggcataaagctgaatccggagaagtgcgttttcggcatccggcgcaggcaagttgttgggtttccttgtttccgtaagaggcatcgaggcaaatccagagaaaatcgatgccatccagcaaatgaagcctccgtcaagtgtacatgaagtacaaaagctcgcaggccgaattgcggcactcagtcgattcctctcaaaggcggccgaaagaggtttgcccttcttcaagaccctccggggcgcgggaaagtttaattggacaccagagtgccaagcagcattctacgagctaaagcaatacttgcaaagcccgccagctctgataagcccacccccaggaagcgaactgctattatacttagcagcttcgccggtggcagtcattgctgcactcgtccaagaaacagagtccggacagaaaccggtctacttcgtctccgaagcactgcaaggagcgaagacaaggtacattgaaatggaaaagctcgcttacgctctagtgatggcttcgcgcaagcttaagcactacttccaggcccacaaagtcatagtgccatcacagtaccccttgggcgaaatactccgaggcaaggaagtcactggccggctcagcaagtgggcggcagagctatccccgttcgacttgcattttgttgcacgctctgctatcaagtctcaagtgctagctgactcgtagctgaatggacactagtacttgcccccgaccccgagcccgccgaacaattctgggtgatgtgctctgacggttcgtggtcgcacaggggggcaggcgttgcggcagtcctcttctcgccgaatggtgtgccgattcggtacgcagcaagactgcagttcgacacaaccaacaatgcagcagaatacgaagctgttctcctgggcctaagaaaggcgaaagcactgggagtccagcgcctgctaattcgaactgactccaagttggtagcaggccatgttgacaaatcctttgaggcaaaagaagagggaatgaagaggtatctggaggctgttcggtccatggaaaaatgcttcaccggcataacggtcgaacacttacctagagactagaacggggaagcagacgccttggcgaaatccgctgcttgtggtggcccacattcgccgggcatctttttcgaagttctgcatgctccgagtgtgcccatggactgctccgaagtcatggcaatcgaccaggagaaactgggcgaagacccatatgactggcgaaccccatttgtgaaacaccttgaaactggctggcttccggtagacgaagcagaagcgaagcgtttgcaactcagagccacgaaatataagatggtctcgggtcagctttaccgctccggggtgcttcaacccttatttcattgcatctcttttgccgaaggcaaagaaatggcaaaggacatacactaggggctatgtggcgcgcactaggctgcaagaacagtggcctccaaagtatttaggcaaggagtttattggcccactgtgttgaaagtctgtgttgagcaaataatgaagtgcgaaagttgccagcgtcatggccgaagccaatctgcgccccagtatgatcggcagcccattgcgccaatatggcccttcgccagatgggggctggacatcatggggccgttcccggtggcgcgaaacgggtataaattcgcaattgtagctgtggaatatttctctcgatggattgaagccgaaccccttggggcaatcacttcggcagcagtacagaagtttgtatggaaaaacattgtttgtcgtttcagagtgccaaaagagttcattactgactatggcaagcagtttgactctgataagttcagaaaaatgtgcgaagggcttaacctggaaattaggttcgcgtcggtcgcacttgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggatgccaaaggatggcataatataggctcatttgcaaaagcagcatttagcaaagagttaagagtaataaaacggtagagttattgattagaaattttaatcaacactgaacagcacacccatgctgcacaggcccaaccatccaaaacaaccatacctggctgtacagatctaactccaaaccaggagctaaacaaattattaccagttatagcatcaataattattgtgagaggtgtgagactaatcatgaaaaacattgctcaacccgcccataaccgcgggcacagctattcgaatagttttactctggccagaggtgtaccactgtacccacaagacacagcctcaacatcatgtctaccatgcgtcgcgatattggaaagtacccgaatagaggctgtgacaataccctctgcacaacataactcaccacagtgcaccattcctggatcataatcacccccttataaaacaaggcatggactccccagtgacccccgtgggcttatctccgccacttctcagtctggtgctccgcaatgaatcatgctatacaaaagataaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatcaagctgaaccaatatataaagctcaactagtcaagttataataacccaaggtatcaaggaataaagtaatcaatgcaaacaggccataacaaaggaatagattcacaccacccaatggcattcgaaaataaatgcacagttgaaataaatagagaatttaaatataggaacaacatgttcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtagatcatgattttagatgaattatgagacttgaacggcctcattctgacttcatatgaatttattatgaattttacaagattaaatctaattaaagcccatttaaaaggaattaaataaatttaattcaatttatggataattttaatatgtagatctttattttatataacttttgcaacttgaaccacattaaactgagttacaatgaattagttatgaatttttaaagattaaatcggattaaaacacttatatggattttaattgaattatgacgcaataatgaattatcttttgaaaaggaaaagggaattattgcgtcagcggctagggtttgcggtggaccgggtgcacggcggcggctcacgggaacgaacggccgagatcgatcctatccaaaacggacggccgagatcgatcagtccacgaccgggccacggcagacggtcccgatgacgtcagcgatgacatcaacaccggcggcggctcggcaacgcatgctcgccggcgaacgacggctcgacgacgcaaacggaggacaccaacgggtagagggcgacacggcgaactcaccggtgaccaaaacaacggcggaaaagcaacggacggcgccgacgacgaggaagaagcggcggcggtcttcgggtcgacggtgacggcggtgctccggcgatcgacagcgacggcggaggggcggacgaggacggcgacgcgacggcgaccacgacggtgacctccccgagcgacggcggcgactggagcgatggcgaagcacggctggagcggcggcgacgacaacggcacaaggttacacggggctagggtgctaccgacggcgagagacgaaggcgagggtggcggcgggtagagggaagctcgggggtccttttataggggcaaggaggtggaggcgaaagcccacggcgaccggcggcgagatggaaagctagggttcggaggagagagatcgatccgaatcgaactcgaatccacggatttccaaacgaaattagccgacgattccataagagaaaagatagagtggatcgcggggatcttttcccctctatcgattcggccggagatggaaaggagcgatggaatttggaagggcggcggcggcttgcgcgcggctagggcacggctgcggcggcgcgaggaggacgacgaccccgacaggtgggtcccgcctgtcagcggctgagagagaggaggaaggggcgcggcggactgggccgactggaccggggagggagagagaaagagagaggttttgggccggctttcggcccaaagccaaaagagacttttaaaaacctttttcaatttaaattattcatgaaatacaattccatttattaaaaatacttccttagctcaaataaatcccagaaaaatctaggaattatagaattaagcaaagtatttaacaaaattttatctagcccaattttatattgagatttagcaaattaaaattagatcttatcttttaggcttttaagatcatttctaattattccttttaaacaacagtttataatttaaggatttttaaacaagaaaagctcttaacaattataattagatcattattgatcaaataattactgaactgttctttgtatcatttaggaattgagctctgaaaaatccgagaaaatttcagagagttgacttaatcatggagaatttaataaaaattaaatccacccatgctttatatttaggaaattttatttcccacatttaacttcacttgtaaattaatgaagatttaatataaattctaataataatttattaaataatttataaatcctgaaacgaaaatcaggatgtgacaacacccgcagtcaaatggggcggccgaacgtacaaatggcaagatcctaaaagcactaaagaaaagactcgagggggcagcgaaaggcaaatggccagaggaattgctatcggttctctgggcccttcggacgacccccacaagaccaaccaagtttagtccgtttatgcttctttattgcgatgaggcaatgaccccagcagagctaggggctaactcaccaagggtgatgttctctgggggcgaagaaggacgcgaagtatcgctcgaactcttgaaaggagtaagagtcgaggcgcttgagcacatgcacaagtatgccacaagcacttcggcaacttacaacaaaaaagttcgacccacggagctgatgcctggtcatttcgtcctaaagaacaaggcgaacccagtagcggttggcaaacttgaatcaaagtgggaagggccataccttatcaaacacaagtccaggatgggatctttttgcctagcgacactcgaaggcgtggagttcgaccattcctagaacgctgcctctctcaagcgcttctatgtctagaatgggtggcacccaaatcgccaaattgtaaaaatgtacatactgtcatgtaagcccttcagcactatataagcccttcggcactatgtaagcctttcggcaagaaaaaaaagaagaaagagagaaaaagaaaaaaaaaactagatgtagggctattatccaccatggaggccctaaccagtataaaatctctgtgtcctccgccttcttcttatttttcgtgtgattgataatttgtggaaaaaccccaaggaaaacgcctgatcagcgaaaaaggccaggggggcgaaacgaatcggccgaagcatcgctcgccgaacgttgaaaccgcaacagcttgtctcggaaaataaatagccgaacgacattacgtccgatcagcataaaagcaaaagcgcttctctcgacacagaacgctacagatcaaagatgaacgacgaaaagctgaaaagtcagtacacctatttcgctaatatatgcaaaggggccggcatgttccgacctaacggaagcacaaaatgtgacgatgcaaacaatagcgaaaaggaaataaaacacgtctttattaacttcgaaaaaaataatcgaagaatagaagtttcacaacacgacataattcaccttacaagtaaattacatcttcgtccccataatcactatccctctctaaggaatgataaggcgaactaggttcgtcatcactactaatatcgtacacaaccttaagaggagtggggggtgcaacacaaactaaactgtaacgacgctgaaagttcgttccctgacgattagtcttctgatggtttcgccaaaagcgagccatatcctccaaacgttttgaatgaacaagatcgtaatcttctaaggttcgcccggggtgcgcccgcagccagttggcaaccttgaaaaccttataactgcgaccgtttatctccatttcgcgataaacaggccgaaatggacatcgcaccttcggcagacccttcactgccacaaatttctcattttgacttcgccagctcccgaaagggggccggatgaacgactttcggcgaaccccctgatggacagtgcagaaaaagcaaaacgcagcttacatagtaagaataggcggaagaagggggaggtatggcataatgcgagacgagcgaaataataatacgccaaagacttcgatcatcaaaaagtaattaagattgtcacacattccaaatatacaaaaaaaaaagccttttttttttaaggtttggcgacagcctgccgaatgtacaccattcgcctctccaggcaaactcaaaaaaggaagcaaaactacaaaaacctaaggaaagggcggagggcctcacacctctaggtgatcctaggcatcgcctccaacctcttcgcccaccgcgtcctctccttcgccctgatctgccgcctccgccttcgccagttgctccagaaggcgcgccttggcagcggaccggccgtctttctgccagaattgttttcgccacgcgcgaagagcgggcgaaatattctgcgcactaatctcccagtcccacttcgcgtaggtagggaactcggcgacgtgctcgcagccgaactgctgcaagaggcctaaggtgaaagccgccgatacacgtgcacagcaatcgcgccgtacgcggtggcgcagtccgaaaccaatccgccagcctgctgggtccactcggagaagtcgaaggctgaggcatcctcgatagggaccccccgcaccttcgcgcccatgtcggtaagggcgaggcggagtgtttggcaagctgttctcgcagattcggtggtcttcgccatctcctgcgaaaaccgctgcgactcctccgcggcactcgcttcggccctgctagccttctggcgaagagactccatcttcggcttagtaaggttgtaatagcgatgagcaccgccgaatgggccttctccttctccagttcggccgtgaggcgatcaacctcggcccaggcctctttccccttgtccaattcggactgaaggcgtttgacctcagttttcgccttcttgagggtgcggaccagggactccacctccaggttcttgcggcttatttcatcatccttggcccgaagacggctcttaaaaccgtcaaaacgggcccgcacggttcgctctttcgaacagtgagccgcaagaatctagatgaaagataggagcgggcgaaaagaaaaaaaggttaactgcgagacgtaaaaaaaagagggaagaggaaaacgaagaaggaagaaaaggcatacccgaaccgccagacttttgatggtggaacacccctcgtcgaactcgttaagttcggtgaacaggctcggggtgccggcgggcaagaaagattgcttactccctccacaaagggaataaggtccggccgggtctcgaagtcaccaggggcgaagtggggcgccgcaagggaatactccgaggcaaatgcttcggcggccgcacacttccccttcgccttggccagcggcgaaatggctggctcgcgcacagggctcccgaaaaccctcgccgcagccgacaagatccgttcggcggaggcggaagccccggcggcggcgctaccgcctgccccagcaacgccgagcggagcaaggggagcagccgaaaggtccaaactgcggccagcaggtgaggtcggagtctcgtcagaagactcgtcgtcgctgaaaacgcgagcgatgtcgaggaatcccttcttttttaagatcttcttgaccagacctcctttcgccgccttgcccgacgagaacgcaactaaggccttcgccccttccaaatcctttcggcgaagaggggagctgttcgactccaccccagtctcgttgtgatctggacttggggtaggagtgtagccgggggtgtcgacgcggtcttcggtcgcctcgttcgcggccttatcagccacagcctccacctcctcctcttcctctccttcctccttgccgtcacgttcttcggcatcatcctcgtcatcggcgtcggagtcagacgaagcaggaacccttcgcttcctgggggcaagcttcacttgtccacgcatccgctttcgcgaagggcccgcatcgtcatcggctttttggggattcgcccagggaggcagttcgccgttgtaaacccggttcgcccgcccagccgcttgtcacgttagcagctggctatactcgactaccgaaacatcgccgatcatcctgcgggcttcggcttcggcctagttgagggtcgacactgtaaaagtaaagggtgtagctgcgttaaaggtcagacaagacaaaataacaaaacacaggagtgtatagcaaaagaacggtcttactgttcgtcccctcaggaagaaccaagttcggcaaaccgtcagcttcttcccattgctcgatcgtgacttgccacgactaggagaggggaaagatgcgaagcatacagaactcctccaccaagtcacggcagctaaggcaggagcaaaccttgcacaacaggacgaaccgcgcctccatagcgccgtccacggcgatcttgggttttcggttcggcgcaatcgccctacgccggcaccggagggcttttgccgagtcagaaccagccgcgaaagggatggtgtgatagaaccacctcgacatggcagcgttcaccggccagagatcggaccgctcggggcgaacaccgtcttcttcgttccagccggggtaatcaccgtcttcgagttcacggtggcgatgaatatggcgccgaagagctcggcgctaggctcaaacccggaagtccggcatgcccagtcaaagatggagattcaaactagcgccgccgggctcaactgcggaagctccacctggaaaaggcgaaggatctccggcaacaacacgttgcacggaaaccgtagccccacctcaaaaaaggcggcgaacaccaccgtccggttgtcgataggctttggcaccacggccttccctggggcgaaagcttgccccgcgaccaacgccccagagctgaccagcttcgccagctcaacgtcgtccacaagagagacccccaaaaaggcggtgctgtcatcatcgactcggccgggatccagccctttcgctgaagcagggtttggcttgcgaggggccatggagaacggtgcgtttacggtgacgaaaaaagagattgggcgaaacgcctgaggggtcgaaagatgctgtggaaggaagagacggaggaagagagcgcgcacggtaaaatggcaagtgtggtggtgaaaaggaaagagcagtgggaatatatagcccacccaggcgaccgttcgcctacccaccagtaataaagcgccacgtgtcgcaaaggtaggcgaaacggtaaattcccaccgatcgagcagcacagtaaaaagcccacgatgggaaggcccaatactgttctgttcggcccaggaaaagagaatatatataaccaccaatcgcaggaggcgaagcgcggcaaaataataccagccgcacaagtaacaaacttcattcgcaggaataatgtaggtttcggcaggagcatcggtcgaaagggggcgctgcataccataccacatggtttgcacggtctcggccgaagctccaatctcacccttacccgtgaggggcttgttggcggatggcatgaggcccttcgactaaatctgccgaaacccgtggcgaaggctatgaagcaagaacggcgcgaggcgaagagtcgtacgagtgccttgccaggccagaggcgtctcaggcgaatggtgtaaggcgaagactacctgccgaaggaagacgacttcgccatgacaagttcgcccccgcgagggccgaggaagcctttccggcccatcaagcctaagggctatagggccggcgatcgccagacggcccatcaggggcccatgagcccctataacattatgtacccctataaatgtcccttttataagggtaatcatgtaaattcccctgtacaacctaaaccctggtagtaagaacctgtaatggggctataaatagtcccctagggccatgtaatggggggatcccaagtgaaattcaaaatttaatacatttcatttttccaaccactgttgagtaaccacgtctttcgacgtatgcagttgtcgtttcgacaacattatgtatctgctagcatactgtttggtagcattaaaacaaacaaacaaattaaacaatagtaataatgcttgttcttttttgtaattattattactgtttgctctagggccattcacagtgcaaaatactactacgagaagcctcgtagtgccacataggacagagacacatgtctcaaatgactttctccccacagtgcaaagtagctttttagagatgtttcagtcttgcatgccagaccccttttttttaattatagtccccatattttgtaatttacaggaaaccacaatattttgccccaaacaccacataaattagaaaaagaaatataaattttgcacctccccttcgctcgcaaggaggccaccctctatctcctccgtgcaccgcgcaccctctcccgaactgcaccgtcggctctccttcttccccgccccatgccgtagtcctggatctggtcagtgagcttcaacctcggacatccaagggaaaaagtgggggtgatctagtactactatggtgtttagtccacatctctatggtagttgcttttgcaccatttgtagcagcctcaaagtatatatggccaatcttgcaatcacctactcattgtttgttggtgcctttcttatggaagtatgtgctatcggcattgtgatattgtcatcaatgacataggcacattcgagaacccatatgtcttagtttatctatcaggaagaccattgaggagcagagaagttagtggtgtcaatttctatggggcaacttagcctaacaacatatgtaaa

SEQ ID NO: 45727 - DNA, 2023 bp, Oryza sativa
cttttatcacttggagggtgactaacactaatcaattcagtgcttaccagcctaccaatgtatatgatgtcctttttggaaatacctaaaggagtgatcaagaagattgattatttccgatcaaggttcttttggcaaggggatggacacaaaaggaaatatagactagcaaggtgggacatcatatgttgtcctaaagaccaaggggggttgggaattcaagatcttgaaattaagaacaaggctctccttagcaagtggttgtataaactactcactacagatggtgtgtggcaacaaatgctaaggaataaatatttggggtcacagcctttgtctcaagctcagtggaaagcaggagactgacacttttgggctagtctaatgaaggccaagcctgattttctcaggtttggctccttcaacatcaaagatggctctcaagttcggttttgggaagataaatggttggagaatgcctgtttaagagaacaatatcattgtctctataacgttgttaggcataaacatgcaactatttcagaaattttccaaaccagtcctataagcttttcttggcgcagggaccttactggctctaagttagtggcgtggaatcaccttctctcacgcatcgctaatattatattatctcacgaccaagatgagtttaaatggaatctaaccactgatgggagattctcggttaaatctctttatcttgcgttggtgcagaccgatgttcccaatataaacaaaagaatcaggaagatcaaagcccctctaaagattaagatcttcttatggtacttacgtcatggagtagtcttaacaaaaaataatcttattaaaaggaattggagaggaaacaagtcttgttctttctgccacaaagatgaaactattaatcatttgttgtttgattgtcgttttgcccgcgcagtttggtctttaatccagtttgcttcgaatattagtttacctaatagtacaactcatatgtttgggcattggataagaagacaaccacgcaatttgagatctttggtcttattaggggcaacaaccactatttggtctatttggctttgtagaaataatgtggtttttgaaagaaaaaacatatcttctcctttgcaggttatcttggctccgctcataggctatccttcagaaggtcaatttgcggggtactatcattgcggcttgtcaacaattggagctagtggccatggagttttctaccccggcgcatgggtggcgttctaggctacggttagagggctcctgaagttctttttgtccctgctatttggatgatgagtttatcttttgtttctttcttgttggctgtgtgcactctttgggtgcagaagccggaggtgctctcagaataattgtttcacttgatagaattttactgagattaataaagcttccattatcttaaaaaaaaatatgatatctcttaactgagctttctagctcttccgatttcggttcttagtctttatttttgcggattgtcaggccaacgaatcaacctcaatgtaacttactgagttcaagaaagcttttactattaaaaaaacaaatcaacctatttggttgtttgatttctgggttagaaataagatttttgccgtagaaatgcagcctgcagggctgaataaacaacggacggctgctgctgtttttgcgtcccagtcactctcatttgatagagagagccagtgtctttaacatctgaagctgctgttcaacacctgcaaacccagtgccacgttctgaacctgcaagcttctgcttgtgacgttgtcaagctccaacaattcatatcagctaactagtagcattatagcaaaggttaatatctgcagtgtcataattgcaaatcccccaaaataaacaatgctcttttcctactctctgttagcttaaaacagggtagcccaaggtacgtttctcgaatcatctgaatctgaatgatacacgttagaagcacagcaagcacttcgaaaat

SEQ ID NO: 45728 - DNA, 2867 bp, Oryza sativa
gatcaacttcacttgattccacgctgcacaattaataagattttgttagcaaatcatcatgcaaatgatggatggatgtcttgagcaatttcaagaaacttgcctgatgatggatgtcttgagcaatttaactgccatgcgaacatgggctgggagaacctgtgaaattaatcccaaatgaagtcagcagaaatattatgccgtaaggtgaaaaaccccaatgcaaagggagggaacaaatgtcagccttttaaatttaacaccacaaccaactaataatactattcctgattgttgaacttaagttaatttatttagacaccatactgcataatctaaaaaacatgcaatatatgaatgaggattttacttacaactctttccaaatgacttcgggcaatagcttctgaaagcctgattaatgcctctagttgcctaactgtcatcctataagcaaccctagtaccaggggtactatctcctctacgaagggtaacatatgattcaaccagaactttctttgcttcagaactcagctgcattgacataaagcatctataagttgatgacaagttgaaagttatatatgaagtgcataaagatataaacctgaggtttcaaggacttcgcaaaagcaatgtaacgtttcaattctgccgtgctaaatgcaggggcaagtgcttcttcacgtttctgatggaccctcacaatgtgatgagcaatgtggtagtcagtgttttcatcaggctcatcgatcattatgtataccagatcaaatcttgaaagaatagctggaggcaatgccacgttatactgataaggattgcaacgattgaaatattagatctcagcactgaaattttaccacaacatgtcaacaaaatacagggatgcaaaagtttttcagaagtacttggaagtacaattttttataatttgttaggcttaccttgagtggttttgacttgtcataacgccctcctgtgggatttgctgctgccaaaattgaagtccttgcattcaaagttgcttgtattcctgcttttgttatgctaatggtttgctgttccattgcttcatgtatagcaacctacaatggagaaatgaaattgggacactcacgttcaataagaaaagaggcaacaataggtaaaagtcggcaagcctacctgatctttgatgtccattttatcaaattcatcaatgcagcagatgccattatcagctaacatgagtgctcctgcctgcaaaaataaccagtagcagcagaggaggtaaggcaatagaacagaagaactaggaagattgcacacaaagtgcatccaagctcattggagttcaatttagttgaagcatgcaattcaaagcaaaggtgcacttctaaatatgtattagcaatacaaatggatggaatcgcaaaattttgataatacctcaatgcaaaattcgccagtctctggttctttagcaacagttgctgtcaaaccagcagcagatgaggacttccctgatgtgtaaacagatcgtggaacaataccagcggtatatctgaggattggattaatagcacatttgtgatgattcatgaataaatttcattaagatgaatggaacttataacaagataggaagtccaatccaagaacaaaattacatgagcaacttctggattttatgtcaagttgtcaacccataaatatcattcagaaaaacattgttaaaaagcttatagtaacttaaattcaactagtagactaatcaagatgtattgcatcatgctgagggacccttatcagaaagcaatggtcgtttatgcacactaacatatgatctggtgaagcagcagaatagattttatatatcccagaatgacaacattgaatgatggaacttaaattttattcatcacagaaaaagaaaataagaatcatgacaatgagaatacaatgagaagcttactttaagaactgagacttcgcacaacttggatcaccaacaatacagacattgatgtcacctctaaggtttatcccttcatgtgttatcttgtgaacaccacccaaaagcatgagaaggattgctctcttaatttcttgatgcccaaagacagtgggacatatgctatcaactatcttattgaaaaaatcaggaacgttcctcatcctaacaacttcatcttcctcttcttcctgtaagagagaggggggagggagataattaataatataaacactttgatgacaaaaaactatatgatcaaaaataaagaatataatacacaaaaacaaaaaagtggaatgataaccatttcatgatctaacatccttacatgaatatgtaacacactaaatcaacagtgcaccaggatcatgcaaaagtttagggagcttgaatgatactcattgtcaaaaaaatagaaaaaggatgctggtatggttacacctatccatgccagcctgctagcatgcaacagaatgttcgaataccatgtaaacagaatttctcatagttctttttacaaggctagtcccttttccttcttcgaaacagagtaactagtctcgagtctgaattgaacttacagtgaacttctgtctttcgctgtcatctccatctatgtccctgtcccggatgtcgacttctctccttccatccgccacctaataacattaaagagaaaggttaaccttgtaataaaaatattataaccaagctaaccagatcgatatttattgctggaaagaggtcatacctgcactgagtttgctacaaaagcaaggcgatatgacagatctcgtactcctagtgatttcaagcccttgacaccttcttggacaccagacccattctttcgctgaggagcctcc

SEQ ID NO: 45729 - DNA, 864 bp, Oryza sativa
tgatttttgtgactgttctgagttttgttcgtcttcgtctgtttccagttccacctcctgaagcagaggcagctgttgaagcaacaacgggagcagcagctcgccgcggcaacagcggcgacgtggggcacgcaccgcgccggcgtcggcccgccgcttggtctgaactcgtccggctggccaccgctgcagaagtcccaccagcaggcgtcgtccgcggccggcatgcgcgccgtgttcctcagccctccaggaggcaaaccggaacgcacgggcaccggcgtgttcatcccccaccagggcggcgcccccactgagcccaagaaaaagctaagtgcgcacctcctctgaagcaacgcaatgctcaccacccagaagcgggtgcagccgctgccgacgcatgccgctgcacgccgtcctcctcccggacgtaggactgcagctcggcgaggaagtcgccggtccgtgttaaggcgagcagagcggcggcgccctggaagatggcgatgaggacggcgggagcaggagcagcggagtacgacgaggacagagggagcggccgccgcggcgcttgcggtggaggacggcgaggacatagaagccggaaccctcgtgcggacggcggcggtgagttcggtcccctccttgaaggggacgcggcgcgcacggcatgggcgtgcgagcgaggccaagatctgctgccgcacgaggcccacccggtcggcgacgacgacccgcagtttgcggacgccgaggaagggctggacggtgacggtgccgaggtcgacggtttggtcgccgtcgacgaagacgacgggcagcacggccgtgggcggcggcggtccgcgtgctggtggttgagct

SEQ ID NO: 45730 - DNA, 729 bp, Oryza sativa
cagcaacagtaccaaacttgctgttcttggtttaacgataggacatgtcatctattagaaggataacctagagaacatatcaacaatgaaggaactggatttatagcacaggtctgcaggaggcttgatgagatattttaaaaacaatgaggaaatatttgtctattttctcacttgttagttttctttcaatgttttacttatgtcctgttttcctctattctccagaattgaatttgcttagccttctagtagttatatgcatttcaaatagttgtgtatatcctaatgctgctgaaacctgcaataccagttaaaacaagtatgactggtgaccacctgataggaacccattagaaagtttacctacattagtcttgacagttattttacatgacctaactattgttttggttactttgctatcttaatcaggcattgatgtatcctctgttggttgcttgcaaatcaataagcatattaagacaacgagcggcgcaagaggtcgtcgataagatccgccaacatagtggaggtcttgttgatcaggttagcatcagcacctatggggtctgtaaaaaaatattcatttcactcctgatatttctgtgaatgttcgttgttccaggcacagcttgtttcaaaggaactgatacgagttgccattctgtggcatgagatgggcatgaggctcttaaggaagctagcaggatgtattttggtgagcac

SEQ ID NO: 45731 - DNA, 721 bp, Oryza sativa
ggatccccctatgactatcttacccctcatcgccaaagtagaagtatttcagcatgccctagaaaacagtgaaggaaatgaccttgcaaaggtactgtgctgtttttgtcatgccaaattggtgctttctgagacaatgtttaacattaatctacctgaacaaacttgtgtcaggttctctggcttaaaagccgaacctctgaagtatggcttgagcggcgcacaaattatacgagaagtctggctgttatgagcatggtatgatttactgtcatgttctgtttttgtttttgaattaaatgttcttttccatgttaagatgcttcaatgttgattttctaggttggctatttgcttggtttaggagatcggcatccaagtaatcttatgttagatcgttataggtacatctacaaaacttctcttcctgttcatcattgggcaattgttttcattgcgtcttctttttttgttgcttcagtggaaaaatattacatattgactttggcgattgctttgaggcttcaatgaatcgtgaaaagtttcccgaaaaggtaaggatgtgttctggacattatctctctccaattaataatttattctgtagctcgatgatgtatcattttatggtcttcctttgacatcaaattatttttcatgtgaggttgtcattatctcgtacgcattgatccataagagtatggcatttcattattgtatg

SEQ ID NO: 45732 - DNA, 7944 bp, Oryza sativa
  unsure (1)..(7944): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtacatctccgagctcgagcgcagcgtcacaaccctgcaggtatacatacatatacgtgcaatacgaacatatcaacgacgacaacaccaaactcaaaactagttatcacaccctataccaatccgctcttcgagctctagcaagccgagttgacgctcgtttcgaaacgcggcacaattctgaatcctagctaggaaaccgaacaccctacctcaactctacaaactcacgtcagatcaaccgttcgtggctgtgcaatctgcattctgtgcgatgtagtaagcgacccgtcgatgagtttcacggacagaagtggcgccagtttgagaccgaccgatggacacagccacactggttggctggcaatagcacacaatgtggcgaggagatgagcgagagcgtgagcccccaccctcgtgcatatgcacgcctgcggatgtcttacttcacctcaccccccgtacggcaccaaccagcccacgtagacgtagtggcaatggcatgtcatgccatgatccagacgcacatggttctgcttctgcatggatggattggccagtgggcagtggtgtgttgtgcgtggtccctttcctagctagcttagcttgcttgcgcgacatctgattaaattagtgccctattaagaaatgtgtggtagtactactgtttgtgcaagtagtagtactagcatttaacaactgttgtgtagtgtactccatgtaacatgctccgtttgtgtgcacagtacgttgggtcatatagagcgctctgatcgtgggtgcacatggagggatcggtcgagacagttacaaatcaaatgtgtatcagtagcgtatccgaacaagctagatgcagggtaattcagggtgccattagtgtctgaccactacggctagatcttctttgacaagcaggcatcagtttggtttattcccaaattaaacatcgccattttggttttgtgtaaaatgtgatatgttttgcagaacgaggtatccgtgctgtcccctcgggtggcgtttctggatcagcagcggacgatcctgaccgtcggcaacagccacctcaagcagcggatcgcggctctagcacagggcaagattttcaaggatggtgagttaaatttgtagtaaaaatttttacttctctgcaacatgctgcattttctgttgctgctgcttcccatcatgcctgaaggagcatctctttactttccattatctgaaaaaagaaaccactcatgagaattaatcaatagcctgcatgtgcagctcatcaggaggcgttgaggaaggagatcgagaggctgaggcaggtataccagcagcagaacaccaagttgtccggtggtctggccgctgaccacgcacatgtccatggcggcccgccgcctgtgcgagcagagaaggagctcatgagctagctgatcaatttgcctactgtcccctgtgcagtctgccttagcattaactttggagggaacattgcatcatgaacctgtggatgttttcttcttcttcttctttttgtttttttattcttttacattgacttgtgtattcttgattcggatgttgattggagttctggtttacaatgggaattgtgggagatgtcaataagaaaatgtgaactgcaataagattaactgtgatttttgaaagcagtgcttcacctgtagatgatcgctcgtgaatatctgtaatgtgacggttgaacagaactgaaattaaattgctgaacatttgaagaaatgaacctactacgacgacaatggcttcaggctgtcctagcctgttacaggctgacggcacctgacctcttgtgcatgatttggttcccgcttctcggtgaaagaaaccaccggaggcgaaaaacctgcgcagcatatcgttatcgtggaacaccgttactgctccagtttcaaggacaagtcgcacagcgtgcaatacaacatctgcattattcagaatttgcagtatatggatctggatcagcgatgattaaccatgctacatgtggtgttcttgtctcaagatactgatttttcctcaattttcgtttgcacgttttttaagattgataaacggtatgtttcgtgaaaaaaaaactttccacttcctccatcctactcactcagacgtggaaaacatagcacaattttcaaaactgatcactgacttcaaatttctcaagtattacaattttgtagcaatgacatcataatcatataaaatgacaatcaaataatattattttcatcaaataaaatttaattataataaaatagtcattagttaaatatttgaagagagttggggcctgttcactttgataccattttcaaccataccatttttggtaaattgccaaaaaaaatgtctacgcttagtttgatgctaaatttggtcaatacataagaaatcctgccaatattgccatcttgccaaaattttagcatttaccaaaacttggtaatatttattttggctacaatttgaacaggcccttgaattttaaaatgtgtgttcatctatagaagttgctttaaaatatcaaataaacttatttttcaagtttgtaataattataattcaattaatcatacgctaatggttttctcgttttgcatgccctaagttttctcgttgtacgtgtattatactacgcttttcacaaagcgatctttttttgttccaacaaactgtgacagtgtgaacggtgactagtgagctgatgcgcttcgctttatagaaatctgaaatctccgtgtaatatcttcgaagccagatggccgaagagcctcaggactctgtacattatccaaggagatagtactctgaaatttttgatgtacaatttctagattgaaattaatagaaactacactatagatgttcttcacatataaatgtatcaagaaaagaaaaaaaaactttcccgcattatagttcttctgcctaatcttcatatttccgatgggaactactccctccggtcttaaataacgagtcgttttggatcttttaaaacaaaattatacaacttttactattagcataaattttaaaaggacttcaaaagttacataggtgtagaatatatcattttcctatacccaaaacatatacttcacatgtttttataatcaaatttaactcgtgctgactgcacgtatttaaaactgacttgcttttttagaccagaggaagtgctagacagattaccaactttaactaacagactgaggcatcggcacaggaacatcaacacccaaactgccaaacatcacttgttcaaagctcaacacacctatatacaccaacactcgcgacgaccgtgcgaaagtactcctaaaaaacagggcatgaattgcccggtaaaaaccataacacaaaaaaaaactcatggactcatgctctctccagcaaattcagagcgcgctaaatttgcaaaactgaggcaaaaaacgcagatcaaactaccaaactggaacctggtggtggtactagtcacttggagtctaagcgaaggccatgcactaatcgctaacgcgtaacgtaggggctactagctagccggagttcactgatcactcccacaacgggctactgtacagttgatccgtgcaggaggcgtcggcgccgtaggacgggtagtggaacgagtagtagctcctcccgtcctcccactccatggccatgccgtccatgtaccactcctcccccgggcactcgccggcgacagcgaacgggcccgcggtggcgtggtccatctcctccatccagaactcggagaggtacggtggcgacgacgccggcgggtacccgccgccgtcgaagtcggagaggatgtcgtcgaggccgcagtcctcgcagccttcttcttcctggtgcgggtggatggagttcatcagctcctgcccgtcccagccgtcgccgacgtcggccgtgaagaagcccagctgctgcttcctctgcgctacagcctcctcatcctcctccgcagcgagggacgcttccaggagctcgacgagcagctcgccgtccatctccggcacctccacgaccgtttcttctcctcctccttcttgctgctgctgctgccgccgccgcggccgctgctcctctggatgctatccatgggagctggatactgcgattgatacgctgatcaagatttaactgtgcgtgaggactgaggccgcgtttgttgtgtacgtggctgtgatcatggcgaatgatcgatgaggagagggcgcgcgagctttatagcgcacgcgaggtgggacgggacgacgtcgtggcacggtaccatctctacagggagccgactgccgagtgaccgggccggtctcgcacctaagcggcatgtggggcggacgccactcgcgagcattgatgggttagtgctgccgctttgccccgatcgaattgtggattgcttttcgcgcgagcaaaccctcgatataatcatttcacccagtgctccagctgtcaccatgaacaatcaaattagcatatactggctccttaaaaaagtccaacatatatagtattggattagacttaggccgagtttagttacagactttttctttaaactttcaacttttctatcacatcaaaacttttctacacacacaaacaaactttcctacacatacaaactttcaacttttccgtcacaccgttccaatttcaaccgaacttctaattttagcgtgaactaaacacacccttattagttagtacaatgaacctatatccaattaaatacttagattgagttttttttaacaaaagaagtagaactgtaggagtgctacttagtactccctccgttctaataaaaaccaacttaatattgtatttgatataatctaatacaataaatcttgaaatgagcaatcttattattggaacggtataacggatgtagtgagtaggagtactattagtagaacggatgcagtgacgggaatagagcaaaaatatgaattactgtgtggcacaaattaaacatggtaccactatgacgaattgacgagacgttcctctcaccaagtttgtgcagtagcagcgtccaaagcagataaggggacgcggtacgcggtaggtgcctgctagctccgaaggcctgcctgttcaacactaatgtgtgtggcaaagccaagctagcgacgcttgggtgcagcccttgaagacgtcgtgacgagattcggtccatatccatcgcacagccggccgcacaggtgcatagcctctgcacgagactccaactcactccagtgtccagtggcgccgcttttctcagcacctacgacacccctgaggatatatttgtagtatctcgtgtgcggtgtgcctgattttgttctgtaaaagaaaaaaggaggaggaggtggaagtggaacggtagcaaaaccgatggtaaaaaagagggaacagtctatatgctccacacttccagcgaccagtccaccataggacacactgacaacagctgggtcaacctgagcatggcatgtgacggtattctctgctggctgcgtatactagtcaaaactatatttttggacggcagtgtaagcggtataaaactatatttttattggactgtctgtacactagtcaaatgaaaactcttaagggaatttcagtcaaactgtatggtcactcttgatcaaacgtactactctataaaaaaaagatagatacaaatataagatactcgtatgttcagatttatagtaatttaatatcttatgagacgggggtacttgtgatacatatatacatataccatttctcaaacaacatattctcacctctcatcctcctcacttgtgttccttccgtttaagtttcaagatattttgattttattctaagttaaacttatttatatttatgaatcacgtaaaagaatgtagcaacatttataatatcaaattaattttattaaatccaccattaaatatacttttatagtatatatttaatatttataaatattgctacgttattttttaaatttggtcaaactcgaagatggtgagagtaataattgtttgatgttaaaaatattgttatattttttatataaatctagttaaatttgaaaatatttaacctagcacaaaccaaaaacataaaaacggagagagtagtatcatggtgcctctttgactccgctctttccattctcaacctctctgctatcaaatgcccgctatttcgaagagcaacgtaaaattacacctagcttaggagccaggaagggagagattgtggccctatttagatcccacacaaaaattttacacccagtcacatcaagcgtttaaacacctgtatgaagtattaaatgtatgctaaaaataactaattacacagattgtgactaatttgcgagacatcttttgagcctaattgctctatgatttgataatgtggtgctacagtaaacatttgctaatgatggattaattagacttaataaattcgtttcgcagtttattaacggattctgtaattaggtggtgtccgtatatctgatctgacacgctaaaactttacacctataaaagctatacatactgactttttcttactaaattcttactaacactgatgtgtcatgctatgagtgcatctagatttttttaacttccatctacttaaatcaaacggttgagattattgttagtaaaagtttagtaagaaaaatatagtacgtgtagcattgctcttaagtaccttccaacaggagtgcagacgagaaactgtagattgcagagagcaggctgcaatctcctgttatatggggacacgatccgaccagtgtacgttacttcaccgtaagtacagccctacctcgccaactcgccggcgacagttgcacggtagtcgatcggcatatctacgcctaccggcctacgcagcgaggttgccgtcaccagaggaatatggcctggtggagcacatggcttgcttgggccttgcccgcgtgacggcggtttggatacggtccgcttgggcaaaaaacctcaggttcgatcgccgccgccagcacgcagccggcagggcccctttcatctgcatgccggtcactgcttcgtaaaccaggcgaggcgaacggcgcccgggcatccgtgccgccacgattcgcccaccgttctgcacgatgtgcgtgagatggcgcagcgccgtagccaaaccacgggctttggccgactctttcggccggatacgtatccgagagaccggcttggtttcctctggccatgaaccgaacacgcatgcatgccgcccgcgacgcctcgtgtcgttgtcacatggttggagcgcatggctacgccgctgcggaaccaatgagtggattggtcctgcttctgctcctgcctgcgcgcaggcatcacaagtgctttgttcctgcctgagtggccctcatggaatcccaattctgaataggaaccgagatccaacatcgtattaagttggtgacagatcgcagtaaaatcgctgcgacactagtctggtcatgaaaatgaggcttgtttcagcggatctgacctgttcattcttactcagggtatgtttagttcgtagaatttttgccccaaaacatcacatcgaatctttgacacatacatagagcattaaacacagataaaatactaattacacattttgcattcaagtcgcaagacgaatcttttaagcctaattagtccataattagct

SEQ ID NO: 45733 - DNA, 2839 bp, Oryza sativa
tataaagttatccccactaataccttaaacttaacatgcaaagataccatatcatcatccactaacaagatgccacatcatcatccactaattaacaagatgttactcatcatccactaacaatcatcacatttaaacatcatgaaaacatgctatatctttatagtttttataatttaagagcttttcaaatacaaacatgttaaattatcatccaacataattcacataatgtttcaatgtatatttttattatgttttataatatcctatataaatatatagttcatcctcacttagtgcttaaatgattaatctatggtgcaaattatctttctcttttttcctctaattaagtcatatcacatcaattgtttttagcttttagatgattaatctatagtccaaactatctccctatttttcttcttccataaagttataccaccttactttttacgtttgaatcaccattctacatactatttaaatctaaattatcataaaccgtattaatttacttaatctgatgttatctagctatcttacatgttattttttttattgtttttataataaattcccacagcaatgcacctattaaaagtaacagcacagcaccactggaccgggacagcacagctcaattgactggagactggagactggagaccaagacttcgaagatatggtactacagcccccataaggacttgctcggttaatctccgtgagaaaggggattgaagagaactgagagattaattccttcaatccccatgggagagggatcaactgaacaagcgctgactgtttagttttctgcctgttcggcagccgattaaccttacatatacaagctagactgtaactactggctcctcacttcagagttcagaggaacattcaccaggagatatcaacacggtgcacagtatgctccaaaaatcaagcctcaagtccactgaaagcgtttcggatctcgatctgtttattgtttaccctttgtgcatcctaaatagtttaaacatacacttcaagcatctatttcttgctctaatattctatccagttttcgtattaatcaggacaagatggtagccaaaacctagaacatcagaaataatgacggaacaacggcttcacaattggcggtaaaaccttactagtcagctgaagtaatttcgaaaattgaattcacaaaatacactacgaccttttctgtaaacgtcgtgtgccgatgttcttatactcagagaacaatagcataacagcagtactatgtttttcatgaggttaaatttttaccagacctactaaagcaccagttaattcagaaaagacactacataaaaaataagagccttttctatatcagtgacatgtccctacgttcttacacgaagcaagacagcttatagcataacagcagtactatgtttttcatgaggttaaatttttaccagacctactaaagcaccagttaattcagaaaagacactacataaaaaataagagccttttctatatcagtgacatgtccctacgttcttacacgaagcaagacagcttatagcataacagcagaattatgtttttcacgcggttagattgttaccaggctttttgggacaaaagcactattcttcagcattatcccctttctggaatgtaggagatttaccacgccccattgtaaagccccttgtcccatccggcattctcggtccaggaataggcttgttcacatgatcagaaccagaagtggcaggggatgagacatggcctgatatgaaaaatcatcagtatgcatattccagatagagttaaaaaatacatatgtggagaaataatcacaggtatttgatttttcattagtacaaaactagagaactacaaatcgatcttgatttccttctgcgtgttcatttggaatatcaagtgtttacagcaagaactgtcaggattgaattcttcagctcttgttaaaagatacccgtagggaaaaaaaaactagttacatcaatgtaagtctggtgaacctactgtcatcaagatgaaaacagacttagctttggaaatgaacaaggatatcattgcgcaaaaaactaggtgaggagatgtgtacaatggtattagttgcctaagataataaatattgttcagtttttttccataaagaagcagagtaacatgttgaccatgaagcctcctgcctccatcatgcacagacatgggaattaacttaagttgtatgtgcaaatggagttcatctgagaaacatttcactcagtgcaaaacaaactgatattgtggatattggatgaaactcagtggcataaaatgtatcacccaaataatctacaaatttagtagggtcaaaatagtgtaaacagtttaccttgcccacttgtattttgctgaatctgacctcttccttgagatttatatcgaccttttcgtcctcctttagcatttactttttggtgttggtgcatgtcctaaagatatgcacaaatgacctatgagcaaagacacttgcagaacaatgacacaacctcctgatcatagcatctaaatatgaaaaaaaaaactaaatagaataatacatttgaacttcatgcttgtatcatgtgtgcagttcagtaagggaatgcaaagggtgaagatggacgtaagagaaagtgaaacataattgtgccaagtggataattgaaaaaaaacaataggtgtatgaaataaatcaaacctcatgggaaatattagagttcacattctcattgtcgaaagcactctccactgaatcagtaccaccattcttttctgataccatctgctg

SEQ ID NO: 45734 - DNA, 19161 bp, Oryza sativa
aacgagtggtagtttgtatggcgggtcaatcagaaataacccatggctacaatacttattttatcgattacgaacctatgactacaatcagtaggtagtaaaatcaaaagggctgtagtttgggtatctataagatcttttaagaaaatgtcgctgagtaataactgatacacaccttgttacttagcatgatgtcatggttcttaattgttgcagattctcccactgaatgttgatcatgaatggttatcttcgcaattctggcacatatgaagataaagtacagttccaaaacaatatattatgagcatcaatcattaagtgtcctcagaacaatatagcatcacaaacacaagcaaacaacatacttcccaactgtttcaaatttcgcatgtatgctttccatggagaaatcagaaggcagattttccaccacgactatccttttctgcgtgcaagttaaagttaaaacttagaacacagatattccacaatacatataaataatgcatttcagcaaggagtgggctggaaattgaccttaacatcattcaattcattatttggcaatggatgtaacctcctgacccttttcccatctggactcacgacctgaaagttaagaacaaaataacagcatatagtgatatacatttaaattataactattaacatagcaaccatatctatctcccactgaccaaaagcaccacttccaaagcatagataataaatgggcaatatattaccagcttagatgatgtcctaagtgcagcttcaattatagagagatcctgactgagtttcttcattcttctgaatgaggcaataactccaataggaactattaccaaagatagcacataattagaagaacctttgagattttacttcatataatacataatatttgatgaaagttaaccctaatgaacatcaatccatatagacttgagcactataaactcgctaagcaacacttaattcacccgacctaatgtaaatatatttagtgattcatgacagaagagtaccctatatctaacgagtcacttatgatataccagttacagcctagaaattcagaaagaatttaatacctgaaaatcaacaaaaggtaaaagtataattccacaccatgccactgagttgtcatgcaataagtagtgctacatggatcattgtttacaagctacttcccaagcatgtacaaaatccagcgcatatgatacatacagaacatcaggctgctaaaaagaaaaaaaaaaggtccatgtctcgcaaaacgattgcagctcttgtcccaatctatgaatgagggcagcaaactattgctgtaaatgatcaatcaaagagttcaaaactaatccatcctactttaattgtgaagctcaaataaaaaggggcagctcagatgagtaaggagcatatcagttcccactgcaacagcttgactcagctaccatggaagaataccagacaacatcggtaatgggatcaagtttcatgtatcctcatggcccgacagtcaaactaaatgtgaggaaatctaactgactacagaaaccatgaaaagagagaaacaacaaaaataagtaaatagccagcccccatggtttattaattaaaaagtccccctgattataatttcaaaacagaatggagtgaatcagacaacagtaaaccagtattcacagaggcctaaactagcttctcggcacaactaaagaaagctgcaccaggagtacctatgtaaatgcctctcataagtacctgtcatatttcatcattttcacctccattccactaatgtatgatcgacaaggcaaaataatgcagaaacataggagctagaagagtcacaccttgtctcacggaggatagaataaaagagagagagaagggatataaaagagctttcagaacttgaatcatatacatattactgaccaattaccacatctatttctagacttctagaatgcaatttatgcgaaaagcaaacctgtcataaacctaagtacaattatctcggtggcaaaataatacaggcaaataataatagggcgcatcacaagcagttcaaaatggggagaaaagatactacacacttggcatggctcctgtctcaaatacatatgtttctaaactaccagactaaaccatctaaacttagcatcacaatatatagaggtttcgctacatgaagcaaaagcatgccacttaccaaacccctgcttgttcttcttcacgaatttaatcaggaactcatccgtaggaagattctcatcgctgaagtagtactccacctgcaaggatggaacgtttgacgtatggatagcacaacatctcaaaaaatccgtcgtctttgcaggagcatacaacagaacatctgatagccaacagagggaaggaccggaaactggtgtacctgtttgacgatccggtcgcagagctcgtcggtgagcacgacaccacccgcgccagcctcggagggctccataggtacggcagcggcgccggcttctgcgacgacgggggccacatcctcctccaccacctcaaggggcggatgcggcagcgggtcttcctccgcgacgacaacaccctccgcctccagaggcggcgctggcggcggcggctggtcgtcggtctcggcgacggtgagtggctcggccgcgacggcgtccgcggctggatcctggaggtccataccgcgcagcggcgcaggggagggagatcaggggagccgagccgccgccccgccgcccgcccggtggccgccgctcgaactcgccggcggctgcgggtgggtgggaggtgcgactgcgtgctcgagtcctcatcgtgggttgcaagacgggctatatactctccgcagtgagaggcctctggaagggttaaacggcccgctagccactaatgggcctaacgggcgtcaatctttctttcgcctgtagccgcgggcgacaacgcgtttgtgggctctggactggagtcatggtaatttaattcctttcgtcgcgttaagtcgaagaaattcacgatttcctctctctctcgcagcgaatgattagtacgagtgggagaagaagggtcgaggctcgaggggaggggaagcgggttacagcagcggaaattctaattggcgcgtgcggcgcgcacgtgccggcccatacggctcaagacggggttagttttttttttcgaatttttccatatatatatgtaaactttcaacccatatttaaaaactttcaactccgacttaaaaactttcaattccgattcgaaaactttcaactcagattcaaaaactttcaactcgagattcgaaaacttttaagtcgagatttgaaattttcaaattagatctgaaaactttcaactcgagattcgaaaactttcaactcagattctaaaactttcaacttgagattcgaaaactttcaagtcgagatttgaaattttcaaatcagatttgaaaactttcaactcgagattcgaaaaatttcaactcagattcgaaaactttcaactcgatatttgaaaactttcaaatcagatttgaaaattttcaagatatgatttaaaaactttcaactcaaaacattttgaaaaaaaaaatacgtgtgctaaagattttaaaaaagtaatcagaaaaaaaagaaaaaaagaaaaaagaaaaaatcaaaaaaaagggaaaaaatcgtgaataaataaaaggccgatgggccttgtgggccggggagcagctggcgcgcgcgcgcgtcaactagcaaccctcctacagcggagcttctcccccatacggccgtcggcagcccctttccccctctttcttccccatacgaaacccgaggcaagttgatgacggcagcgacgacggcggcaggttgacgacatgcagaggagggacgagaggagaagaggagaggagtgctcgcctcctcactttctccatgttcgcctcaaagctcgtgctcggcgatggcgacggcgcgaggcgaagactctcggagatgctgacgcgacggcggcggcggcagcgcgaggggaaggcggaggtggaggcagcgcaagcgggaggcagaggcggcagcgcaagcgggaggcggagcaaggcggcggcagcgagagaggtgagagagagacgagagggatgaggggacggcgacggctagggtttggggtggttagtgttagtgggtgtcattttgcaaaaaagcccctcgtcttatgattttacagggcagtccaaatttacggttttctctcctttgaatgaaaatatccgatttttataagggtctccacataaaacatcctctcgaagtactattcgtgaaggacatgtatcgaatgacaccaaaagcgaaggactttttcgcaaaaattccaccccgcgcactattgcaatccgacgcggcatcgcccagcgcccgcgccatcggcgacgcttgatgtcctctaagagcaagttcaatagtatagccaactactagctccaatttcatctatagccaatctaatagctcattcatacaatagttacatactacactattaatacatggtcccacctgtcatacacacactgtatcttggagttcgtgctacatctggttataaatctgtagcccgctgctcttctctctcctcatttatctacttaaaatatgtttgcagctggtttgtagcatgctattgtatctgctctaattcgactctcaaatctcaactaccagagagatgcagcatcatgttccacttgagttttgcttttcctttttttcccctgtcgaaggataccccggtgttctgtttctttggcaaaagtatacttcttaattaacaagctcatatgccatctcgactgatagtagtgttgtctagtgagcaatatggaacagacagaatcagtatgctggaaccggtgcgtagacaggaggtagtcttgcaagtgaagaaacctttgtgtcgggaaaaccggagaaatccctgccttttccacagaaaaacctaaaaaaaaaggcctacaaagttggcgcaaaaggtgacggggcatttcacatcatttcaggatggtcttgtttcgtttcagaggcagcaagcattacaacggagcagttccgcaccgcacgctagtcgggactcggggctcgatcgatctgatcctggaacagattgggctccggctgccggtggtacgggcacctaccacgacagaaaaacggtgcagggaaaaccgaccaaatcaattgggacgcaaacgagcgccgaattctccggtagcgtgcaccgccgcaacgtgcgtcggcccggccactcgtaaaggctccccgcccaaccagccggcgatcctttatcgcggccgcggtacgtcgtggtactacgtaacgtcgtaacttcggagagagcgcggcattgcagaaaatccaccggatgacgacggtggatctgcacagggctcggtctctcgggtcgcagatcacgagtggacctgcctgcctgcctgcctgcgatggtaagtatcatggcgtggtacgtgtgtggcccgtatgggtacaggggtatggggtacacgccaactctcgacgcatggccatctttgtccatgcgttgcacatcggtagcggctaccaggaatttctgccggctagctttgtcttgtctatcgcgctttcacgaatcacgcctgggttttaccgtaacagtttattacggtacgcgctttcattctcaccctgctggacctttgcagtacttttgtaatttgtattgccaatttggcatgaagtaggagtaacactagttcccttttgcattttgtattggcgtgaagtctactcattttagggcctcttcggattgagggatttttgtaggattttcaagggaatactgtagataggaaatatttcctttcctgacattcggttcataggaatcgacccaaagaaaaatcagaggaaaaattcctttcatgtggaatcaatagagaaacaaaggaaaatttccatccactcctacctcattttttccatttcctatgttttttctttgcctatccgaacacatgtttaccaatcctatctacagaattcctgtgtttttcaatcctctgttttacacatacattcctatcatattcctacgattttcctattcctacgtttttacaatcccgtgatccgaataagcccttactggaaccaggagtaagtttttttttcctacggtgtgtcctgagatcctcgatagtgtatgatatcttgtatcctgcacagcatgatgtacacgcataggttggtccacacaaataaaccaacttcactgctcggatctgctgacttgcgattgatttaatacggcattttgcatcatctgcctggctcagtagagtagaaatgtggaatcgacgacgcgttctctacgcgaagtagtactgaccaagtttgaccgaccgctgtgaaaatgtgagcgccgagaaaatgtgtcggtgtgtagctgtgtgtgtctgtgtgcactgtgcagcagcgttccaccccgcccggtcgtcccacaccctcacttcgatatctgaatttcactgtcggttagcagcgtgtcatggtgcgcacccaaaagtgaacgctactcgactgctcgagcccctcaaagacaaacacgatcagtactttattaatccgaagattcagaccctgtttgcttcgtgggtcttaatccattagtccctctattttagtccattttacttcctccatcctataatataagatattttaacattttacttacactgtttctccactcatcttttttttttggttttgtccactcatcttattaaaaaaaattatgcaaatataaaaaacgaaaaattgtgcttaaaatactttggataaaaaagtaagtaaaaaataaataataattctaatttttttaataagactaatggttaaataatgcaagtaaaaaaatcaaaatcacttatattaggggactctctccatcccattttaagtacagtcatggttttccgtgctcaactttgaccgtacatcttatttgaaatttttttgaatttttttagtctatggatcggactatttttttttgtccggatactaattttaatccagaaacttaatgacccaaacatggtctcagtaaggccgggaagcccatagaagaaagtggccactggccactgaccagcatagtggataacacactttggattatagaaacccgtatcgccggcatgctcacttgtttactcaattgggtctcactttggcagacgttgatggttttgagccgctctgtctgcaaccacctacctaaagtgagagcatacgcgggtacaatctcacttgagccgtcgccgaattcccttccgttcattgtgctccacaatcatatgtacccagaaacggtgcgtatataaaggaaacaaaacagaatggactctgaaactgctttaggattaaggcacaatgtaaaaatagaaagagtactaagtcctctaagatacccttaggagtatattttgaaagtgatcttaaaacaatgattacacttaaaaagtaatcacatacatcatgtaaattaacattaacttaaggtgcatcttgtgcttaaaatctaccacaagcaaaaagaaagtatttctctcttattcacctgatggacaagagccgaagcagttctttttttcatctcatgtggtcatcttgtgtttaaatcctagacatgattactttaactatgatccattattcatggaccgactcctaaggttacaacatacatccacaccacaaacttgagcttgcccatttttatgagctagcattgtgcataaggtttagacataaaggaataaacaaatatatcattcatctctttccgctcatactttgctctctatcttgaaatgaggggctcactttaataaccgctcttacattgtgaaggtgccaatatattatagtgggacccaccttaagaccaacttctgttatacattaagcacacccaatttctcttcaggttggtaaagaacatccacattgtgctcccaaatcaggtaataagcaataatttaatattcctaccagtagtaagtattgtggactcagtaaatagctctcagcactacaacccggttgtaagaaataaaaaagacattgtttttttttttttgctatgtattgatcttcactctctcccttcatgctactggttgttgttaaactttatattatcattgtggctagatattatggaacttttaaagatgtttatttttgttgggtctaccttatttactggtctgtaaatatacattggtgataccaaatgtaaacaaacaatattctggcgctatctttaccattgatgcttgtctcaaacaacagacactgtgtgcccgtggctccgtacctgtacattcatcgctaatcagtaatcactggagtcctaaaatataatcatttttaagatagacacagatattaaaaagtactaccttctttctaaaatataataatttttggttataaatctgaacataaatatttatattttggaacagatggaataggtatagatgattgaaggagggttgtaattagtggattagataaagtaagtgaagagaatagttataattggttgataggagagggtaggtagaaaaacggcttcattttaagataaattactgtgctaaaaatagttatatctcgagatagaggtagcatgcttctatcctgtcccggtgtttgtcgtacattcacggatgagcatattactggtagaaaaaaagaaatatctgatgctcttcgcagccacattgcctcgtgacttccctgactggtgagggactgcgggcaaaacgcaactgcactacacaggcctttttaaatttttttatcacatcaaaacttttttatacatataaactttaaactttttcatcacatcgtttcaatttcaactaaacttttaattttagcataaactaaacagacccacatgcaagttctactgtactacaatcgtgtgggcagcggcgcctttttttggtgctcgacaaagtgctaccaaaacgctgcgaaaaaagcaaaaggcagcagggtgacctctagagtattttattgaccatcgacgccattctcaccatccagtggtcactgctcctccttcctttcctttcagaccccacgcctgcgagaaaaatagaataatgggggtggccagcaaagtgccaaaggaaaagggaatcgccatcccataaaaagcagggcgtgagcagagagctgcctccagcccagtgagagtaggactggctcggctcgctcactcggtcagctgcacacacactgcacttcggctcactctctccactgttcttcttcctcggcgaggggggaaggaggaggcgagagctcgaggcggctaggaggaggagatggagggagattcggcgaggaggctcgcattgctggggctgtgcctgggcctgcttctgctggcgccctcccatctggcctcggccgctgcggtggaggatggtatgctttgctgtctcttcgatcgtttctgtttcttgcccttgctggaggatcagtagtgctgctgttcttttgatgctggaggatccaaggcagtattttgacatatttgtggaatatttggttggagtttgtggggatgggtagttttctgcatcacagatctcagcaaatagagaaatcatgcgatttagtacctctccgcatcccacatttgtataacaaatgcggagttcattagcacatatacatagcactgaggagaaatttgaagggtgggtaggagaagagaaaaataatcccctaggaaaatggtgtggtaaagcatgccaagaagttagctttgtgccctaggaatcaagagatgtggttgcactcgtgaggaaggagtgtgatagcccccccccctttatttttttttctctttttgtagagcatatggttcagtatacctgcaaagtaaaggtcctagaaagtaggaaggagccttggcccttgatagctgagataacatttaccaaggctgtgtttagatccaaagtttggatccaaactttagtccttttccatcacatcaacttgtcatacacacccaacttttcagtcacatcatcttcaatttcaatcaaaatccaaattttgcgctgaactagacacagcccaattatccaaacctgtcctgttactgaagtctgaacagccaaaaactgaccagttatactgccacttgtgccaaagctttcctgggaatgtagttttttgcagtgaccagtgtaaccacttcttttaagtacattaattggataaaaatatttatacctgcttaatacacatcccccttccttacttgcctttgagtttagtctgcatgtatatacctttataaaattattccttttctatgattcatgcaattttatgtttgaaaatgactaaaaacccccaagtgagctgtcctgtatgatgagagagacattctgttgggtgcagaatgctgctaacaaaaccacttgaaagattcagaaaatcttcaggcttgtaactgaaagagtttcagtttcctatcttgtccaaaggaggtattatgaacctctatgcaaggacgaagttgcatgaaagtcaaaatgaaatgtggcgtagtagtaaacttggatccaggccgaacagcacagcagcagaaaccagtgagccagtgtcctgcaaacgcgttcaatgaaccgtccagtaaaaaggtcaaatggcttattaaaaggatggccgtgagggtccatgcctgtctctttaatttttcgtaccttaacctccccagaattacgctacgggccgtggtgatttcctccggacatgggcagctctggagtctggaccactgcatgaggctctccatggtgggatggtggatagggtagggttggtggatgtttcactttcaccacataatatcgtcgtgcatagtcacatggctgtccttgtaaggacattgaagcacagtaaagtggcctacccgcagtgccccaatgaaatgcattggatgtacaatagaaaaacatggacatgttttctctcctatagtactgaattagaggttttagctgttaaattttggcacaggagatttaattatggtacagtttatctgtgcaaccgtgctttcaactgggagggtagccataaaaacaagcttgagaagtcactcacttataagaaaaaccagtcctagaaatgaactttcccaaactctactgtgatggttcatttcacttgttacacatgtttccgtagaaaggttcccgtaaatgtcctaggtttttatctgaaatttatttttttttgtcactgttatgcatttgatttgagttgtacagtgccattcaattcagtctgagttgtacattattttatatatgtcataataaagatagtccagcgcattgtgtactaggttcagtgggggatcatatttacggttcgtcctatcctacaaaagggtagagctacacaacttaaaatagttatggttttattgcattgcagacttgcagtagatgtacttggcttcacttgcatgggaacgctttcacatataacatgggtagatattaagtagagttcttgagaaatatattttctgcctcttggtcttggattgcagctgtgttacttttggagatctaaattgaccttggcacttacatgagcaagtgatctctttgcacaacaggcttgctcagcaatggtgactttgagacagcaccagctggtggttttgtcaaatctgcttcagttgctgaaggtgcatcatcgatccctggctggacgatcaatgggacagtcgagctcatctcagcaggccagcaccagggtggcatgattcttattgttccacagggtatcctacagagcttttctccttctgtcctctgatcaatcaagttgcaccactgatttgtattcgacatgtttaatatttggattttcatttcaggggatcatgctgtacgtcttggaaacgacgcaagtatagggcaggtggtgcaggttgagaagggctcagagtatgctatcacgttcagtgctgcccgaacgtgtgcacagctagagtcactcaatgtgtctgtgctcggtggtgcatcacagacagtggacctgcagacattgtacaacatagaaggctgggatgcatatgcattggcttttcaggcaacagatgagcaggcgagccttgagttcaggaaccctggtatggaggatgatccgacttgtggacctatccttgacaacgttgccataaagaagctcttcactccagacaaaccaaagggtatgacagttctgcttatctctatacctattagagtgtatatccttacaggatgtcttaagagagctagaggtgctctagtttgtatggttcttaagtcatcacttggtattgtcttctttcaacagatactgtggtgtcaaatggagactttgaggagggtccatggatgtttccaaacacgagctttggggtgcttctcccaaccaacctcgatgagcagacgtctgccttgcctggctggatgattgagtcaaaccgagctgtccgctttgtcgactctgaccaatacaccgttccccaagggaagcgcgccattgagcttctatcagggaaggaaggcatcatctcacagatggtcgagacaacccctcagaaagagtacagcctgacattcacattgggctcagcaggggattcatgccagccaccaatggctgtcatggcattcgcaggtgaccaggcccagaacttccactactcgcccatgggtaatgccacaagccaggctgcgaatgtgacattcacagcacgagctgagaggacgcgggtagcgttctacagtgtgtattacaacacgagaagcgacgaccacagctcgctctgtgggccagtgatcgatgatgtgcgcgtctggggcttgaatggagctgctgggttgaaggcaagtattgggctgctgcttggcattgttagcattgtcagtctgatgttgttctgaatctcttagtgattgtggtcgaaagatatataaacctcttctgtaagtatgaggaggccactagttttggtagtaagcttgaagtttctattaggttgagtaatgtgagattgtgagcttaggctaaagctacctgaagctatgtatggctgtttctgttgctttcttttgtgattcagaaagtaacatgccattgtgggaagtgtgtggtggttagtgtgccaagagcttgtaatgttcaaatatcatcccttcaatatattagaaatttcaggagttgatccgatctccattgtcttctagtctgatgaatgccgtttcagacatgtactgcgtggagtgtgttgacagaattcatcaggcaatgcgtacaagcagaaagccacaaaagggttggtttgtacctggagcctggagaagtggagagttcatgttcatcatctgctgcttccggggcctcctcgcgagtgccttggacggtgttcgctgagctccgatcgcttggcgtgcatcagatcccaaatcgtaggacctagatagtggccaaaggataagtccgactttgatatctcgcgcttccagcggagggagagaaggtagcgaggagaggaggctgggtcaggtggggaggatgattcatcgcgatgccctcttccggcaacgttaggcggctgcaggcctgcaaacatcggccgatttgccggactagccgcgggaggagggagcgagaacaagagtacaagacgaaacggccccagtggggtacctcgttttcccgtcggagcgcgttcttctaaactgagccgctggaccgagaaggcgaaacatccatgttaaaccccctacgctgaacggccccgttctggcccacactagatccggaccataaccatctgcctcggttttaacgcactgtcctcatcttcccgttagaaataagtgcactttgactccctcaaatatagctccaatctaattcgttttcctcaacgttatattgtatatcttgacccttaaatattaaaactggtgtaatttgcttcctcggtcaatttgggagcaattttcgcaggcatggctttttatttgatcaaactacctgagtcagtatgtggtgcccacatatcagtgacctctctctttcttctccccctctttcccataccgatacactgccagctcctcaccttgtttttgctcgccgccaccttctctcctccagcgccgacgaacaagcagccctctctatccaagctagcagcctcgtcctaagttactgatggtattaggaggggagtatccttcccgatggcagcaagggcagaaaagggcggtgggagaaggcgggctggttggtagcacagagggcgcgcatgataggggcaggaggactaggcacaggagaggataatggtgaagacggtaagcaaggggaaacaatagggatgtgtggagcaggagctggagcaggtcaaccaagtggcaagcggcacagtggcctttgcagtggagaaggcgtaggatgcctgagcacgacgacgatgatgacacgtgcgacgccaccgtcacagcggagaacatcaagtaggcgcaacagtaggacttggggacacacaacgagatggttggctggcggcggcgaggaggcagaaaaaatcgtgctcttgttggctgggttgtcgacggcgtgaggactagagaggcagaaacggactccgccttcgttggctggccctataacacaacgtccgagctcttgtgaagggttggtgcttccatcgctgctctagggtagcaaccgccgccgtcctctcagccaccaacaagcagattctgtcaaggagacaacggatgtggatgtcacttatggcgggcgctgacctgctcagcagcacgatgttcgacctcttggccgtcatcctcccaagcgttcaccaggataccgacggaggaggaaaaccaaaggggaaaacccgaaaaagtagaagagagttgagggggggggggttgctaggaagaggggccatcgccgatgtcgacgagctcatggtggatgtgcaagagcgtgccattgttcaccccctatgactgatagaaaaggagggggaagtaattgtcgcccacggagagagagaggacaataggataaagaatggacattgaggtccctttgctgactcagccagccagactagtcaacaagtcacgtcaacaaaaagtactaagggagttaaactacctcggttttaatagttaaagggtcaaaatatctgtattgtggttgagggagtacaaatcagattgaatattttaagaaagtcaaaagtagacttattcctgtatgtcactaccgtctaagaccaagtccttccgtctccgttgcgagcaattttacggtccttgagaaggtaccatgaggtaccattttttctattgtaaatttggtacctcttgatacctcggtactatgaagtatcatgaggtatcaaattttatactaaatttttggtacctcatggtatctactcaagaaccgtagaattgctcctccgttgcgctctgggcatgcggagccgcacataatctgcggcaagttggccgcggacgggctctcccacatccacaacttcccgtctgctcgctcttccatgataccatcagatgactctagcacgatgagcgtggcgtactggcgttccggccttcgcgtgcacctgggcgctggaattccggattggctgcgagccacctgatccagacaaaatcgccccgagggtgatcttagtgctttgacaagatctgcatggcggcagcctcatgaacatcggcaagaacatcctagttgcaccgcgcactaccatctggccattgcagtgccaccagtcaccactacaagccactaacaaacctcgcgcttgttgttagtcgtcactagcttgagacaacaactttacaggatatgtatacttactggtgcagacacaagctcgatcagcagttaaaacctttctaacaaatcattgaaggaagacaatcattggatgactggagttaatactaagcagaaacaatcatctatgcatcgagtggcagagaaggtgagaaggaaatttaggggaaatcaagtgtttcgtgtcagcatgggatgctgaaaaaggagagagggagaaagaaacaaaatttcgcagctcactctagtcaccggtagaaccgcgaacaagttgacgcggaattggtgccactcgggtcatttgtgtgtctgactcgctgagttgaccacaccatggattcgcgaggtaacgttaattggtgccgcgcctgagcgcaacgagacgacgaccataagcgagttcggccgtttcatcatgcagacttgaagcggtgaagccctcccatgtgctctgtgaaccgagcaaacgttgctgtcatggtgtcactggaaaactctcgggtttttgactgattttgctctcacgggcaaagctagcatgcaaaggtctgcaggtttgttgtgatcgatggtgcacggtaaaggcgccgggcgcatgatctttagccgctgccaaggcatgatccgagctgtgctgcacgatcgccactcgccctagatacactcggcctggatataacgatatagcacgctcgatcgatcagcaaaaagtaatggcttccaggtcgttctcagttccagcagcaggcactagcgtggtagtacatctatctgaacgacgacgggacttggacacatgggaggtagtacagccagtagtctctgaattgctgtgtgtattaagcagcagcctgctttgtttgtttcttcagaaaatccatatgcaacaagggtgtgttcgaggagaaggagatcagagagattgagaagatacgcaaaacgaggtgagccattagcgcatgattaattgagtattaactattttaaatttaaaaaatggattaatatgattttttaaagcaactttcctatagaaaatttttgcaaaaaacgcaccgtttagtagtttgggaagcgtgcgcgcggaaaacgatgtgctttctcatcctatctcacacaaaagaacgcagcctaagtcattacacgtggattttggaggaaacttaaaaacttttttcattgcattgggctattattcaccacacttaatacacatttactgtataggccataattgggcttaatctatattgggttgtgtttcatttttactgttgaactgagtttgagatcggcgtgtgcttggtgagctcatgtcatggacaactctaatccagcaccatcatatgtatctaggggtgtaagtggaaaatcctgatactcatatatatatatatatatatatatatatatatatatatatatatatatatatatatatatatatatatatatacatgtttatcagttattcttttatagtaatataaaatttgaaagaaaaataaaacataagtatgataagtgggggaaaataacctgcttatccgtcccacttgcatcgctataatggatgtgtgcaaactcactgtacggtgcggaatatggaaaatcttgtttcgtagaatcacaagatatttttcttttctcaatccaataatctaaaagcgaaaagttaacggtaaagcaacgactactttagttattcatcaaaaagttgggttccaaaactaaaagagccaaaagaaatatgcataaagtgccctcatacgtgctatgctgactggctggagaggaacaaaatatcacttccaggacaaggcaatcctattaaataattaacaatctattatatcattaactaaaataagttgttatgtgagcacctggggaggttcccctgaagactcttttctttgtagaaccttgtccatttttctataatggaaatggagggctatgccctttgctaaaaaaaaatcattcactaaaataagtttaaaaaaactatctgagacctaaaaattatcatattgataaaaagagagagagaaatatacattgcttgattgtaatgtgtacggtttctatccatgtagattgattgatatagttgtataatacaaaagaataccatatttgtaaaaatagaagtaagaattgtacatgtcaaattcaactcttaaaatctagttttgcgcaaaattgtttgggaaactatcctattttttgcatggacattatgttgttaatttaaaacgttagctaaccgacatttggcatatctttatggtttaattaacttttcctgtttactacatttatcctttgatgggtacttttttagctagggagtatatagtatctactttatggtggtgtttgagattgatgaagatgatgaagtgggtgcccgtaaaacgagaaaaccattaacgtatgatcaattaagttttaattattataaacttgaaaaataaatttattgtaccatttagcaatttgaaaacatgctaacagaaatcgagataaaatctacattttatgagaagacaacacggcctctaataaccagtaatatttgatacagctccctggtctgcttcatttaagcaatcatcagtgtcatctagtctactgtctacacatgctaggggaacatactagtatgtatataaaattggatatattcattttatcctcaactctaatcttattttaatcaacaccctttgcatagtttagagggagtatatctggatctattgtaggaaagtaccgacggtcagggccggccctggccctatgcagccgaggcgaccgctgggggcccatgatggtagggggcctataatggtgggggtgccaacacctaatactagtaacataatatctcatccgatgttgagatcaatgatttttattcagaattaaaggtgttgcaagtgagtttgccagattcttggatgttcgcgcctgagattctgaagtttgttatggatgcagatttctatccaaatgttgcagttgcctatcgaattctcttaaccgtacctatgacggtagcttcatctgaaagaagttt

SEQ ID NO: 45735 - DNA, 13260 bp, Oryza sativa
ttggcatcttcaggctttgcacaataaagacaatatttttagcatgtccccctactgatcagattatcatggcacactttagctcattgaaagaatatgctgaccattaggccattaatcttgcccgcgaattaacctgataactaacttaacaacctctgcgcgcccccactactgtaatggccacgccaccatcgccacagatcaatctggcatcgacacaggtcaggaagcatctgacattagtgcaccatcaccgtgtctgtgtcttcaacacggcaacacctgacaactgacgagaccaaaggtaatattacctccgtcccaaaataagtacagccgtagatatccatgtccaacatttaaccgtccgtcttatttgaaaaatttgtgaaaaatttaaaaatatttagtcacacaaaaagtactattcatgttttatcatctactagcaataaaaatactaatcataaaaaaatttcaaataagacgaacagtcaaacgttgaatatgaatagtgtaaaactacacttattttaggatggagggattactaagcagtatcatcatcttctctaaagccgttcctgttccatgtataagtatgaatccacttttagttcagagcaacagtacgaggtctcctccgttataaatacgcggcgacgccgcggcgactctgcagaattcagcaacctgacctctcccgttctcctgcagctagcctccggccagtctccagcgcgtcgccctggaccgaaatattatgccacgttcttctcgtatgaatctgtggccgcattgcttcccgtgtttcgacgatggcgacagatcaggcaacaggttcagtactgtatgcaacttccccgatgatctcctcccgtcgctcggtgctaccgctcaccagcctcccaagctcaggaaatacctcgtctcgccttatgacccgcgttacaagtacgcgtgcctctgcttccgtatatgcctccaagactgttgttgttcatggatatcgatcgatcaagaactgaaatgtacgttttgatgctccttgttaatttttacagggtctgggaaacatttctgatcatcctggtggtgtactcggcgtggatctgcccgctggagttcgcattcctgaggtacctgcccagcgcgccttttgtcgtggacgatgtcgtcaacgggtttttcgccgtcgacatcatgctcactttcttcgtcccgttcgtggacaagaagtcctacctcctcgttaacgatccgaagaaaatagcagtcaggtacgtactagctagttagttcagaacttgaacagctagttaatttccggagatcaggcagacagacaacatggcacagcttaattttcttgtgctcactgcattcaggtacctgtcgtcttggttcgtcttcgatgtatgctcgactgttccattccactccatcagcctgctgttcaacgagcacgggcatgaccttggcttcaagtttctcaatgttctcaggctctggcggttgcgtcgagtcagttcgatgtttgcgaggtaaacgccacacgtgccctaccaatccactgtaaaatggttatacgctagccagtagtcagcatgtgacatatatatactatactttgatacaccatatataggcttgagaaggacatccggttcaactacgcggtgatacgctgcacgaagctcatctcggtacgtccatgatacgatatcttttcctctgatcagtacgttctattcctctgatcagtacgttctactccaccaacgagcaaaacgaaacttctatctgcatggcaacaccaggtcaccctcttcgcgatacactgcgccgggtgcatcaactaccttatcgccgacaggtacccggacccgaggaggacatggatcggcgccgtgatgcccaacttcagggaggacgggctgtggatccggtacgtgacggccatgtactggtccatcacgacgctgaccaccacgggctacggcgacctgcacgccgagaacgccagggagatgctgttcggcatctgctacatgctcttcaacctctggctcaccgcctacctcatcggcaacatgaccaacctcgtcgtccacagcaccagccgcacccgagactttgtacgtactgtccgatcctaccaaagcttctgtgcttttgttctctgtattgtggtttgacgatcgaaatggcttgtgcgttatttgcagagggatgtggttcaggccgcctcagaattcgcggcgaggaaccagctgccgcagcaaatagaggagcagatgctgaaccacatatgcctccggtacaagaccgatggcctcaagcagcaggagacgctagacgtcctcccgaaggcgatgcgatccagcatttctcactacctcttcttccgggttgttcaaggagcctacctgttcaagggagtctcctcaaggttcatccagcagttggtgagaaacgaggctgaattttgcataaaaaattgcgtaatggaagaccctcattaacaatttggttgtatatatgcaggtaacagagatgcaagcagagtacttcgccccaaaggaagacatcatactgcagaatgacagcccatcggacttgtatcttcttgtatccggagcagtagtacgtaaaatctagtactttaatactacctatatatgtatgatcagtgcacaaatcgtaacggaaaatgaatttctacttacaggacattctggtattcctagatggaacagaacaggtaatggtatctcctgagttgctgtttctgaaaagacagataacgggtttccggacaaagatcagacgcacttgaaaaaatgacacctggggccgtttcatgtttcaggtttacaggagagcagctgagggagaactgctaggggagataggtgtactgtgcaacaagccacagtcgttcactttccggacgacaaaactatctcagattctgaggatcagtaggaccaagctgttgggtatcatccaggagaacagagaagacggcgacatcatcagaagcaaccttcagcaagtgaacgtataagtgggctagcttcgctgggcgtgctcaacgcaagacagatgcctctgttggaaaatagcatttaagttttgagcggatagcatctaatagtttctgtacaaaaaactaaaaatggaggaaagatcatgcggtggaactggtgaaaactgaaaagattatctgtactagaacatcatgcagtgtaactggtgaaaaaacgatctgtgttcggacagatcttggacgttgagacaatatcacctgcctgtcaaagaaaactactactacctttaccaatcatttagggttcacgcagtaaataatgtgacttcaaatctgtgtaagcttgtaacaaacgagatagctgtaatgtcccggtaaagaatggctcgaagaaattgagtatatatttggttccttctttcggaccgggaagattttatagaatgggcctttttagcacaacaaagttgtattggtttttgcaataagttcacctacagtccctcaactttacctcaagtctgtatgacatccctattccccaataccagaaatgttttacccctcatgtttaaaaccatgcaaaataggtcctatagcagtatatataggtggtttcgctgacgcggcatcctagtcaacaatatggatccacatgtaagtgagatgaataaaaacgtgggggtcagcatcccttctttcttctcttttctcttctctttcttctccttgccgcagagcgtggtgcggcagcgggcggcgacaagcggctggagtaggtaggcgcagcggtggcgccgggcggagcggagcagcggcggcggcgggcgagcgccaggaggtcgctggcagcagagggggagcgacagcgagcgagcgcggtagcgggcgacttaaagcaagcagtcggagagaggagccagccgagcagagtgggggcggcggtgggcgagctctcgcatgaggctgtcaaggttgatgtcgaagtcgtccgatgccacagccgcggtgccgccgcttctgcttgcaccgggacagggcgtaggaggtagatgaagatggcccgaggaggtgatgaggtggttccggcagagagcaccaggctattgggcaaccgtcaactggtccggaggtcagtgaggaaggcgggaccggccatgcaggccatggagcgggcctgcgacggagtgggcggtggatcggaggggacccggcggcagtccggcgtggtggggagctcatccgccgcgagcggcatagagcaccataccgggctccagcggtagtgcgcgcgacatccttgacggggaggtgggagacgaccttgctgaggagctcgtcagggagggtgctgatgcggtcgacgacgtcgtgcggggtaagtgcgcagaggcgtgtggtagcggagacgggcgggctggggagggtgtagtggatgtaggagagcacgcgtgccacggtcccatacacatcatctgggtcgtccccgcgccgccggaactcggccgccattgcgcggcccatgggtacaagtagcacacgggtgtccatgggccgtcgctccgcttgctgccctctttctgcttcgctcgccccctgctgccgcactagcccgtagtggcttcaccctctgccaccggtggcctcgctcgctgaagaagataatagaagagaagagtagagagaaaagaggagaagagatggtagacctcacttacatgtgggccctatatatatatatatatatattgctgactaggacgcttcatcagcttaatgagagatccatactgctataggacctaacttgcacggttttatatagtttaggggtgaagaattcttgtattggggattatggatgtcatacaagctggacgtaaagtggagggatggccggtgaacttatttcttgatttttattatcatgtgggcctaaatacaagggctgccggatttatcttgggccaagctctttacgcacaccaccggggcctaactagtctaagatcctagtatgggctttttctcaaaagaaaaggggagtaggcccagagataaattaaacgactcagactactctttctccccgtttttccgccttcgctccgctccactgtcccaaaagggctaaaacccttctaaaaaaaataaaaagcccaaaaccgatcgagtacgtccacaaacacaattcggatggaatatcccgaaaatttggcgaagaaataccattggtggtctacgagaaactcagttctaccacaccaagccctcttcactaagggctgtgtttagttcagcgtaaagtttagattttggttgaaattggagttgatgtgactgaaaaattgtgtgtatataacatgttaatgtgatagaaaaggactgaagcttggatccgaactttggatctaaacacagcctaacacgtgtactacgagaaacacactgcgaaccgtcgcatcgctggaggacgtttgaaaatcgaaaccgaagcccggccacggcactggaccacggaaactggaagccactcgagcgcacccaccactccgtccgcacgccaccacttcgtccgcacgccccctcctcctcggctgcgcggcaacgagtccaacgagtcccccattggattccctccgccggcacgcatgacgcctccagcacaaccaacggctacctgctgactgactgactgactcctgaccgcctttaacttttaacggctactccactcaaagcggcccgccaacgggccccgctgggccccgcccgcccggtcaccggggattcgaacgtttcgccctccctgcgaccaccaacggctacatcccacctataaattccccctcaccacgccgcccatttcccgcactgcaattcccacacttgcacgcacacacgaacaccacagagagagtccagcggcgcccggcgagaagcttcagccaagtcacagcggcctcggcttcttgcagctcgctgctcttccctctcttgatcgtgtctcgtgccacacatcctcgtttcgtcatctccatggcggcgtcgaccaaggccttggctctcctcttcgcggtgctcgtcgcgctcgtggcggcgacggcggccgtgagagtgctggaggaggaggccgtcgagctgggcggcctcgcgcctgctcccgcgccggccaacgcggcgggcgccgtcgcgccgggggcgtgggccgtggccgcggtcgtctcgctcctggccttcctcgcgcattgagatgagattcgacccctgagagggcgcagcgggtagtttgcggaatctgttgggacgggaatcctgtggtttggatttccgttgcagcggtagcatttggtgtttatctgaggagattattgctgtacgtttctatagttattttaggcgtgtttgttctagtccgttatggaggtgttgtgtactgccgatctctcttttgcctgtataagagaggaatatggttttgaataatacaattcatttactattcttttataagctctgtcctgtgcactctcagaaaaactgctcataaagggccaaaaatactcggaacacgttggtactacactcggaaaaaggaataagttcatttagtgaccctcaaaagtgattgaaatctaatccgtaaccttaaactacaaaaccggatatctcgactcccaaactcttaaaacccaccaatttgactcccttggtggttttggaggacggttttgctgacgtagcgcctacgtggcggtattgaccgggtctcttttacacgtggcgttgacgtgacgtttaggtggcatttagaattaaaaatatgtgtgggacccatttgtcattgacatgcaaaagaatttgtgggacccacgtgtcccttctctctctcccctccctcctgttccttttcctcctcgccgctccctctctctctctcgagtggcagaggcgtgggcgtggcgcgacggcctgcgagcggcggaggcgcgggagtggcggcggcaggcactggagcggcgacggtggaggcatcagtgcgccagctaggcggtggcaagcaacagccgtcatcggtgacccgaccaagccgcaccaagcaggatccgcggcaagcaggaagcggtgagcagcggaagccgacggctgttgcttggtgccccttcctcgacgtcggcgagcaggaggcggcaagcaagcccagcggcgtcgcccttgctggaccgcagaaatggtttcttctcaattctaagcttgctctgctacttcattggatccggcggccatctacacgcagcggtaggccaatagctgtcatcttgccagatatttctgtcccacaaatacactgaatcttgctttgctgcaaatgggaggttttggtagatgcatagcatttggggatctctttcctttgttatctttaatttccttttctcttttttatgcatgcgaatgatttgtccatgtaaaggtgaggagtagattttggttttggatgaggggtgatgcaactatgctaagattagttattttttctgtaaatgcgcagagttagcagtaactatttgatgttgatacggatggtgatgaagcggaggaggtggagaaggaggtcgcgtgacggcggacggcggcggtgacggtggaggacatcgtcgtcatcgaccccgccgcatgtgcctccccccgtcctcctgctactcgcaggccgccgcgccatgcccgcgcctccgccgctcaccgccgtctctgcccgccgccgctccggccctcgccgccgtcgccgcgagagagagaagggacacgtgggtcccacaaattcttttgcgtgtcaatgacaaatgagtcccacgcatatttttaattctaaatgccacctaaatgccatgtcaacgccacgtgtaaaggagaaccggtcaataccgcaacgtaggcgccacgtcagcaaaaccgctctccaaaaccactaagggagtcaaattacaccggttttaagagtttgggggtcgagatatccgattttgtggtttagggccacggattagatttcgatcacttttgagggtcactaagtgaacttattccctcggaaaaaacattgctcactacatgaggacgatcaggatctgtcaatttgatccgttttctcttgttcttttagaggaggcccattaagctctccaacggacccaactggcccgtggcacatacggcccactttctgttcggtttcattcagaagaaagcccacagactggcccgtttaattatgaaaacacatgcctcggcccgagtgtagcgtgtatggctgtacgcatcatatctacagggagagatgatcgccaatttgcgatcgcccatcagatcaaatgcaccttttgttgaacgcgcttttgttctggatctctttaggataagatggtggtgtcccgtccccctcccccaggccccagctattccagcttccgatcaagccgcccgccttacctctcctggccgtcccaccccaccatccaaagctagatagcaaccacacgtgcccgcgtcgatgcggcgcaacacctgtgcatgcacgcattggcgcgcgcgatcgaaatcgtgatgcgcctcaagctagcagtaaaccacctcccccgtgcatctcctgactcctgttcatatatccggccgctgttttcccccagtactgttgccggtcgctgacgagacaccccatgtgtacgacgatctcgccctgtgctcccccactgctgcttagttcggtcgttcggtttcggtcgacacggtctagttatttcgtctatctgtgacgaatcgcgcgcatacgtacgtactggagggccgatcggatcgaggactgccactttgccaagttgcgatgtttttggtttggcaacgggcgggcagctgcaactttcaggagatgcacaccagctgttccaacgaatcgggccctgttgatttctccactcgtccacatgtttttttacacgtgagcgaactctatctcatattcctggacacctatattatattagcatatccatacgcatttgacgcatggacgcgtagtgataatcaccagaaagttcagatcaggttactgtgttatactgtactatgctatatatgtatgctttgctagctactagtctcattcagattcagctgctagctgcttgctagctagtgtactcgttcagattcatgcattggtaatcaattaccacaatcgcatgcatatatgccttgatgaagtgtcgtgcgctcactcccgggctcccggcccggccgctcatgcagatacactttaattgcttggctcgtgttcttccttcctggcgcaccaataatttgcagcaagccttttcagccgcatgcaatgcactactcaacgggatcacgggattattgtaacgaaagttttggcacgcatacactgtttgtcaggctagctaaatgttataacagttggcctatatatgtcaccactagctagctagcacgcagagatcacaaatggatttaatcatcgcacccaacaagacggcaacaggtaggcagcaaaacgcggatagccatcgctaacatctccggggattctttagacctcggccactaacttatttactgatgcttccagcagcagtgaagcctaacagtgtcctgataacgggagcacgatcgatcgcaatggcgaattattgatgctagcaggggcggatcaagatcgatgatgatatattataggagtagtatatactatactccctaacagatatgatgggatcgccgaatgactttggttatcatgcctcgagcctatctctgacggtactggtcgccgtaaacatcactggcgattcgagggaggaaaggagtttagctggtgaccacagggttgacggccacttctccttcagagttcagacaagactcccgtgcgatgttaaccggaggaagttgcattgcccggcccgtaccgtgtctgaaccaatgaagcgtagcgtagcgctcgcactccatcagaatgagtaacgactaatcttatcaagaatcagaaacactgatgagcagttgcacgcgcactgatcagagcttcagacaacaggtcgacacaatgtctacaaatatgcatgccacagcgatcaagaacacatcctagatgtcttgaggttacgtctcatgagagatcagagtagagcgtaattaatcgttgaaatctcggtcgttttcagatgtcacacctgagaagctcatgtatctaacgggaatctgaaccactgttcaggtgtcttctccgaggagctcgggacgtgcatgcgaggaggaaaaaacggcactaatcttaaaagctggatggagcaggtagattagatctcgcttaatgattatctctctatcttctggatgatctactgaataatcagcagctcctcacaccacacaattatgaaaactatcaccgtcagctatagcttgtcatgtcagaataaacatcactaccgtgccttttgcaatcagcttgtggtctagtgcttggagaaatatccagttccctgtataccatcaagtcatcaaaccatcagaatcaggactcctatgtcacccagtgcgtcagtcatagtgattagaccaaagtagtccacttgtacgttctggtagtcgtagtacaaaaaggaatacacgatatatacattaattattaaaaggtagcccgcgcaaatacacgggcatgcgtcgtacgctaagtttgagacactaaaagcgatatattaaccggagaacatctaccccaatttctccataaattgtttttgttagcattagttacttttataatttttaacctattagctttatattatatcatatttaaataatattagttatttataatcttcttcatcatttgaaaagaaggtagacttattttcttttgaaaatatttcaatgaaagtaaaagtaagtgtaaagcaaaagaagtgtgtttttatttttttattacacatatattatcatggtttattagaggatgaatttggtgggacataaagctccactaaattttatatagcctaatataatcgatatagtttgagagacaacccatctataaacatttcatgtagagtgggtaagaggttctacgcaatctaacgtgaatacaattgcacaataatatttttgaaatgtgatgtaccatgaatacgcgcttgtttttcttatataagatagatctaatgattaaaaataatggtttcactggtttaaaaggcataggagtattctaaaagtatagcttaaaaatcatggttgttttaatatccaacattattttgaattgaacatagcttaactggttaggttccttgtggtggaaattgcccactcgtgttcaagtcccagacttctttcagtggtagacaacgtacccatcgacagtgaggcactcatggtgactttgtcaatctcaaaatatgtcggcccaatctctcagaggtactcatagggggtaaagtgtgcatgtgtgcgttcgtaggggtgagtgtgcgtgtgttgtgagcgcactttgtctctcaagaaataatccaacattattgataagtttattagttattgataagtttattagggacgggtggacgatgcgtagtatgtacatgctcgggagatttttttttctcaatccggtggatagtagtacgtattgtacatgtgagaatgagatgtattttaaataaatctaatctaatgatttaaaaatagtgggtctgccgaattaactgaaaatcgagggttggatttttttttcttttttatcaaaatttgtaaggttctatctaatttattatagtgccacgtggcagcttaagggcattggtaggagtctcacgtggtggcttgagagttttctagaaagtttaatggatttttcatatataatatataggtacacaggacaaatacacatgcagcttttgcttgcttgttccgaagttgaacattaccgttatattatcatgttatacagaaagaaaattagctttatctttacttccatataatttctatttccttatcaagtagaatttggtacataataggtcatttctatcttaagctctgaatgatatataggtggacaaacagctaggatctgactgattattttttaagtaaatcttatttagttatgaatgttttgtgatgcatcaaattatggtataatctatattttgtttttctcataattcagaatttttagaactttttgaagttcataaatctgttttagttatgcatgccggtgaagtgatatatgatgaaatagtatataatgtcactttcttttaataattgttcatatatgtttgaataacatgtaaagggtctcaacaaaacttaaatgaatataattttacaagttaaaatatagtcaacatgtgtcttaaattctaattgtgattttaatcataaataacacaattgtacaaatagataaaaaattgaacgtataattttaaagttaaaaagttagtattatttaaaatttatttttgcaaataatatgtatttagaagtatgcttatttaaaatttattgttgcaaaagctttcatagagagagaatggaaggaaaaaaacgtagaggatttcctaaaagaaaacggagggaaggatggacgtcttttttttttaaggatgagaaaaattaaatctaatctaatggcttgaagtgttatgtccactaattttaataaaaaaattaaggttagatgtttattttttaggtatataatttaggtgttacgaatgttaaaatttttttaatcgaattccccctgttagctaatacaaggaaaaaggaattatacatagaggggagggagagagaggggcatacgtggggagagggcgaacgtaacgactgaggagagaggtggggaaggtacgtggtctttctttccatttctttatttatatgagattaaatctgatggttaaaataattagcctatcaatttaagtgaaagtggatgttagatcttcttttctcgggatttatagttttttttaatttattagagtgccacgtgatgacttaggagcgtttgaagatgtcacatgacagtttaggagcgtttgtagaaagtataatagacttttatatttaattactaatattaatttcggttttat

SEQ ID NO: 45736 - DNA, 21887 bp, Oryza sativa
  unsure (1)..(21887): unsure at all n locations
aaactcaccgtagccggcttgctcctggaagaactcatcgtcagcgggatccgcttcatcttcttcagcaacttgggggggattatttatatagagcaagggtgagtacgggagtactcagcaagccatgggaaataagtgtttaatgcagacttcaaagaaaggccgttgtttttgcgattgattttatttaaactcttttctgaaacaactaagggagtgcttctcaaacgacacggatgagacagtgcgtctcgtccggtcggagtatatgcaatgtatcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaactacgctagaaatcacctcacatccgcccatgaccgtgggcacggttgttcgaacagttttaataacctctgcagagggggtacactttacccacacgacattactaacccggatcatccagctcgtggggatcagccacgtcgggagacctccaagctttcatgacaaggcatttccaaagccgacacatgtttaccatatgctgacgagaggggtcccagaccaacaacaggttaggtcccagaccatactgtgccaggaagcccaggggtcctccccgacaccaccccggcgaatccacttgtctctcagcatcaaggctcccctgattagctaattactcagccaggggtgtcccattccacccatgtggtcgtacttgtcttatgttcggatgaaattccaaggaaacggtccttaagtgcaagagcgggaaactgtacacccggtacgttccccggtcctcagttttggaaattcatttagttcgcaagcaccgacccaagtgtcgggttttccaagtcttttgtaaaacccaagttttacccaagatgtttctcagattttaagtttgaaggcgaccgttgatacccgtgcagagagcacgattaccgaggcacaactaggtgggtacaagggaacatggtataacaattacaatggaagggtcaaatgcaacaaattaggtaggtccgccaatctgccttgcaaacgggacaagcagattaagtgcgatcctatcaatgcataatatttttcaagcaacataattaagtttaaatataggctcaagttgttcaaaggtggcttgcctcgctcgagatcttgagcttgatcctcgaaatcctcgcactgcgggtcttcgggctccgaaactacacgcgaaacgggacaactcagcaaacggcgaaaataaagccctattatcgacctctaagcgtgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagacttccctcgggcggctagggcgcggcccgagaaaaaaggggcggctcggccgagcttaatgggccggccagcccaagaaggcggcccaaggcgcgcgcgcgagcggggaggggagagagagccggtgggccgggtccatcccgcgtggtcccgggtgggacccgcttgtcggcgactcggctcaccgtgagcgaggtgcacgcggggcgtgctagggtttgggaagggaggcgcggcgcatgcgcgcggttcgcggaggacgcggtgcggcgggcccacgcgcagcctcacggctcgcggtggtccgcgcgcgcgagggggcggagggaagcggcggaccggggtttgcttgacccggtcgcggccgaggtggcgcctacgtggctgccacgcgggccggcgggaggtagatgacgacgccagccggaacggacggcggacgacagcggcgagcggcggagcgaaccatggcgatacaggcgaaggcgagcacactgggatgttgcacaggacgaggggagacgagccaatggctcggattcgccgggggatgctcgacggcggcggattgcggcggcggcaaccgacggcgggagaagggggaaacggcgatgaggtcacgaggggccgattcccggcggtgagagcatctacgcggctacgggaatccgttgctagcgtcggattgggcggagcgacgccgagcgaggccggcgacgagcgggcgctacggagcacgggcggcgacggcggcgagcacacagcgagcggcggcaacggtcggggcggcgccagctagctacgggaaggctacacatgctactaccgaaaactaaggggaggagatggatcgaggagggagaacgggggaatgcactaccgagatgaggcggggcgctgtgacgagaggccgacggcacgggagtgatctctccggcctcgggccggggaagaggaagtaggcgagcgcccggagtccccttccgtgtcctcgctcgtgccggctcctccgacacgtgcgacggcgaacggcgacagcgaacagagcacgggaggcggcgacaatggagtggaggcgaatgggagagcaaaggaaaggggggaagcttgggtttatattggcgacaatgtcggtttggtagaggggaaccaactttgaacggtcaagccagcgagctggcgctccggctagcagccaaatcggcgacagggaggaggggaatgacgccggcggaggaagaaaaaggaaaaggaaggaagaaagggggcttgccccttgccactttgggaaaaggaggagctctgcctccgtcccttggaggctagcgcgcggaggtggcggggccgggtcgatgacgacggcgatgacggcggaccggtttggagtggagcggcgacacgggcggcagacgcggggcaggcgcggcaggcgctgacggcggcggcgactggccggtcggccaccacggtgcgcacgcgcgcgggcggcgcggcgatttgggcggcatcggcgggaacggcagcgagagcggagagggaggagggctcggcgcggctcacgggcagagcggggggagagagagagagagagccggggagggagggggagatgggccgagagggattcggcccatcgaacccgagggaggcaaaatagacttttgcggagggatttgatttgggaaggatttgtattcgtgattgaactcgacgatagatcggggatttgagatctgagatggcacggacactagacaacaagcaaagaaacagatttcgcaactagggttattaagagatagttttctcgctaggcgccacgacggaacgggcgctacaccaagcaacgcagatggatgcattagtggcagcgggctgaggggaatatcggcggcaatgaggacgagaaaagaggacgaggggaacgaaccgctcacgcgataaattatcggagcggcaattctgtttcttttttccttttttctttcttttctctaaccactcacgctcacgcggataaggacggaggcagcgagctgacgggaatcaccccagcgaagaaacgacgctcttttttttttcttttttcttttctcttttttttattttttttcttttctcttactgcttacagtataattgtgacatatgaacattagattaattcgtggattagtacttttcagaaaaatcttttgttacggcatgtttgcgtgtataagaatacttctaattgactaattcaaatgttaatatgatattttatatgatagtatagagataactcacctaactaaataaaaggtgcttatacacaccgtttctcttatgaaagtaactaaataaaatggtatattagctagactaaataaatacaagcaaccaaataaaggaggcatgcgtatcctcttggccatatcaaactcaggctaataaatacaagcaaccaaacaaaggaggcatgcgtatcctcttagccatgttaaactcgggttgtataagggagataagccaggctaaggagatatgagctaccaaacacacgggaaggacggggtagcttttgttgatgatgctgatggttcttcattcaaggatgttctggtcgagtactgcttgaagaacttctattccaccatactttaaaaaacatattttttcaactgtcacgttttattttgtttgtcggctacgtggaccacgttgaatcgcgcgattgagtcatccaacgcattaaatcgcttcggtaaggaccccgaaagttagaaggaattaacccgccttgctatccacttaccaattcgatccaatcgttcaccatgcacacacctgctccacccttatcccttattcgtttctcccatctctcagtcgatgatgggtaggtactggcacctgctggtcccctccctcgatcacctatccgtcgtttacgcgtgacacgatcggtctgcacgtgatttcgcgtacagttttagaaatgctacacaatacttgagaaagggcgagtattatgagaatatgagtatatcaatatgcaatagtagtttttatccgattgatattctgatcaatacttagcctaataaataatttatttgtcttttatccatagctctgtagcgaagcacgagcattttgctagtatatataaaaaaacagagtaaagaaatcgtaagcatatcattgacataaattaaatatataattttgggggccctaattatatttttaaggatcttgtacggtggcacatcttaaacgtagggacagtcctctgtacgaaaacaaggctaaattaaatacgcgcgcgaaccgggactcctctctcaaatcccgctaaaactactatcaaattgttgcagatcgaggatggtttgaactatggacttccttacagagatggaaaaaatttgtgtgctccgcatatatacactaatacacacatcgatcaacatcaagtggcgcacgtacgtagctagccttccaaagaccatgcaaacttctccactcaggctccacccctccactcgggcatgggtcgcatgcagttgccgtcacgaggctagctgcacgcgccttcgacgacacaacgtacgggtatttctttttccgtgtagtgtctcctcgagaaacgtagaggcagccgtccacgcgtttaattagaacggagtcaaacactagttagacctgtactccatgcggtacactgcatgcacgctgtccgattacgtgttccacggatcggatccgttgttctcttgaaccgcggataaaacaatggtgcgagcaccgcatttctgcagtgaagaaacccccttttcctctgcatgcagtcaagagatgatccgggctactagcttttttctcagatattgttacatgcacgttacatgccttcaaccacagcctcgtagtacaatgttgcttcactcttgtttacgatagtacaccgctaaggatcagggtgtctggaaaaacaaagaaaatatcttacagcgtttctttacgatgaaagcaagaatgaaatgatgaatagtgaatgatttctgataattattcgaaagtaatttatactatatatgaagttctttctttagaaaaacaccatttagaaactggggaggcatttgccactataccattctcatataatgaataggcactactaaaatacctacttaggtgcctgttggaaaccccacatggataccggattccccgaccggcaccgatgaggtgcatggtttgaaaaaaaaaaactggattagcttgatttgaacaaatgcttcgagcccaaatatttcccaaatttttcttcatcaaacacattattattatcaacatcacaaatcacaaaatgaatcataaatttttggcataatgcaataatactcaaattagaatacatctgctacccaatacctaactatccattgcagcatcaaagggaaaaacaacatccccaaatccttaacagataagagaaccgaataaactaaagatccccaaatcctcaagatcagccgtcgcttgttgttggttgttgcctccatcatcgtggtcccatccgctatagtccggatctagccttaattaagcttgcatcagcgctcgactgggagaaggagacggggagcttgtggcagcagatttccctgccctcgagcttgtggcgacggatcagctggcatgaggaagtgaggaggaggaggcgatgctgactgcggatgcgagaagtggttgtagtggtggatgcgaggagtggtttgaggcggcagtggatgcgatgaggagggaggacgcgtccgggacgacgctatgtgaggtagagagacgaggcggattatgtgatcgagtcacgcgtggatgcaatcgagtctcgtgttaaaaaagtagggcagctggctgtctggtgggctcgactccctctaagagatcgattttttaataaatcgacaccaatgtcctacatatgagtgagcttttttgtcacgcctcgaactagtctcgaccggaactagcccgtgacgctccaaattaacctgttaatcgataccagtcccaggaaacagtgctggtatcacagagagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactgggggggattatttatatagagcaagggtgagtacgggagtactcagcaagccaggggaaataagtgtttaatgcaggcttcaaggaaaggctgttgttttcgcaatttattttatttgaactctttttctaaaacaactaggtgagtgcttctcaaacgacacggatgagacagtgcgtctcgtccggtcggagtatgtgcaatgtatcagtctttagaattgaaacaaggttggcacccggccaacagcttttcaaacggccacccgggccaacaacttttcaaacggccatccgggcctagctgatcccgtcagctgctgatttttcaaacatcgaaccaattttcacaacagcaatttcacaagcagtagtcaaacaaaactacgctaggaatcacctcacatccacccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacaagaggggtcctagaccaacaacaggttaggtcccagaccttactgtgccaggaagcccaggggtcctccccgataccaccccggtgaatccacatgtctctcggcatcaaggctcccctgataagctagttactcagccaggggtgtcccattccacccatgtggtcgtacttgtcttatgttcggatgaaattctaaggaaacggtccttaagtgcaagagcggggaaaactgtacacccggtacgttccccggtccgcggttttggaaattcatttagttcgcaagcaccgacccaggtgtcgggttttccaagtcttttgtaaaactccagttttacccaagtggttactcagattttaagtttgaaggcgaccgtcgatactcgcacagagtgcacgaatatcgaggcgcaactgggtggttacaaggggacatggtatagcaattaacaatggaaggatcaaatgcaacaagtcaggtaggtccgccaatctgccttgcagatgggacaaaagattaagtgcgatcctatcaatgcataatattttgcaagcaatataattaaatttcaaatataggctcaagatgttcaaaggtggcttgccttgctcgagatctggagcttgatcctcgaaatcctcgcactgcgggtcttcgggctctgaaactatacgcgaaacggaacaactcaacaaacgacgaaaataaagccctattaatgacctctaagcgcgccattagatagatctcgagatttggggaattttggaagttgaacggagtcaaacggatttacggttgggaagatattgaatttctacgatcattgaatttttgatctaaaggaaaaggatttaattaaattctttttggaaaagaaaaagaaaagaagggagggagggaatatagacttttctcggacggctaaggcgcggcccaagagaaatggagcggtccggccgagctaaatgggccggccggcccaaggcggcccaaactcgcgcgcgcgcggaagggaggagagagagagccggtggaccgggctcaccacgcgcggtcccgggtgggacccgcttgtcagcggctcggctcaccgtgcggagggagtacgtggcttatgcgcgcgggcgggggagggacgcggtgcacgcgcgcggctcgcggtggacgcggatgcggcgggcccacgcgcagcctcccggctcgcggtggaacgcgcgcacggggagggactgaccggggtcggctcgacccggtctaggctgagctggcgccgacgtggcgcctacgtggcggccacgtgggctggcgggaggtagacgacgacccagccgcgaatggacgacgggcggcggcggcgagcggcggagcgaaccacggtgatacgggcaaaagcgagcacaccgggtggttgcacgtgatgagggaagacgagccaacggctcggattcgccggagggagcttgacggcggcgaatcgcggcggcgacaaccggcggggagggaagagggaaacggcggcgaggccacgaggggtcgattcccggcggtgagagcatctacgcggcttcgggaactcgacgctagcgtcggattgggcggaactacgccgagcgaggccggcgacaagcgggtgctacggagctcgggcggcgacggcggcgagcacacggcgagcgacggcaacggtcggggcggcgtcggctaactacggggagtctactcaagctactaccgaaagctagggggaggagatggagcgaggaggaagaacggagggaggcactaccgtgatgaggaggggcgctgtgacgagaggccggcggcgcgggagtaatctctccggcctcgggccggggaagaggaaggagagggcgcggccgaagtccccttccgcgtcctcgaacgcaccggctctcccggcgcttggcgaaggacggcggaggcgagacagagcacgggggcggcggcaacggtgaggaggcgaatgggagaggaagggaaagggggaggcttgggtttataggatggcaatgtcggtttgggaaccgacttagggcggtcaagggcgcgagctggcgctcggcggtcgcggccaaagcggcgacagggaggatgacgccggcgaggaggaaaaaggggaaaaggagggggagaaagggggcttgcccctttgccgattcgggaaaaagggggaggggagcgggggcgacgcggcagagagaggaggggcgcggcctccttcccttggcggcttgcgcgcggagtggcgggggccgggcggtgacgacggcgatgacggcgggcggtttggagcggagcggcgacactggcgacaggcgcggcagacgctgacgacggcggcgaccgggcggtcggccactcggcgcgcgcgcgcgggaaacaacgggcggcgtccgcgcgggcgcgcgcacgcgaacacggcgcgcgggaagcgtctttgcgagcggggagctcgcgcgaggggaggggcgctcggcgcgggcgactcccgcgcacgcgcgcgcggtgcgcgggcggggcgggagggggagcggggagagaggcgctcggggcggctctcgcacgcgcgagcagcgtgcgggcggggaagagagagagagagagaaagagagcgggagagcgcccggggggagagggagagaggggccggggaagaggggaagatgggccgaacctcgggggaggcaaaatagacttttgcggaggaatgtgattttggattcggaaatgaactcgacgatagatcggggattgagatcttgagatggcacggacactagacaacaagcaaagaaacaaatttcgcaattagggtttttaagagaaaattttcccgctaggcgccacgacnnnnnnnnnnnnnnnnnnnntttatagaaaaggcacaaatatcgttggtgccgatttttttttaaaaaaaaggtacttacaaggggggttataggtgtcggttctctcaaataaccactcgcaggcacgcgttcaggtgtcggttatagacttttcggcacctatagtatcgtctcttttttagtcaatatagtactgatgacgagtggctccgctattgacatatgtatatctattattgaacggattgtttcagtagattatctacttattaaagaaataaatattttgagaattaacagacatgttagaataagagtggtttaagcaatacaatactataaaattatttaagcaaacatgtttttaacccatgaatatcacaataatactaattcggtaaagtagttaaaataaactcgaggtgtacccgaatcacgagggcagttaaacgaaggtgtccagctgattgttgagtctcatgaacacatgagatcgcacaaggcccaagaactccacgtcaggagaagttagtgatgcaatatactgtacacaccgtggtttcctggccaactgatctctgtcccccctgtggtcagatctagtcattcgaaatggaatatggtcaacgacagttccccggcctgtaccactggaatctcgaacgaaggcagtttggggattactttgcatggaatgtctggttgtactacatgtgtgcgtgctagacatgcatttctggcaggtgtgcaatggaggagtacaataatggaggctataatgtaattatgtaatgtgtgaacgtatcaacttcaaggaacataccgtagccaactttataatccaaaaggcagtactagcagatgtgttttataatccaaaaggctgtcccatagagcgtgagaaaaaggcctagttgcttcagcggcattgactaggggcgaccttttttttttatgagatcgaagtgtccaactggcctgccggcaggcaggccgccaccgttgatcgccgcgaaaaaggcaggattagattaacaaaggttacgtgtggcacggatgtcagccgcgagcccgcggcgccgctcatgatcgatctgtgcggctttgcttttctatgtgccgaatcagcgggattatgcagaaatcgttcacgagcctctctgcatctgcatggacgtgaacgcccccgtgactgatgaaccgatccgatcgtttattattgaagtccaccgttccctcagcaaagtcagcattgcttccctcttcccgatgccattgccaccctagcataggtgaccctcgcggccctcatgctgagaccgcgagacggtgagcacaacaatggtacggtcgtctcggtctgtcaatatataatcagcagtcaattaatttacttacttcgaaagaaagctttgcctgctcctctttatctcttccataggtttcacccccatcgtttatccacggggagaaccggagaagagagcaatggcggcaatgcttaattatctgctggagtaagagattaaagcaggctctagcacgagggaaaaccctttaaaaagacagacaaggcagacgacgcatatgcatgcatggtgacctaactaagcaagcacggacggtaatggtatggtggagtgtgaagtgcggactaataaagcacgtatgatgtgaggtttggagtagaaaatgaagtggatcgatcggacctgagcacaaatcggcggggttctctctctcatacgttcgccgatctcatcaaaactacttttgccaaattagatcgaccggaaattttggctagaccacagcggtaccatgcatgctttaatcgtgcgtgtgagctactgccgctaataatctatctatctgtatcaatcggatacttcaagagagttctcacgttaacgtaaaagaatgtagttattgactggatggatccagaagcagaatttcattggttttagaacccttttagttttaaaagcatactctcatgaaacttacttgtaacttaaatgagagttgttgtattacttacctccttgcacaaatgtaagacgttggttagtttaatttttagctaaccaacgtcaaacaaaaaaatggagggagtataaaacaaactaactaattttgaatgctgaaattcaccatacgttatacaagttgtttctaaaatttaaattttaaacttgattactattttctccatcgaaatattttttttagcatttgacatttaaatcactaaaggcatgtgtttcatccattctattgctaattactcatgcagcttataattagcattagccaatggcaggggcggatccagcatgggggcggcggggtctcgagcccccactactggcgtgaagactatgagagaccccacaaagaccccactaaaaatttttaccatatatagatgggagggggactgtaactctatctagtttgctcagaccccactgctatttttttctggatccgccaatagccaatggagtcttaatagttttgaagatcaaaattaaaaaaatataaagttgttctcccaagttgctgtattttaaaatatccaaaatatttagcataaccacaatattgacaacaaatatcccgtaccatactcgaccaaagatatttcttttgcgtgttcgcgtacactgtggctagtgggtttttcacgtgaggaagatgtgcgtgcctggatnnnnnnnnnnnnnnnnnnnnatgcacctatgcagccatgggccggccgtttccccggtggatcgtgttcggacacgtcgcggcccctccacgacggccttggctccattgccaccaccagataaagtaggcgtgcatgcgccccacccccaggcgagtcagagcagcgcgcgcgcgcgcgcgagcgagcgacgccgtgagaaaccagagcaccaaaccgaaccgccgtttctcgcgtctcgccctctccgtgactctgcccgcggggacccgcgctgcagggggagaggcccacccaaccggcaggtgccctcccccgctctatatatacgcccgacctctcccacttctcccccacatgcacttgcagtcagtggtacaacaccacagcaacgcaccaccggccatcaacctcctctcccctgcttctcgctcgctctcctgccctgtttcttggagaagtgagcttaagtgagagcctctgtccctcgcacacgctattggccatggtggttctcgctggcccgcccgccgtcgatcacatcccgctgctgaggtcgccggaccccggcgacgtcttctccggcgtgccggtcgtcgacctcggcagccccggcgcggcgagggccgtggtggacgcctgcgagcggtacgggttcttcaaggtcgtcaaccacggcgtggccacggacacgatggacaaggccgagtcggaggccgtcaggttcttctcccagacgcagcccgacaaggaccgctccggcccggcctacccgttcgggtacggcagcaagcggatcgggttcaatggcgacatggggtggctcgagtacctcctcctcgccctcgacgacgcgtcgctcgccgacgcctgcaccgtcccgtcctgcgcggtcttccggtgagccctcaaaaccgacggcgatatataatatcagccccgtccgtttctctcggttttttacctagtgtttgacatggtgcgcgcgcgtcatgcatgcagggccgctctgaacgagtacatctcgggggtgcggaaggtggcggtgcgggtgatggaggcgatgtcggaggggctgggcattgcgcaggcggacgcgctgagcgcgctggtgacggcggaagggagcgaccaggtgttccgcgtgaaccactacccgccgtgccgcgcgctgcaggggctcggctgcagcgtcaccggcttcggcgagcacaccgacccgcagctcgtctccgtgctccgctcaaacggcacgtccggcctgcagatcgcgctccgcgacggccagtgggtgtccgtgccctccgaccgcgactccttcttcgtcaacgtcggcgactcgttgcaggtacgtacgcggtacagccccgacccttggcgctgccacgtgacaccaattccatcaacgcgctaccttcctctttctttaccatactttttcctttttccagaataattcccattaaactagatggtgtagattaaattactaaattaaatgacgtggacacggctgaaatggctgcgcctagtgagcgggtcaaccgggacatcgttccagttcacatcggtattaaaaagaaagaatcatcatctggacgaatatactaacccaattaagacgagacaagcaagaaaaggaaaggggttcacctgcatgatagcatatggtacgatggccacagcccacacggcagggactgggtttcgtagataactacgacactcgagacccaataactgccgccactaacgagcagattcagtacatgaacatatatatgtgtgtgtgttaggcatgaacacttctgttatgcctgcgtggcatctcattgcgtcatcatgcacacactcttaaacactttgtgcacttcccatatacagatggacaatatttctttatccgttagcacaagaagcacagatacgtttgattaatttttcgtgctgactattaccgtattacgcatgctgattataaccgtattacacatatgctgatagatatacatgtggtttcttggtcctgtacaggttctgaccaatgggaggttcaagagcgtgaagcacagggtggtggccaacagcctaaagtctagggtttccttcatctactttggagggccaccgttagcacagaggattgcaccattgccacagctgctgggggagggagagcagagcctgtacaaggagttcacatgggatgagtacaagaaggctgcctacaaatcaaggcttggagacaacaggctggcccagtttgagaagaagtagctagctagatgcctagcaacagaactggccggtcaagcaacaacgactttactgcatggcagctagctaccttagctatgtctcacgcacacgtacggtacaccatgaccacgagaagatgaagctgcttaagagagaaaaagaaaagaaaataaaaacaggaagaagataataacttcaagatgcacaatgtacagccaggttggatggatagctagatttttctcgtgtggctaatcaccgtgtgtggtgaggtgggctcctttcctgtttcggaatactgatcgatggatgaacagcctccaatagttaatgttaaccaaatatagcacaacaaaggggttcttttcttcctttggttgtttcttttttcctcttgcctttgattttctcgtcatgctttctgagcattaattatgtgtgcgtgtatttcggtatacgtaacgtacttttacctatgtgtgtatagtacgtggcttgtgttaacaagtaaatattatagtctctctctttcgttatgcaactgacttctgcgcggtccaaatgcattgatggagatatatctattggtgtacaatgtcaccttcaagattaatgaattttcatcactcaggatatccctttattattacatgtcatctaaatagttatcaaaaaattactaaaatagattaatatgaaatatatcactccactaacatgcaagaccaaatttgatttgtacaagttacaataaaaagaacaagttaaactgaaaatagttaccgtacattcacatatatatttgttatttttgttgtaacttgtgagagaaaacctagattggatgaacgccgtgcgtgcaactgaacaataacaaacttaccagccatcttaatccgtttgcatatgtgataagttcaaagtagtttagctaatctaacactgcccctcaatctaaacatcttatattaagataacaacttgtagaagttaaattttaacttacatatttgtatagtgatatatttcatattaatctatcttgtcttttttttaatttttttaagactatttaggtgacatgcacgaaacgagttaatatcccctccatggatgaaatcatttcccagatttcaagggcttcattcttatcaaattttgttttgctttttttcccctatcctgcttggtgcaagtgcatcgatcagctaatttctaggattctccatcggagcctagtagcttttatcttctctaactgtcgtgcgtgcaactgaacatgaggtgcataggagtcgtcttgagcaatttatggttatcttgtggtattctcttgttcaccaccacaatagacgttgtccgggtcccccatgcatgcgtccttttaagttgaatcaaatttttgcatcctccctcccttaatctccaaccatgagctatataacacccacactttggaattaaaaaatgattttcaacttacatctcgtgcattttatggttgtcttatgggaaaacaatcaattttgcatgcacctaagtagtagatatctacccaccttccacactgttggatgtggcctatatataaatgtctttacgtacacacataggagcataagtatgatatatcacaggttcatactaagagcaagtttaatgcatagtatagccaactactagctccaaaatcatctatagccaatgtaatagtcaatttatacaatagttgcttactacaaaattaatacagatctgtagccgttgttcttctctctcttcttttatctctttaaaatatatttatagctggcttatagtctgttattgtacatgctctaatactacacccctcatcactcgctaagtaccagcttaagagggccggtcaagatcgaaaaggccagcatgggaacaaaaactgaatttaaccgccattgtttcattttctagcacatgagtgactgatgatatgtattacagcatgtttctagttgactagttgactacttcctccgtttcatattataagactttagaaagtcttataatatgaaacggaggaagtagacaacaaacagaagcggatttgtggtaattacctcgtgtttgaccacaatatataaaaacaaaataaaaaactactttatccatccctaaaagactataatttcagcataagtatttgtctcacaaaaactgtatttttagagtaggcctactagctagatatttttaatatatttttttctcgttttagctatcgaagtagtagtacttcctccttaattagcgttttctctccatattatcgaaggatataagttttttaacctcctagtacttaatttgtagttgactaactatagtcttcaggatggaggaagttattaatgagtacctttacggtgatcttattatcaataaaaataatgttaatttatgagttctactataagtataaaatatcaggaattgaggtgatagatatatatgatctatcaaattagaaaatatagatggcccagattgattctagtgtcacgatccattactggagaactgatctttcgtgggtcggccaaaaatcacattagcctctaaacttttttttgtcccagttaaaaagcacaacaccactttataatctttaccaaccgggactaaaaatcatttttagttccggttcaaaaagcgtctggcccctactatctttagtcccgattggtattaaaaatcaacgtgtcatatgtaatgccttgcacttatcctctcatcctcgatcgcaaactcctcctcatctttaacttcctctcatcccttcctcctctctcttctctctcttatgctctccttttcttgcagtagcagcagcgaggagcgagcgaaggcgatggcggtggcggcccgtgcggccgtgttgccgacgctggcacaggtggcgaagcgggaggggaggtacttggcacgggtgatatgtttgtctgtaaatttattgatttgtgatgtctttagatctgtaaatttgtgatgtctatttgagtatattcattcaatctgtgaatttgtggatgactttgtgatgtttctatgaacgtggataatttaattgttgagtttggttcaaaaccaatatgcaaacatcaaaaacaaatgacaagaaaaagaaaaaaaatagacacggttggtaacatcatccgggactaaatatcgatatctttagtcccagattcgtggtcccaatttacaaccgagattaaaggggttacaaaccgaaactattatgggtttctccagcagtgaccattataaaacctctctagtgataatgcctttttggatgggccctactccctccacccaaggcatgatagttgcatctttcactaatgctcgtcctttcaaaccaccctccgttgctatactcttcatttgtgcagcagcagaaacgatatatggctgaggaagaaaggccattgaagacaaccgtaccaccagcacgagcaggagccatccagctaggttaccattcgcgtagtaaaggcggcgccagcggactgtacgacccgcaatccagcctccgcggaccacggggaataaaagaagagagggcaaaagctgtgtcaaacagggtggactgcgtgcctgcggtgcggtgggcagcgacgctcgaattgagccggtctctcgcgtggctgaccgcttgatgccctgagcgcagcgcaacgcatgcagggctgtggtggtggccactagctgggcactgcggctggaccgctggatgtgccgcctagatgccgatactgctgctgctaccgcgcgctagccagccagctagtacactggtatgtttttgttgtcaaaggctctgtgagattagtggcggatccagaaaatcgattcgttagtgtcagaacatgtctatccgtgttatagtatgctaattattcttagatcatggtgttatagcatgtggataaacagtttcgctataggttttgttaaaagttgtcggtgtcgcttgacaccggcccttctactgtagatccgcctctggtgaggacgccaggagcccaacgaggatgcaatcaatccgcgagcagcccaccgtatttgcaacgcacgcattataacgctgtatacatgcaccgtcgtggtcgtggtggcagtaatacggtcggggcctgcacgcatgcacgaggtagttcgagcattagccaaacatcagatcgatcgagagtggcgtgcattggatgcatgcgtgtacggacgacagcctctggccatcgcccgtactgctggcagtctgttgctagctgttttgaacggatgaatgctgttgctagccgatcgacctgtgtatgttttccgttccctctcgcgtggagttctggatttggcggggccaccggccggcggccggggaccaattgtgccacgccgcgcccgctaatagctactgacgcgtgtgctaccggtggctcggttgggggccggagtagatcgatggatccgtgattgatgaggccctgttccgaactcctttccagcaaagaggggggctttggataatctcctcacacggccgctagtatctggcattactgatgacaattgtaacattaactgcctctctgtactgtattgcaccggtcagttacattgatcgatattattgcgaacctcactatcgcgctgacgggcgaacgatcgagatcagatcgtgctgtactgttgataatctcactagatgacctaacggctggaagcctggaactatatagctatagctagcatcgctctagctaggtcagctggtcctatgcccgccccaaacgggcacatgcatgcaaggttaggactttggttaggaggaattaaatcatgcatcagagcaacgtacgtcctgcatatatcatatcgagtgcccaggctttacgagttctgtagcctggagtcttgtggaccctatatactgtagctagctaagctaacctatcatagtaatcaatggatatatgcgattttgcgaactgcatatatcctatggcgagtcgcgcgctagcttgctctagcacgcgacggtgcggcgccaccagttttaattttctcccaaccacgcgcgtaacgtacgtcgtcgttctagttttgaccctagtgcgaattctctctttcacgtcaggacaccagctagccaccatgaccatgccatgtttgtgtcactgtgtgtctacgtcaaagagtcatgcagcggctactgtgctcgtacctggccgagagagcatgcacgtacgcacgtcggatatccacacgtatatatatccaacgtgcgagagcgtgtgaccgatgtagccgggacgtcgatcgattggcaagttaacaacgacgacgacgcagagatatcgatctatcgacggcgatattgtctcgccggccggagacgatcgccggcgagcgctagctacgtacgttacagctagcgtaggtggccgcacacgtgtttttgggcagtgccgcagttgatgtgccgcctgcaggctacaggctgcgttaatttccgatggcacgttgcacggacgcgtgtacggtggataacgcagtgcatgcatgcgacgcgagcgaagtgctcgtgcaccagcatgtcagagcggccctgggcccgggcgaggccacgaacaggttggctaattgggccctgcatgctgaagtggctcaggctttgggcctatcaacgcatccaaaggccggtccagcgttaacgttgcaccagaaaatcgatcgagctgctggatccagcaaagcagagagaccggaccagctttcctcgatgattgtgtttattatgaacctggcacactggcaaagccagagagatcttgttctttccccctggacgggatcgccaaagctggaacggaaagtgagaacagaacggctccccttctccatcattcccgtcctgtcccgtgttaaggttcatgcaccagtgatcaccaccagtcggagacgctaaaccagtaaccacgacacaaccggcagtgcagtttcggctgcttgtgttgccttgtcagctggggtccctgctgcataggtgcactgcattgtggaattgcctttctatctgctactataccccaataattctcgagaacgaactcgtcagaaatgagtagtaccttttgtttcaccagatacattctctgaacatattaaaaaaaaatcgacacgttcttgcaagaaggctgcgtcgccaaaagctcgagagcttgcggtgtggcaacttgctgctggggacagcgagcagaattgcgaccagttaatccagatctggggcaagcagagaatattttgttttaattattacggaggacccctaaaaacctcactgaactgacaggacagctagcggaggaacgtgcggcataaaatatgtgtattttgcttatgagattgagatcccggccaggtcacatgtgaatcagaattcagaatgcatgtggtagaagaacaatggtgtcatactgggattagctcggtgacgcagcgtggtttgggtg

SEQ ID NO: 45737 - DNA, 1426 bp, Oryza sativa
attgggggcactggttagtggcttgctgctcgcaacgcgtgttggggcggtggggtttggttgaaggaaggaaagggattagggttgatgggaaatagggtgttgagtttttatatgtcaatttgaaatgggcttgctggacttgtattgttgcaatgggctatttttaaagaggtaactcacatctggggtcacttcgggtcacccacgggtttacttccgatcctcgccctggcccggaaatttacgggccccgtccccactcacccgtgggtgagaattctcccccggccctggccccgtaggggcggctccccagccccaacaggaaaaatgccacccctatgtatccgctttgaccaaaccatatgttagagtggccacctcccccttaaactttaactacagcatctggactagtatagtcccaagcgtattatggttattttgtaaattctctcgttgagttggcaaaaacaataaaatattgtaggcggggccttaaaaaagtaacaaaaaatcacatttttaaatgcctatgagcgacgaggccacgttttttcctctccaacaaagaccgtatttttggaatatcttctgataaattttttaatttatgtaaattagtatgcaatgcaactatacaattttctaaaggtggaaaacaactaactacatgcatagcatatgttggacatgttcgactgacctatacaattctcactgccaccttattgctagctgctacaaaaagtgaattggtgcagacaacggggtaacactatactacctccgtcaggttataagactttctagcattgcccaaattcatattcattaacatatatatgaatgtgagcaatgctagaaagtcttataatatgaaacggatgaagtattagatagccgaacaagtccactacccatatataaactagtatagaggaagtagtagactacttgaacataaaagccatgttcagccggaggacccaaagttgccgatggaccacaacattgtactttgatttcatgattaattttaggccggtcattgctcgtgtccttgttctacgcctacgttagctgtctaaaaaacctacactgccaacgatttttaaagaattaatcaactccatgtataatttgtgaattgtgggcaggtttgcatcgctggtccagcagctttgaacacaagcacggagacgcaattctggcatcctgcggggaggaaaatgcagcggcggtgcagtactctccccggatccgcatccagatcctcccccgatctcgatggcatctggacaaaactcccgcgggccccaccaactgatgccggccccaccaactgatctcccactgtgtaccagtcgctgtgcccgctagctcccccagtctccggggagaccgaccgtgcgagatcgcg

SEQ ID NO: 45738 - DNA, 4224 bp, Oryza sativa
ctgtttcctcattcttatttcacaggatttcaaggggttctgggagtccagattcgggggcaagaaggagcaggagccggagcagaacgggcacgccaatggggtggcgaacgggagcgtcaggaagaggacgtccgatttggcggtctacgagcagttcgagcagcaggtatttccgtgcgttagcgatcctcttttggtatggaatggtttgcgtgcatgcaggtgttcttggacaggcgtctcgtctcttgtgtagtccttgatcctcgatcggtgttgctgtttcaggccaggcagacggaggtgcgcgccgcggcgattcgcgatgggaatgctgatgcgatgtgaggactcttttcagttcattgttttctcttttttcctgatggaatctcgaagcaatgcatgtgtgatagagcatctggctggggattgcttattagattagatctgaacttttaggtttgaattagcctcgtttttgtaagaaagggattttgattcgctgaaaattcagagagatctaaccatcgtactactttggactggaatatgtaaccattggcacttcatacagacaagatgttaagttccttgaatcatggatgtgtgatcctgttcttcaaaggagtagcatcagaggaaccttagagctagaaaaaggttgtgtaaggaaaaatccctgctgatgaacattggtgaaattatcctggaaagataccaagctgataatttggtttggacttgtggcttaagcattatatctcaccctgctgatgaaggctagattaaattgaattagggcgtgcaggctttcttctgccttgtcaaaagcctatacaagattgacatgcagtttatttgttaaaggaaatagcatcaatcatctttaaatatgcttaaagtagcacacaacaaagtggcaaactaacatatgaaaaatcatagatactaacactctaaagtctcggtgattcattactggcatttcaagacacttattcctgaaataatgcttttctcatggccaactttgatttattaagacattaactcaataaaattatgctctcaaacattacgattttggagttttcttttgcagccagaagcccctcctaccttcgtttgagtcagctgaaatgcgtaatcttgcagagacattgttgcggtaattcaagattcacaaactttcgaaaaataggaaagcacaaatttggccattgactatatattcttgccttcatctttcagggacattattcgcggcagtccagatgtgaaatgggaaagcatcaaaggactggagaatgccaaacgccttctaaaagaggcagttgtcatgcccataaagtatcccaagtaagttagctgtttcatgtttattggaatagaaggacatggtctcatactgtaatttacagctgtacaataattcagcctttcactagcggtagactggtggtatccagtatttagaggccagttatctagctctatattgcaaatgtacaaaatatgttttgtgtgacatacagataatcaatcaatctatcagttattcataatcatattttggactatttcagatacttcactggtctcttgtcaccatggaaaggcattttactttttggtcccccaggaactgggaaggtttgtatatgcgcttgattgatatgttacttctgctaattggtcgagtacatctatggagtatagcaatactttcttaccttttcctatatttgaatgcaacctcttaagtaggtgtccctaactacttatctagtttataaagtacaataacatataaccttaactccttaagatgtttaacctaatagcgtatgacctaaggatttgtgaaccgacaaactcatttaatgattggcaagctacctctaacaactgacattcaccactggcgatggggtaatttttttttttatgaacatacatcgttattttgtcatgctatatttgcattgtgagtactttgaaattttctgattttgcaatatctctgtctattactatatacttcggtagtcagtttcaagcaattcctatttgcagacaatgctggcaaaggctgttgctactgagtgtaaaactacattcttcaacatttcagcatcatcaattgttagcaaatggcgtggtatgtttctttgaacacctggtcctgaccccatctttcttttattgcacagaaaacaagttgtttttagctattcttttttgtagagttgtcctagttgttctctctttgaccatttagtttctatgttcgctgatagtgataagagggcaagaggcagtagttaattagtgagttcttgttgtcatcctctttttcatcaaagacacagacatcctggtcgttgttgaaagttttttcctcctgtgctcccacacaattattttgatcaatctaattcaatcatggaacttaaaacttttgatcaatagaagtatttaaatatttaattttaatgttggtatttttctgtgtgcgcgctaatgcaggggattcagagaagctagttaaagttctgtttgagcttgctagacatcatgcaccatcgacaatatttcttgatgaaattgatgctattatcagccaacgtggtgaagctcgcagtgagcatgaagctagtcgacgcttgaagactgagctactcattcaggtttctgcttgtttgaacatatcaaaattaagcttgctagtgtagcactccaagtcacggtttcctacttcataatctttcagcttgaaactgtcccaactcccaacaaacaatacgtcagatttcaaagtttctatatttctgtcaatgtttactgcagatggatggcttgacaaagacgaacgacttggtatttgtacttgcagcaacaaatttaccttgggaactggacgcagctatgctccgccggcttgagaaacgggtacattttttttacattccggtactatagtccaataagtaggggcgggattaaatttgtaaatcttctttgtaatagtcatttgagctttgccttggatggattttcttttcttggtgcatactttagcctaaagaaacttattttaggacatttgataatgctcactaaacatttgaaaattttgttgtaaccttggtgcctttggtcgtcagattctcgtacctcttcctgaggctgaagcaaggcatgctatgtttgaggaacttttgccatcaactacctcaaagctagaggttccatatgatactttagttgagaagactgaagggtactctggttcagatatccgtcttgtgtgcaaagaagctgccatgcaaccactaagacgtcttatgtcagttcttgaagccagagatgagctggtgcctgaggaaggttagttttggttcttttctcagtgatgctatttttttttctgatgaaattataccactgaactgaaaaaaaattcatgctattgttacacatttttatgtgataccttttctcttgggttgcagaattgcccgaggttggtcctctcaaacctgaagacatcgaagttgctttgaggaacacaaggccgtctgcgcatctccatgcacatcgctatgagaagtttaaccaggattacggaagccagatccttagtcaggagcaagcctgaacttctcaaagttcagacataccattttcaggacgcaacattttttctgcagcagtttaagttgtgaggcgaacgttacaaacggatgttgctgctgcagcagttatgaaataaatagcatcatgaatatcgaacgcaattgcctccttttatatgtgctccgcatcgtcgaagcagaaggctggatcctatgctgccagttttcctttgcaccggctaataccactagtatggtacgaccaacgtccacatgatccatcccatttataacggacgaccagcgatggagcgcgcaaacaacatgacatcgcaaaagcggccattggcacataatcattccattaaaggctgatcacacgcagaagtgataatatcacacgagaagatgttttcttcacaaatgaacaggcccggcgtgaccgatttccagttcgttacatgcaaaataagataaccaagtgcattcaatcacaacgaactggctcagcagagccaacgcttcgggcaaactcaaggtaatcccctcactgaatcggcggtcttcccagaccttgcat

SEQ ID NO: 45739 - DNA, 12109 bp, Oryza sativa
  unsure (1)..(12109): unsure at all n locations
ccttctccttagccatgcttggcttgaactgtcagcaaattaaagttagcacatctatatatcattatcagtaccataaccaattattttaggagccaaacaaattctacatgtaggtgttatccaacttgcccagacagactattgaaatgaccaattttattttcaaaagaaaaactgaacaaagtaacttggagcaatgattgaccaatgaccagcagaaatagtgcaagacaagtggatacagaaacttcaaacaattggtcagcaatgagattatcggtttaatcattgcacaaaagcacgaataatactgaagtgccataacataaagttaattatgttagttgtgattgagaacatacgagcatatgatttatcatggcaacagaaggatcaagggtaaattagcatagtgagctttcagtgcttcctcattgatatacatgtacgtaagtacataaaatgccacatggagaactaactcaattcacgaatgtacactctggtcaccagttggcatcaccgctaccataaattatttacactggagaatccaatatttttggaagtatgttctttggtgttcaggttaagaaaatgcattaaagcaacaatcattgtgcattagaacaaaaacaaataaatagcttggcatatcaactagacaattaccttatcctccttgaaatgcaagtctaaccagttgcctttggaagctttgtaaagcgtcacaataatctttgtaggcttgactaaaaccttgcatttctcaggaacaatttctttgtgcagcttaggtatggcacatcggtagttcttgcccttcacatcatggaattttgtatctactgacataggcttaaaagtagtctccaccttatcttgctcaacaccctccaggaaaacataaatctgaagatggacaaagctagattattatctcaatgctcataaagtctccacatgcaaatgccacaggatttgattaataaacagcataaactttacatatgcacttatcatattttcgtcatcttcactagccctaaatgaagctaatgatccacaagatactgactgacatctcattaagtaaagcaggatacatcacattattgtgcttccaagtttaacaacagagaatttcctcctcatcaatcactattaatacatgaaaaccatgaaacacaatatggtcaagaattattatgcctacaaaatatcatattattgtacttgccagaaatatatttgatatacgacataaattgaatttaagctcaattgaacggagcataggaaaatagtttttgctaacatgaaattcttaaagtttttttaaaaaaatatataattgcaccttagcgttagcatgggcatattactagacactattaatatatgagagccatgaactaatgtctacgtaacacaaaatgaccaaaacaatcctaaggtcttgttcggttaatccctctttcaagaggattgaaggggatttgatggggaataattccagacctattgagatgtggaattaacctcgttcaaatccttccaatccctttctcctaggattaacgaaacaagccctaaaaatagaagaattacggaagtttgtatcactgagttttctcgtagttgataacatggcaagcatatgctcacctatatagtttaacaatcttattcaaggtacatataaacaaaacactaagaagttttacgttttttatttcacttcataaaatcaaatcatcattaaacatccaagatcgtcgatctcttctgtatttgcaattctgcatacagaatacttatatcgtttcactatcctctactcccttcgtcccaaaaaaaggcagaccctaagtttccgtaccaacgtttgactatccgtcttatatgaattttttttataattaatattttcattgttgttagatgataaaatatgattaatactttatgcgtgacttatattttttatgcgtgacttatatttttaattttgttcataattttttcgaaaaagacggacagccaagcgttggacacggaaaccaaggtttgtcttttttttgggacggagagagtactagtcaatgcaatcattctgctaattgattccacatatacaacaggaatccctaatcaaacattgcaacttctaacatatcaaatgtcccgcaaatttacaagagcttaaattccaacattaactagatcatactagcaatcacaaccatcgatccatcattgttaagcatatgccaaccatcgaacgagcaaaatgtttcattctccaaagcaacatacctttatcttctcagcatcctgatcccagctgaacgaccccaacgtcacgtagctcaccccagcagcagcagcaggtgccggtgccgccgccgccgccactacaggtggcgatcccgccgcgacggcctgcggtgcctgcggctcggtcgctttcgccagctatccgcacacaaagacaaacgtcaggaattccgaatccatacgcaccacccaagccccgaaacgaatcggcgaagaagatcgcgagagtgaaaaaaaaaagaaagaaaaaaggaaatgaaacaaccttggcatcgacggcgcggatctcgttggcgagggcggagaggacgcggggccgcttggcgaggccctccagccgccgcagctcctccaggtccagccgcagctcgtccgccgacatctctggaagcttagctttcctctctcctctctctctctctccgtcgcctctcgtgtctttccggtggtgggatatgaagggtttaggtcggaagtggaagggaggagaacgttctagaggaatggagatgcagcgacgattccgtggaggcgtcgagaacgaggggcgggccggcggcccgaaccgttgggcctcacccgagtcatgcccaggagagaagatattgagccttgaaaatccggcccatcaaattgaaactgttttgggggttatttttctcgcttttccaaattttcatggtccgttcaaaattcaaattcctgatctactactacttcaggaattttcagaggccgttcgctgtatggatggatggcatcttcacttgcttttaacggtgaccaattgcaaccactacaccaatagtcttccagtacgagtgtgtaggacgcgcaatgcacactcgcccctacatgtcgcgaacacgtaccggctcgctagctagcgacctagcgtgcaaattaatgttgggctccagcaagaagaagcaaaggaagatgcaaatgccatccatctgtacgtgccgtcgtggcgacgcagccgacccccaacaccgcgcgatccacagttcagcacttgaatgttgcggccttgcatgatatgcggagcaacagactaaagggtgtgtttggttcacggttaaggctggatgggatatgacgatccatattttgttggatatggcgatccagtttttttggttgagagaatatagtgatctagttttttgtttggttgtagggataaagatggatttggtaatccaattttttgtttgattggagggagtaggatgaatttgtaggtgtggtcacttctcacttgagatggtgagtataacccccatcaaattaatacacaatacaaatcataaaatttccacaaattttcacttctatctccattataaatacacatagaaaaaaaaagagggaaaaaagccggctagatctgggcctctcgggggctcgccgccgccgccgcctcctcctcagctttcttggccgcctccgcggcttcaccaacctgcttcttgagctcggcattgtcggccgtgagtatggcgacctccatgtccttcgccatcagcttggcctttagttccgcgacctccgggttctccttctcgccggagtcaatggccgttgcgtcaatgctctcctcttcgatcatcttctttgtctcttcctcctccagttccttctcagccaaagcggcctttatgccacagctcacctcctcgccgtcctcggcgccggccgcgctctggttctccttatcccccgattcggtccggacgacctcgaacacatccgtcgcgggggagtttatgctgctctcctcctcggccggcggctccgtcaccttcagctgctgctcagtcttcttgggggtttcgaccgcaaccggagatggggagcgcggagacgccgcggcggcggaagcggggctccccttggtgccaacgcgcttcttagcctcctcgagcgcgacctgcgcgtccttcttggcggcctcggcggtggcgagctgctcccgcagcttcttgagctcgtcctgcaccttgcccagcttcgtctccagctcagccacccgcgtccccgcgcgcttcttctgtaaacccaccaataaccgccaaaagcgattgagccgctgctccttggcctcaccgggaaaactgaaaacggaaggagaagcttcgcagcttattacttacctcatgcagcgggctgcgcggcgagtggcggtcggcgagcttggggctgctccggtcgacgactgtacggtggtgcgcgccattcgcatccgagcaggccgtcgtcttgaggtgcagcggcgcccgcggcgacgctcgctgcggcagctcggaccccctgcaatcatcaaccgcgtcagaaatgggaacacctcgacggggaaaccacctcgctatcgcaggtcacgcacctggatctcggcatgctccgccgcgagctagctaagccggcagccggcgctggttgctctgtccgtccgcccggccgcccctggtctctatcctctcgccgcgtccgtcggtcgcggcctacgatgagagcaaacgcggggaagactggctcatggaaaatgcaggcgaatgtggcgctgcgcaggtagcggcgaaaagaaaaggagccctcgtgcaagggaaaacggaattgtttgcgtattaataaatcgtggcaccgcctcccacgaggccaccgcaccggtgatttcaaatttgaacgcagctggaacgccttgggaacgccacgccacgcaccgcacacccagccgaacgttacgtgggtctctctggttttctggttggtggcgcaccggctgcacgggcgttaatgcgcggggtgacgcgcagagccggacctggaagagccgtgggacgacgcggggcgagcggtagcctgtgcgcggagccggcgccgtcgccggggttgtgagccacacccacatgggtcatggcgggtggccaacttgcaggcactgaccgtctcggcagagggcaggatgacgagccagccggcgttgatcggctcagggatcgctgccgctgctgctcgaaaagcgcatcgcttgtacgggtacgtgacagggagatgctttggctttgcgtgaccgtttggctgcttgccaagggggggggggggggngggggggacagtgcaagccaacanctcntggacaaacggggctgtaccccaaaaggacaagcgggggctggaggtcaaggacaaacaattgaaatcgtagtacagtctacaagagggggggggggggtttcattttcatcgtgacggggttaatacacgtagtagtagtaacagctacgacaagtgaggcgtactccacttttgaagcaatcaggcggcaatcacagggctctgatntgctttgcctttgcatgcaccattagtaagctcacatgcttcaggccctctccactacactcgctttcgaggtggtttgtactgaacttttgagctctactaactacagtagtttactgtgtgtgcttctgatgattgttgaatgtcccctatcaactttatctcacatgtagcttttctgcaatcctttctttttacaattctccaacgaatactactccctccggttccatattaattgatgttttggacaagattgagatcaaatttttataactttgaccatcaataactttaaaaatatttagtttaaagaaactagaacaacatatatagatttgtcttttatagcactataataaaagtaaacatgcatttatttatctattatataattaaagaaaaaaaaaaggagcatccacgttcgctgtcatggcctagaaattctcacattaatcggagaaaaagaaaaaaacaaagtccatatagaaatacaatttagaaatagctgaaattcggaattaaaaaataagaaatattagaagaggtgactagagtccatatagaaatacactttagaaatagctgaaattcggaattaaaaaataaggaatattagaagaggagactagagtccatatagaaatacaatttagaaatagctgaaattcggaattaaaaaacaaggaatattataagaggagactagagtccatatagaaatacaatttagaaatagctgaaacttggaattaaaaataaagaatattagaagtagagtatagagtccatatataaatacaattaggaaataaccgaaattcggaattaaaaataagaaatattagaagtagagtatagagtccatatagaaatacaattaagaaaaaatagaaatttggaattaaaaaataaggaatattagaagtatagtatagagttcatattggaatttaataccaactaaaattcgaaataaaaaggagcctccacgttcgctctcatggcctagaaattcttacattaatcagagaaaaagaaaaaacagagtccatacagaaatacaatttataaatagctaaaattcagaattaaaaaataaggaatattagaatatgagagtagagtagttattacacatagtagttttgaaaagttattgcaaaatttaaaattatgttgtcattgtaatatattttataataatataatgagaaaacatatatgctattatatgagagaaaatataattatgctagccgcgcaatctgcgcgagccaccatgctagttatatatattatagtagaaaaataaagtcaaacatatatcttgtaggccatatcattgtccaaaacgtcaattaaaatggaaccggagggagtacagttctagggaaaccgacaagaaagagaaaagggcaatgctagaattgccgcaggacaactagtaatggacacaaatgaaggaatttggatggctcaagccgcacaagcgaatgggcagcaattgggaaatcaatgtactaggccggaccgccattgctcgcaaggaaggttgtcgacgcgcaatcggcaataggtatggtatttatagactaataatctataaactggagtagtttttaagtaggctgcgagggaagttgaattgctagtgtagaaatatcgggcacgcacaaaaagtcgtcaagagaaatcagatgcccgaattgatcgatcgatgcggcagaagatagatctcgtggcaaagtcagatggagcagctgaacgaatgctacttcatacctagctaactgatgtgcgcgatgttaccagcatatctatagcttattagggcatgttaaatgcgtgaccctagagagagtatccctagcgatggccgtttgcttttccgtccacgtcgtccccccacgatggaacgcggctctctctgcgcctcgccaacttttttgtggggagtcgcagccaggcgccgcgttgagcgcatgtggagctcgtgggcatggcgtcgttcccccaagtttccccttgcaccctcgcctcactctcgctctctcctcagtcttgtcgcaccgcgcctccttctccgcttcgtgcgtccgccggcgctggggtcagaacgaggagctgcggggcggaggggttggcgccacgcccgacaccgttggcatcgccaccatttccatcccgatctagccgcgggagggccaaatccgctagcgttggcaccggatttgccgcccccggccggcgacggcgcgaggcggaggaggccggggaggatgacaacgatagagagaggcagagagagcggtggagctagtccgccgtcagtcaaccgccgttcgttgtcggccaccccgcgtgccgcttgccgtccgccaccgcacccggcaccggcgaggtggacggcaacgagctgcggggaagagagggggagatcgacgacgaacggtggcaggagagagagagagagggcgtggaagaggcagacggatctggtgaagcgggatctggtgaagcgcggttaggtggacggcgacgagcggcggtgggccaacgacagcgtggaggagagagggagaaatcggcggagtggaggagaggagacgagaagagacgaggagaggggaggaagaaaagaggagcgcgttggtgggcagggaggggtactttcggaattttgtacttggggctaccttggactagacacccattgtgggctgaagtatcttcgtcaaatggcctcagattttaaagaacccattaggagtatccttcattgggaggtgagtttcctatagagtgtcctcggttagtgaggacactttaatggtggttttgattgtacatgcccttatgcttactctgagctggtgttggaatacgtctcctatgcaaacgagcatatcttgtacatgataacacgaaggtcttccgagttttagaaactcagagggtgtttgagccatctctccaaaaaaaataagtccctagcctccctcccaaacactctcagatagcagtatctcgaaaggcaaacatgactatttttactgtaaaaggttccttttttctcaacagccaagactaaattccaacaggctgcaaaatatggatgctctagtaggagtaaataaaagatggacaacgtcatacacgtacatgatgtactgaagtcaagagatcgatccatatcttgtggccggctgcgacatcacctgctcacctacatgcgcatagatccaagcggaaataccataaatgatcacgacaggtcacacacctactccaacttggaacacatataacacgaagtatgggcgacgagatcgatcacacaaaggaaacaagacgcgcactgcacacatgaatgatcaggtcatcaggacatccgctcccccacacaactacgactgtgttttcagcgcaaagtttaaattttggttaaaattggagatgatgtgactgaaaaattgtgtgtgtatgacaggttgatgtgatgaaaaaggactatagtttagattcaaaatctaaacacagcctacacaagcgagtactaccatataccctggaccggaagtagagtaccaagaaaaaacaacgcgtatgtatgtgcaaggacgcataaactgtggggcttgaggacaaacgagaaagagggggggaagggtgaggaggagataaaggtgccaaaaaaagctctcttgttggaatgcacgtcaagccatggaacatggcgaggcacggcgagatcagtgagataatgagatgtccatggaaggtcgtgtgcgtggcgtggatgcttgcgctcatgtgcggtttggttcctttgctgtcactacagcggtcttctcgttcctagtttctgctgctgcttctttcgtctcgaggaaactaaactattccattggaattggcttgttccatttgcaggtgatcgaaaacgcatggaagggctgcagctgcactgcctcgcggaaggcaaggcgcatggtgtaggcaggggtcgcctgcgcgagctttgtggaaggctgtgactgagtgagagcaatttggttataatccctccagttaacaatatttgagttgggagtatcaagtttagccacgtcaattattatcgaatagagagagcgacagagaggagggccttaataagatttattttccggatcttcatggtttgaaagttgaaatatcaatggcatcatgatctaaggttgtattccttggtgccagttaggagtcttggaaaataaattaatataaatttttaagcaactttcttaaagaaacttttgaaaaaaaaacacacaatttagtagtttgaaaaatgtgcacacgaaaaacgaggattgggaacaaggggtgccgaatatagcctaagtcggttgaaaacgttctgcatcgtatatatcttgttgggccaattgatatttataaattttcagactatccatctacccattgataaattaatagatacaccctctaaaaataatacgacttttcanacatccaaacatctgatagctgcaagattcatggacacccataaaccctagttccacccccctctcnttcctngttcccttctcactccaagcaccgtcatgcgcgataccagacaccatcgcgacgcttgagcgctcggtcccgaaaccaccgtcgcctgcctagcctccctagttggtaaaaagacaccaatatcctcccgactcgcctcttcccgatctcctcttgagtcgacggtagtgaggtgccccgcctcactgtcttccccgtctcttattgctccccactaccagatccaccaccaccagccgcctcatcctaactagtcactctgttttgcccccaccatcctcctccatcgcgatagctccatcgatgcatcgcctcactactcgccctagtccaacgtccactgccagtcctccgttgcccacggctatccctctaagccacaaggaaacccctatcttcccccttcctctgccctttcctatttaaccctccaatcccaaaaccccaagtgactgaggttactgccgtcccgtggaagctaccatgacttgtcggagttgaggagaaggagaccaacatgaattatatttttgcgtaaatttaatggtccaaattcgatagaaatactcccctcctaaaaaaagaaaaaaaatcttttgcaaaaaggttaacaattcggcaaaatttaatatggccaaacaaatgtattcagtttcatccattttcatggctaaaattgcaaggaaccagtttcctacgttagagggacgtttaactcacgatctccatcgcttgtgcaccggacaactccagtccgtcctttgtccttcggcccagaaatgcaaagtccagcatgctcgttccgcctatgctccactggggctcgtggcacaaggaagctccagccctcggagctgccactcgacccgtcgtcgtctagccggggtatgcggtgctgccgccggcgagggcggattcctcttgacctcgattttgctgccaaccctaatgttttgatagggcggcactttgaaaattttagtaaggcctggtttagtttctaactttttcttcaaacttctaactttttcatcacatcaaaatttttctacacatacaaatttttaattttttcgtcacatcgtttcaatttcaatcaaacttctaattttaatgtgaactaaacacattctaaggtaggaaaataaaacaagcctttaatttgtttagtctgatgtgcagctaagcaaacattggccctgtttagttccaaagtttttttttccaaacttctaattttctatcacatcaaatctttcatatatacaacttttctatcacatcgtaccaattttaactaaacttccaaactttagtgttaactaacacaaccaaagtaaagtaatgcttgcaaatctgcaatgctgcgcctgccaggccttgctcaacgtaaattggtcagcacgaaactgtcgaagtcctcactcctcagcacctaaatgcaaattgaggagtaatctaataattggaatgcgttagttcagaataataattggagtcagtagtaccaatcaaacgctaggatattacactgtcagtgcaaacatttccacgtggttctcgtactatgacacagaattgcgaaaaacaaatgcactggctgctctgcactttacagaataaaggtaaagctggcgatggcattggaacaggaactaaacagtgggtaaattatgtatcggtagcaaggcacagtggcgccacacagcctcaccgagggctacatggaaacgggttgcctcaagctgtaaaggcctctgacagacggggtcccgtctcccgacccatcccgttcgtttttgcacgctgcagcaagcggccaagcaga

SEQ ID NO: 45740 - DNA, 1499 bp, Oryza sativa
aatttgaatcgggtatataaactttagatgtatagaaacactatatatgaaaaatatttgaattcaaattcaaattcaaatttgaattggatataattcaaattcaaatttgaatcggatatataaactttaggtgtataaactttagatatatagaagtactatatataaaaaatatttgaattcaaattcaaatttgaatcggatatataaacttttggtctctaaactttagatgtgtaaatttgaggtgtataaactttaggtgcataaatttactaaaataggaaagtaatacggtgccaaaaatagaaaccaggtggagggaggagggggggaatttgatcgctctgggcgacgcgctcgctcaataacatttccgcaagctttggcccccgctcatttccacctcgcattctctatactacagttattacaccgtgcgtatcggtcagcgcaccgtcttttacggttttaccggaggtgccgcttccgtggttccgtgccgtgtagtggaggacgtactacccggcctttagagcagtatagccaaatgttactaagtccagatcacttatagctaatctaatagtccatttatataatagttatttataaaaatatactacaccattaatatccgatcccacctctcatacacacaaaacatcttggagtctatgttacacttgactataaatccataacccgtttgcttctctttctcttttcttcacgatatgtggttatagctagcttataagctgctattgtactggctgagtcccggagcaaaggctgttgccttgttggcgtcgggcggtcgggccacgacgcaccgcaccgtccctgccgcgtggtccggggacgccgggccggctgcctccaaggttccaagtccccaacggtgggagtcccgcacgtacgcgttgcggcgatcgcatttcgcccgatgccacgattagatccatcacgccgtcggtggacggaggggcccccgtcggtggttgttcgtcccgccgcgctcgcgcggtgggcatgcgtacgtgggggaggtgaataggtgatgcagtccggccagccgccagcggccatggcggaaaaagcgatggggacagtacgactcggaggggctcctcctccctttcggtcggcgatgtcactttcatatagccatgcgacacgagacaaactggaacgtgcattacaatcttgatcggacgacagaacatcgttcctcagatccaccagttagacgccagcaggaacagcatccaccatatatatccacagagtacaattcgagtgctgaaagttgtagagagaatcaggagtagtaactgggaactgtagactgagagtaatcgttcgactggacgactccactagcatgtgctagtgccttcagttgcgtctgatgatactgcaagtgatcaaggctcatcttcaataccacagcaacattgctgcaacatctgtgaaaagtctcagatttgagc

SEQ ID NO: 45741 - DNA, 7972 bp, Oryza sativa
  unsure (1)..(7972): unsure at all n locations
agcatatcgtgtatagggctacgaggatattgacaccatctgtctcagcaacgaccaaccagttcaaccaacatattaatcacattgcacacagaagcagcacatctgcgctgcacatggtgggaaggcagaatcttcactggtagatctgtgaagccaaaagacgtcaatggtgtcctgcctcaggtccaagatatggtcttcaaaaactaactattatccatagcttatttctgaagcaattgaataaagtcaggccagtccaaagaatattatgagctgttcaatacccggactgccgctgaaaaagaagaagatatgccaagacagtgtttgtcaaattataggatcacaaatccagcaacagcagctgctgcagactgcagtatccaatatccctcgacccaaattaaagcctaactggaaagaagcagaactgcgacagggtagtaatgccggtacaacaagtataagattagctttgttctaccatattgacacataaatctaacaagtagaacgagtgctctaaggaatgatatcataaatcagtacaaggactacaaactccgaggaaactcttgttctagaacaacatggccttgtataacatgctaatcgtgctaattaaatctgtaatgagctaatgttttacatattctacatcttctaatgtggcaatccatgacttcatggcacaaaactgaatctaactagtcagttacttcttatcagttcattgttctaacctgctttgatgaagcaggcatgaataataccaaaggaaagctctgaactacacaaattcaaggtctccacaagctgcttcgtccaatacattcctgtccaggcctgcacttgccgcttcttccaattcactatctacatccatgttttcttcctcttccacttcatctgtgccagcttttctcattggttcttcaatttcgtcttttgggtagacttttactctgatgcgtttgcctttgatgcgtcgatattcccattttggtggtggatatttcttctttaattttacatatttgtccaacatccctaacttctggaatacctcaccaagcattctgataatcgaaccgtcaggtctaacacccagctcctccatatcagcaaagatctggcaaatttacaagaaagacaacaatgattagatctttagaatcttggcaataaataagcaattctaccaatgtttccttgagtataacttctcaacaacaaaaaaggttgggttcagaacatgagcgggagaccaaaaccacatatttagtccaaagttggtgaactaacagttgttttgtcaagtaacacaaatgtgtctctttgtacaaagaatgcaactttgccctcttctgggagtaagttaaagtcatagtaataatggattatgttttctcatccaacatgactacgaaaaggaacaaaaattcctaaaacagttaatacaatagctgcaacaggaactgtgccatccgctgtactgaaatgactattgcttataagcaaggtcctttgggagcaattcaggcttattgcataggctggttgagataggcttcagcctcttggcagaaagtggccttgagcttcatgagaggaccaataacccacgccctgtttggggtagcttaatcttctgggaactttaagctaaagcttatcctccacaaaaaaagggcccaagctaccaagtcaggtcgatatatgaaacacgaaactttcaaaaggatagaatcttcgcacttgacttgataatctatcacaggtgggccatgggcttgtttcaacattatttggaatcagaaattccatacctaccaaattttctttttcttttcataaaatatgcctaccaaattttcatcagtggatatgtgtagcatctgcttctcaataacattcaatagagctattcaattaagatgccatttcgcagtggacctttcgaggaggacctaagatattaaaacacttgcaaaatgataacagtctgaaacatcatcatgttcaagcaaattgtagcatagaaaatgtagtttgtcagtgcagtaagcagcaatgaagactttccattaagcatacaagcaaaggcagcactaaaaaacatggagccaaatgatagtcacatggaagaaataaatccaacccatgaatattatttctaacattgtggctgctgatacataccacaggctaatatcatgagaaacttactaaacgatatccaaatacctagctctctaagattagcacactgttaggttttcctagtccaaatatctctgatcagtacactgttaggtggaaataaaaccagtagaaaaacaaagaaaaaatttaaacaaaattacaacttactatcttaacaatacttatgtgttaggctgttagcagaaaatttttacaagttcacttctgttcctccatgcaagggaaaccatggtccagaattaacataagaagggtgtacattagaacaaaagtataatatatttggattcctacctcaaacatcttctgatatgattctagtctgtaatataaagatatcattctcatgaaaaaggtatgaggcaaaccctccaaatatcgtgagaatatttttccatacagctcttctgcttcctccactcgtccatcctcaatcaaagcattcaacaaagtgtaataacttcccattgtctttccttgacctttgttaaacatccatttaataacctgagtcacaaattctgtagttactacagtgtttcagaaaaaaaaaaggtatattataagggagcagctaattcttgacagtcaacacgacactagaaatatgtagttttcatgcaggagatatttacagtgtatatgcacaagtccagtctgagatttttactgcaattacatgagaggaacacattggacacaataatgaaaccaatgcaacaagacctgaattatccgtttccattccttttcatcttcaagggtcttaagtgccttctttactgctatcaagggaaactccaattcccatgcaacaaatgaatcaagagcaccatatacttcctcctttacattagacaagcctttaacctacaggaaaggacaaaagaacaataatttcaggtactcgaggcatgaataacaccaggtagtctgaatctgttgcagcaaaatccgtcatgcaaaaatgtgaaatgaaacacttgcagtcttttgatgtttggcgcctgctttatcagagagaatacataagctgcttaatgaaaaagaggacaaccacaactatcgcaaactgaagagctgcagcagcgggtgaattctagagtagctattggtaagcaggtgtacgataaaccatataatttagcacctcaccaggaagatgttggatgcaaaagcggatacaaactgcaactgaaattacagcacaggaaagcagaagaacctcacacattcgacaagcttttgagacttggaaacggttccgattctcttgcgagttttccacacacgaggatatcttggcctcgggcccctggcaccacatacctacatcacaatcgtaatcaaaaccatcagtttaactgcagctccagcactatcgcaagaaccacatgcagtacagctgaactgaacttaccactaaagtactgaactttgaaggatgcgtaatggcagccctttccaatccaaaggcgaatgcaggcggcccgcacctcacagaaaacatcgtgtaacctgccgtgacaaacaatcggataaaccttccgcagcagacagtgctggtccgtatacgaaacaggaaaagggatagcgagcaagaactgcgcaaagaattgggaagaaaaagttctagctgtcctctcctcttccccttctcgctcgccccacctgaataggggaatcgaagggacgggagcacatctcaccttgtaagaggggaggagcagttgccgccgtcgctggcctcggtgaatccgtgcgccgcggcggcttcgttctccgcggggcgtagagtccgggaacgggaggagggacgcagccgcacgaccgcaacgcaatctctccgccccactgggcaagataatttcagcgttggatgaaaggtgaggcccactgtcagtggctcaggcctgtaagagtaagatatcagtatcgttttctgtcaaataaagaggaaaagaaaaaaaaaaggaaaaagggaatagggaagcgagggcggagtactgcgctcttctcctttgcctgaggcggctggggtgagggcagctagcgatgcctgtggctaggcctgagcctcangagctccgggtgatcgcccatgtcgacatggattgcttctacgtccaaggtcacctacctacctcctcctctctctcttcccccctcgccgccgtcgccacgactcgacccccaaactcgcggaatgatgcctctgacgtgagggagtgagcgtttattttattttgccgcagttgagcagcggaggaacccggagctcagggggcagccgaccgccgtggtgcagtacaacgactggaaaggcggcgggctgattgccgtcagctacgaggcccggaagttcggcgtgaagaggtgcgatgagagcccgctctctccttctccgcggaggcgatttgatcggctgggttttctgacggatcgattgtatgctcattgttgtggttattcaggtccatgcgtggtgatgaggccaagatggtctgtccaagtatcaatttggttcaggttccggtggcccgtgacaaggccgatcttaatgtttaccgtagtgctggctctgaggttggtctgtgcatcttaattggtacaattgacaatggaaaatgaaggtgcttccatggcattgacagttttgcgtctaaactctcaggttgtcacaatcctctcgaccaaggggaagtgtgagcgagcatccatcgacgaagtttatcttgaccttactgatgcagccaaggaaatgcttttagaatctccaccggagttattggagttgatttttgaggaggccacaaagtcaaatatcctgggccttccttctgtaatatttgttctccacgatttaattgttgtttctctgcaatttgatatgaatgtgaccaatagggcttcatatgtgcaggatgtcagcaacagagaagatagcgtgagggcatggctttgtcgagccgatgctgattaccaggataagttactatcttgtggggctataattgttgcgcaattacgggtcaaggttttggaggaaacccaattcacatgttctgctggtattgctcacaataaggtttatatgcattcctttctttcgattgaagtttggtctcttttactctgtaaacctctcttcctattgcaatcctcacccaagatgttgctgtgttttgtagatgttagcaaaacttgtcagtgggatgcacaaacctgctcagcagacagttgttccatcatcagcagttcaagattttctagtatcactgcccataaagaagatgtaatgagctaatgtgacacctccatctttgctagtttcttggtttctgttggacaaagtttttcaaacatcctatttatctggtctcatggttgtgttgtttgcttaaattatgcaggaagcaacttggtggtaagcttgggagttccttgcaggatgaccttggggtcaatactgttggtgatcttctaagttttacagaggacaaattacaagagtactatggagtaaatacagggtaacctggtgcttgcatttatttttttgctctactgttgtttggttgccctactgattttatctttagtacatgacttaactttagagctgatagaaggctagttttatgcattacaaggaagcatacttcatgcagattttacaactttcggatgtcatgtctagttaataataactcagcttataaccgtttaatctcacgcaggacgtggttatggaagattgcaagaggtattagtggagaagaagttgaggatcgtcttctaccaaagagccatgggtgtggaaagacatttcctggcccaaaagcattaaagaataatgcttctgtaagtacttacactctgtcatttttgtttagggatgcttatagcaaagcatatccaggaagtcttttgatgactatgttcatttggtataagccttgactacttgctttggtccatcaaagtcataagtagtgatataagctcatcactccaatcaacaattgtcatgggcattgggtcgggagtccggcccaatgggaacgatatcctcacccctcacgataagtacgtaactcacttgcatagagtcagggtctgttgggattaggttaaggagttctccatctatataaggaaggatcctattccaggtcagttaggcattagattgagttatctcttagtgccaaccggccctgccttcccggcgcgacgtcgataggactccgtcgcgctgtttaggttcagggacagtgctgttacttcctcttttcatcccaaataatcctagcacgtgacaacaattgatattggaagaatcagatcctcatttagctgtcatttagtgacagtttactgatatatccagtgtctgtgcgccttgattgatcatgtaataatctaatcagataccttctacacctcatttctagagcactaggctggagcctaccctcctacttgagtaccagatgctcctatcaaatactccctccgtcccataatataaggattttgacattttggttgcactgtttgaccactcgtcttattcaaaaaaattcgtgcaaatataaaaaacgaaaatttgtgcttaaagtactttggataataaagtaagtcacaaaaaaaaaataattccaattttttttaataagacgaatggtcaaacaattcaagcaaaatgtcaaaatcccttatattaggggacggagggagtactagtttggctagtggcatgttgttgtgtccattcaattacattaagatatgttgcgagcctaattaaataggtcctttgtattgcctgattcaaatcccacatgtgtttgcacagctccatatatgtatttcctgtgtagtttagagaagtttatgttctaaatattttacaaatgggaatttcatggtcctttaataatatcaggttcatgtttaggttaagacatggctggatcgactttgtgaagaactgagcgaacggattcagtctgatttgaaccagaataagagaattgctcaaacactaactctctatgccagggcatgtaaggtacttggtgcaaattatctttttcccccctaggattgcataaattagctcttagtttctgtaacttaaaatgaatatatagtttatttactgattgctttgctacagaaaaacaagtctgattcaatcaagaaatttccttccaaatcttgtccgttgcgttatgggactgtcaaaattcaagaagatgcaatgaagctatttgaatctgggcttcatgatttcttgggttctcagaacacaaaatggagcataacatctctttctgtttcagcaagcaaaatattcgacataccaattgtatgcatactttaactttatcagtaataagtatatcgatttgctctcatgtttaaataaccaacatccctggagaaataaggatcagagcaaaatgattatcttgtttctttgattgcaatacaccatgcatttattgatattgcattagcttctgctctcaaaagttgagggttatttctgaaattgttatctgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaa

SEQ ID NO: 45742 - DNA, 1174 bp, Oryza sativa
gattcctgacaacaaaataatccttagtcattcttatcagggagaagaaaacaaaaacaaagaatttcagttaaaaaaaaactccaaagaaatgtcatataggaaattgtcgtttccatgatgatgtatgctttttagagccttagtttttagggttttttttttttgaaatttctgtatacttctatagttatattgatatattaccataaatcaagaaagcataaacttaacaatttgcaaggggaatatgaaaactcaatgtaatttgtcttactgatgtaaaatagagccttgttcgaacacgtcgttcaggttccatcacattggcatatctacaacaaaattatttgaatatcaattgtattcttcatagtcaagattcctaactggaatttcgtacttactttggatccaagcagtatttggtttctttgtgcgaatcatcaagatcaattgacttcttgtttgagttaggtctatcaaaaccctcattcttaacatccccatagtaacccctatccttccgttttgaagaaggcactattgttggatcatggcatgcattagattcaccaccagcagcagcaacctctcgtctggtgttatgcaggtcaatcagaatcttgcccaacaaacggcgtgcaatctgaagaaaaggacatgagaaacatcataagttgcttctgctcattctgatcaggggaagatcacaagcaaagctacagatgctgctgctggacctcctgacctgagaacatttgcttatgcaccaacaagatctaccaccagccgttttgatcagagtgaaaacacgcgcaaagctatgtgcactgcggacagccctcctgatattagcacattcgaatataaacccatgaaaagcgccgtcagacgttcagatgggagcaagttttcaggtgcagcactaaaagcagctagacgaacctctcggagctgattctcacaaaattgtggatgcacctgccagcttccttatctgagcatgtttggatttgcgtatgccttctgtctgcgttcatgatctgagttcacagaatcatccagcaacaatgctctcaataaaagtgcattctcattttgccaaagtgcagcactgctggaggtagctgccattcactactactagctgcagggctaatcagttaagact

SEQ ID NO: 45743 - DNA, 5338 bp, Oryza sativa
  unsure (1)..(5338): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgacagggttatttagagatatcttagcaatagggagcgatatattatggactgctagacggaactttttaattgccccttgcgagccttaaaaggggagcaattatgtttcaccaatacctgtaggctttatatgctatcacaccttccatcatgctgaattccacttcatggttttgtgccataggctatagttagttagttaccatctgcaatctgtggtgttgatgaactcccttgaggtattggagtatcatgtgtttaaacctttactgatgggcggcaatttgtaaacatgctcatctttaagtgaatccttgaatttgttaggatgaacgtttcagtttgtttccaaatttagaaatgttatgtgattgcccaacctccgttttggaactatccttcaactagtagtggatactactttgtagagggaatttgagggatgcaatttttccataattatggatataatataacatctatacatgtattaacaatggttttgttaaaaatgacaaacatgactataactagttactactgatgggcagggtggattagtgtcatgctaatgtaaagatgatatcatatcatgattagggaagcatgctcgccaatgcagatagcaaaaaggggacgttcagcagggatggaaggactgaaaggatacatgtccttttgttgggttgggggattgtcagctgatggatataattttgaagatgacgtgactcaaccttggataatacatagagttatcaattgcagttagtgggttccaatcagaagaattgtaggactgatgccatttttcattttgcaatttggcttgttatttgaaattaggagacctttttgcaactactttatcctaattcctagtgtttgaatttgcaggctctattttacgcgtgtgaaattgggaagcccaccaaaagaatattttgtccagattgacactggcagtgacatcttatgggtagcgtgcagcccttgcaccggttgcccatcttcaagtgggctcaatgtgagacatctcattctttgcgctcttatccttatctctatgacatgcatacaacagcattgttatcccttgagatggacttacctatcagttgagattcattctgattggattattactttatatgtttttcagatccagttggagttcttcaatcctgacacttcatcaacatcatccaaaataccatgctcagatgataggtgtacagctgcccttcaaacaagcgaagcagtctgccagacttcagacaacagcccatgtggttacactttcacgtatggtgatggaagtggcacatcaggttattacgtgtctgacacaatgtattttgacactgtcatgggaaatgagcaaactgccaattcttcagcctctattgtttttgggtacagttcccttgaagccctgtatctttctaaattttacattagttaattttaaactgcaatcgacaactaaactgtgctttaaggatagtaagataccattagaaaccttgttagtgatgtggtccatttacatgttgacagtttgttgcacatgtgtgacaaagttggctctttttgctgattgagttggtacaaatgatggacctaatggcaacaaactcccaatgtccttaaaccaacagtcttcttgttacttttgcaagcaaacttcctttcaatatccttaatagtcaatctgaataaagttcttgtcatccctgaaaacagttgccaccagaaaaagttgtcaatatccttaatggtcaacctgaataaaattatatttatattttgctttccatgccattctggagcaaaagaaattcagcatgcttctagactactatcctctggcatgcatgcttcatcctgttaatggccttgttgttatgttaacaaaagcttagccttatgtggatcttttagcagtagaagcctggtgacactttgctgtaaagtttaactgtgcatttttttattttcattaccctaacagtgaactttgttgcttcgcatgatcagtattattcattgtctgatgaatatgttaattcttttgaaacagatgtagcaactcacagtcaggagacttgacaaagacagacagggcagttgatgggatttttgggtttggacagcatcagctgtctgttgtctcacaactgaattctcttggggtatccccaaaggtgttctctcattgcctgaaaggttcagataatggtggtggtattctcgttcttggtgaaattgtcgagccaggattagtctatactccactcgtcccatcacagtgagtctcttactagaattacttattgtataacttcagaattctgctgattttttgtttgtagaaaagttttcaaccaataagtgtatgcacattcattaaccttgcgtgagaggctaacaatattgctgcatgagtaacttgatattcttcctcctaatttctttctatggacgtcagtttatgatttatttttcaatgaaatataggcctcattacaatttgaatctggaaagtatcgttgtcaatggacagaagctgccaattgattcctccttgtttacgacatcaaatacacaaggaacaattgtggactcaggaacaactttagcatatcttgcagatggggcatatgatccatttgttaatgcggtgagcttcatagggcccacttatagttctattttctggaattccccatatatgataagcctacgatagtaattaatcttgttacatgattgttagtcctcatattttgtttttgcagataactgctgcagtctctccatctgtgcgctctcttgtcagcaaggggaaccaatgctttgtaacttccagcaggttagcttcttgtttcagtgaaggaaattagcagctcatgttcttcagtatgtcaaattacttacagatattttcgcttttcaaccagcgttgactcgtcgtttcctaccgtgtcactatattttatgggtggtgttgcaatgacggtgaagccagagaactatcttttgcagcaggcttctattgtaagcctgcattttttttaatatatttggtttctggccttggtaacagttgtatatctgcctaaccgtttctgaaaagacttgttcctgcccatattaataccatatcatgcttttcaggacaacaatgtattgtggtgtattggttggcaaaggaaccagggtcaacaaataaccatactcggaggttagttaactagctctgattgaattagctaattatggttgcacgtctaagtctaacccgcaactactattaagacttgagacaaccatcacatcacaccactgatgtctgaaaaatttcaatgattaacaacattctcaataatcacatcgatgcacattaatctgcaagttctttcaagggtattgaggccttgacagattaatcctacgttttgaccccatatgtttttccttgaccctgaacacttcaatttccataaaaaaaaaacagtcgatctattagtcctatgctgatgattgaagcacacatttctccatgttgatgctttgttgctaactatttggtcccactttgacgcagatctagttttgaaggacaagatttttgtgtatgacttggcgaacatgcgcatgggctggactgactacgactgtaagctcacccgaattttcagattttgtccatggattcatcacgttttccgattcttcttcttcgtcgtcgttgtgacaaacaagtgaacaactaacgaatgcctgtttttctttcttttggtaggttcgacgtcggtgaacgtgacgacgtcgtcggggaagaaccagtacgtgaacacgggccagttcgacgtgaacggagcgtcgccgcggccgccgtacagcggcctggtacctgccgtagcggtcgccgtcgcgctcatttttggcggcttctcacgtagatagcagacgggctaaccgatatcgatctcccgacatgtgacattgtgattccattctttgttggtgcattcaggcgtccggttcccccccacgagcgaatgagcatgacccattcttactgtacatacagatagggaaaaggagaaaaaaaaatgaaatgtcaagagttcattgctcatggagcagcctcttttttgtcgctctcactgtctcacacctacacgttggaagggaaaaatgtcgtgcaatctccatatatcgtagcatatacaaattgatttttgagatttgttcacgttagcattagtaaaaagttataaatcttatatgtccattcttttgtactaccggtagtttctggatttacaccacacgtggaattttcacggtatatttttccgtattgggatgacgatgtaactgtctggttttggtgggcgccgtctctggcggtcagagtggcggggcaggcggctgtcaggatctttgcagtcgactgcaccccacctttatcacttataggtgggtctgaaaattataaattatcgctaaaatttatgtcgggaagtttttgaaatttgatttgaaaatttgaaatttgatatgaaagtattcaatttttagatgaaaagtttgaaatttgagttaaaggtattaaaattcaaatgaaaaattaattttctcgaattagtccgcccccacccccctcccccacacgttggcggaaatcccgttacggcccaaaaccaacggcccgcacgttggcggaaatcctgttacggcccaacttaaatgggctgcaagcccatgggaattccgttccggcctaacacggacaggccgcacgtagctgtaaggaaccccgttagggcccaactaatgttggacactcacaatcgcggatctggaacccactcaggctgtggcctactcgcacggagcaaaacactgtagcacagccgttggatggcgagaccgacggttcggatagatttatggtggggaccgccggaagagaaaaaacgagaggccgtccgccaatttcactcggctccctccctgcaacccctcgcttccgcccttcacttctccccttccaagaaaaaacct

SEQ ID NO: 45744 - DNA, 20520 bp, Oryza sativa
aggtaataaatgtgcggcattgttttcgccccccttccaggggcagtacatttactgaaatttgttatccgcctcagtgcccagattcttgtatgtctaggttgcattgaataaaatacacacttgggagagatccgctgcttggcatctggtgccgctttagttcagagaattcaccattttagtttgtggaatttttattggaaatagcttagacatgaatagttcaataaacgttaacaatagcttagcattgttagtagtatctttttactgtatgggatatcttctaacattgctgcatttttgatgtcgtgaactcataatgcggagggccatagatttgcaactccagtttttatcatcatttatcaccgttgtagttgagcaccataacttacaccttgtgtttcccctcctgaatctgaaccaggcatattgagtattgcatgcatagggttaacatgttgcggcaccatggcgtgaaaccaatccttgtatttgacggaggtcatctgccgatgaagggtgatcaagagactaaacgtgaaaggtatgttctttcttagggctccagaaagagcctaacatgtttcagttgccaaggaacatctacattacccttacagaacattaaaaaaaattgtgatttgacattttacatacggctatagttatggacaactgtggctttaggctgatatagagcagtcgcattattagtacagactagtggataagctaaaggcctccagccattctttgctatgtgatgtttcttgagtcattggatgctaagcaagtaagcatgacatcctgtaggtcacgaaaggaaaatcttgagcgtgccaaggagcatgaatctgctgggaattcacgtgctgcttttgagtgttatcagaaagctgttgacattacacctaggattgcttttgaactgatccaggtaaaggagcaaattccatgtatttttaccaaatatttaccacctatttgaagcagttctagtcaggagtaggaacatttggcttgtcttaactgattattgttccaaaacttgcaatgcaggtattgaagcaagaaaaggttgattatattgttgcgccttatgaagcagatgcacaaatgacattcttgtctgtgaacaaacttgttgatgccgttatcacagaggattctgatctgataccatttggctgttctagagtaagcacagtgttaaaacgctttatctttgtcctccacgtaccccatagtattttgctgctcagctagattagtgttcatagtttgttgtaacttctctaattaaaatgcatcttattccattgtgcagattattttcaagatggacaagtttggacaaggtgttgaatttcatattacacgattgcagcgatgcagggagcttgatcttaatggattcactatgcaaatgctactagagatgtgtattttaagtggctgtgattatcttccatcattgcctggaatgggtgtgaaacgagctcatgcacttatccaaaagctcaagggtcatgaaaaggtaaaccctgtatctgttgtatcaaatactaactttaggcctagttggaattggaaagaactgattcatgaactaacatgaacgatgcctgagatagtgttcaagacctacaaagcatggtaagaaaaggctggatagtagaaccagaatgcagttctacttagacataactacagaaggcaaggcctcaacacaaaattgattgcttcaacttttatgaggccaccgtcttgtacttaggtcattagccaatccatagcctgtcatacatgcaggacatgatttgagttactactgagcttgtagggcaacgatgtgcaatcactttcttgcttagcaaattagaaaaaaaaataatgagcaaatgatgcgtataatttcaggtaatcaagcacctgaggtacagtgctgtttctgttccacctcaatatgaagaaaacttcagaaaggcgatctgggcatttcagttccaaagagtttatgaccctgtgacggaagatattgttcatttgtcaggcattccccatggcagtagtgaagacttggactttttgggcccatatccttgccaaacttatatttgtacaatagatgctaaagctcattcatatgataacctgttgttttatccaccataagtccataaggatgaatttccacttttgtttggtcatgtctaatggccattatacaagttgcgttagaaagtaagctaacggcctttcaatgccaccatttctcagtaataccgaattgtgttacttgaagaaaatctcaacttgcatgcattggatcttttccttaattggtttatacatggctaccacagactgttgctaaaggcattgcccaagggaatatcgatccgattaccaaggaaccatttgaggtactaccgatcttccctcggttgttttggtttcttggtgctttgtttccttgaatgtaatttcatcctactctgattctgtgcactgcatatgtataaacatacccaagcatcaatatgcaaatacaaacgaggggctcttgaaaatggttgtaagctcactgaaatatccaatcagaggctacagagcattacagaagctcattagagaaaaacagataaaaatccataaaatattttgtaagaaaaaaatgtagggtcctcactgaaataagaaagtacattgtaagtgatcatggttttactgatgtactctgttttattaaagatcaccagtatgcaagcatttgctttgctgacatgcgaataccaacattcaattttatcttttgtggattgtcttactaagaagttatatatgttttatttgtatatgtgacttgcagggcaaaacagagagtagcgcactcgcttttgataaagtgcatctgaacagagagtccagtgctccttcaaatggaaagaaaaagcttgatctacctgtccaaagaaacgtattgacaaattacttctgtatcctctcaacacattttaatttaattgagagaacaatatatataccaatcaactttattatatgaactacttgttgcagcttatattatgggaatgccttggataagatagttcagttattgtgctttctcgttcccaaacatgtttaggatcaaatgaagaactaataatttccccataaacttatttacgaagtctaaggtgatgtgcgattcttagcatggtattttgcttgttttgtaaacaatacttcaactgtccattggatgaatccttgacttttagaaggcttagcatcgcttgaggcaaaacggaagttcagagcacctaaggttacacctaagcaacaagtacttaatgggtctttgcccagtcccagaattgaagactctggtacccctgatttaattgaagatactagcttgccatcaaataacattcaagtttatcagtgtagttctgagcattttagctcaggaacccctctagatgattcaatcaataccgcctctcaatgtagttctgagcgtgtccgctgtgacatccctcgggatgattcagccagtgtttcaccccagtgttctcatgatattggtagtgatcctgctgaggacccagacattgaaggcaacaaggtatttcacgtttctttattgccttattttcagtgttctcgtagtcctacctttctacaacaatatcgtatttccgtcattcttatagttttacttctgctatacaggtgaaagtcaacttctgcaacagaagtacaataccgacaggctctttcttagagggtaagagctctacctttttgtagttgatgcatgacttgatctgcaaatcatgtactggtatatctaattaaaatgaaaataatcttggtttctgttttgtatgcatttattttcgttttctagggactttgcctgggatatcagatccatttttagattcacacaacacagagccatccagagctgcaccacgttatgctgaaaaaagcaatgtggtctctgccaatagaaatattactgtgaggagttcatatttcaaaacagtaaataaaagagtttgcacaaatcaaggagaagatgagtgccatgatgaagataactgcgagactggtaattacactcttcctggagatcaacaaagaagctctggaggtatattgaagagaagaaaatttagtgatccccaaaattttgaagatgtaagcaatttttttttgagttgttattctatcatcatatcgcagtgaactgtctgtatcattctactatctggtcttgaatgtactatttgtgcagggaatgtttcaacccactagtcctcatgaaagtccaccggttgctgataaaggtaatagttccacctagttgtctgttcttattctctgtgagaatgtgcacctttccttgttccatttctctatagataaacttgtgacgattacaagaaattcagtttttccaaaaacaacagaaggttctgccaatgtttgagtgtgcgtagttccctttttttttgttgctgagggaaatcttctgaatgtctgatactaatgcaggctgtgactctgattcccacgacggtatcaacacaaattctgaaggaaaatttggatgcaatgtcgcccatgtaaataaatacagtggcattgcagagaaatcaatggataagtttgctgcgctgatatcatctttcagatacgcaggctctcgtgccagtggtcttcgcgctcctttaaaggatgtgaagaacactcttcctgtcaggtctgcagcttcagaaaatttcaattgcaccaagttcacacaatttacttatcagaacttaagagggggacacagttgtcccaatgagttgatatattttataacattaattgcagatctgttctcagacctccagaacagagattcggttgtacggctaagaagactactagagtgcctctacaaagcagattctcaagtgatgctacaaacagcactgacgttcctgatctgagcacatttgcatacaggcctacaactgcttctgctcattctgatcaggggaagatcacaagcaaagctacagatgctgctgctggacctcctgacctgagaacatttgcttatgcaccaacaagatctaccaccagccgttttgatcagagtgaaaacacgcgcaaagctatgtgcactgcggacagccctcctgatattagcacattcgaatataaacccatgaaaagcgccgtcagacgttcagatgggagcaagttttcaggtgcagcactaaaagcagctagacgaacctctcggagctgattctcacaaaattgtggatgcacctgccagcttccttatctgagcatgtttggatttgcgtatgccttctgtctgcgttcatgatctgagttcaacagaatcatccagcaacaaatgctctcaataaaagtgcattccattttgcccaaagtgcaagcacggctgaggtagctgccattcactactactagctgcagggcttatcagttcagacttcagagctcatccgtatctgcgcaatcagaagcacacatgttctgaagggaagtgctttatcttctcggtttccagagccaattatgtggcattttgcgagccaaatgtatgtgctcgtttttgccttgtccaatgaggttcttgtatgaacagcagtcgaatttgcgatgctatttaagccgcaaatgaggatactgttgtattgttcctttttgagaagatactgctgtatgttcattcttatacaagtgtgagcattccttcagaattcagatagcattactcttgtcaactattgatcaagatgttggaaagactttgaaaccggctgtttaagcacttgccagcattctaccagtctttctgaaagattataataagagtaaattgcatattgggaacaaatttttatctagtttgcagattttcactttaaaccggcaaacttcacaatagttgcaaaatggaccggtgttcttttccaatctaaaattccagtggctagtcttaaaataacggtggccaaactctgggattacaaccgaaatgaagctaatgcaaacatggaatgaaaaaaaaaacgatactatatagttttcaaagtattccctccgtcccataatataagggattttgagtttttgtttgctttgatgactcgtcttatttaaaaatgtttggaattattatttattttttttgacttactttattattcaaagtattttaaacacgaatttttttggaaataatacgattttaatgaaaaattgtaaaaatataggtcgattaggcgaaatcgcatgtttagcaccctgtcgaacaaccgtggttcgacagccatctgtcgaactgggtagttggtctaaaaaaatataaaaaagtacggctacaggaatcagcaggaacatgtcgaactgacaaagttagatagggtcacgtgaacagtcagaaatcagcaggaacatgtcgaactgacaaagttagatagggtcacgtgaacagtgccgctacaggacatatcgaactttcaaagttcgacaggttgcggctacaggtggctgtcgaactacggttgttcgacagatacctctgtcgaaccacggttgttcgacagggtgctaaacatgcgatttcgcctaaccgatctatatttttgcgatttttcattaaaatcgtattattttcaaaaaaaatttcctttaagcacaacttttcgttttttatatttgcataaatttttttaataagacaggtggtcgtaagcaaaagctcaaaatcccttatattatgggacggagggagtaattaatattcaatttcttacttatccattgaaatatactccatataacaattgaagatactgcacgaatctccgcgcaatcagccgtgcagattcccctactatcccggccagggagtacacttcggtggacatcatcatgacccgtcaccgcagaggcaagcgcgggcgcgcgagccccgaccctccggcgaagcgccgccgccgcggccgcggccacggccacggccctggcccgccggagttagaggccgacgagctggaggctcctccggcgccggtacaggctccatcggcggcggcggcggcggcttcggagccgttgctagtgatggtcgcggggctgccgcccgggtgcggcgtgatggagctcaagtcgcggctcggggcgtacggccccatcgcgcgcacccgcatagacgccgcctcggccaccgggtacgtcaccttccgctccgccgcggccgccatggccgccattgctgcctccctcgaccccgacggtggcgtcaccgtcggatccaagaaggtaaggagatctgcgtgctgcagttggatgagctcgatttcaacttgctgtgcgtgtagaggaatgcagtacagcctgtacagggtcaagctttgctgagaattgtttgaaggcgctgctagatttgagaattttatagattggcatcacatccggccttttatctcgactttaaagttctgatggatgatggattatggatcaaacagagtttatgaaaattatttgagggcacagacgagagaatttagtattagaaagttgaaaggttgactttaaaaagttctctaagaaatgccgatgaagaaagtttatgcaaaaatcataccgtttgggagtttgggaagtgcgcccgcaataatcaaaaatccgtgagaggaaaagaatgctttttttaattatttttcatctcattttatactctgcatttgctgtttcattctagcattttggatttaattaatgtgctagttattcaattaacttacacatttgctgggctctacaaaacctactcaattccgtgatgaactggctaccttaaattcagtccaaggttacagtcaaccattttatctggtacaagtctataagatagtaaattatattcaatattgatcttgtttacatccagactgtgctggtatcttcgctgtcacaatttgttcatgttaacggtcgtttaaaaccaagtagaatacagatttagtttagaaaaaataaacaataaacttattttgcactttattttagtcgaaatgcatctgcactttggttgtgcagcaggcacaaaataaacagaacaaaatttctaacagattcaggggaagctatagcatgctacacatgttttgagccatttggtactcttgctcttcgatactcagattgctggttctttcatgggttgcaggttttagttgtacaggcaagcgaggcgccgaatgacttgagaagtacagctcaagccaacccagtgggggagaatacgcatgatgcgacgaagaggaatgcaagcgaatcttcagcgttctcgagcacgaaagcggctccagaaggaacctacaaagctagagaaatagtcgcctacgatgatctgttctgaacttctaataaccagccttctttagggaggaggtgagacaaccattcaggtttgttcttgtacactgctagggtctttaggtgagtaagctatgggtattttttagtgtgtgaaggtaccttcagatgggtaggtgtttcttgtattcagcatgtattgtggaagttatcatcaaaacatgagaatttatgtatgttagattgttaatattgacagtgccttaccatcttctcaaaatttctattcaagtgcattcgactattattcgtggctactttgaaaacatttgaaaaagatttagcaaaaaaaaaaagatcaaaagtgttttgatcgattcaatatttgacaccgtttcataaaaggcagaagaaccgtctgatcaaagaggtgaaaaaaaaggaatctgggagttgtgcttcgtatcacatcagtctataccagtaaaaatagagcaaaagtaaatcgaatatatcacactggcatgtcacaaatatacaaggtattattccgggaatgttcagcgagtactttttgttaaacatgttcgattaaaacgctccaacctgtaaagctctaaaaataacgctcttagcaaacgcctaaagtagcagaattttctagtgaaattattctgaagacggaaacactataattttaaaggcacataatatgaccaccttgtatatatacggaaaattttatccagatacacgtgtaacctattatttacgcaattacactgtctgcaaaacagctctatcaggttacattctcagaactgacaaaattgttccagctgcatgatcttcagtgcttggcactcatgcagcattttgcagactcactattaacctctcttcaaggcaagtgctttatcaacattctattggtaaaccatttacctgagacttttgttaacagaaatatcaaaccatgtctgacttatcttgctggcctgcgtgttgaacatgctattcttgaagcttttttgtcttcctttttggcataccactcaccatgtctgacttatcttgctgtcaaatttcaaaaaggaaaatatgtagttaatataacaggaggaggtaataaaataagaaattttaggtcattatcgccaaaggttaaaaagatatagccaaatcaatcatgtatacaaagaggaaaaggctgtacagtgacatctgactggtttgttgatgattattcatagcattgtgtcaatatgactagttaagctgattgttcccagacgtaagcagtcttctaatgatttctgattgattgcagaagcagacagcctcataacgctatctgattaatggagtatccattggcactagtcaatttttaattcattagcgttatatactcgtgcagtgacgatagttccagcattgatcccctctcttagctggttcatacaatgttgtgacatttcttaaaccttcaggctcactctgtggtataagattggagaagaatgttttggtggtattttttggcactgacaaaacattggaagtattagatgctattttctctaaaatagaagggcagaatcattctatgataaagaacaggatagggtaccaatcttgcgccttgcaatccattatccttgcagaaacggactgccaaagattgagaaggggcagctggggggaaatcttcagctggcattgcaaatggacgaaccattttatcaaatttgtccaaggtgagatatgatccaacttcctgcaatctttctggctccataattttcatagtgtgatcatcaggtagcaatgaatcttttccatgttcgctctgtatggatacatttttcaagaactgttgagttaataaccagaaatgttgaaaacaaacatcttacatttcatttgaaggggaccaaactcacctgtaaggaacttatatctgcaccacgactatatgtcatttctatgcgaaacctttttgggtcttccaaagaaacctgcaatagttgtccaatgacaagatcaatatcacttctcaccggtagtattagtaaagtaaaagcttatgattacactataattttttaatacctctgtattctcgaacatacgcaatacaatgtaactcatgtagtcaagttcccttgttttaaacagattatctagagcatttttgcaaacaagactttcttctccatccatagattcatcaaaattgcagtatcgaagtacattcattagagaatgtatatgtgattcctgacaacaaaataatccttagtcattcttatcagggagaagaaaacaaaaacaaagaatttcagttaaaaaaaaactccaaagaaatgtcatataggaaattgtcgtttccatgatgatgtatgctttttagagccttagtttttagggttttttttttttgaaatttctgtatacttctatagttatattgatatattaccataaatcaagaaagcataaacttaacaatttgcaaggggaatatgaaaactcaatgtaatttgtcttactgatgtaaaatagagccttgttcgaacacgtcgttcaggttccatcacattggcatatctacaacaaaattatttgaatatcaattgtattcttcatagtcaagattcctaactggaatttcgtacttactttggatccaagcagtatttggtttctttgtgcgaatcatcaagatcaattgacttcttgtttgagttaggtctatcaaaaccctcattcttaacatccccatagtaacccctatccttccgttttgaagaaggcactattgttggatcatggcatgcattagattcaccaccagcagcagcaacctctcgtctggtgttatgcaggtcaatcagaatcttgcccaacaaacggcgtgcaatctgaagaaaaggacatgagaaacatcataagttgcttgtgactaaaaaacaaaacagtgccaaataaaagggctagcctctaggagaaaattgggtactacatattttctgcaacaaattcctttagcatccttcatttctagaaacaaaatctcatttatgttagtttttcggataaacactacataatgaaaacaatgaatatacaggacgcaactcataacagtttcttttccagttttcaaatatatttacacaccagtacctttgaaccaattttgagtttctgcttcgcatttattccatactcatttggaattacaccatcagctagtgactgaatgaaaaagaaacattataaatagttagatagcaggcagaaaatggatagaaaaagagcattagaatgaccaatcataaaattcagaattcaacataagcacgccactcttactagtaacgtactccctccatcccataatataagggattttatccctctcactagacccacaatataagagattttgctatactacttgtcacatccatcatctctaattcaaatttctacctattttagcctccaactacccactcaccacaaccaaaatcacatttaataggggtattgtagtcttttcttttcatccttaacctttcccaaaagggaataatcccttatattatgggatggagggagtaataggtagtatagcagtacatgtttctaatagtgcatagcatattgagttctctcagtgttaatttagtaacagtaaagcaataatcattcaccactctactagttgtattcataatgtaaaacagggatcaaaggatttcatttaggacctgagtgctatgaaatgatgtcttcatgtgcaaatatttcacaaatacacaggagcagctgtatatccgtggttctacacacatttaagtgcaaggtacattttaagagtgcgatacatatttaatttacctgagaaactctgaagagatcactcaaaccattaagtttgagatgtgagttatgaaggaggtcatacctgtcaagtatactgttagaaatagatgaggtgaagagatatgctggaacaaagaaatgtttttgaaacttgagaaaatgcttttgtttcgaacaaaagcatcacgtgatttttaaaataattgcaagaagccttgaattgcaaaaaagagagagcagatgaacacttgcaaaaaaagcaaaatgaagttattttgggcaaattttatctgtctttgagatcgtcaacattgtgaactttccagtgatccactagcaaactttcaggtaagctttaggaaatatttgagactttgatagtcatgtttttttttttttgaaaccaatagtcatggttttcttatgaaaataagaaatttattttcctacggctgggctgtttcgctgaacattcttgttgattccctaggtcacagcccctaaggcctaaacagcatggaaagcagctgggcaaatcaaggtcaggccctctcatggccaagtttcgaggcacaatttggtatgctaatttgcatgttcattcagaaaagcaaattcgaatgaagttgacaattgacaaagatcttatggaagagcatgatacaatcatataataggcatccagggcccagctattttgtgaagagaaatagaagcatctggagatggtaacatggttacccacttgcaagagtcatatatatcaggtatttgcgtagtgtcaaaacgtctgcatcataatgagagttttagcaatggttacacaagctgcaactccttctgagaatttaatcaacaagaatattaaaagcttggaaacatacttttttctttcgttgtagagatccctctctagtttcttccaacgggcaaacatcaaaaggaagctctcgctgccacaaggcaatccagaagcaatgcggtccatatcaattgctgttttccctagtgcctttgcttgatcataaggatgacttggtgagtcactatctgtcacagcctcttcatcttcattgtcagaaagcagcttcacttgtgcagttatttccttggtcaattgagcctgattggacagttgagataagggcaacttatttgtcaccattatagatgtaattatcttaacgtttggttgttttagatgtgcaagtttctgcagaaacaactcacaagtatacggtatagaaagcaaaggggaaaggaaataaatacatctaatgcatataccaaatttgtgagaaggttagcagcatttggaggcactccagctccatcaaccatccatgggaactccatagtctcaccatttgcaatttttgaagaaaggataatattgtgcaaacgagcctgcagagatctgacattttatgacagaaacttttgaagtttcaaacaaatattttttttcataagtatgagttatggcattggtatctgaaggcgaccttcgcttcatctatctcaatagagccatcctgaagtccatcaagcatagaagagtccttactgacaagtgaaacctggagacagtaaatccaatgaattgcagctctgtcaagtcttcaactggatatatttccgtaataggaacaaaccagaattggagttaactccccctccaaatcaagaagacctttcgcaaaagctgctgcagacatctattaggtaacaacaagaaaaaaaatgtaagcaaccatccgttaggaccgttacccagtacaagaaaaatgacataggatagtaaggtcaggaaaccccagcaatcattactttttttacatattaaatgcaaaattatttgatggcatgtcattatgttcatgttgtctttggattttctcctttattttctctgttgtctgtgtgcatccctgcctgatgtaattccattacttaatgaaatatcccttgcctaaaaaatttaatggcatgtcacagaaggcataaatgtacaaaaaacataaacatttcagtgaatccagaatggaactaaatagtttctggtagttagagaattactacgaagaagaataagttattacattacgttactattgattatatggaccagggtccagaaatctgctaccagttctgcttaatactgggtttttgcccacttgaaggtgtgatgcatcaaatcatgtgtaatcatgtgaaaagaccagtttttcagatagctgccaaaaaatggctggttttcagaggaacagagcaggcggttcaatcctgagtcccgactctaaaatcctaaccctgatatggacatgatgtacccaaaaaatggctggttttcattttcttttacattcaataacccaagcctgtaagaagaaatactgccatttacctggacacgaccttcatctgaactgtatattttcagatcatgcctatatgtactgtgcagacgaagcaatcctggtccttcacctaaataaaccgaagtcacaccaaaatagtacatgagacacaaaagccaaataaatggtgctgttttcagacagttagagaaaagaatgggaggctatctaaagaatgggaggctatctaactgacatctagacagaaatggcagccaaattaacaaagggaaaggaaagaaaggacataagtagggcacaaaatatcaacgtgaaggataataaaccattttgtgaaatgattgctggagtaatttcactaaaagtaaagattgagataccatttcagtaaaccaactgaactgaaatagctgaacctgaccaagttacattttattgaaaaattcactacgattattttgtttagttaagttttttatttcaaattggtacccaaagtggcacagtgaaactgaatataaacatttagtgaagacttcaccgaaggtctgaaatggattagactattgtggtgtttagtgatgcagttcatacaataatttagttaaaaccagagtttcagcaaaatatcacgttggagacccacagcttgatgccacacatagaaagttctaaacgggaagcggaaaagtttaggataaggcatacttggatacatattatttctgaagtatcttcccaactcttctgcctgcatgatcaaacaaaagcatctgagagacacaaaggggggacacgataagaacttaaatgaaatgaacagactgatcattaatcatgtttacttagattatgtccatagtactaataagttgaatatttggacattgaaattggagattgttgaattaacataaaatatccataaaccccaaaaaatcataccgacatcaaactaaatgagcttcattggcaacgcagtgctcattataataatgacagataataaaatcttcaataggtgaaatgaaagcaacctgctttctcccagcatgagttagaactccaccgtacttgagaaccatcagtgcttcaattggatactcctccttcccgttgccgttacttttaggaatatggacccaattggatggctttaactgcactttcctataaatacctgaaaaatgtccaccctacaggccatagggaaactaatacttaatgcctaagaatctattgtatttgcaactaaaattgacaatgaggacaaatgcagattatatatggcagtaaacaaaaggaaatgtctagacagcgcctttgtatcgcatttctattcatgcaacacaattgtctcagcaagaacaagtacataaataaacaatcttatatgtagtatttaattaaacagaaaacattttgtaaatagtgatgtggtatttgattatacttcacgaaaatctacaagaactctgcaatggaggcatggagctccatagatatgtaaacagtaactgctgaaccacataagctatttatgtatatacaaactgttaacaattttatgttttttttaacatttatagatggaaaaatgatttttgaagaacaggtagaacaacaataagcatgatggagatccacgggaaatatacagttatcaacatgaagggaatgctttcattatgcactgacaagatcacaagaagcatgctgctatcgttgtagtagaaattagctgacctaaataccaggcaccagtgaacaccttttcgtgccactccaaagtacgtccaaccaaaaccaacactttaggctttaatcctcacttcattttacagggttaacccagttggtgtgcatggctcttcaaggtttatgtacaactaccattcttatgcttgtatattcatcctaggtgccatgccaaacatatagccctattaatacttgaacactattttacctcttctagaactgctctaacttggcgtagcttctctgcatgctcaatttcagcatcactatcactttcacggccagacctgaagttagaaatttttttcctctttgttagcaacaaatcaacaatgcaacatacaagggagagaacatgctcacaattaagatccgtgtggatgtctactatgtattgttagaagtcagaactctaaccaagatacacatattacataaaaacataatttctgacatcaaaaggtaaaatattatatggggatattaaacatgatctcatagatttttagcattttgtaaactagcaaaaatgcacatattttgaaacccttgagaacaaacaataaattggaagacatatttgatacggattaatattttgttttgttgtatgttactagtgacatccagctgcacatacacaaaccataaaccataaaaccatagaaaatttgaggctccagaaattacctagcacgtggaacaaggattcttgttgcatctaatagatcttgcagctgcaaggcacttttaagttttgcctgcacaatttgacaacatgatcagttttcaggaagcaaaaatataaagctcatgaataaatctaaatcgaaattgagttagttttcgtacctctgcatgggcctttcctccattgtatttcaacattaattttaaaagcttttcttcagttaccttcagcttcaccttttgctttggcgtgcgatccccacttgcatatcattttttgtagtgtcaaaaacaagtttgatgatgatacaatttagagatcataagattatccttactggcgtataacagctatgacacagcgcagctcttctgattgcctagatatgccaacagttcccctttctcgatctcttacagcatcaaatggttggactggctcactgactttccatggaagattagcaggaatggtggatgaaatatgtggagctttatcatcgagaaacattttcctcagaatgcatgcagcatcatcgtagtacctggagttatgaaggcattcaccaaataaacaagatataacgaggaatttgaccatagaaaactacaaatgcattaaactgttacagtaattgttccaacagagtgagaaagatttacttgtgtgagcttttcacaaaactccagccattgacatcacatacataagaccttgcctcccccaaatcacaccttagaagatcaaaaccacacacctacacaaagaaggaacaactactgagctaatacaactacctgtatggtcttttggttttggaatcctgacatatatcaaattgttatccgcagtcttatgtgcttcgttctttgtaataattggctgtagattctgttgaagcaaatgccggaattaatctaattccattatataataaaaatataactaagcacatataaattagctctctgtatatttgttttctgcatgtatggcttctggtcatggaatagaggtgtgtccaattcatctccaatctatctaattgatccattttgctcaatggcaggaaagagcattgcatgccatttcattaagctagaggatcgaaagtattttagttaaaaaaagtcaaactcagtaatcacaagatattcagccagagatcaggtccctaaaggaaaaaacaaaacaaaaaaagaaaatcaaggaactcatttagtacagatgcgccagcagaataaggtcaagaatgaccaacaaaggaaaatttaagctacatatataagctcttaaaagcattttgctccagcaaggtgccatttcatgcactccttgatcaaccaaacttgaaccactgcagcattgatcctattgaaaattctcgttccacagaatccaagcaacagagatcactatggagttggatgctcaataccttcttgatcttccacactacttgaccttgtgctaattaatcttgaaggaaacaaattctacttatatgctgtagatgacttaacacgatgatggtttcactaactgtatccattatgtctagtggtattgacaggtgacagcccataaatacacaatataagatacatcctaagttctgaaatagtgtaagcttccgacatagtaggaattaaataataactaaaagaattctgtaccgcttgtccgaaggcttggcaaatattccttgcaatttgtttctcagtaggggttagtaaaacaggatagcgcaccttcaagaaagatacaaattatacaacaagtgttagatacaaattatacaacaagtgttactatatatctacacagaatggtaactaaagaacataaacgggttaaatatccatcaaagtgtcaaatactgaggcatattgatagcactggtgaatcctatggcaaataggcaacaaaggttacctcttttccatcagaattcctcataacaaccccatctacaactggagatttgcgggcttcagcatgtgcatatcctggcccaactgtataaacctacaacatgatggttagtcttttataggacaaagcaaccctggaccaattgggaaactgtcctgatgaagataattttccctcaaacccagatttccaagagaatgtgattcccttttggtatccctagagattcaagtccttaccatggtgcatttcttaatgcccaaataaaaaaaagggaagcttgtggcatatgttgcatgttatggcaacaatgcatgtaggcatcaactgtataaaatataattattttatgtttactcattaccaagaagaaagctgtaaaaagttcctttttaacatatctggagagtataagttgggaggaaaaaaaaatagcactaggcgcaagttctgtcaccttgacatctgttcctcctgttggcatgaattcttcataaatgtaagatccatctcgcctcaccttcctaatgtctggataaaattcactagatcgattgccaacctatgcataaatattttgaagaatacatctggtgagtgaatttggggagttttgaacagatgaaagtcgactggaagaacatgatatgacaagcagattcagaaatcagaatgcacattaactcattcatttatatcaaagaagtttaacctcagcaagaaaataccaactagagcaaagatagccagttattttttaaggaggccggcctgaatatattaaccttcaaaggtaaaaaaaaaaagtaatacaaaggcggacacagcgcaagcacgtcagagaggacacaaaatagataaaacagcatgttagaacataaagcagatgatcatctgctaggttactgagttatactgtgacagtgtttattatcaagtaatttttcttagcaacaagaaagacatcacacataattgtgtgtgtaaaagaaaaatagataggattatagacactctgtgctaaacaaggaacaagcttggaagaagaaaatgaaaaggaaagcagattagaactgaagcagctccctatcgacagcgctaacaccatctactctagatgctaagtacttcctcagttaagaaatgattagtattttcttaacaagaaagagactaattacaatttttctaccaagaaatgtgtgtgaattgaaggtaacaagtgcccaccttgcggaacagttctttcattcctccaccagcggagctaggataatatatcattatgttatggtcatctcctatgtacaacagaattagtcagcagcagcaaagatttgttctaacacttctttacaatgcggcaaagttaatgtttaaaatagacaatctgacaaattaaatttg

SEQ ID NO: 45745 - DNA, 14437 bp, Oryza sativa
ctgccacttctcatagttgatactaggaagcagccttccatgagaagcttaatcaatcagacctagtgcaggttttctttttctttctttttttttgttttggcgtacatgtattccgcagatataaaatgatagttggtattctagtgggagacagaagaacaggcatgaactagtagaaggaaaaaccattaagaaaatattttttctatcaagagctgatactaacataccatcgattggtttctccacaaaaggcttgtaaaatcgctttccatggatctcaataaaatcatcttgctcaacaaagtactttaactcttggttagggtattctcttctgacaacagcataagttggaacaggaactccgaacaatttaaggtgctaaacaggcaaaagggaagtatcaacatttgcgaaaagagaataagctattatgtaaaaggttgcaaactggagtggagggttgtgtttctctataagtatagttggataaaaccatctgttgactatcttatccatcctataaattttgttgacggtaatagttgctgtgtcaggaaaacaaaacaagaatacttataggccaagcattttgttggatatacataatgatataacaaataaaacaaactatactgttcttgcagactaggaccacatcagtcacataatataaggaacagacataacatctagttttttttacagtacttatctttccatccaaaattatgcatatccttttgcaggttccataggacacatttacacagaggaacatattgtaggcatatgaacttaaaagaaatttcttttcaaactggaaatgctatatctaagaagaacatttgctcacaggagattatctcattggtatcagtttccagagagagagagagagagagagagatcagtaccaacttctgcatttattaggataaaaaggcctgtttgtattggcagtttcaaaagagaatgtaacagatattacagtagagtcttgagattaacatggtcaacaatagactgcagaagcaaaaactagatatttcaaacgaactaaacaaaggttcattaccagatattcatagatgatcttgctgccatcttttggtttatatactgttgagtactactaccttcttcaagagaagttatttcttctagtttaaaggaggttaatttgcatcccatgataactagcaagaaataacacatctttaaagaatctattacagaacaagcaactcagtcaaaacatgaaaaaaggatatctcaaatgtacgaagcatcattttttattataccgatattaatacctcatatactttgctgcgatcatggaggaggtattggggatccaactcattgaccaaaaatggcctgcataaagatatttacataatgttattgcatcaagttgatgaacttatataggtatctagctaataataaacatgtgaatttcttaggcccataatcaacactgcctgtgtatttcccaagaaaaataatatacacattaataatatgttcaaattgcagctgaccagtgttaaaaaaaggctagctcaaatgataacctatacttatgatttctaaagttctcttcaaaaaaatcagctacagaaaaaaggcataggcgaactcatatatacagacatgaatgaaacagtgatatcaataagagcttaggtgatgctattatgaatagagttgctttagatacattaattagccatgggcacattcagtagcgactatatcaaagtaactttaaaagtggtgcaaatgttgaagccaaaaagggcaactatacagaaacaacacatgggtcatcaatgtccacaattttattgttgataattatcttagtccagctgctagtagtactagaaatgttctatatgtcagggaagcctgttgtgaaactaaagatacttgcagatccagcacaaagatgtgctctgaaaatttcatgtgtcaggaaaagcatttaacctgcgtaaagcagcatatttctctgccttttctagtggatacccagccgagtaaaaggcaatcagacagtcacatagaggccagctgtcaacaaaaaaacagaacaaagatgatttcatagtaaacacaatatatgaagaaaaataaatcactgaattaacctcattatactccatccaatcacgaaaacatatgtgcagataattagatgttttggacatgtttcaagtcaaactttaaaaagttgaacatcaatgtattactagattgaatgtatgaaaatcatatgcgtagatttgcctcaaaaagtattgttgtaatacatcaggtattcaaagattttacaatagaaattagtggtcaatactgcattttgaagaccgtgtaactgtccaaaaaggcatttttttgtgaccagaggtaatatcatgtaaagtctgatatcatcagatagaaggaaatctttagtattctaggaatattaagttgacatctgctaagaggtgcatcatcacatatggacaatggatttatttagcagcacaaaattttaaaacatatcagttatatttcctagacagatattcataatcactctatcaaggattaaatatggttatgctacagcaatcatttgtgaactgactatatttatcctaggtcttatccttcaagtaagacagcatgatccatcattcatgtctgtacatctgtacagatattttgacctgcataatttgcttttctattttgccaataacaacaaattgagaactaaagaattcaagctcatagaaggctctcccttcacagctatcaggcatacctttcaataggatcttcaagaatgattttgtcaccaaaaattataatctgcatccataaagcatgcatgtagttattaacattcagcacaatgtagttgctttactaaagagccagagatgctcatatgttgtattgatcagaagcaaaacactttactatgccaatacaccatggtggcatatacgtatcttctgcaggattcatagctacaactgactgtatttggcaactgataacagaagagagagtataattacaaggttcttcttccataacattttatagatatttatctagtttttatgactaccaaacttgaagttgtgcaggccacacatagacttttgtaggaaataatacaagaatggcgttttgcatggttgttgtttgttcctcctacatattcttgttttccgggtacccggccaaataatgaaggattgattgagccgtggaacccgggcaatatgtaatcgccacgccttaacttgtacagcagtcagaaaatagggtgctaatgggttcagttacacagtttactcctgcatatggaaacagagacacaaggatcatatgcttttttcagttgatgttgtcatagacctctagcatgtttcttcagacagttcgcgggcatcaataatcctaattgaatctctgaatgcttctcatcctacaaaaagactccatttttcctctccatttgatatcaaaatttgctcttaaggagaaacgtcaaactaattaacaaaagaaacacgggctggaatctgcctgaagaccagaatgaccttttccgaaccatacctcgaactccccgaacgcccgcagcctctcaagaatctgctccatgggggaacaccacacctgcaaccaacatgggagaaaaagaataacaaaaagtaatcaacatggccacctccgcattggagccaacccaagaacacaactgaaaaaaatggataaaaaatcacaccttcttctccatgacgcagacaccaatcttgatcttgcctccaccgtcacagccatcattccgccgctccatcccctcgctacccctttctgttctccgggaaagaagagattacaacgggaaagggagggtctgtttcttaggacatttcgcaccccccacaaggattccaagattgaagctttttatggaggagggcagggagggacgaagagggtatgtgaggagagtgcactgtgcaaggataaacttttcttcctttttccccctttatttttcaaggactacaagtctacaatgagcagctctctgcgtctctccccatgctagttattctgaatctcttcccatgctagtttatctcggatttgctcggaaagaacctccttttcattgcttttacttttgtttatgtgctcagcagtcaacatgactcttctctttttcagtttctccacttctgttcagcaagaaattaggagatacggtagttagttggcttattgctacgggcacacggcaagttttggtttacttgcaagcacgaccacacattcgaggtttctgacaatacatgatgagtctagtagcaacacaagcacaatttaggacaatttagggtgtgtttagttggggaaaaggaaatttttaagtgtcacattgaatatttgaccggatgtcggaaggggttttcggacacgaataaaaaaactaatttcagaactcgcctggaaaccgcgagacgaatcttttgagactaattaagccgtcattagcacatgtgggttactgtagcacttatagctaatcacggactaattaggcttaaaagattcgtctcgcgatttcccccataactgcgtaattagttttttatctatatttaatgctttatgtatgtgtccaaagattcgatgtgatgtttttgagaaaaaattttggggaactaaacgggccccaaaggactacgttttttggctgtcaaagtttcttagagcatcgatagtactgcaacttggcgaatgcttttggattaggtgttttttcttttctttttgtcatatggaagaaaataaatagaaaaacaaaatcgatactgcttttgagcaacgcatggtatgaactcatgtttgctttagttgtagtcaatccacaacggaatgtctagagtgatttcataattaattaaaatatgtcggtccagttttttttaatgtgcttataagatatagagatataatgtacgtgaatatgcatgtgtatattagccgtagtacgtttagaaaataaaatacaactacatgtgcatgggaatgggtgcacctagtatttcattagtttgttcggtttcattttctcagtcagatactcccaacactttgtaaggtagcaattggttcctcctatgtttttttttcttcttatgaccagttgtgatagtcaaagttttaaaactttaattgaatgtcaaagttttaaaactttaattgaattttatctacttcctccatcctagaatttaaatattttttaagtagacacggatattaagaaactaagtagagatgattaaaagaggattgtgattggtaaacagaaagtaggtgaagaaattactttattttggacaagttactatgctacaaatagatatattttgggacagagatagtagatattaaatatgtatgacttacggtgtacttatatgtcactatatttgcatattttcttttcaattacaatagtaataaaaaatacttcatacttcgtcacactggagtgtggtgaaggcgcccatggattacgtcgctcaggaaggaaatttaagattgaatggtctttcgaaagatgcatactgtatctcattttatatatatagtcttataaaatattattgctactttaaaaagaaaggctagattatttaggagactgaccaagaaatgtataggcaaatttttatatgagcaagcaaatgtttcttgcaagacccagcaaaatgttccatcagcttatggaggcacttgacgttagtcagccatgtcatgcaaaaaggaaaaagaaaaaaaaatcttctaggcatccactcatgctggccttcttgaacagcggaccttaacgaatgcacacatgtattttaatcacaacttttgatgatgtgaccttttccgagaattaattttacaaataaactgcggccaaaacttatttcagaaatgactcttttgttcagcgcaaatcgtatggcgctaaacttagacacctcagcgtcatgtcagctggcgctgaatgtcgtgccaccgcggatgagaggctgagtcggcgtgccaacatgcattcaacaccgtgctatttgatactgaggtgtctaaattcagcgccatacgatttggcgctgaacaaaaggatcattttttaaataagttttggccgcggttcatttgtaaaattagttttcgaaaagggtcaaattgtccaaatttgtgtacttttataattgatgttctctaaccacaggcacttaatcgcaaaatagaaaataatagaagtaggtgacaaaatgttgtactacctccgtttcaggttacaagattttctagcattacccatatttatatagatgttaatgaatctagacatacatgtgtatttaaattcattaacatatatatatatatatatatgaatatgagcaatggtagaaagttttataatatgaaacggaggaaatacattttacagaaccagatcttggacgaattcctgtcagtgacgcgcgcgcgcgcgagatcacatcccacaaaaggtgaggtacacctatcagatgtcctttgggtctgaaagtgctaatcagaaatgtttagggaatcaatcaccaaattttcagctgtcaaatatttgccccaaaaatcagtattacatctccaaatcctccctttcagatgattcagaaataaaaaaaaaaccaaaaatggaagacccaagcaggaatattttgaagaacattcagtcataccatggaatatccaggcaaatgctcccatcagaagagcaccctgagattaggcgaaattgacccgtgatctaatccaattggtgttcccgtcggcgtcgacgtcgagatcgtagcacgtagcaggaacatccaactggaatatcccaaaaaatgattttggaggctcatgcgagattatctgaccaaatctttgtgctacgcgccacataatccaagaattatgggaacctttgcttccacgttcaaactccagaaatgattgttttcggctatggacaaatacaattacgtctgatcctttatatatatatatatatatatatatatatatatatatatatatatatatatatatatatatatatataaggcaaggatagaatttttgtatttaacacaactgatagaatatttgattgtgtaagttttgatcgaactggagcactgaagaccatttgatttactggagagtcatctactgcgtgtaactagccgacacttattatagtagtgtctgctttgtgtgtctctactctctagagtctgctttcaaaaggtcagcagtttgatctttaggaagacagcatctgagaatattgttctttgaagaaccagatgcgtcactacagtattatatatattcaatccagaatatggttctacgctacgacgaatagcctccgatggtatattggtatggcatactgattactgaatttattttaaattcatctataatggagaggtcgaatgtggagtccaaataaggtaaatatagcccgggattggtaaagttatcacaaaagaaattgaccaaatcatgttgcacacttaatttttactccaatgacaacacaagaatggatctgatgttttgcttctgtactagccataaaggggaatccagcatgatactaactaatcagactctaagccagaattcaccgcaatggtaaatccactcccacaatagacgttaactgaagcagaagaacatggcctcttatcacctatattaactctctgtggagtcacttgatcacaagtatctcccaaaccaagctgtccatgctctccccaaccccaggtgaagactgttcctttatctgacaaaaagatgcaagagcaattagtttgtaccacccagggattatgtgctcattttcagcctttgagtaacttacctgttaccgaagcagaatgttcagtgccagcagctatgtgcaccacctgttctccatcaacacagggaaccttcaccagtgttgatgatgaggatgattctgcaaatcacaaagacaaattttatatggtgatagggaaaaaaaatgcagcatgcagatcaaatggcaaagaaaagaatgccaacctcttattgaagaaaaaaattgttcgacgtccgatttaccctatgctatgagtttatttcaactaatcttgtatgaactaagcagattgttattacaaaagaaattaacagaaagcacaacggttgggcaataattactaggctaacacatagaatgagtattcatctatatgtaaagatattttccagtccagctactggttcctaataaaaacttaatacaactacgtgacataatataaccaaaattgaaaaggggctaccatcatgactatggcttgttgtggcgggatttagtctctgcactggctctgcacttggcaacacatggggatcaagcttacgatgacggtaagcgccaattgtgtacaattcacctgctgtaactgcggaatgcttactcatttgacagcagttccagaaaacatatttcaattgaaaaggaacaacgcaccacataccagataaaactaatgcatgatgccatcctaatgccacttgagaaatacccaaagaaggaaagactggccgaggttgatcatcatcatgttcaccaattaatgctcttccccagatgtacaactgaccagattctgttccatgcaatgaaagtacaatcatgtccaagtaccaaagagaagaagagtgtttgcacaacaaatttacaaggcttaccatccaatgcagcactgtgatctccattggcatatatattccctatcttacagtctggaaaaccatcaattattcttggaacatcatagaacttttggttcctagtgcatctaccaatttgtccccgtcttgttgagccaaatccatagacagaattatctgcaagaacaaggactagcagtgtcatccgtttgtaacatatataacaattagtttgtcaatacatcaagtagaagaggtgtccatataattctcaggacgtccaataggaaagatatatgactgatgagctaaaacctgcaacatctcatgcatattcatcattagaacacaatgatggtgcagcatccctctgaaaagaatgctaaaggatggctcaaaggtacaccttcatagattccacatcatcagagaaagcagtggccttaaaattctcagatgactgataggaaatattatatggttgtggattgatgaccctcccacgtctcccgaatcactagtgcagaagggatggttctgcatccacatgaatgctttgtatgccatattgccatagttggaaaaaaatcaaagaatgctcactcagcccttcttcaaggaatcaacaaccctaagttgccggtatgtttggcttcaaagaagtgtataactgtgtataggtcatcttgttcttgattttcgctttcaataaaaattatcagtatggtcttgccctgctatagcgatgcctatcctcaattgaaaagaaaaaatattgattaattgtttctttcaaaggctgtttaactttagaaaatgcattacggaatatgattgggtcatttaaaagttgggtattgcccagacaatggaagatttctgagcaagtggtttcagaagaggtaacagagtaaatctgggtaggttcatgtactatgcaatttcttaaaaattaagctaacatcgcaacacatgatgttgcatacctttcaaaaggacaagagaatgacgcatcccaagtgcaagcctcacaacatgctttgtggtaaagtatgccacttcaaaaggtaagtttcttgggtggttatcaccagcaccgagctgtccaaatgaaccatctccacacatgaaaagctgtccagaatctgaaaataagaactagaaacatcacagctaagctcatcagtaatggttttatttttgaaacaaaataaacacctgaaatgcacagactatatgtgatatagagtataaagtagattttttgaacataaagcataaaggatcaaaagaaagtacaaggaaataaggtggtttcagaattggacacctgtagcaaatccagaatggttccatccagcagacacacaggttatcatgtagttctcaaagaactttacaagctttggatgagggatgttctccacgtccccatgaccaagctgaccatgtgtacctcttccccaagtaaatacttcaccatcacctgaaatgttgagtagctgttcaaagaactgatgcatattgctcacgtgaaggcatctgatgcagagactaaattcttgaggactgacggaaatgggacaaggttgccaatttagggcacatacaaaatttctgcgtgccattgcactaatataggcacaaaaagattcagatttacaagcccatctcaaaacacccaagaggaaagaaggcaaaaatgcttaggttgccaatgagagaattttcttcctggtaaatgatcaagcttcagcgagcaatatatcttgataatggaacaagaatgctttgaaaaaatggccaaggatagaacaaatctgtgaaacatatccaatcactaattactggaaagcggaatttgaactgaaaaggaaaacactcagccccttgttagaatacaagtatacaacagagagatgtctctccacttaatggcactaagttcaaatattcagaacaaaggaactagcgaaaaccgaaaagttttaaatttgtgaaatagaaaactgttctgattaatcatcaagcccaacacagcaacacttcagtggtgtttggatggaagtgattattctagacactagaactggtgcaaactgaagtctctgaacatctgttgctatggtgagcaaaactacatcgccgtgcacaaatccattgtcaatctaggtatctaactgagttcaagttccggcaaatgcgagaaccaatcattactacaacgatcgtttactagaaaaaaaaatgtggcggctttgaacgggaccggggcttacttgtgagggcgatagcgtgggcgccaccgccggcgacgaaggaaaccagaccgcggcagcgaggtggcaggaggagcggctgcgggagatggtggtcctggaagccgccgttcccgagctgcccgtccgttcccgcgccccaactccacgcccacaccgcctcctcctcctcctcctccgccgccgccgccgcctccatgcccccgaaccggtgcgaagaaagttccacgggactccggtccttcggttatccgaaggacttcacttccctgcgtgacacgtgtcccggcacgaatctcagagcactattcctctctttctccgaccaggatggcctttgcccacaagaccgtatttggaatttttcttgcaggggaatccgttcaacttatgtgtgcaatactgtgacttttcctcaagacaagaatccttctggattttgcaacaagtgagacagcgtgtggtcttctagttctagcaagtagtactgattctcgaatttgattcccttttaaaacgtgtttgatcttcgttctctctctcaaaaattctgctaattaaccgggttagtagacggaaagtcagacgcttgagctcgagcgagttctttacgttctctccttaaccggatcgccaaattaaagcagcacatcgccttctgcaatctgcacctccggatcatttccatttgcccaaaaggagggcaaattggcctagctagcaaggccaccgaaagctcacgacaatggcggtcgatcaatctggtctgtacttttttcgacggtgtgaaagaaacaagaacccgaccagcatctgctgatctccgatcgatgcttagtgtccgcgagaaccagcgagctaccttggtttgtagtgcttcgattcgagatcttggaacgagctcgcaatcagcttccttcgccggcctgccggacgattctcggcgtcacgtcgcggtcgaatctctcatcgcctcatctttgatgaagaattcaagataaaagtgcttaactaggatcgccgttcacattgcatttagaggtgggaaaatatttaactcgagaggacatcctttccttttatacatattatttaaatggttatttttttacaagatatattaatatgtgataagtcactctacaaacatgtaagatgaatatacgtaagtcatactcccaatgaatgacatgcaaacaacgaggggtgatccctcgagaatttagaatccactccctacgaccatcggtttctgactttcaccagcttcaacgttggcatcaacattgttctctcttttacggccttttttttttctgaattctgaacacttctactattgaacttttgttacggttgtattaggcattgcgtgccttgaagttaagggcaggaacaatccgaaaaggtaaaaaggtgacgaatatatatcgagctttattcgtttccctccgatccatcacacgcactcgccgatggatcagctgctgacagcggcgcacgcaggatggtggccgggttggaacttggaagctccaaacaccgcgagaagcatcatcactcagctgcaacctgaagcaccgtggtctataaatatagctccaggacaggctctcttcttactctcacccagtatagttctccattgagcaaactaccaaagggtactcatctgaaacagaatccagtgatcgaccaccccagatgatcgtaggtacggctactcgtatccaccaccccaaggtaataagcattatgatcacttgcagagttacattcatgatctatctcctcgttgattttacttgcttgattaatttgggcttgcaatgcgtgcgtgcagggtactacaatgggccgccggtgatggcgccgccgcagtacgcggctccgccgccgaggcggccggagccgagcttcctcgaaggatggtaagaacgacaaagccatatgcgagcatacgatcgtcagaatactgtctctgtcctttgcattctctctgctaatcatggtgctaatttgtctgaataatacagccttgctgctctctgctgctgctgcctcatcgacgagtgctgctgcgacccatcggtcatatttgtgacctaattacggtcacagtggcgtctcgactggttgacgaggacgaacagtctgagttgagatatacactgtacacgtgcttgccttttgttaaatgttgataattgtatcggtctatagctagattacagtacaagtcctccgttaagttcaggttcttcaagtatcagatgcatgcgtgatccacctgcagtggaaatatttatattgcatgcactggttgctcgattaaccaaaggacgtatacgtttctatgtgtatgtctgcatgatcgactataaagaataaacgaaggtaaagtgaagttatactgtgcatggtcctcaaatctgcaatatatattttgcgcccccctgaatttcttctgcaatggcattgcacattcctaatcgaacggttggcagagattccgatggggttcggagttttcaactccgaatcccatcaatgggccttcacgagcccgttcagcgccataggccgagagcccgaggcggagcctcccatcaggcccaaggatcacggagcgtcgcgaataattccactcatctaggccgcacgggcttgatcgaacggtcgtcgggtattccagggagctcggagttggaaacaacgaacccccgtggccctgtattcgggtggcaagaatgaggcgccaggcctcgccggagcgccgccgcgtaatacccgtccccagaggcaaagaggacgcacccgagtgcccaagttccagacttccagtacgccgatggcgtctgggtcaatgtgccatttgtccccgtggcagctagcctcagagaaaagaacgagctaaaaccatagaaggtctcactcttcttcatctgcattgatgaacttactggagcagaatttcatgcatggccataatgttgcaaagggcaagttcgatgcagcataaaaggttccagctgttgttgttgcaacactgccgcgcagagtacatagtcctaatcaccgcaacacgacacgttaaccgctagctgaaatcccagagggggtcggagtactccgaccccatgcaccagtgcatcctcctcctgggctcactgcggctgtgcggcacctgctgctcatctgagccgcacatatctaatcagacggcgggaaaagattccaaaggggtttggagttttgaactccaaccccaccaacgggcctgggggggggggggggggggc

SEQ ID NO: 45746 - DNA, 38846 bp, Oryza sativa
  unsure (1)..(38846): unsure at all n locations
gggggggggcgcttcagcgcgataggccgagatggagcctcccaacaggcccaaggactaaggttcacgcggcgaataggcccaataggacgtcggggtttgaaacgacgacgcacggcaatggcgcatcctgcccgtgccccgctaggcggaatggcggatgcagatgcaaaagacgacgcacccgagttcgcagtacgtgccaatggtgtctgggactctaggtcgatgtgccgttcgtcccccggcggcagctagcagctagtctgtcagatatcccatattcccattgctgtggacgatctcaccggcgccagcgcacggatgcacacgcacgcatcttcgatccttggaatcaagaagaaggtagagacggtataggttgtgtttagttccacgccaaatatagaagtttgaagaaattggaacgatatgatgaaaaagttggaagtttatgtgtgtagaaaagtttgatgtgacgaaaaagttaaaagtttaaagaaaaaagttggaatctaaacatgcctatagagaatataccaataagctgaatagcaaacactccgattctaaagtccaattcaaagaagagttcaatcaatgccatgtgacgtgatgtcagagagacaggaaagaactacgaatgtgaccccattcacctccgacatgaaaaacagagcaatgaattagtacgtgattaattaattattagcttaaaaaacttcaaaaatagattaatataacttatctatagaattttttcaaaccacgcaccatttagtagtttgggaagcgtacgtgcggtaaataagagagtgaggttggaagcttaactgaagaatgcagcctaaaaaccatagcattgtatacaacaatcaaatatggtagtagtaatttgtattgcgaagcaatcaaagtaccatggagaggtaggtagtctcgtgcctcggtggcaccggttagcctagctagagttccggcagcatggcggcaagcagggcagaggattgaagaaggggtcggacaggggcaagcgcccgtcgtcgacgccgaagcgactgggagggagtctccatccatcgttgcgagcagctgctcatctagaccgcatatgcataatcgaacggacaacagagattccaatggggcttggagttttaaactctggacccttccaatgggcctctgtgggccaattcagcgcaataggctgacacagagaggcctctcgtcaagtcgaaagactacgcagccacaaattattccactcatcttagtcgtgcaagcttgatcgaatagtcataagatattccacggggttcggagttcaaaacgatgactcccactcccactattttgtactcctactcagcaaagaacaccaccttggccctcgtgccaagcctcgccggaccgccgccgcgtcctgtccacccttcgctagccagatccacatgagaagaggatgcacccaagctctaagcaggtttcccttaccgtcggtgtcgagtttatcgcaccttagcgataaacacgattaccgcgtggtaactgcagtaaactgtataaaatttattaaaaaattaaattatttttaaaatttgtttaaatttaatgagattaccgtggttttatttttatggtaccctaacggtaagtaagtacagcaatttgacggttactgtcggttttgtcaaccttggctgttggctccattcatccctgacggtatgcagctagctagcctgtcagatattccaatgttgtggacgatctggtcgtcgaggtgctctcgccgtcgcccgcgcatgcacgcacctttcatgggcctcgaactctggaatggagtactccctccgttcagaaaaaaaacccaatcctagatttaaatctggacatacactgtcttcagatttaaacccaggattggagtatatgataagctgaatgacatgcagattttaactctctaattcacagaagagttgttggagataatagaaatgtgatgtcagagacaggaacaaactactccaaaccatactccgcatcgatgatcttgttggagcagaattttatggtctcattattgcaaagatgcagcattgaaggttccaatatattgcactaaacaaattggatatagatgcaaattaaaccgcaacacaggcgcgcgcagccgcgcagagtgcatcagagcgatgagatctaatggcctaatcaccgcaatgcatcacgttaacagcgagctgagatcctagagtgggtcggagatttaaactccgaccccgtgcacactgccgcttcacgccagcccgataaacgtactctcttggtctctcgacgcgtagtctcggttgacttggggcggtttatgaagaagagcagaaactgaaaggcagtcaatgcagtgaacaccgtggcagcatttcatcgtgttcatgctatagcagatattttctttgcagtcaaattgagaagacctccagctcaaaagagagagagagagagaaagaaaagaatgagaagaacttgaaagcgatgctaattaacttccggcatcaacattcacgaaccaacacggtacgtcaggcgaacattaattcagaaaaataaaacatccaaagtaaaaaaaaaaccaataaatttcttatgtgctgggaatgcgtaccgtaccaaagcttgcgatggattaagaaaggagactgtccggcgagaagggaccaaagcagttttcttttttctccgaaaagcatccctggacggttggaccccatcccgagttccctgctggtgaagtagtacactcaaatggcaggcttacgtccaggttacagtctttcttctcaaactgtgacacagcagcaatccgtagcagagtcatgtcttcctttctcagttcaatactgctcttgtaatttgggctctatacaacccttttagcatttttttttagagaaggatattttttaaccggcctctacatttaaccggatatatacggccattgaaatagggaacttagccccgcaaacaatccaatctgaaattcgctccataggaaatttgaactcagaaccttggggtactactcagatcactacaacccttttagcatacatgacctgtaaagttacttaatgatccccgcaaaaaaagttacttaatgataacgaataatcaattaatcattcgtgatcaagttatattgaagtacacgaaaaagtgttaataatgctgccaaatgcagaatgctaatgccattgttctttatggactctgctagtaataagaaacaacagggtcagtgttcttgatggaacctacgaggtttggcatacttttgagttctcagtcaaggaacagcgagtgtacataacggccggcccctaaggaccagctgcaaacaacgaactcactccatttcatctttttctatttattattgaccgcggccacacatacagataagttattccccctctttttttataagaaggaaaataaacagctcgttttcttttcttttttgaacggaaaacggcacgagatagtaccttttcattgaatggagtaggagaaacagcttgctttatagtattaacaggtaataaaaccgaaacggtggatcaaagaacatatattacaggaaggatttacatcatcacataaatggaagagggtaaaataaacggagcaaaacaaggaactttcgatctcgatcggcgattattcctcccttttctacgaggtgggccatcacatcgatcacccaaaaaacctccaccaatataaatactggtttcccccatccgaacacaccgagcaatgatcatattgtaatccttcccgtcgccgagagattcccacacaggctaaaactatctatcaggcctgcaaatgcaatagggctgagaagtgaggaagctaggcaacctcaaccttattctaacagcatccaatcccaggctaacaccttgagccacgcgagctcggcctgtgcctggctggtccttgcaccgaattaatcgtcgcgtgcgtctttgccggcctcgcacatcatctctctcttttcttgcacataacaatttctgcaggttaacctcgtgtgcatgcgtgttttgatttctcgcggttttcgatagctttggtggtgtcgatatcatcgccttccttggcccttgtccttttgtcgccgtcgacgaggacgtgcatactttctccatgaataaaaacgagagatctcataaagatataccagncgcancgacaagncaagaaagatcaacntagtgtatctctttaaccacaacagcagaacggaccacccgcacctcttccgcgtcaaccaccacagcaccggagtgagcctccgcggtaagttcgtcccgtttcgccctttagttagatcgatctctagcattcacacggctcttcttcttagtcttcttcttcttcatggtgtttatcgtgttgtcattggtttcagatgttaagaggtggctgtcggagctgcgcggccaggacatggcggacaatttctcctggtcctacaaaaggtaccgataatttcataacaggaaggcgattcatcaatcttgcccgccttatcgtcatcgtccatgatgatgatcacgcgtggttatattgttcggtgtttctttttgcgttaattcctaaatcatttttagcatgttcttgcttacccgatagatttagcaatttaggaatgtttataattgattcttgattaggaagtacaaggctgggtatatatggcaggacctgatgatggacgacgacctcatcacccccatctccgacaacgagtacgtgctcaagggctgcgacgtccggcgagccaccgaatcgccaaaggagaagtcgtcttctttaggtgcggtgatatttttttctggtcttctttttctcgttcgacgatgacgatggctcgtgattaacaaattcacaaaatttgtttgtgatagctgaagagccaaagaaactggacagtcaggaagtgaaggtcgcgtgcgatcagaagcaagtcgaggaggtgacgacgacgacggcgccagattccgacgagagatcgccgaagacgctgccgccggtcgacgaggactcgcccggcgagccggcgagccgtagtacggcgccgttgaagaaagacctgccacgaggccttcgcgaggagcggaagaagcagcagcgagaggtggtgaaagtggtctccaaggcggtggtggtgccggcgccggcgccggagcagaaggtgaaaggagcggcgagcggcaggatcagcagccacacgccgccggcggtgggcagcgcgcggaggatgcacctggcgcagctgctccacaacctcctgacgtgcggcgcggccgacgccgacgacaccgcgctccgccccgtcctgcggcacggcgccgacgacgacggcggcgactggcctcctacgccggtgtgccccggcatcgacggctgcggcctccggtgagtacggaaaccccacacaattcgatcatccgattacacagtgctcaaataggattatctggcgtgacagggtgggcaagaaggtgaaggtgcgaagaggcaggaaagacaaggcgaagccgaagcgagacggcggcgattcgcacaagccggcgagtttgccgcgttgctcgtgagtactcttgactagccagccccgtttcctctcaactgattttgctaccgcctgcacgtacgctgtccatctgtttctcgttcttgaccatttcttctgctcgtccaagaaccttgcgtggcagcttttcggttgggttgttgcagttgccacctattcaggctcgctgtgcgcaatgtgctagaccagtacggctataaacctcatgggccggcccatcaagataacaaaggctctcgttatcgagcagtctgaatagaaatttcatgggccggcccatcaagtgcagatttacgtctactttgaaaccccaaacaagctatcagcatccacacgactctgcttttttttttttctgaacaatcactttcttttccattgatcgtttataacctgtttaagaactgacttgtgaaatgttgtaacacacttctgcaggcagtgcgggaaggagttcaagccgcaggagctgcactcgcacatgcagtcgtgcagggtcttcagggagaagatgaggagcagcaccagctcccgggtcagcgtcgacaggggccggacctccgccgccgcgaggcccgaacaccggaggacgagaagcaagggcgccgccgccgccgccgccgcccccggcgacacctcggaccgaccgtccgccgtgctcctcctcagggactcatgatctgatgatcatttcgatcgaccttggagttcgtttgtgaattttgcagcacacgcttatatggcgtgcataatatttaacagcttatctaggatactgtacattgatctcctttgggtcaaaacttatagatcatgccatgatactgctcctaattgaatcctagctacgccaaatggttttttttcaggaatacgcaaaagaaaagaattgtgcacctttattatattaaaaggaataaaatttacatagacggcaaacaaagaagtaaggggggtcgaggagaaaaaggaagaaaaaaatgaaaacaagtacttaagcctattctcgcgtttacagtgtgacaaccaaacgaccaagcacgctaaccaagaagctttggtggtgagggatgggcaagccgccaaagggcggcctcttgtgccatgcctgcgacaacctcaggctaggatcggaaatagttgttaaacacacagttgttcctttctttccaaatggaccaagcgccaagggtcacaatcatgtcgaacccacgacgacgctccctcagaactttgaaccacctagtatggagcgctatccccatgagctctaggttgtggatgcccaacccctcatattccagtgcgcgcgcagatataggaccaagttagccggcaatggccaccttgtgcgcttgcacaaccacaccaaaggaagccgtgccggatctcgttgatggctttcagcacccatttcaaggggtggggggattacaatgagcagataaaaccaggatcgcgctcagcataactttgacaagcgctaggcgcccggctggatggatccaatcagatctccacagcggctatcgttgtgcaatcttgtcggccaaaggctgaaggtcctcgtggtgcggttttctgatggagagagacaaacccaaatacttgcacgataactcctcaactaaatacttgcacgataacgcctcaaccgggcagaggagagagtcaccgaggactgcgacctctttctccgagcagttgatcggaattgcggaacacttgacatagttggtacgaaggttagaggcctctccaaatagagtcaggatccctattactagggtgggcgttcggtctgaccgaaaaattcggtctcggtcttcgatctttctgtcatttcggtctttgaaaactcaggatcgaatttcatccaaataaactcaggaccggcaaattcgatctcggttttttcggtttcagtctcagtctaaccgaattcttggacagcgcaggtgggcagcaagagctggtggcgaggccatggctatggctgtcgcaacggcgccacgccactgctagccaggagcaccacggatggcagcgctcgtcgtggccgcggcggaggctagaggcagcgccgacgtggacggcggcgctccttgtggtcacggcagaggctggaggcggcagtccttgtggccgcggcggaggttggaggcggacggcgatgctcgtcggggacgcggcagaggcgggaggcagcgccgaggcagacggcgacgctcgtcgggactcgggaccatggcggtcggcggaggcgggaggcggcgccgaggcggaaggcggcgtgatggatggggtggggatggatggaggcagcgctggtaggtgagggactgaggtagtggggacttctagggttttgcaatttattgggtttattgggccttctagtcctattgggccacaatttggttttctcggttaaaattcggttaaccgagcccaatgaccgaaatacccaaaataaattcggtcttttgatggctaagaccgaactactaaccgaatttcttggtctcgatcttttcggttcggttcttcggttcggtcttattttgcccacccctacctattatactcggaggacaactctgtgcgtgcgagttggctgactcgatctcgattactgctcacgttcacgatagaaataacagggaaacaatcgaaaggcgttttcgaccgcgcgcgtgaccaaccatgagctgaaatctgaaacgaaacttgatttgtgtttggaaccttgggttctcaacccctctctatcgtattccgcgcgcacactttttaaactgttaaacgatatgttttttgcaaaaaaaaaattctatacgaaagttgcttaaaaaatcatattgatctatttttttaaaaaattagctaatacttaattaatcacgcgctaatagatcggaacatgctattcggaacacaccaatttgcatcgaccggcacggatgcatggtagaattggaccacatcaaacatgcacgcggatcatccacgtgccaagacggaacgtgttcggcgaacaaatcaaattttctgcgaaacgaacaaccattataaccggccggccgttagatatattatttctgcgatttcatttcattcattgtttaacaatagcaaataagttgatctgcgaatttcgcggggccatcatccagttggcacttgaacctgcgcatgttagttttcccttaacaaaccagaaacaacaactgctgatcgttcagagccggccaatcaccccagctataccagctgctgctaatcatagcaaacctaacaatgccccagcctgtgaaaggaactcccagccaagcaatccattccttattccaaggcgaccctgccctgcctaaacaaagcacacatgcaacgcaaaaacagcctaaaagcctccccgatcgcagctatataaacacgacacctctcgctcttcttttcatcccaaattaagcacccccccccccccccaagccctcgctagctttctcgttaattctccgttgccagcatctccagtcgattcatagctagcgatcgaaatggcggccaccctcaagctcaggatcctcgccgcggctgccaccgccgccgtcgtggcgtcgtccttggtcggcgtggccaccgcgaccgaggccccggctcctggcccgtccggagcttccgccggcgccgccgcgacgaacgccgccccggccgtcgccctcggcacgctcgccgccgccgccgttgggtacctcttctgctgagctcgcgagcgcgtcagttcggtctggaccggttgcgctctcgccgcggaggttatatgcattaattgataaatgtttttctttttctcttttttttttcttttgcaattgtgtctgttgttgttggatatatataatgtaagctgatagattgatgtattcgttcagctcgtgtacacagtatttcatgaagtaatatatataattttgttcattgttgatcgatcatcaccttctccactgtcaatttctgattcatgtaaattttaatggggaaataatttgatcacctgagacacattccacgttgcaaatctgaataaattattacgggaatgaatcgatcacctcaaacacaattgaccgttcaattctgattagtggatgcctgaatggtgctctgacttctgcccatgcaccattgcacccgcctggtccgctagttttttttaaaaaaaataaaaaacccttattatagtatgggggaaaaacaatctgtacacggtgcacccaatcgtgcctaccgacagataaaaacagtctgtatcattttttttatcagtatggtgtatggatgcatgatcaatggccttctggttacagtagcagctcgattgtcagaatgaattagcttagaagtaaactaactctagttatactctttttgcgtcttcttgcatagttaattatttacaggaacaaaggaggatttttttcctaaatagatgttcgaagatccaacagtgactcttgtcacatgcacatggctatgatgatcgccaaatcctcttggctggcgtacaaaagcgtcgttcatattcagagctttcgtgaattgaattaaaatccttgttctcggtctctgctttaattttcgaaaggagcggttttcgcttcatttcaccatcaatttttcgaattgctcgtctgctacccggagcgttcattctatcaaaaaatttcaactaactcatcgcatccaaatcagcctccaatttggttctggagttgtttttctggctggcagtttctagtttagcagaactactgccaaccacctccttagacgtgtccacgttattcctccaaattgcgatcgtaaaagaatgcacgacgaagatttgcacttccaaattgcgacccaaaaataatcaatgcatatgtaattaatcaatcacgtttcggtatacacatgagagtacatgagcaattacaaccccaggatcaagaaacaaattgcacccacgcatctcaacaacaaatctcaaagcatacgtgatatgtgtcgacgcatatgctctctctgcatcacaaccagcctaacagaataggtaacctcccaaagccgcggcggcgaccgacacggcggcgaaggctggcgctgcggcggcggtggcggtggcgcccgacgtgggcgccggggcgggcgcatcggccgcggaggccgtgccgaccagcgacgaggcgacgacgaccacggcggccaccgccacggcgacgatcttggacttcagctgccccgccatcggatctcgtacgagctgggttggagaagggagggctgggggagactgcaacaagacacgagttctgctggtttcggtgggtgtgtgtgcgagagattggagatggtgcgctgcttatatacaagctgagctacgcgcggtgcgttgtgttacagctttcaggcggcctggctagctagcttaatataagctgacgatcgagcggccgggcgggctgtcgcgcgcctggaatcgattggttggcttggcggctcggcgccaccagctggttcagttcatcgtggtgggagggagtccgcccggcgcgggatggggtcgttggcgccggcccggggcccgcaattgcgtcgctggagagcggcggaataattgattgcgctcgcggcgcggcgcggcaaggcacatggtgaattggcgttgagatgacaactcctctgccgtgccgcgctgtctactggttacgggggcttgcgtccatggtctacaagcgaattctgatgcagcccaatccgatgatccaggcccattttccgcagggttgggtaggccagatcctcctaatcagaggctcagagcgttcggcccagaaccgtactgaaacagagagaaacaagtacagggaaactattctaatccctcgaggggatgttccctcgtttgctcaaaaatcatttaaatggttatgaaaaattctgaaaaaatttgacaacattcatacaacacatatatacaacttcacaaaatcttaagtccaaactcaactcacacatcgagatataaaaaagacaaatttagcgtatgaatagtagcgtactgtttatatctaaatttgtcttttttttctcgatgtgtagatcgaatttgaacatgaattttggtggactagtaggtatcattatactctacattgttaattttttttaaaatttttcacaactatttatattaaatttaaaagaaaaaggtatacgaggggatgtccctcgagggattagaatccactccccaaataaaggggaaagccaatggagcgttttcctgctcgagcgttcggtacgaacacgatcaattctctgttgcgtgcgcgcgcgcaaagaaagcggcaatggggagaacgctgacagttggttgcgacgtcaatttcgcataaatctcgcgagattcaactcctgttcatcttcttcttcgccactcatccaaagagggacgaaacaatcgcatccaaatcaacagagacgacacggcggaagaggggtgcgctccagggaggaagaagcccatcaccacactcatcaggccggagccccccactgcggcagctgcattctgccgccggccaacccatccgatcaacatgctccaagagagatgccgatgaaacggaaggccgccaaatcaaatgacagcaccaaacactgtcctaaatcctatctacacggtacacccacaatgattctaccacttcatctccgatgggccacgacgacctcgatctccttattagccgcgggtgccattaatgcgggcgctgcttgtttctgcccggttgtcctcactcaccgcgtcggcctcagcgccggcgccggcgccggcgtcgtcatcggggttggcggcggcaggccgtgggactccacgaggatcgaccacagcacgtgcacgtcctcgcacgggcacgacttgacatcgtcgtacaggatgtagatccctctctctgcagccaaacagccattgatacataccgtcagataagtgcaggcagaagcagaatcagaggaaacaacagagcgagatcgaggagtggatgattttgggacgtactctttcgctgcacggcgttcatgtggcaccagagcctcctcagcggggacaggagcgaccggagccaccccatcctcctgacgaacctcctcgcccgtcgtctgcacctcacatttataccgaagcaggagcggaggagccgtgacgagccccgacgacgaccatgtgaacaaccgctgctactgccgctgctgctgcacatcgagaagacgagagagaggcaggttggtggtggaatgtatggtgcgtcgtcgtaaactgcgtatgtgtgaatcagataaaaaggtctagtagcctttttggctttgctttacacttgggtaaagtctcgcacactgctctgctcttcgatcgatagtttctctcttggccgccgcgggcgacgcatctcctctccatctctctcgctgacacgccagactcccttgcggcgggctcaatcatacgcgttacgcgacgcatgagcctcgagcgaccgcggcagcgcgcgctgcggccgatctctttctggtggtaagtcgttgtagcaaatctctcgcgtacggcgacccccctctcgcgccgttgctcgatcgcagaagcaggtgtaaattatgccctcgatcaactgcagttaaaatactactggtagtaacaagtcatggtaaattggtataatcgacagttactactaggcatggtttctgctatatgtgccgttcagctgtggattaaagctccggttcctgcggttaagaaacaattaagaaaccgggagtaaaggacacctggagtcctggacaggccctcgcagaatcgcagtgaacacttgtctcacaagccgctagctccggcctctttagtcaagcgtggaaatgatgcctgtgtagaccagttgcagagagaggcgtggaaaacgcaggcagatgaacgaacgcaaacgcagggtaattcgcacggcatcgatcgatcaacaaccagacaagcgagcgtgcaaccgaaaacgaagaggcgaggcgatgaaagccgatgatgagccgccgacgcttctcaccgtccccggccccgtgaaaaaggaggtctcgcgcgacgcatgagccacgtgagaaaggagttcttcgtgtgggtttgcggccgtacacctgttgtatggtccacctggagccactatgttttttcagtttgttatgcgactaccttgggagatagaggaggaagggagagaagagggaaaagagaggggcgatgagtgttgacgtgatcccattatatatattttttatttttaattagatactcttttttttcttacttttcatgtcatgtcaacgccacattagctcaaatcaccatccaaaccgtcttaggatcttatttgcactggttttaggagttgatagacatgtcatatatggtgttgtggtttagggacgaatttcagatttggggacaatgtgttcgggaggtggtagtttattaatatataattaattaagtattagctaaaaataatttgaaaaatatattaatatgattttttttaaagcaactttagtatatactatatattttttgcaaaaaatgtaccgtttaatagtttgaaaggcgtgcacgtaaaaaatgagagaggtgaaaagaaaataactcagccttaagggacctaaactgaacatattccgtgcgcttacacgtggcctatgaagcggcccaattgtgtggtggcctgggaatggtggctcgacacggaagaagttggagccgtccgatctgatcgacaatcccgattgatctgtacttatataaaagttctgcaacctaaaccctagccttaaatcatttcccctcccctctctctcaaaacgacagcgtaggtggcgcctctccccctccgctgtgatggcgccactccccttctccctcccctaccggcggcgccgctccatctccccctctccctcccgtatcgccggcatggcaccgcgtcggcgagtgctcgacgggggtacagcggcgacgacgaccgtcctctcttcccctctccccgtcggcctcgatggtggggctacggtgcgggccatccttctctctttctctcctctgcctccgagcaggaggagagcacctgaggatggggggttagagggagggggtgccagtgtggttgggaaggcggcgagtgtgaccgtgcccggcgggcgcagccacgacatgagtgcgatggacggctatggcaacgagctcggatcaatcggattcggtgacattaagctcgcccatttatgcgattttttcctctcctttttttcttttttctagggttctcgatgtgtatatctccgattgattgatttttttttcatgtagatttacccgattaaatttttatggagctgcccaattgaatttcataccgatctttgatttgattttatgccttttccatcgancacgatggtaaatagagtgatgacggacgaaaacgcggacanaaagatgtgatgatcggaaaattacgaattttttanttagttaagatagaggaattaagaaaataaatctatccatccatctatctatctattatataataaacagcttgaaaagcaggcaccacgttcgctgtgggggctagaaattcccacgttaatcggagaaaaaagaaaaatctagaccgttagattatactgggactagactttgatggtgtagattaactttgataatagaagtctgaatagaaaacaactgctagatcaaacggacaacactgatcaagtattagaatacaagtccaaataggtggacgtactcctgctttgattctttccttatcctagatggatactaaggatcaatcaacagatcaggtgattaggattcaaacacaatgcgtgcatatatattttagagccggtataattagaattaaaatgtgatttttttacctatggatgaaaaaaagagtaaatagaccagaaaacttatgcattggtagagatacatcactccgtccaactcgctaaggagtgttcaaatttagtacggtcttaaaaactaaactttaactttaaaattttcattgtagcaaaaaaaatcataatcatataaaattaaatttaaatgaatatccaatgatattatttttaacaactaaaatttaatttataataaaatacagctttgaaagaaggcaccacgttcgctgtggaggctagaaattcccacattaatcggagaaaaagaaaaaaacgaaaaggagagtccaagtagaaatacaatctaaaaatagctgaaattcagaattaaaaataagcaatactgaaagaagtttctatataagaacccaatacaaaattaatcaaaattcaaaataaaaataaaataaaatccaaaattagaaagaaaaaaagagacccaagtagaaattttttttaaaatagctgaaattcgaaattaaaaataagtaatattgaaagaagtttccatataagaacccaatacaagattaatcaaaattcaaaataaaactaaaataaaataaaaattagaaaataaaaggatagtccaagtaggaatacaattttaaaatagctgaaaatcggaattaaaataaggaatattaaaaaaagagtccatataagaacccaattacgagattaattaaatttgggaataaaaaaataaaatccgaaattagcaaaaaaaagaagagttcaagtaggaatacaatttaaaattagctgaaatttggaattaaaaataaacaatattaaaataaaaatccatataataacccaatacgagattaattaaaattcagaataaaaaataaaataatattcaaatttagaaaaattaaaagagagttcaagtaggaatacaattttgaaacaactgaaattgaaaataaaaaattaaaataaaaatactaaaagaacacaatacgataataattaaaatttgaaaaaaataaattctgaaattagaaaaagaaaaataagattttaattgaatacaatttataaataactaaaatttgtgataaaaataaagactattgaaagaaagaccatctaaaacacatgacgagataaattaagtaacaggcctataaaggagtagagtggtggcggttgatacgacatataaaaactattaataaaacaccaaatagaatcctaatgacgattaaaaggagggacgataggcaggccatgaagcaaatgagcaatgcgattgccgggactactagaaagtaaaaaaaaaccccattgataatcatattcaatttttaaaatctcaatgacaataaaaaggagaagcagtgggcggggtgtatagtagtatagtttcagagccgctgatgtttgacgtgacttctagaaaataaaaaatgaattccaacgatagttatgctcaatttttagaatcacaatgataataaagaaagagtaggcggcggacgggccataaaggagcatagtggcatcgtttgacgagacttctaaaaaaatataaaaaatgaaacccaacaagacaataaactctaaaaactataaggttcaatttttaaaggttccgaacttcgaaaaagtaaaaaaaaacaatgataatcatgttcgattttaaaatctcaatgaaaataaagaagggacgcagcgagcgagccgtagagaagtacaatggcaaagccgttgacggtttggcgggatttctagaaagtaaaaatgaaccaaaacgataattatgttcgatttttaaaatctcaatgacaataaagaaaagagacagtggacgggccatagaggaatataatggcaacgtttgacgggacgtctagaaattataaaaacgaaacccaacgtgacaataaactctaaaaactataagatccaatttttaaaggtttcaaggagaatgaatagaaatagtggtagatcgagcaagcaaataaagaaggagatgtcataaggggtagcaactggtgtgacttttaaaatatatataattagaaacacggggatgataaggtttaatctttcaaactcttaagacatgagatagctatttaataaattttaagtaaaatcatactaaaaaaatatatgattttatttgggtgctagccgcgcaattgcgcgggccacccagctagtttaaatgatgggaagaaaattacgattagttaataagagaaagtggctgaagataataacttaaataatttgtgattgtttgagaggatgtggtaagtagagaaatagttctattttaggacaagacaccgataaaaaaatagctatatactacctctatttcaaaataattataattatatttctatgtttagattgtgtttgagacttgaacaaagagaagaaaagatcattgctttttgtgttcacgcttcacaaattattaaatggtgtattttttgaaaaaaaaattctatggaaaatttgctttaaaaatcatatttatccttttcaagttaaaaaataatcaatacttaatttattacttcgttcgtttcaggttataagactttctagcattgtccatattcatatagatattaatgaatctagacacacatatatgtctagaatcattaacatatatatgaatgtgggcaatgctagaaagtcttgtaacctaaaacggaggtactatgtactaatagcttatctagttttgcatatcttcttaatcttctttattcctcatttctcaaacatagctgtggagaaatgctatgggaaaaaaatgatgtatagccaaaaatgagagggtggttgaggataaaattgaaaaaaaaataaataagaaatgattgatggaacaattactactttattatgataactttttaaaagataataaccgtttattatgacggaggtagtaaaaaatttaggatgaatgtagcaccgcagtttgcaatcgccaaaaaacgagcgtgatcaaactgtggggctttgcttatgtcagggcgctttgtttatcaactaagcgtgattagggtggacctgtattttgggattctttgaagcgatgcgatgcgatcaggtggtgtagtgtcaactcaaggcccatcacgatatgcaaaatgtgattttattagtataaccagtagctaagctatcaatgtccgttcagagattctagcatgggcttttattaggttacgcttggatgtcagagttgaattgggttggtgtggacatggaggtccaatcagggttgtggaaaaccacgaaattttgaggtttcgatgtggaacggaagtagattttgagtgaaattttaaatagtttttgagaatttaaattgaaacagtaaaagttttgactaaaatttaatgaaagtttgttaaaaaaatgtcataccactagtgccgtgtttagttgttttggcaaaaaaaaatgacgtatacggacacacatttgaagtattaaacatagactaataacaaaacgaattgtagattccgcctgtaaactgcgagacgaatctattaagcctaattaatacatcattagcaaatgtttactgtagcaccacattgtcaaatcatagcataattaggctcaaaagattcgtctcgcaatttcaatgcaaaccgtgcaattggtttttttcgtccacatttaatgctccatgcatgtgtccaaatatttaatgtgatggaaaaattggaagtttgaaggaaactaaacacagcttaggttgggttccggcactcattaaaaagatgaaccctaggtctaattcaataacaattataattggtacaatatttggctcgaattcaaatttaataagatgaaaatattgtttttgatgaaaaaagttactactagatcgctagcaaattccaacaatattacttaccaaattttgctgtactctatctctaaggaaaagaataacttataagggcgaatctagacaattgttcatattcgcacatagaagttgtttctttaattgtacaagtatatgatttcacatatatgatttccgggagtttctccacatctattaacatcttccacaagctaatgttccaaactcatcgcgttgtgcctttttcccttttctccatatgtatatcatgaattgacaattattttctggaagcataataattaagaaatcatttatctcctgattagaagatcaaaaatcatcgtcgtaccagggcccccgcatgtccatctaaaaggcccccacatgttaatactggaagagacagttcccattcattgcatacttggaaaaaacacaagcaacaggccaacaaactccagcacatgtgctcatcaatactagatcgatgagctacagcttcttttcttaatttcttctccagtcatcaatagttcggcactccaactgatcctttattgctcttttaaatccatcgtcccgttctcaaaatgacgaatttataatcaaacccaatcccttactcaactatagcaagtgcacacagaaaagcacagaatggtgcgaagtgaaaaattccaagacaaaataaattcgtacaaagcatagcatacaatcgatcctttccttcatgatagacatatactccagctttgcatcaagagctgaaaacaaccgccaaaacgctcgatattctcagctacgttggacatttgctaactgcctttttgtcccctcttgtcacattacatgacattggaatataaaatctccagatctctgcagggccacacactagtactgtcgctagccatggccctggtagtattaactaccactacgtacgcatgttcttgtggacatggattggagtgacctgagaggctggtgagcccttacaaaaatggtgaagcaccctaatcttccatgggagatcgagatcggtacagcatcttccttccttttatattccgcagggtatcaaattggagtattttttctctactcgtgtagcgatgaggagtgtagagtatctattggagcgccttgcaagcaacgccaaacgactactcctacacccaagacccaacttcccactcaactgtactgtactccactcgccgcacacactgacacagcgggcccacctgcagttagttctccggatcgcttcttccacctcgcgcgcacttcacctgcgctgcgcacacacgctccagtactccgccacgcgcacggctcttatcccgagctcgtgtcactggtggggtggggcccaccatgacaggcgaggcgtgggtcccgcaagcagggtcagcgcgcgagtccgagtaatattcccccacaacctctgccacaacggaaaacaacggcctcgctttgctcctccaaaatcgaagagaaaatttccaacaccccaccctcccccatcgcctcctcctcccgtctcggccggggcggacataaatacgagccgctcgacggggaaccgccgcgccgcgtccaccacccaccacaagctcgccgccggcgtcgcggacggcggctcatcccggtccggcgtgcgatccggctgactggccggagacctaggagcttcgaccccccccccccccccgcgatctgggcggcccatggtggggtcggtaccgcagggcggcagccgcggcagcgagatctagggttttcggcgcctcgggggtggggagggagcgatggggcgtcggaaggtcgccgcggcggcggctgcgacgccgccgcgtggctcgtcgaaggccgggggcggcgtcatatccggtgagatcctcgccttcgccttcggtttcgatgcgtgcggtggcggtagtgtcaaggcattgcgggcttttttagatcggagcttgctgctactgggatgctctgtgaggttgggatcggaactatacgatgggagtgcgatttcgaatggcgctttagttttgtgggatttggaatacctataaatccgaagcatgagacgcagtgtatttgatcggattcagtggtggatcagctagctgactgtgacgtagcgtgtatatgttgcgtcatggttttgttctctcagtgtttaatgcgtgcaaagtctcagctttccccgcaaaaatatggctcccatcggatggcctaatcagccaaagaaaaagccaaaatttaaattttcaagcttaattttgagattgattttgagatattttcaacgtagtttcttttacaacattggctttaagtcacgaataacacatttataaaagttttacctataaattcatttttattttctaataagccgttttggcttattaggaaataagccaaacgatggggacctataccgtctcagctttaagctatacgcctagctggttgtgcacgtgtactatgtaattgagaggtgttatttctgtgttttatatgctatatcatgttgcatgcacatcaccaagaaatgcatgctgtctatggaaagttagtatattctgaactgatattggtttcctttggaatgtgctacaccaagtctgtatttgaggcaatacattaaattaggatatatataagagaatacttgaggtcattgttgtggccaatgtattgacaactgttcattcttcaatgtaatggtgcttactgatacagcgaatcgatgaatagctattcattaatctactggttgaactgcaaagtatatatgttacaactcaaatcagaggaaagctaatcaaatctccaattttgtttggttgcatgtatatacttttaccatttagagtcttgtaaaattgccgcactgcgtgcgccagttcctgaatcttctcccatcctggagcaatgaacttggcagtttaacattggactggttcacttgctgatggcagttccaatctcccttgataactagggatcctagtagggttcttgtgttactactttgatttttatttagctgatgagcaatggctggcaagacagtaaaaatcctctctagttaaggaccccaacatctgtgctttgtatgatctctttggttcaggacttagtcatttgaatattatctacattatacatgttgatgtagttaggtttgcctattatcagagctgtagactaaggtgctatattggaccagtcgatgtttggcgttccattttcaatccttaccttttttttttcgttttgcagaaatccgtgagaaacacaaattggaactggagaatttgacactaacaaagcatccattcaggacattacgttttttcatgttagctatgttgcaatacttgaaaagattagcaacatatatcctgagtaagggtgctttgtttgttgtcctcattgtgttggtgctagctcctggaattttacttgcggttacagatggtctgcataaaaaggtgtgttacttcactgtaatttgattacgatcgcagtgcttgtgctgataagagtagacatgacaataagggcactgatttattatgttagcttcttgtggtgtgcttgaatactgattttgttttctgatgcagcatgtgcaggagttcctgaattatgctagatttgtgttgtggtgggtttcactaggcgtggcttcgtcaattggactaggcaagtgttactagcatctgtcaaatttatgacataccattatatatatggaagtaaataatgtgccactgtactttattttatatcctttctagttctataatatttttagctgatgtttcttatacactgttgaaagtgactaaagcacatgctaaccatgatttagttaggaagagatgaacataagaaaaaaaacaatgattgttttcattttattagttattacttacctagaaactctatcatatcaggaaaattttaacaacaaaatcacattaaatttatgtactatgacttcattgaacctttaaaaaatcttctaaaaactcgtattgggctagaagagcaaaaggcacaccatcgccaaattacacactaaagttactttgagatttaatgcattgggataaagtttcgcaattacagggctactgctgcaattagccttttactttccaatctagagaaaggtatctcagcgttcttttgagcagaatttgtggatattcagaattccagataattctgtagtatcattttgaccagctactggaaatttctttggttaacttttaggggcttagaggtgtaaaagcatataccaccagcaaatattaagtgatgcttttttagtttttattggcttgaggcttgttgcaatggatgctcttctggtttaatgactttcaaatttggaaattttgaacttcggatgaaaatgagctcatccttttttttactaactaagattaatatctttgaaattcaggttcaggtttgcatacatttgttctgtatctgggccctcatattgccctcttcactattaaggctgttcaatgtggtcggattgatttgaaaactgctccatacgataccatacagcttaagcaagggccatcatggctggacaagaagtgttcagattttggaccaccagtgtaccaagcatcggctcattctgtccggatcccagtctttgaattactccctcaggttcagctggaagctgttctttggggcattggcacagcgcttggggagctccctccttattttatatcacgagctggtaatatggcataacgcttatttcttaagtaaagaagcttagctatatgctttacactttctcacgtctcagtactggtgaacctatgtaattgtacacatgatttactctgctttctattatttttttttatgaattgactttccttgcacactatataactgcatctcatcaattttagtaccacacaactaaaatatatggtccaccattactgtatatagttcttcaacttcaataatgctccctccatttctgtttgtcatctttgaccaccttttgtgtttgagaacaattgtcaccacatttttaaagttcaggttgcctactttgtccttttgtgggcttaataatgaatttaaccatacaattttattaactttgtatcttgacatcttatgaatcccttgattttgcttgttattttttagccataaattagggctgtggtggaaacttcggttagtgttgtgataaattctagaagatcgattgtgttggcccatgcattaatttctgaatttggttcctgtctcttttgtcatattcaaccacaccaagtaaatgatgtgtcgtgttgcagctcgtttgtcaggaagtgaaccagaagctgtgaaggagctggatgctgctgcttcggatgaacatggtccaatagcatccactctcaatcgaacaaaacgctggctcctttcccactctcagcatctcaacttcattactatcttgattcttgcttcggttagtctatgtccttttcccatcttgtcatgccaatttatttgtagcagtaaggattttcttgcaaaaactacatataaggattctctagcaaacatgcaagctactattcatttgggcctctttctcgagtcatgcctactgctctgaacatagatagctcatgcatctttaaaagagggagctggagttgatggtaggttctacacccatccaactccggatcttctgtaactgcaaatatgtgtaggcgtgtgtcatgtgtgtttgcatctttgctcatataattatgtatattgtatacaagttttagagaggataattattttttatgcattttatatttttagacttatagtatattagttatgatctgctgcaatgcatgcatgatgctaatggtgctaaaaaaagttgaagcggacattctccgtatcaatgccatagctaacagatggtggtgatatggagaatcttggttcttttgtactaacatctgatggataaataatttaccatacaatgaattttctttgtgcttactaggttccaaacccactgtttgaccttgctggtataatgtgtgggcaatttggcattcccttctgggagttcttctttgctactttgattgggaaggccatcatcaagacccatattcaggtttgctgtctgtctaatcttctgttaatgcttatatttatatgtttcgtaactttggggccctttttttttcgccggggggttgggggggggggtgcgcttttcatcaatgtgaatgatcttaacagggcaaatcgttcttagttgcattatgtgtcagcatgttttcctgagtcctattcagttgaaatcataatttcaaaactatctcaaccttgcccattcagaaaataaaccaaaattttgcaagccctatcaaacaaaaggccagaccatgcattagtcaaattctagaaattctgttgtttatctgtttcataacttcctttttctcccttagccgcataaatagttcctgcttctagtcaggatatataattttgccatacaaagtatgttaaaagccagtgctatttttctcgttgcactcttttcattcctgccgccacagtaaacttttgcagggagtctacagtatttgaacttccaagcctgattgaactgaattaattactactgtattccacttgaattgtcttgtcgatgatcccaaaagttgctgctgacacatgcattttgccttctctcttttgcagacattatttattatctccttgtgcaacaatcaactcttgtatcttatggaaaaggaattaatctggatatttggtcacattcctgggttttctgcctccttgccatctgtgattgcaaagctccacagtgcgaaggataagtatttatcaacaccaacatcggccacatcatcctcaaaaatggaggttggtattttactgtcatcagttcaaaacattggtcccgtggattgagtttcaaatattaatttcttctctatgtatcccatttcttggctcatttttttgtccacttatgttatatatccaggatacacagtggaatttctcttttacattggtctggaacactgtggtgtggcttgtgcttgtgaacttcttcattaagatcgtcacatcaacagctcaagaatatctcaaaaaacagcaggatatagagatggagcttattactgattcctcgccccagagtcagtctaaaactaactaaatattgcaacttgtggtgtttattcagctgcaagttgcaaatattctcctcatgagattatactcctggccaaagcccttgcagatgatatcaagtaccggtactaagttggtatttgtagttattcatctgttcagtgagcaaatatacgggcttcattaacttgcccaagtgatggctgcaaccttttgccattgagccctggattggctgttcctcgaggagaacaagttaggctgctattctttagacgtcaacacggatgaaccttttaggaattgtttatgaagaacggttgcattagtgaggtgtatcactggtgcctttttctttctgttttggaaatactttagaaagcttgagaggattcgacagctatactttcattgttcaattcactgtaaaatgcagatttgcaactggtgccggctagaatataatggaatagtagactatttcggctacgcatactctgcgaatgaaacttttgagttttgatacagtgttggacctgtgtttagcgcgttgcaacataatccttcacgttataacatttgcgttagctatatatgttcatttattacattatgatcagcctctgatatgtgagaaaagcacacaccttcagttacagtgcgattacacctcagcaatgcggacatatttttagaggagcaatgcgaacataggcgcgtgcaagtatgcaactacggcctttgtcgacgtcaaaaggtaaaaataacaatagaaatgacctttgtgttgcctatcacactagtacttccgattgttcttcgaaggaggtgggatcaaacataagtttgtgtttagtttctgaaattggaccttatgtttagtttttgaaattgggagaagtttggggaaaattggtagtttgaaaaaaaagttaagagtttatgtgtgattgttcttcgaaggaggtgggattaaacataaggttgtgtttagtttgtgaaattgggagatgtttggggaaagttgaaaaaaagttgagagtttatgtgtgtagaaaaattttggatgtgatgtgatggaaagttgggagttgggggaagtttagtgtgaactaaacatggcctaagtattgcattgcaaacataaatgtttatactaatttttttaaagaaagggtattttttacctggcctctacatccaaccggatatatatggccattgaaatagggaattgaaatagggaacttagccccacaaacaacccaatctgaaatttgttccataggagatttgaactcaggactttgggtactacttaagtcactataaccactagactacgtggactttcataaaaaaatgtttactaataagagtatatatatataatgctaggaggcaagtcattggatatagtagtagctgtgacgtgtctacaactttctcataatgcacttcatccgaaattgctgaaaggcgaacggtagcaattgctcattgacaaaacttcgcctataagtctacgctattcggtaagctagcagttttctttagaaaaatgaaaaggagtgaacgtcgatgccatacatattttctcatttagctaacacaccgtgctaattacgatgtgaactttgtgatttgtgaaccacggaagaagcagggtcatcgtgtaaaacttcacctccacgtcgtgctcgcttggaagcactcgcatatgacgctcgagactcgagtgtcgactcgacacggctctccacccaatcacaaagtctatctgcattctggcaataaacgatcttcttcgcacgttcgcccgcttagaaaatctcttcgctcggagagagccgatcagccgagacgaccgcgtcacgtcaagcgtgaatttccccgaaggccacgtcaaaacgcacgcagctacacagaacggacggtgtgggtgctgcatttgggagaaacgaaggctctaagtgcagtcccaaccttccacctaggatagtgtctatggcattaactacattgctacgtagaacttttagcttatatggcattatattaattaagagagagagtgaagagaggaagaaactgggtctcatgcaagacacagcttcaacaagagaacctatgcattatacactatcaagttttgtattgggagagaataatgtctttataatagatgaagaataaatatgataggtagagaagagagatgatgtatttattaatggtccactttaaaaaaccatagattgtagagtgtagtttatattgtgatgtcttactgacatagaattataggcattacttatagacactatgggttgggactgtcctggtgcgcgattactaacgtggaatccgcactgggagcaagaccgctaaagccacgtcacgtcaccctctccgtcgtccaggcgcgggcgcgtcattcggcggtcgaaaagcacaagcccgatggtgacacgaacgagttcatcgtccttttaattcgtcgtccaaaccaaacccgcgcaagccaatccaccccggcctagtctgcactgctagtgtactactccgtcaatatttatttaatagattagatgagataagaggagcaaaagaccccacttgcttagcctccaatctaaccccggagaactactggagtatcgcgcggagagcggaagagagagcagaggctgtggaggcggagagcggagagcgagcggacatggcggcggcggcggcaccggcgccggcggagagcaatgtggagttcatccgcgcgcggagcgacaagcgggagtaccgccgggtggtgctccccaacgcgctcgagtgcctcctcatcagcgactccgaaaccgacaaggtctctccctccccgatcgctctcgcttgcagaatgctcgtcggttcatcggcgatttctcgcgtgatttggtggtgtggtgcgtatgcgtgtgtgcgtgtgtttaactaacccctaattcctcggcgttgcaggcggcggcgtgtatggaggttggcgtgggctcgttcagcgacccggaggggctcgagggcctcgcccacttcctcggtcagtccaccgttcgcttccgctccctccctcccttctcgtccctcgtctccgctcacttcgcttcgattttctcgattcgtttcgtgtgcgcaatccgccaccggattcgtgtagtggggaatcagagtaggcagtatgggggggggtacttgcgtgttcggttcgacaggacacctggcgcttccctttctctgcgattcgcttgcgccgcatggtggatgaatccccttttgggatccggccggggtctcgaattgtctcccatggaatcgggatgctcattcctcggcgacctttccccactgctacttttgtgggtcaatgacgttatcataggtataaacgtcgatgtacaatnctttttctgcgaacgagatgcanacttgttttggccgtcggatcatgcagctgacggttcagatcattgatggtctgatgaaggaactgtcatctctgttcttcagcgtgatccattgagggcatccgtgattgatcgtacgggacgcacatgatcggcctatgctgtggcttctgatgtacgagcagacgcccttttattaacaggatgtacgagcagacgcccttctatattgcctttttatttcgtttagtcggcacaatgttattcacggatggtcagctggccagactgtaggaaatagagcgggtcattcttcaaataatttatcttgctctgctcctgcacgttgttgcctagtaggatttttgtcagcttgctcacaaaaatgtccctttacctttgtctatatatgtacagaaccaacgcattgattttgactggtgagtaaattccaccttttagtgataaaggatcagtcagctacactcgcaggggtgcaccaattcattggctcactggttatcgtaagtcctgcgctacacctagtcacctacacatggggtactgtaccaattcattgcaagtacttgggggggggggtactttctgcacattcgtgacagtaccaaccctatgtatgtgaaggtagcggtgtaagtggctaacccgcgaaacccacttataggctaaaataagcgcgaacccgcttattttgatctataagtgggttcgcggctgacccacttacacccctatgtgaaggtatactgcagatgaaaccatgtaaagttaaattgaaattctaccctagagagttgcatagttttctaaatattttgtttatcatctaaaggcaaaatgtttgatgaaagcaaactgtactggaatggactatggagaaaatgattagcatgacaaatgttagcccggaccctggactttaaaattcagtaatcattcaggcatcctttggaacacatagattttttttttgggaatacgcgaggggcacatctttgtattaagaaggaataaaagtattctttggaacacatagatttcacagtaattatatagtattctcacacaattcagttcagttcctgcaggaattaagaaaattcctggattgacttaaagtcttttatctgttttcttgtcttgatttattgtcgtggtcttgtttgcagagcatatgctattttatgccagtgagaaataccctggggaacaagattacacgaagtatatcacagaggtactttcaattaatcaactctaaatataaagaaacactggtcttcatttcatttcattgtattttggggtaaagtattattcacacaatatcatgatatgctgacacaaccacatcagatttgtatgagatcagcccagtttcagggttacctacatcatatttagatgtcagatcagtagaaatgtagcaaacaacgagacaatataagagatgacgagaaagggaaactggtttgtatgtgtgcaaactgcagaccaactgctatttaatatttggttgttcccctaaagtcaggttatatcccatcgtgctctgttgaagtgaaatcccatgcttgccagcgtggcattatgtcgtggtgacgtttaagaggaggggcagtgtcctgattagcaataacattttaatcctcatcttgtcatctgtcgcaagttgtttaagagctacaccttgcacaatttctcgaacatcaaaaaatattttaatgcttggaaatcacatacctagactatatttttgacaattgtttgatgtgaaaaatatcagcatggtggctcttgcaatgcctacacaagttcggagacaacaaatttctattttgatgtcaatgtggccaattttgaagaagcattagacaggtaagatttttttggtagtgcttttagttcatttattgtatatgtgtgtgcgtgtgtgtctgtgttgaatatggtgggggtttgttctgaagattgtcatgctttttattggaaaataacaaattggtggctcggttgtgcagatttgctcagttttttattaagccattgatgtcgcaagatgctgttcttagagagattaaggctgttgattctggtaagttctgattattcgctttgcacatggtgattggtgatgctatttgtatctaacatcgtattatgcttcttataatgtgggtagttaacatgacataactacaaccctataaaaatcgcttcaaaactcacagttgtttaatttggagtagcaataagcatatattttggctaactttgctttgtttcgtcctagaacacaagaaaaacttgttgtctgatggctggagaatgtatcaggtactgcaacatttcaaatttggtagttgatgtgtcatgtattcttccttgcaacactgtgaaatctgtatgactgtatcagaagctacaaccattaaagcataggattatgtatccttttcactcacagaatatgtatatattctttatttacaaggcatgtttccttatataaatatatatataaacaattggtgagactatacacacgttaatggtcctccaataaaaaaagaaagtaaaaaatagcatgtacagtactttccattcctttgctttgaatctcatagcacatgcttcactattacctaattttccacttttccccatgcagctccaaaaacatctggcttcaaaggatcacccctatcataaattcagtactggtatgcaaacagttgtgttcagaaattgtgaacttctgaccagtcagcctttatgattaatgggttgcatttcttgtgagaaacatagtgaagattcaaacaggctaaaatctagccattatattagctttgcaaatcccaattttcttcaggtcacattgaaatatgatacatttattcatgaaaatagagatgacaagtctaaaatctaaattcatatcagataatggtcagttgtcctatcaattgctgtgcatcgtaattagctactctcttatggtgatcatatcttgtttgcatgaaatactatttgaatttaggaaacaagttaaatgttttgttgctttcttattcctaatttgtcatttaattcatcagggagttgggaaacgctagaaacaaaaccaaaagagaggggattggacattagacaggagcttctgaagttctatgagaattattcagcaaacctgatgcaccttgttgtttatggaaagggtaaatattactggttagtccattctcacacaaacttatctgttactgaggtttttttttttttttgggtagagagcctggattgcatccaaagctttgttgagcgcttgtttagtgacataaaaaacactgatcagagaagcttcaaatgcccaagtcaacctctttcagagcagcatatgcaggtagaaacttgaagcaacaccaattgtggtagatggagaagttggaatacttgcaacaatcactaaaaataaaatatatgcgatggttcgggaaaaaaaattgatggtaaataacatgaaatttgccgtgcagcttgttatcaaagcaatcccgatatctgaaggcgattacctaaaaatatcatggcccgttacacccaacatccacttttacaaagaaggtccttcccgttatctgagtcacttaattgggcatgaaggcgagggatccatcttccatattataaaggaactaggcaagtacattcaccagttgattgctgtaccacacttttgccttccttatctactcatagtcactctagtttattctttctacatgtgacatatgctcaattttgactactttaggatgggctatgaatttgtcggccggggagggcagtgacagtgctcaatactcctttttttcaattagcatgaggctcaccgatgctggtcatggtcagcttctatctttaattagaactaacatggctattttgttttaagcacatgttgttattatttaagcctcttgcgtgcacatgcaatgatttcagaacacatggaagacatcattggcttggttttcaaatatattcttctactaaaagaaaatgggatccatgagtggatctttgatgaggtaattgaaaagaacatggacttacgcaatgtgtaaatccatgttttatggttagaagttctgatacttgtatgacattctgatattttccttgagagatccaaaattacccaaacaagagttattccacataattgagtttcttatctttgcatatctttgataggaaaagttttctttagcaacgtcagttgacttttttggggaatattttactggttttaatcattcagtgaattctataacgaatataaattttggttaacaaatggtatattttccatttgaattggacctgttagttttgaaaacttatgagggttcaggacagatgtccttctaattctggacaatagactctatcaattaatgatacactacaaccatttgtatacgagtcacgctccaaaaaaaaagaaacatttgcatgagtcgtactttcttttagcaagacctcattatgtttcaatttatcatctcatcatcaacttcacttatttatagtatcaatctttttctgcatgccttaagcatattgggatgatttaaatagataaactaaatgtgatggtaacatgtttttggatgtgttagcttgtggcgataaatgaaacggaattccactatcaggacaaagtccatccaatcagctatgtgacagatactgtctcaaccatgcgggtatacttctcaatacctcattaagtacataatgtatcgtttgctattccatatgatcaattctattcattactgatacacctccagcaaagcattatgtgataacaccgattaccaactattctatcgtctaaattttctctgttggactgacatatgttggagaaatgcacctttcatctgtagtccattagctatcttcaatatgaaagatcttttggactgcttgcagttattcccaccagaagaatggctggttggagcatcactaccgtccaagtatgctccaaatagaataaatatgatacttgatgagttgtcagctgaaagagtaaggtacatttatgcagttcacatggcagcattgtttgttcctcctatctatttacagtatctactatttaggtatctcaacacacaaacatttctgaattcgttcttttctgaagtaaaaagtggtaataggtttaagaattatgcatcattatttgccatccctactggtttcaacttcttccagatatgcgaccttagaaagttatccctactggtttcaacttctaccagatatgcgaccttagaaagttatgcccaaaattagtcattatatttacttgcccacttattttctgacaagctgacagatatccagtttggcacttaaaaataccatatgaagctaaatattgtgactttcctcttccttttatgtaatatttctctctctccgtctccaggatactgtgggaatctaaaaagttcaaaggatctactgattctgttgagccatggtatagtacagcgtattctgttgaaaatgttactccttccatgatacaggtttgtcctttttgaataatcttgattttttgaactagagttttcctcttatcttattgcacattacatactgttagaatgtggacacttgttataatccatagagataatatgctagaacatattgtcagtgattgttctactttggcagcaatggattcaaaaagctcctactgagaagctctgtatcccaaagcctaacattttcattccaaaagatttatcgctcaaagaagcgcatgaaaaggttggattcagatcacctcatctgtgttttttccccacattagcacagttctaaatgaattgctgaatcttgaatatagtaaatatctcttacaaaataaatgtttgcaggttaaatatccagcaatattgagaaagacaccactttcacggttgtggtataagcctgacatgctgttctccactccaaaggttcacattataattgatttccactgtccgttaacaagccattcccccgaggcagtcatttctacgagtctctttgttgatttgttagctgattacttgaatgcatatggtaagcaccacttcacaaatagtgtaaatattagcatatttatccgtacattaataacccatttgggtattactactcccaccaactgtaagttcaaacataaatttacaaaatgtttgtgccttttgcagcgtatgatgctcaaattgctggtttattctattcaatatatcgcacttctgctggattccaggtttagtcagtgaactactttattgttctcatttagtttccaaggagtgttccagccaaaaaaaaaattcattgtaaaattgttatgctgtctgatagaattgtcatgcatcatgaggttgctttattaggacagtttgaattagaactaaaaacatttttactttctatgtaaggtctcagtaggtggttacaatgacaaaatgcggattctgctagatgccattatgaagcatatatctaactttgaagttaaaccgaacaggttttgtgccttgaaggtaagtagatttagttattttggagtttaggtttcaatatttaattgttctctttgttttaactttgtgtgcatcaatttttttttcgatcactggattttactttcattaggcaactgttatctatcaacttgtaattgttagacaatcaaagcttagttgtgtcaaacttttcaacttatggacatgatattgtgggaaccaagaacacacaggatgattatatgatactctgagtacataattaagatttatttgttcttgtttgttgcttggtgtttaccgtgttacggatttgatgtgaaaacaaggcagccttacatcacatgtataacttgccgtgcagaagatttgggtacaaatctattcttaaaaaacgcagcaatctagacaaacgggtgaaagcaaacatcacaaataacagttcttactccatatcctaatttagtaatcttattaatgttttcagttctgcatgctgtattgttttgtacctgccagaaaattatccaagatagtcagataacttgtacttgtttgtaatgagctctgttctcggtctgttgataaatataggataacaggctctgccatggaccaattaggatcttttgaatacaatgtcattttgtttcattgatttatttcatcctaccaccacaggaaactgctgtcaaggactaccaaaatttcaagttcagccaaccatactctcaagcttcatactatctctcgttgatattggaggatcagaaatggcctttggctgagaaacttgaggctctttctaagcttgaaccagattctcttgcaaagttcatgccacatttgctatcgaagacatttttggaatgctatattcatggttaggcagaagttcttgttagtcgattcatcatgtagatatatttgcaatggactgtaacaggatgaatttccagtcatacttattgattaacttttctccttgtagggaacattgaaccaaatgaggcaacatctattgtccaggagattgaagatactatattcaatacccctaattctgtgttcaaatcaatgtctccatcacaatatctgattaaaagggttatcatgcttgaaaatgagttaaaatgctaccaccaaattgagggcttaaatcagaagaatgaaaattcatcagtggtccaatatattcaggtaaatgtccctgtggcttgatctttagtgcaagggatgcaatgcaactactattaacgaaagcaactactgatccatgatcagtaacttcagaactaatggtgaccaaattgattacaaattgttgaacttgttcctaaaattcagtagacttgagagttacctacttctaattgctaaaaatattattacatgtcgtacttgcatgcaaagtaatatgaagtactcaaattcaaccataaaactaattcaaagtacaattacttgatcaaaacaatctgttagtgtgaaattcctgaacaatttcgcctagaatgaaaaagaattcgtcaataactgtagcttatacgagcaacaatgggggcatctcttgtctagtcaaaaggtatctgtttcacagatgtactgcccatagtcatataatttgtttattccacttcagatccaagtcaattaaattaaattccttttgctggaactaatgtttgtgattttatatggaatgtgcgtggtgacacttggttttgctcctgtcatttgtgctactcctttttactatatgcccctgaaagaaatgggagggtcagactcatggatataatcatcgctctactcaatgaatcatcgtctcctatttgctctttaactattcttgaaaaacataccctgcaacaaaatcattgcca

SEQ ID NO: 45747 - DNA, 1651 bp, Oryza sativa
agtttgaaaagtaaaaaatgttgatgttatgtagaaaaaagcatgtgaggatgctaagcatgtttatattcaggttcatctggacgatgccctttcaaatatcaaacttcaactgtttgctttaattgcgagccagcctgccttcaaccagctgcgaactgttgagcagcttggctatatagcaggtctttctttaaggtgagcggcagaggtttgccttagacttgttgcttcttactttgccatattaggagatacataaatatttcctatgaggttgaccatttaaatcctagcttacaatgaatatcctcgttcatcagatctgattgtggagtctgggcactcgaggttgttattcagtccacagtaaaggtacaggttcaaggctagagtaattgatagtagtatgattgttgtttactgctttctctaactgatcttatgttgaatgcctaggatccttcacatcttgatgctaggattgatgaattcttcaagatgtttgaaagcaaaattcatgaattgtcagacaaggattttaaggtttgtagcctcgttgaatcgagttttcaagatttccaaactttcatgaaacttcctttcttttatcttccttaagtgctcacatgttcttttaaacattcatttctgtgcggtaaacttccacatgcacaattgtatacaatatctggaggggttgtaatcgataaaagagcagtgatatagtatgctctatagtattttgatcactagatgtactcagttggagcacattactactaggtggttctttacacatcaatgcggctggggtattgacatatggcattctttttgtagaggaatgtaaaatcacttgtcgattcgaaactggagaaattcaaaaatttgtgggaggaatcccacttctattggggagagattgaggcaggaactctcaagtttgacagggtcgagtctgaggttagtgctctgttttcagcaaacagttaattgttggaaaaaatgtatcgaattaatgaaaacaagttattggttaacaaaaaaaaaatcaagaacagattaaacttggtaaaatttatttacaggaagcatatgatagagttgtgcatttaactgttctgcaggtagctcttctaagagagctgaagaaagaagaattcatcgaattttttgatcagcatataagacttggtgcccctcaaaggaaaactgtaagcgtgcaagtcttcggcggcgaacatttggcagagttcaagaaggccattgctgaagctgatacacccaaaacttaccgaatcactgacatattcggcttcaagcgatccagacctttgtaccgctcactgaagggagggccaggccggatcacaatggactgacagctagaattagttacactctcttatagtattattctttctcgcggtgatatatagcttgtgtatatgcatgaactgaattttgacggcattttaatggccggagtatacacgattgctattcttatggtatgattcaccaatgcacgtacttccgaatgaaatataacaactgtacagactactagagagtaatgcacaaacttgtataattgtctttccttttgagttctaacaactatacactctgtacaaacacacgagca

SEQ ID NO: 45748 - DNA, 1139 bp, Oryza sativa
gattgcttcgtttggtcgcgtctccgtatagaaatggcaattttcggttcactcggtgtatgatgcgattgtgaactctagtgtgacggtccgcaagaggatctcttatataggaggttgaaggtgccactgaaaatcatagtatttatctagttgtttcatatcaaaataattctaacaaaggataaccttgcgaaaaagagttgcgaggtgataagcaatgttgttttttagtgtgcaagagacaaccaacccatattctttgaatataacatagcacgtttttctcggggatgtgtattctttgctttcaatattactagttgtggagattatggataccccatatcaacataacagttataatttagtcggatatacggtaccaaatatagatagaatatctttatgaggactcgggttagtttctaacttgtatgtcaaggaaatacccgagatcttagtcggttacgattgtattttatttgtaatcgcatattccgttagggatatggactgtattttgtaatacggatcccttcccctatataaggaggggtctgggttcctctcgggatgattctctttttcccaaatcatacgatcaataacatactcggcggaatcatccccggacaggagtagggtattacttcttgaataagaaggcctggacctgtataaaattccttgtctccaaacccatccacttttctagcttgatagccaccccttttagtattgccgaaatcttgtttcgacactacttctcggagcgccaaaaatatatttggaaattggtttatgggagtgcccagcttaaacaaaatggttttatttgggggccagtagtctatgatcaatttggtattactgaaatgataatattttttataataaaggattggctaatctatacatattatcttcacatctaccagctagctccacatttgatctttgacgctatcataggagaagcagaatattatgcgcactagtgctactcttatatataattgataactagagtttttttttcatttttgatggcatagcccctataaaattacttgcaagaatatatactggaaaacacattttcacatacaacaaaaatgccttttctcatgcgggtt

SEQ ID NO: 45749 - DNA, 716 bp, Oryza sativa
catatatttggatgctttcttgctgaatagggcggtaggttcaggggggcacagctctttctgttgtgtgttgtgatctttgtggttgcttcagtgtgtgttctgaaaactgcacaacttcacctttttatgcattgagatatacacaccagcatcagagcatcttgcaactgattaatttgcacttgttattatgatctatctattgattcttctcagagttcgagtacatgtgtttcagcaactgaaaagctagctagctcctttctaagcctgcattttgcatctgtttttttattctttttttattttttttgcagggtagtaccatcagcttgctgatctcagtcaaggacaagaacataacaagaacaaagtgaagctcaagatgatggtgcagatggagaagcttgtgaggcagtgcgacatggaggtcatgaagatggccatgctcaagcatgaagagactttcaagcagcaggttagatatatatcgatcaaacgcaaaccaaagatcacaatcatcatcactgcaaagaacaaaaagaaaaaactctaaaattctaccaaacaaaaccaacaaaattcttttcgtctcgatgcctctgaaggtgtatgagctgcaccggctgtaccgcgtccagaagcagctgatgagcgacctcaacaggtcgccgccggagctaacctgccggcggcggcagcggcgcaagcag

SEQ ID NO: 45750 - DNA, 748 bp, Oryza sativa
tgggtttccgtgtccaactttgactgtccgttttatatgaaatttttttataattcgtattttcattgttgttagatgataaaacatgattaatattttatgcgtgacttgtctttttaatttttttcataattttttcaaataagacagacggtcaaacattggacacaaaaaccagggtttgtctttttttggacggagggagtacagagtactcccaggttgtccattactgcccccagacgtagcttcgatggtttcgacccggtcaaatcatgattggacccacccactaacctgctacaactgtcatcctttcttgaaactatgttagctgctacgaagtactccctccgaaaaaaaaatcaatctaggagaggatgtgatccctcctaggacaacgaatctagactaccctttatccagattcattgtcctagtgttgacgcggaaaacatgcactggtctgagagatctgcttaactttaatgcacgtccaaaagaattgccttcggattctgagcgtgccagctggtttgatcctgcaaccaacaagatagaaaaaaggacaaagagttaaatccatcaacgatagctgatcggtaggattgccgatgacgtattgtatgagggcatgccgacgtaacttgcgttagatcggcagaggcaaataaaaacttggagattgttcggtatacttgatcgggtgtagatgttagcgatgcgtaatccatcaaatgggacatat
